United States Patent 10,113,201 (METHODS AND COMPOSITIONS FOR DIAGNOSIS OF GLIOBLASTOMA OR A SUBTYPE THEREOF) - sequence listing, part 9

SEQ ID NO: 114 - DNA, 606387 bp, Homo sapiens
ttttgctctctgggattggtttcttaaagaatctggatcctttttaatatgtcaaaatgagtctgctgatgtttacacaactactgctctgtggatttttatatgttcgggttgatggtaagttaaaaatgctttcatctttttttgcgccccccaccccccaatcccccaaaaccatttctttttgaatttgatgtgggttataaatgaaatgacattatgtctgttagtccgttttggcccggcacgggctccttgggggcagaggttttatttaagtcttttgtttctaaactgctgtaagtggaatgtgttggtagtcacctattgttgttattgttgtaatttacttcactaattaaggagttggataataaatgattgggctcccagttttgttagaaaaagaaatattacagtcaatctcctgcaagagcctaatactattgtgcctgctctctatttgatgtttgctcttgtgtctgaactttggctgagacattcaagtgaagaaatacagtaatagacactctaaggaaggttcagtgggttaggaatttgagactgagatcaatgtgtatcacctgtgtgccagtgaatgctctcctagcgttaaatcgaatgaagaatttagatcctagggagaaaactgtcaaaagtgagactgggcgaggctccacgaagggggaagcatcagctatgggctggccacaggagtagaacacttagctcagtccccagtgggcaaacacaatggggaccttaaacaggtgctggaggtgtctccctctaggttgagtcagtctgtcaagcccacagcattctgcctctgattctcttgtcttttgttccgatttggtttactgggatattttcacaggatgtcaatttcttgtgcgactattgcaaaatccttttttgtggttcttttgaatgaagagtggaaataatcattaacatgctttttggtttgtattcaaaagaaaaaagttaaaagaatatttgctgttaaccttctagaggctttaatttttatatcgatggaaacaactggtataagggagtactagatattttttttttctaactggattgcagtactttaggtttttagttactttctgtacttgtaaagaacctaaagggtattagtctaactgtttgagccatcacaatagcttgttgccacataaactttcctccagcatttgcattgtggatgaattcattatttgggacactgcctattttggcccatctgagtagctaactttgttcctggcagctactgctgcatagagcccaatgtattggactcaaaaaggaaggctttctataaacatgaggcaatacagaggagtttacctactgtcaagtggctgttttcaatcatggactacatgagtacctttgccccccagcgatagtgagggagggatgcgtgtgtgtgcactgcttctctcttttaccagtctaagcagtagatgtttaagatttaattattgtgaattatactatggcaacatctctaattatttttcatgcatttatttttcagtacattaaaatacgtgtacattaccgtaacaaaataggtttacctatttgtcccaggtgtgtttgattttcatgataagaagaatttggtataacttttaaaagaatatgtcctcataaatcatgaatttacatatctcaacagaaatgcatgtgtaaactatacattagactacaaaattatcaccaagggtttttttatataagcgtttttaaatcagtgtgttgctaggaggaatacaattaaattgctcagtggaagtgacaggaaatcagaagagcttggtgttacagaatgtaattaatataccagggtgtttggagatatatgaaacaaatgcaattaaccagcttgctggagcagcagtagtaagacaccatttctgtctgccttccctccctccctcctttcattcctccctcccttctttctctccgttttattcctctctcccttctttccttccttctctcccacaccacccttctcctgcccccaaagacaacctagaacctttgttctgatttaacattgtaggataagggggcagtttgtgtctgggccacaattatgcagcagaactcatagtaatgtagtgaaaaatgccaaaattgaggagttgacactgaaaaggcaatattaaatttttgtgtgtgtgaaactagttttgtatttagcatctgctgtgtcaaaagcaaaggaaaccctggacactcttactaaattaatatgtaaatcatacgtttgacattggattgcctttggatacttcagaatgacagtttctccacggggatggttgaaaatttgggatgtggagaacactgccctctaggctgtttcagcactttgagactcagtgttcacatatatagtgaagaggttggtttgtaggttctctaagctttgttactcttccaggattctatgatttctatttacttattcttcttagaggtgtgtgcttatactccacatgaatttcaaatgtacagaagcctgtaccatttcaaagatatactgaccatccttgtgctagacacagatattaattttattcagtgacaaatgatacatatatttgcattgatatttgcttggtgggttatttatatgtgcatttttatagtatatgaaaaatggtagcgttttgccacctcatagaagctatctgctaatattatttataatttttcagtattgtgtccctgtagcaatccatagagagcaaatattaagttagttgagaaatgtagataaacttttctatttgggatgtaaataatggttttcttattgatgcagattaatcacatctagacttttctgtatgatcatataggagaatgtatgttaaggttagcctttgttttccagcttttctttatttttgaataagaatagggttttgcagtcatttatgggaaattaatatgaactatggcaacacttttaaattacatctatatgccatatattacatcaatctgataattttataatacttgtgaaaaggtgttttaaaatgagaatgtttttctcatctttaccctttaactattcttaaatgaaagtggcacacatgatattaggggagataaatatagtaaagataatgtatgtgcatagtgcagatgtagaatctcatagaggtttatacatgttgctaaagtgctctttttcagtaatgggcttattatcatagccatatgtagtctatttcagaatttaaattatatataagtaacctgaaatgtgtttttgaagctatgcagtaataccatgtttgaattggctttgtttgaataacctttgatgctacgcaacatgtggaccataaaaaaaaaggatttcttagaacattaagcaaaaatattgtaaaaaaaaaaagtaatgattatataaaaagagcagttctggccatctcatccctgagcagcttgtataaaatagcatgtttgacgataaaaatatagatatgtaagcacattgtataagttgggatacatacatagcaatgaagggagctgatgtatgtgggatgtgtgtgtgcctagtaatatctgctgaaatagttccggcagtctacaggaggtacatttacttcccatgtgcaatttggttttcgaagagtattagaaaaaaagattatcatcttatttactatttctcctttttctcctttttttcctccttctcctctccttctctttcttcttctcattcatcgtctctttccttttcttattctcctcctctttttttcttttttggatctaatgaaaggaattagagaaacacttgaagagtgaagaagataggtgagggtgtttcttgaatgataatttagaaaatctgcatttaaaggaaaaatgtgaataatattttacctttaggtatatccaactgggattttgactttctcacttttaccccacaatactatatatagctttatgcaaaatgttttgcacggatcctatcattttccagtttacacaagtaaaagtcgtcatatctgagttcaagcaaacagtggagatttatagagtgccattttacagatttatttctaaagaaaagtattgctgtatttcttaaaggttctccaggtatagatctatcaacctaaatcaatacattggcatagatattgcttttctccttcttctcttctttttttttccatgtgtgcctttattagctgagccactacttgagggtttaaggtctttgtgaggggcttggaacacccaatgttgggggagggaggcgggcggtagggaaagtatctgaaaggacttcctgagccagctgtaggcttttcttcttcttgtaaaagaattactatataaagaatgaaggaatgattataaactctttttaaaaataaatacctatcaactctactgttttagtagtgtgttatacaatgatagaagcatatagcatctagggtagcatgcttacccagaatacttgactcaacacagtgttggagtaacggaggcctcaatccttagtgttttctcctccatttgcagccaatccttaggctctttcatctaatcacatgaggtttaaatacatgtttggattgataattctaaaattgccctaatcattgcatggagggatataagatccatcagcacagaacttggctgttgtatatactgttgatctccagtgcttgcatcagtgcttgacatactcacctgactacttgacgtctttgcttcatgtccaatgagaatgtacaaaactcaagcctaagacagaatcttctctttctagccattcccatcacagtaaatggcttccaccattcataggctttttcatgacccccaatgaggaaccatttttcacttgttctcacaacttgtattcaacttgttctcagaattgtgcaaccatcactacaatctaactttaaaatgttcttaattacccaagaaagaaactatgtagcttgttccaccatccctccaccaaccacaagaaatcaccactctacttctgcctctgtggatttgtcttttctggacattttatatataaatgcaatcatacaatatatgatgtcattttgtgactagcttcttttctttagcgtaatgtttttaagggtcatccgtgtcatagcatatgcatcagtacatcattcttttttattgccaaacaatattccttatcatctatcctttggtttactagttgatgaacatttaagttatttccatttttggctattatagatattgctgctttgaacatccacgtactaacttttgtgtgaacatatgtcttcatttaacctgggatggaaatgctgggttgtatgtttagtctgtgtttcacattttgaggaactgcaagactattttccaaagcagctgtgctactttacattgccattagcaatatatgaagtagatattttcttttaattgatcatggaaagaaagagtcgaagggccttatgagttgggtatgatgttttgaagtgaaacaattttatattatactaatctgtctcaaatccccaatagtcctgatttctaatcccttcagtggttgttgtcttctaagtcttcctcagttgcctcgtaaaactttacaaagatagtacctcagttgaacttgtcacttttagcagagatctcagcaatagtaaatataaatcatagaatgatagcatctcggagccattatgaatatttgcagctatattgcacaactctcttattggttgggcacatggagaactgaagcttagagattttatgtgccttgtcacagatcccattgctacttagtggtagagcagaaactagactccagggatgcttcatctctgtaccaggcttctgcctatgagagactgtttctggattcttagccctggaactccttaacaagaattccaggctcttgttactgaaaatgaccagctattttctgaagagtccatgagaaaatgagcttgaatatgtttaggttattcctttgattcaacacatgcatattgacaacataacttgcttggctctgtgaagaacatgctgacctgtgaaaatattcccacattcaaggaagtcatgacttggtagggaaggtaccaaatgttcaagtcactagaataaaaaaagtagtgtctgataagtaagaagtttgaaggtgtacacagtatagtcttgagaactcagagaaggaataggtgatttccagctggtacaatctgggaagggtcaacaccaaatgggtctcttaacctggaccttagaggaagagtgggattttggtgggcaaaaagattggaaattgaattccaggaaaagaagtaaccagaaaaatggcatgaagatgacaaaggggtgctaaggaaatggcaagaagtctagattgattgcaacatagtttgcctgtaaggaagaaggataagatggttattgaaagactactgagcaatcactactgaatgagtatgaacaagtaatttaacctttttatgcctcagtgtccttacctgtaaaatgggcatggtaataatgtatatctcatacagttataatgagaaataaaatagttttaaaaatataacgatatataggcagggcatggtggctcacgcctgtaatcccagcactttgggagggtgaggtgtgtggatcacctgaggtcaggagttcaagaccagcctggccaacatggtgaaaccccctctctatttaaaaaaaatacaaaaattggctgagcatggtggcaggtgcctgtaatcccagctactcaggaggctgaggcaggagaatcatttgaacccaggaggtggaggttgcagtgccaaaattgtgccattatactccagcctaggcaacgggcaaaactccgtctcaaaaaaatatatataatgatatatataaataaataaatatatatataaaataaagatgtatataaagatatatatgggctgggcgcggtggctcacgcctgtaatcccagcactttgggaggctgaggcaggtggatcacgaggtcaggaggtcgagactatcctggctaatacggcgaaaccctgtctctactaaaaatacaaaaaaataattagccgggtgtggtggcgggcgcctgtagtcccagctacttgggaggctgaggcaggagaatggcttgaacctgggaggtggaactggcagtgagccgagatcgcgccactgcactccagcctcggcgacagagtgagactccgtctcaaaaaaaaagatatatatgatgccatgaacagtgtactttataaatgccactcaagcataacttattgttataattagtagtatttttattagattattattccctgcctagtatgaacaaggaaaataactagaagaggactttgctatcagactaattatggactacaattggggtgcatgttaggacaattttaataagatttttcagctgtgagtcttcaggtgactgattaagaatttttgttgcctcttaagggaacttatcggtggcctcgcctacacagctgtgacagttgtgctatgacatgtgtgtttccattgcatcataagctgattacaaaacacatgtgattcccaagtgaaaggtgcgacgaatgaagatagtaaacaagagaggaatcacacaaatggcaatttgttagcaagtagaccatgcttgtgtaagcctgcattttggttcatgttggctgatttacatttcatcctggataatttttacctggtgctttgatataacgtactgtggagataaatcttgtgtaagacaaactaaataaacactttgagaaccgaagacctaagtaaaaattaacatttggtatccactcactaattcgttttctagatagcccccttagcttcccttcatttagtataagacattgaatctaataactttttataattatccattagttacatttgcacaatgagtagttatgcatatcagaaaggatagcctgaataaaacaatatcattactattgtggaagtgacatacctttggtgaccagatctctggactgcactgttagcttccctagtggattgttaattgttctaattgccttagaaccttaccaaaaatggtttcatttgactgtgtaatttccaaggtctccatgaaccttaggttttattatcccaagtacttctgtttaatgttccaacatttattgttatatctgagaatttttaaagaagaaaatttagcctgggctcggcgcagtggctcacccctgcaatcctaacaatttgggaggctgaagctgaaggatcgcttgagcctaggtgtttgagaccagcctgggcaacatagtgaaaccctgtctctacaaaaaagaaaaaaagttagctgggcatggtggtgtccacttgtggtctcagatacttgggaggctgagatgagaggattccttgagcccaggaggttgaggctgcagcgagccatgattacaccactgcacttttgcctgggtgacagaggccccgtctccacacacacactcacacaaatttaggcttgaaaagaattatccaaaaccataaacatccatctttaaaaacaataacagtctattgtctaatatgcatgtagcatatctgtgttttggtgtgggttcaatgatatggctatggatatgcatgacagccaaaattaactagtcttatgattcacatccactctcattcattaatgaccagtggtacttaggctttccttatcaataaatggaattttaaaaatttaatactaaggagacaatagtcttaggtcaatgtgcttagtttctggccactataactagaaccatatgcaacatggaaattttagctcaggagagggggttaacagccactttttaatttctgttgtaaggattgatgtgggatctctttccctagactttggttccaagctttttggaaatgagctggagaacatggaatataactcaactatcccactgaaaggcttttcaagtttaagcaaggaacacccagttgaaaccagactggaatttaagggatttggaccaaacctctgcagcacttataaccaattaaaatgttcataagtgtgattcaaaaagggagaattttgactttccaaaaaacttgagttaagagttattcattataaaggaaagtttataagtttttataaatcaaggttagagtcgtacttagaagttttataatacgtatatttccaaatactagcaaatgctagaatatgattaaacttatttagatatatccgattattataaaatatagatttcagggttagagtaaattaggggaaatttagaatgaatctagcaacaggcactcttgtattttatatctctattataaagtaaattttaatacgttgccagataacagtacagttattgaaaaccaagcttattattgttccattaaatcagagacagcatttcaccttcctcatcttaagcatttcaccttcctcatcttaagtatataaccgtttgtgtattctaagtacctttgaatgccagcaacaacaagctattactcaaacgccaattgttttagtgcttcttaccccatctctatcatgggttagcgtagaaactgagtaggagaaatgtaaccttttaaaaagaaaatgccatttctgtttctttactactctaataaacttactttcatttaaaaaaagaaaagaaaatgctaggtacaacattctcagtctttgcttttgtgtgttttttttttttgttgttttttggttttttttccccatgcaaaattgactaagaagagttacaacatttaatgtggtggtctcaaaacatttttttttttttgcattgtaattgttttcgcataatttcaagagttaaacaataataatgaaaagatgtttcaggccacacagcgtggctcatgcctgtaatctcagtactttgggagactgggaggatctcttgagcccatgagtttgagatcagcctgggcaacatggtgaaaccctatctttgcaaaaaaaaagaaaaaaaaaaaaattagctgggcatggtggtgctcacctgtagtcccagctacttgggaggctgaggtagaaggattgcttgtgtctgcgaggtcaaggctgcagtgagctgtgagtacaccactgcattccagccagggtgacagagggagaccctgtctcaaaaaaaaaaaaaaaaattcatcaaatgggcatatgagccctgaactcacaaatcaagttgtcattcagttgaggtttaaggcctccttttctgcccaaaaccagatttaactgggttattcctcactggctatcatgaaacatgtaaatacatttcatagctaagtatgtttttaagtgtttcagtcccacctttctgatttgaaagcctgaataatgtcaacttttaatactaaagtgaaagaaaaaagaatcagaaaatatgtacaacatgtgggtacagattttgggcaaatatagctcttacccccttgcctcccacctccctgtacacatggcaataagactattatgaataaactgaggtgtttgatgcctgccctctactcacaatccaacagacaacttgtattttaagaaccctttccaggctgggaattcttattacactttcctgttaaactgtagcacctgtgatgttcatcacttggatcttatgaaactctccagatttttgaggctctcagtaaatgtgtctcatcatggtaaatttaaattccaagtgtattcaacatttcttttcagaaagcagtttttaagttttgaagcagcggctacacatgacatgcaaataaaatgaccaggcaattgcttgtattgtctgtctgtatcaggattcaattctaagctttccaaacatggatctctataggaggttatgcctaatctttgcatttgaaatggtcaaggaggtgcaaggatatacctgggaggggcaatctccctgaactataaggggaggggacgaaagagtgtgttggaaaagtgaaaaactgaacatttgaatgaagtcggttggattagcatttgacactcaactatacagcaagcggacacgctgatatttagttctatggattgttaacattcacataaaacagaattatttagcatttactgaaccctttttgataatcaatttgggatcaaatgcaaaagaacatgtgtctgctttgtatgaccccagattcttccgttttctctttgagcagatgacatgccttctttactgactgatgttggttgctaggagaagtgcactggtttagtcccttcttatccagcagtaaaactaaagagtgtatttagtaagagaaagaggcagaacacagtacaggccatgaatcatgacttgtctccaatatgtccactttgctcccattttctttccctttaaaaacttttgtttttaccaatgatgctttctttcagccattatctataatccttttggagcctgaggggatgagggttgctaaagagaggctgtgctgctgagagtccactcagagcaataataaaagccttgagagttattcatggggccacattagtgagaatgccctactcagtgaatagcatcagtcagctgcctttgagatcgagtgattaataccttctgttttgaaggggggaaaaggcagacaagaaaggtcttcatactactttggctattttgcaaattagatcttacatattgtcaaaccttttgacaaagaaattgctaaaatgtcaatacctgcaatagtcttttttaaaagctagtttttcatgaaactgttaattgtggctactgtcaaatacaattgaaacggtaataatatcccaaatgaacactgaaaaaaatcagttagccattcttagattttggcagtgtttatgatgacatcaaactaagaacgtgatgttagtgatcatattcagaatgttatctaggcagatctatttgacaacagccaaatagcatttttgtttgtttgataaaagaactaattgcaatactcttgagagtttacagaagcagctaatgagaaagtgttaagggtggcaggtgttagtttcccataagcactgggatataagggacagtctgtgaattacaaagaagttgttatttatatatgtatgcctgtatgtttgtatctataggctggttcagcatatgggattaaaaagtggtattattataatcctcatgacctctccttttatcttttgattatattatgtacatggcactgttcaaataaaattgctcaaggtttattaaacttgtcaaccatctgagttgcatagttagaaaagcttctggttttggtggcctgagtgtggcagctagaaaatccaagggaatgctttgccatactgtttttcagcatgattccaacattaagcaggctgttaatatttagacagtaaattaagccatgtctttgtttttaaaaagtcattctcattctattcttcattttacattttaaacttattttttatatagcagcttagtctggcccttctgtatatactcatgctcattccaaaggctttactttcatctgaatatgagaacaaacaacatgttaaagactctgtgtgatgcttcctgtcatctgttttcactctgtggaagtgaaatatcttgttaagagggggtaatacccaaaggcaatcagagataaaaatgtaacgatttggtgggtgatgtctcaagatcagctttaagtgaggtctgatttaacatctttattagtcatttaaaagggaaatgataaagaaattgtaaatctcaacattggaataccatcagaacctcccctccctgtccctgaaatcacatataatgatatacaaaaatttaggcagcagaaaatattagtggagtaaaaactaatgctttatttggtatataaatgtaaactaattcttcagggaaataatcagaaatctagaaatctaactagagggagaagccagcaaagcaataacactgaaagggccctggggataagtacaggagttggcgcaaggagagaatgtgatttagattaggagtgttatatcccagtttaaaggtcatgcgattatagtgcccatttagggagtattgcatcactgactagggagattctctttcaatgaatgtggcttaagtgcagttgaaatacttctttcattttgtacttcattgccagaacatgagagagattttggcagaatagaaacaaggttagtacaaagagagattctttaggaagatgcttgtctacttaacactagagaaggattttccattggaaagttcaagtagttcctttttagagtgaatatagcatcttcaaaaccaagaccaaattcataaagccttccaagagaaatttctaccatctgtcagtatacagcaaagcccatgtttgtgttttagttcattttatatgtactgtattacacatattagggcttaattaaggttgggtgaattaaattgatctattaaatttaatagacaacttgtatgcagaaacctatacaacgtatgccatctgaccccagataaattcaagagtaatattttctgtggaagtcaagggtcttccttccagtagaagaaagtattggatggagtagggaagcatagacaatgactcttcagatgaagtgtgtcgcatttaccacattcctggttaataaggatgctaggtctgatgataaagactagagaaggttgtacaagtgagattctctgcttgctgcacaattatatgttgttccttttccctagtcctcagatagaaatcgccattttttttctcctgatgtaagagagtgatagaaatagaatggagccagcatctcagtaaaacagaagtaaaaacaagttaagatgggcagtgagaggtaatggaggccaattcctagggcttctgattggttttattttgtcaattttacattcccatcaatgctgtggggctacttcatagccaacatttgaaagcagatgggcatcctgccgtaatgtcactgcagccagtgacagagaggcgcctgcagtccacaaaatctcgcgtgtatgtgtgtgtgtgtgtgtgtgtgtgtgtaaaacttggttaatgtgtcattcatcagtaatgagattagagccctcataataaagtccctacatgttaattgtggaattatggtgcaacaataagtagagaaacactcattctttaaaaaaaaaaactaccagatacaaaatctattcatttggaactcacccttctgtgatttttattcactacttttacagttaattttttaaagattttcttttattcagcttccactgcgtcttcccactaacatcaaacccttctgcatccagtattcatcattttgtaacaaagagcatataaatattataagggatggtcttgatattaggggtgtctatataaaatccattctactggtctagtgattgggccagtaaattgcatactgtattgataaaagggctttcattctcataatagtctgtgaactcactggggactccttttctggggagtcatgtataaatgatgagaactatacaaaatctcttgaggagtttatcatagaaatagaggtgctggaaaagaaaatatggtagactcatactcctttttgccttgattttctaacacgtcatcctgtcacaggatttctgcataccttgattccatgtgagggttataaagagttagagaaaaatatacatttggaagactcatttacgcataatatatccacatataaacttccatgaattggattggattataacttgtgtgaaataaatgtaacaaaaccacatttttgaccctgaggaactaatcaaagccagaggctaactttattacacccattcctgattggtttatttctgtaaatttatataactacgagatgatttcttactttttcgcttctaattttaagttttaaaagtaaaattaaccaaaagaatgtttataaggtgaactttggccaaatgatgattgtcataaaacgtaactttttaagtagttgtgaaatgcaataaattgaaaagataaatagagaagttgaactgtccttacaaatgactgcacaataccagcaatgtcttttgagagaggatttaggacatagtgtgtaggtatttatctcacacaaagagaaaaatttccttccgtgggaaaacattagatcataggaaggcctgaaatatctgagttgcagctttgtgaaaccacactcagtctaaacaagttacaacaagataaagtcctcagaatacgaggaagggatgatgactacaaagatccaccactgtgtttcccagcttttttctctaatgtagctaagactttctttgatgaagtcatcctttcttgatccatttgtgtaaaaacttgtcccccaaccaccgtttgttaagggaggcagtatttagcaaacttggtagagtttataaagacctaattttgttggatgagattcactaggattagacaacaaattaaagacaaaatgacatatattagtaactgaaagatcttgcttattattaatatcttaattcatgcagtgttttttttacttataagaagacaccgtactgtataacattccatttgagattgttatgttggcaacctcttatttctttgaaattgtgtgggcaattcaaaaaaattaaagacaggataatatagagaactgagcatttaggaaaaaaattgtatatttgatgtaaatttcatagttttaaatccacagataactcaaaactcagacacaagacatacaatattttggcaatttgtgttaaggctgtaactttttttcaaatgtattattgcttaatatttctaacatgaaacctaaggtgcttgaattgaggccatgtcgtaatccagggaagatgttttataaatcaaggaattgacatgtaatatacacatatacacagatgaatatatacatgtcacacatatacaaacatatgtctatgcacacgtacatacatataattttgtaaaaaaaaagaccaagttcataggaatgccatttgacccagagatcccattactggttatatacccaaaggattatcaatcatgctgctataaagacacatgcacacgtatgtttattgcggcattattcacaatagcaaagacttggaaccaacccaaatgtccatcagggatagactggattaagaaaatgtggcaatatacaccatggaatactatgcagccataaaaaaggatgagttcatgtcctttgtagggaaatggatgaagctggaaaccattattctgagcaagctattgcaaggacagaaaaccaaacaccgcatgttctcactcataggtgggaactgaacaatgagaacacttggacacagggtggggaacatcacacactggggcctgtcatggggtgaggggagcggggagagatagcattaggagatatacctaatgtaaatgacgagttaatgggtgcagcacaccaacatggcacatgtacacatatgtaacaaacctgcatgttgtgcacatgtaccctagaacgtaaggtatatatattaaaaaaagaccaagttcaaaggctttggcacatctgtcttttagtcattgcatttttgtgagttaattactaatgtggaagctataccttttagattccagaggattttttttttttttttttttgagatgtagtctcgctctgttgccaggctggagtgcagtggcatgatctcggctcactgcaacctctgcctccttggttcaagtgattctcatgcttcagcctcccgagtagctgggattacaggcacgtgccaccacactcagctaatttttgtatttttagtagagacggggttttaccatgttgaccaggatggtctcgatctcctgacctcgtgatccacccacttcgacctcccaaagtgttgggattacaggcgtgagccaccgcgtcctggcaatatattttaaaaaatatgtggctgacgggttgataggtgcatcaaaccaccatgacacatgtatacctatgtaacaaagctgcacgttctgcacatgtatccagaacttaaagtaaaattaaaaaaaaagaaaaacatgtggctggattttgattgaacgttaatgttatttggggtgtatgtgttgtttttttcattaaaaaggagaatactcggatgttttcctaattgttattaagaaaattcttagattattgggacaacaaagttcttcaaagtctttcactaagcttccaagtatcacctgaataaaataggtgaatagaaaactgagcttagatattttttgcttgatagccatctagttttattcagttgccttgagacaaaaaatggaaattgaaaagtataatacactaatgtttagttacctggaaagttccagctaaatataagtaatattcacaatagcctgctattgtaattttaaataaaatattattgtgtgccatctggaataacttgtacacctcttctgtaactttccagctcttgtgagggttaataaagatctcaagtgatattttcagaatgcttcaaaaagtaattgaaaaaatgaacctatgaaatatatcactaacatatagttgcttttatttttatttatttatttgtttttgagatagggtctcacgcctctcacctaggctggagtatagtggtgcaatcttggctcactgcggccttgacttcctgggctcaggtggtcctctcacttcagcttgagtagctgggattataggcctgcaccaccacacttgggtaatttttttttttttgtattttttgtagagatggggtttcatcatgttgcccaggctggtctccaactcctgggctcaagcgatccacccacgtcgacctcccaaagtactgggattacagaggcaagccgccacacctggccttagttgctttttaattgcatgttgttttactatttccaagtttttgaccgttattgttaattagttagcacacaatcacatgtatatattaattcattagaatgtatttactgagcatctgcaatgtgctgaatacttgtaacagtgtggtgagtttttactttggtgagaaagacaaataatcgtgctgaatatgtttatacctgtgattgaatttttaagtattatgaaagaaaaatatagggtgtcataagcagattataaaatctatgaaatttagatttttgtgcctggagaactccctggggaagtaacaattatgttgaggactggagatagctatgtgaagagtgagatctgagaaaagaattctaggtagaaggaaggtcccgaagtggacagggattggagtccctttgaaagcctggaagaaagtcaagtggctggtaaagctgcaagcagtgaaaggtggaagaaggctgggctggatgacacagattatgtaggtaatgataaaagaaaaaggtaagtacatttaaatttcaagcagtgtatttgaacatttaaggattcatgatttggagtagcactagcctataaggcgtaaaatttcattgagaagggcaagaggggaatcttttataaagtgttcacataagcaagacaaagaaaacaattttggttacagtggaaagaccctatttaaaggttagttggtggtttctgattgttagtttctagtttcaatttactattgatgttgggctttgatttattgatgtgggaatttaaattgccagagacaccccagtttaatagtttcccaattacaattttttttaattgtctccttttgatcagcctctcatttatgagagattgaccaaagtttgggcataagcatcactctctgtcactgtcttggctgggttgtctttatctcagtgtaaaactcatacgtcatgacatcaggctcattgaagaaaggttcttatttttgctcatctcatttttgttgctttaatcacagtgagaccatctggcatacccttgatggctgcacacatacatttgagacccttcagagtatatactacaccaggggggttacagtggtgactatcaggagaatactaccaagagactgaagtatgctcctcagccaaggtcatcacaaatcaaaccaactagtatttctatggaaataaaagaaaaataaagaccaatgactagagcaaactataaattcagtctctgagtccagagggtaattagtcaagacttctagatttgagttcaaataatgttttcctggtttgcagtttgagtgtctttggttatagcattgggtgtgttggtgaactcctggagtcatgcacagatcaggaatgagggttgtcctctgaaattatgccaggctacccattccagctcatggcatttcaggaacagaggagttcttgttcttagtaatcccaagttggaaaaatgggagaaaattgaattggagaaacctagaagaattccgcatctagtccattctacaggtggaaaataaaactcgagaacaatgaacagagctacctttatttcattgatatttacctaattcacttgttcttaacacttgtatttggattgctcatgaaaaatttcataagacactaaacacagctagccattgaaggagttcaataaatgtcacctcaagctattccactttggtatattgatcactttgagctaaagggacttgaaaaatagcaaatgcagagagaggctttccctagaccacctcctatttgccaaatccagatccaccacagcagctcaagtgtcatcagtcactaccctaccccatcatcttatttcatttgtgtttacaggtcaggcaaatatcaaagttatcacagaagcaaagaaactgaaaagctaaacattattcttccctctctgtctttttctaaattctgtaactaacaggcaccaagcaatttatgtttactacatattttactctttggttggagttattgacttaaacatctagcagagataatacaaacccatctgaccagcaacccaggaaaacctaacattttttttttttttaaagagacagggtcttgccccgtcaccaaggctggaagacagtggtgcaatcatagctcaatgctgcctcgaactcctgggttcaagggattcttctgcctcagactcctgagtagctgggacgacaggtgcaggacatttccagctcattcttttttaattttataaatttgtttagtaatatcatcccaaaatatcacatacacataacatacatatgttcatacaaagacatgcatgtacatacagacggaagcagataagttgttgatttaaaagtcatttattaggagaagtctgaaggtcagtctaaattgttggttgccctggagttgctataattgcaaggccattaatttggaagccctttgtttcttaccttgttctaagattctttacacatgttcagctaacctagctaaacctatggcttatttccttaccttttttaaaatttttaactttttttcctatgtctccaaataatacctggggagaatctttttacaaaaagggcagcaagggtaggctgggtttcctggaatgccataagaaaaacaaaagctctgagtggtttttgaaatcagtaacggattcatcttccttctgtctgtaggtctggttgattgtccagtcagtgtgagtggggaaacaattcaggaatggctttcagaagattgtttttagtttttttgagctttttctggcacatatgtgaaccaaatggggacttatcaccatggatcgtgtcctcacaatgataccattctgcctcttgcatccatttttgagcttcccttggtcctgtcaacatgtctttaacaggattactgagttccgggtggaaccaattaacatatagggacaaagcattttctatgcaggacaggaataccgtttattattcatctgagctcaagactttgagcaaggaataacagtggttataaagcagacctggttgatctgacatccttttgtcaacactgatctggttctttcttttttttccctttgaggtgagcaggtaaaccagtgaaaacattagtagattcaaagtaggcaaaggataatagagagaaaccgagagtttagaggtctctacatgtcagtcaaaactgcatcctatggttttgaggtgtttgggatcccttttgatgtatgtgccctatagatgagcagttttacttaggttaaaactttcccattgtggccaccaaaattctacattatatttgttaagattcacccatttctctagaaaagcacaggttccaagatggagtcttagactctctggatttaaataaactcattatttctgtcttctgggaacctttcctaccagaggtgtttaaacccaattcagtttctgtctaacccagtcaggcacctaaaggctcctgacagaatgcagtgcagtttctattaagacttccaaacctagttcagatttttaaaaaatactcaaataaactcagagaacaggacccaagttgtggaactcgtgtatccaagaggacttagtggtgatgacctccaaatgtataggaagaaggagtgagcagaaggggcacagctgggtacttattcctgtttacttaatttctcccagaggtcatgattgtgtggtagcctttaggtcacacttctgacaccagagcttatgaaaaaacaacttaagcatatttaacttttaaaaagtttatctgggcatccagtggcccataaattggagttccaccacactgcaaggtacttagcactccaccaggagggtcaagagggggaacttctataaagtgtttacagaagcaagacacacaaaaaaaatgccagttttgattgatttgagtggaaaattcctagtgagaggttagttggtggtttctgattggtgcagttttaagtgtcagtttgctatttacattgtgaattagtttgtatatgtatgagtttaaagtgccagagctaatctagtctaatggcctcccagttacattttttttaataataaagattctgaattttatcccaaggataataaaaatacattagaggaatattatactgctgtgggaatttacaggcagctaaggcctactggtgtctctgaatactgtagagcatcatcaatttttagctcagaagtaaactggtggactattaaagcatatagggtgggaactgaaaacatcatgagggtgggagcaggatctagaagtggacagcttgggttgagttcagagtaaggtttcgccaagggctatgcccatctgccacccctaaccagttacatgaaatggctgggagaggagtgtacgtgtctgttttctaaaagctctctcatgcaattcttgatgtgcttagatttgataatgtgaagatggtaaggaataaaataggaggaggttgcagaggaactggaaatcagtaagacaggagcaaagtgtgtgaaaagggggtgtgtttagggagataattaggagtttcaccagaaaaataaaaccatttcaagtgtgtgctgcaagacagggaagctgatggaagtttgacagatctcctgacctcttcaattcccataatcatgtaactctttcttcctttctcctggattataacttacttgaattgtagtaatttacatatgtgctttatgactcacacttacgttaggctacttcgtgtgaagagctctttgctcttaacttgatattgtttgtagtctgtagcaaagcaacgtatacataaggaagtgtttaataaatattcgttgaattcaatcgagatggcccatttaattcagctcttctttctctctgcctattctagactcagccaaaactactggtttccattggttttgctgacttcatcaatagagggtgcaaattaaaaattactctacttatcatctcctgaacatatacaatttatgtgttcaaagtttgattgggcaattgcctatctatccttgtaagtttaaaagctatttctcatttaagaacattcataataaacactttgcattgtacttgttagtgcacatacctagatgaagggtaaatctattttcttcatgttatctttaaagcctgcagaaaaattatatgcttatgttggtattgttaagctataatgtcataaaaggtaaatgcttgtgttcattgttttcacttattatgctttttgttataaacgtttgattttatttttaaaattaccttaaaaatgtattaaattgtattgtttattcctttcaaagaaagaaaagtaaggtgtaaacattagtttataaaagtttgtaagacaaaattcaagcaaaggaaaaaatgagtagtgaaatatatttttatacaaattgcaattttatattacaaatatttaaataaaattaatacttggatgtatcttttttttttttttttgagacagagtctcactgtgttacccaggctggagtacagtggcacaatctcagctcactgaaacatccgcctcccaggttcaagcgattctccagcctcagcctcccaagtagctgggattacaggcatgcaccaccatgcccagctaacttttgtatttttagcagagacaggtttttgccatattggcccggctggtcttgaactcctgacctcaaatgatctacactccttggcctcccaaagtgctggcattaaggtgtgagccaacacacccagcctataaaaacatatttcatttcagaataaaaagtgtagtagttttgaagagctaaaaaatttgggacagatagatccttgaagcagaaaccaatctatttcataatgatttgtgcttccttactcaaatattttgattttcttctgagggaaaagggagaatgaattattttctatgacaagatatttgtaataattatactctggtattcacaggtatcattttttcataaggttgatggccaccaaggaatatggaggtcttgatagctttaattctcagctgaaagcaaaaatgggtttttggaaactgatcagaattgcatgacttcccagatttggaaaggagaggtgctcacaacatatttttattcaatgattctaatgtaaagtggatctggcctaatcaagggcactaagtaaatcaactagaaaaaatacatcagagggaactgcatataaaataataataatcacaataatgtttagtaatactatcacagtcttttcccaaggagcttcaagcacttggcaattgtctcattaattctcagaagctccctgggaaagagtagagcaataaatcacatattaaagagacgttttaaataacagagtcagtcagattcttaataaacagaagttggtcaacaaaagttggaatccagttttatggaaataaattttgtctttttcttaacaagtaatgaatgaccaccaaaaactttcttcaaaattaattgtgaaaaatatcctattgtttctctttgtattttttgtatctaaacccaattacctgtcattcttgtgacctattttcaaaattccattaaagtcagcaagtaacaaggtttcttgcaatctttagtcagatgtcatttgagtattggtgatcaagattgagagtaccttaaatgagaagtttcaatcaatggccatcatccatgctattgattaaatactttgttaccttagtaatggcccaaatttaaacatttcttaaaattggttaattttaaggagcaactaaaatagtaaaataatgttattgtttgcattagtaattagaaaattattgaaatatgaagtcaaatatatgtttctctttgaaaatagtgcctcatgctattatgggatatacaaatgaccttaccactctgaggtcagagttcaaattaagcctcagtcctaagtaaattgagatgaatggtttggtctttgtccctagtgtaaaatagtccatatcgcaaaatcaagatacatctgtttttgcaaaattggcgtaattggcattctcccaggactttgctggcatcgaagccgaagctatttcttactacaaaggaaaatgcttttctaggtcatgggtttttaaaaaaatgtgtataaaaatggctcagaccatgtctgttcacttgtgacaagggtgaattatgtctcatcataatcaatttggtgatcgataacagcacagaaacaatctagtatgtttattaagttgggtgtgattatgggaaatcgcaagataaacagatggaataattttgaagaggccacttccttgtcttagtagtagttttataagtactttcattcaattatattgagaaaaatcaagattgcctttacattctagttaactaaattattcatttatgtcaaaacctttaacatttaaatgcataattatattagatgtcaaaagacattggtaataataactctgacaacattaactgcagttggaaaaaaattggcttcaaagtcaactctttgttctatagtttcctgtattaattatagtctaatcatataatttctttaaaaatgtgttatcaattagaaaaattttgttagacagcaatctctatgtgaaaaaagtatttgtatttggtatttcccagaaatcatataacaatgtgagtacaatcaaaggactaacagtagggaaataagttaatgtatagaggtatatatgttaatgttaaataggacagtactttaattatataatctgtatttcttagggggagtgattgcttttatttttggttttaaacactttttgatagtacaagtaggcaatctaaagaatttgtagggaatgattgtttagtgttatgtattgggagattagattaagacatagtacagttacttaattatccttctattttctccaaagaaaagaaacagacaaatctttggtatccttgcactacttttaaaaatcaacacccatttttagtttgcaaatgtttgactcttcatttgcttttagtttaaatattttaagaaaagattcttttcccctcccccctccacccctgcaacacacacatacactcacacactctcacacacacacactcacacacacacacacacacacacacacacactgcaaaacaaaaacacaaaacagcttgcctttgttgctaggccatagcactttttccaaagatttcaaaaactgtctgtacttgatttttcgtgactgcataagttgtagtattggatttatcaaagcttccctttgcaaaacatcctaactgaagccagagtccctccaaacatgtaataatttatagtgagtagaattttaaggtaatttatagtgagtgagcactagtcttccatcagtttaaaactcaacactcagttttgcttattcccaaactttgtatttactttttactacttgcccctgatatttttattaacgtctttatttaacaaaagttaagtcagcagacaactgtgagtacagaaaaggaagcattttatccctgtataccgaattagaaagaactgatatatgtgtcatatatgtgtctctaaaataagctgcgcttgaattggatatgcataacagactgaaaagataggggaaaatatcacaggatttttgtgagaatagcattaagcaaggtaacatgtgaaaatagctaacaccgtgcttgatatagactcagtgctgaattgagtgtttgttttttcttttcataaattctttgatgaaagtcacatgttttctactgatatattgtctttagcctcagtggaccttagaaacagtagacgcagaccttcagaaaatagatgagaaaaccatggctgatgttaaaataagaggcatcagaggaatgcgccctatatgtactgttttctttcaaagctaccaggttatcccaattttaaagagcatgctgaggatgtttcagaacttttttcttttttattttattgatgagtactttaaaatcataattattagttttttctagagtatacctgtttaagacataaacatcagttctaaatcacgtctaagtctttgctttatttgtgtttctctttgtgttattattactttatttattcttggtacatttttagttctcaaaatgcttagaagtgtatatttgtaaaattttccaaaaacacaccattagtcttctgtcattgttttcataaagttgtaactaaagggaagaggctgccctttatttttgagtgctacttttctctcaccactgagagtgcacaggcttttggtttaatatttacatcaagggggtaagccttaattgatataagaaaatatatttttgtgacaaaagaaagctttatgtcttatgtgtttgaaaggaaataaaactaagacaacttttgcctacaagtttccttctattgtgtcatgatttctcaagggaagtgatagaagccattttattttgactcttttaaaggagaatgaacgaatcaccaccctattaagaatataatctttgtttaaatgaacattgcatggaataaagcagaatctttttttccattgctggtttctaaagcctcttatctctgcctaactcttatctctcactaacttgcctgttagtcacgtaacaggcaagttcaaaattcaccccaaagtatgatataaatatatcttaaaatataattcaaactcattactgatttgtgagaaagaatgaatggcaacaaaagagcatgagggagggcagaattggaagtagaatacgtgaataaagtaatgtttttgtgaacattaaattcaacataattccacagtatagtgcccagcccacttccgcaggctagtatgtttctaggcttcattaaatagaacatattatctaaaataaaggtgggcacactgcagcctctggactgctgcttggttttgtgatccgcaaactataataaatttttttacatttttaagtcattagtataaatcaggagtagaatgctatttcgtgactcataaaatttttattcggttgaattttcttgttcactaataaagttttatttgagcatggccacgctcaattgtttaagcacagtctatggctaccttctttctaccaaggcagaattgagtagctgtggcagacgctgtgtggctcacagagcctaaatatttacagtcttgctcgttaagagagagtgtgctgatctctaatttaaactataagggcactacgtgtgcttaatgtgtgctctcaggcagtatgcaaaaatgctaaattttaagagagagagaccattggaattaagtgaaagagttcacttaggagaaggaagaggtctgaatgtgtttaagacaaataaaaatatgaaaaatagttgaaagaatgaggatgctttgttggcaaagaagtcgattgggatcatgatattcttcaaatcttcataatcatgtgggagaatgactggacttgtcatatttaacacaaaggaacgaaattggagttaaggtcataggtggacattttactgaaatatatattgattcaatgaagaaaataaagaatatactaataaaattatactttgatggaatatctttgttcttgtaagtcagtgacttctagtacttcagtcattcatgcatagactacttgaacattttgttgacacatctggtggtggttagattgaataactttcttattctttaattaattcagtaaacatgtattcagcagctcctttgtatgaaacactcttttaggcactgggattagagtggtgagcagcacggaccaggtgcctgctcttcttgcactgtcttgatagagtccttgagggggagagacaatatgcaagcaagaaatcaaggtgttggtagggccacactttctctgaaggctctagggaagagcgctgatatgtgttgaattgtgtccctccaaaaatgtttgttaaaatcataacccctggtgcctcagaatgtgatcttatttggaaataaggtctttacagagagagtaaaattttaaaagggtcattatcatgggcccaatttcaatacgactggtgtccttataaaaagggagaatttggatacggagacacaaagagaatccatatgaagatgatgagaggttggaataatggatttctaagccaaagaatgccacagattgccagcaagcccccagaagctgggaggagtggatggaagagattcttcctcctgttcaatagaaggaaccaactctgccaacatcttggatttggacttcgtagcctccagaagtgtgaaacaataaatttttgttgtttaagccactcagtttgtaataattgattacaacaaccctaggaaactaatgcatcttccttgcctcttccagctttggtggcttagatgttcattggtttgtggcagtataactctatctccatcttcacatggacttttccactgtgtgagtgtgtgtgtgtgcgtgtgtgtgtctttttctatctaaggacattttcattgaacttagaacccaccataattcagtatgatctcatctccatccttcccttaattatagatgtaaagatcttatttctaaataaggtcatacgatggcattgtggatgggcatggattttgcagggggacacactattcaacccactataactgttatgccaagagagttgtcagcaaagggggcaggagtgatatcaaatgaaggtaaaggaggcatggaatgggatagatagggtattgtggatcccagttagcagtctggattttgttctaaatataaagaaaatttcttggcaggttttaagctgagaagtagcacaacttgatttacatttcaaagaggtatctcgggctattgcgtagaggatggactgtgatggggaaagagtagaaacaagggcaagctttgtgggtccttgtgagaaggagtgagaggtgctcagtacaaataagaaacaggccaggtttggaagacttgccgatggattcgatatacaccagggtgtaatgaatggtgtcttacagaccggggaaaagtcataagtggcttctttatccatttttgtttactcatatatttatatgagtaccagcagactaagtctttcggaagccgcagaaggttatgctgtgaaaggaaagtcccttctgactgtttctcgcagtctctttactttaagaacagctactgttagcagttttatctacatccttctgaggaaatattttacatagagcattctctttctaagaaggaatataccttctcctaaagtagggctattcttcttccataaaatccaataaatgaacatgtttccaggcccggaaaacttacattttagaaacacctgctcattcagtaaaaatatgtcagtaaagtctaaaatagcattaaattaaaatgaaaccggtagttttatgatacatgtcctttacgattgttgtataatgactacttgtaaagttagctaagacttcatagcctaggctctatgcctagaaaataagaaaaacaccttcttccccattcgcaaaactcataaatgaaaaatgaagtggattttgccatccattgtttctcctgtcactcctttaagatgagtgatgctgttttggaaagcatggctattaagcagcttgcctgagggtcacggagcctgttctgcagaatccatttgaggggaaggctggagttggttgtgtgtgtagattctgtcttctgccagccactgctgtctttgctgttccagggtctttctaggccatttaaaacgtgattaggaaaccatcagtttcctatggcaaagggattgcgcataatcaagtttccttacttgcacgaggctgagccctgtcctgtggagtctaccttccaaatcaataacaaatctatccaccactctcattcctcacaagtaacagtcatcttctagctacactgacattattctagtctctagaacaggagtctccaacccctgggccccggaccagtaccgctcgtgacttgttaggaactgggccacacagcaggatgtgagcggtgggtgagagagtgaaacttcatctgtatttacagcctctccccctcgttcgcattaccacctgagctccgtctcatgccagatcagcagttgcgttagattctcaaaggagcgagaaccctgtttgtgaactgtgcattcgagggctctgggttgcgtgctgcctatgagaacctaatgcctgatgatctttcactgtctcccatccccccagatgggactgtctacttacaggaaaacaaactcaagactgtcactgattctacattatggtgagttgtatacttatttcattatatattacaatgtaataataatggaaataaagtgcacagtaaatgtaatgctcttgaatcatccccaaaccctcctcctgccgcccacactactccatggaaaaagtgtcacctgaaaaaccagtttcaggtgccaaaaggtggggaacttgtgatctagaactgaccaaggccttttgcatttaaagactacttgtgctggacactatgccaggaatgttcttttccacttcttaccatggctaattccatttgtctgtcaggactatgcttaaagaaggctttctcctaataatcaaattaagttcttcctgttatatcccccttgattgcatttatcataatttcgaaacatatacacaatgggatagtaacctccttcagtctctgttttgtttgcaagtatatacccagtgctgagcaggtagtaggtgctcaacatatatttgtgaatgaatatattttctgtttaatatgtagtagagagtataaacttcatcacccttggtttgtgtgctttgtggttacgtcttatattaatctgtttttctttaaattctagattacatttacatttatttactataaacataccaaaataaagttcattttgtatttcagaagaacaattaggacatcatcatttagttcaatgcaatgagtagcagaagtcagaaaggaaattatttttacaaacatgaacagaaaataaatctgctaggcctttatgatgtttataacattgtagcttttgaatggttttatggttaggtattgagggaaaggcttaatagatatgaaaacaattgccctttaaaaattacagcagacaagtatttaatccaaagggggctaataaattgctcaagggaaaagggttgtaattatctttaatcattcccattaaaaatagtctttaacaggttgaatgcatttaactcagtgttctgaataccaggtaaacattggccattatttttctaatgtttactttgtcataagaaatgagcagagtgagaacacatttttatttgctaagagaagaaagcatattgtttcttaagtcacctgtagggcgaagtaaatatgcgaggaaatagtctccataattgtttaaaattcattgaagattgcttttctgtacaaaagaggggaaaagattgtgagaagcacattacagaaaacaaagatcaatgggacaatatgattaatttgaaggtaaagtaaggaagggctctcatttttcacccagtgccaatttgcagtaaacctaagcatttcatcaaagggttgctgttaaccactttaaagcaatccactttcctggaactggaacctggggccttcctgagtcctccttgagcatacagagttgctgtgatccatcttctcttcttttctgtcgacatgaatagtaagtgatttcctccctagtgcattatgaagttgtcttatttaatgtttctttctggggactgcacagcttgaccctcacactgaaggtgaccagatagaattgtcctgtgggcatggtgcaattctctacccttgaacgtggaattatgcagagtagtgaagctttatgcctagttggtgatcatgacctggaaacatacacaaagaaagggataaatgaagtttgttaactagattacatgttttaacttatttaaaatgagctattttgataaacattttggttaaaatagtttaatagaaacgtggaagtgttttacatcaccagggaacatcctgaatgtacaaatgaagacattttcattaaacaggtgatgttaataatttatttttatcactagcactgtgactacttatgaattataaatgaaaatttacatttagatttagcatacatactcaagcgtgtcctgattgttttcacaaatgttagtgggtgaggtaatggcactttatgtttccacactgatagggctacctttaaactgtctccagaagtgttaacttgcagcctctcaccttccttttctctaaggttctgtttaaaatatgtccccttctgcctgtgctataactctaggacataaaagaagtagttaggaacagatgatttttgatgtgttgtgtttccatgaacactaatgcaattagtacatccctgagagggtctttgtatttatctattatattttgaatgaatcaaggcacagtcttttctaacacattagggaatctattagttcacctagtttgctgacagatgtttcctttaggatggaagaagaaccgatacagctagttcaatttagaaaaagttatgtcctgggtgaattcatgactttctattttctctcccatttttacaataacccttcctagagaaagcatcacctttattgtttgatctccccttctgtgatgtatattgctcactgaaatattcagtataaatgaataagtgatgaatgaatgaatgaatgaatgaatgaaatcctttgaagaaataatgccattttagcacaacataaatgtctctaagggcagaatgagatgacggtgaggcaaccttttcttccaaaacttcgagtatttaaaatgctacatgtggatgttgccttgtttttgtttgcatagtcttgaaaagaaagacctaaagatggcaggcttcatattttaactgttttccactaaatgcttttgttatatttgtcgtattacttaaaattttgtagctggaaagttgaacacatcaaaacctggcttttagaaaatgattaataaatcaaaaaggtgaagtcactttgtgtctagtcattaaaatatatacacatgtacataaaacgcatctctttatatatcagcattataatttatatgttgacattccatattagcattatagaacaaccgaccaggttttttgggactcatatctttccaactaagttcacgtgagagtattttttatcgttgaacctgtatctaaaagtatagtgtgtggagtgctgtacagacatagggatacttcagatgaaaatactgatgaatttcagtcattgaggcaattgggaacttcagtaagattttaatttgagagtaatgtgttccctctgtcaccgaggctagacactacctgttgagattatttgagattcctgttctcagatatatcaaagacttgaagcggggtagggtaggggagaggtgctcctagtaatcactatggcagggttgggctttactgtatgtttcctttactcaataaactccagatgagaataactaacagaaaaagtaacttttttgcatttaaatgttgatatatacaacaaaatatgctatttttttatataggaggaatggttcaaatatacactactatttctttctttctcctttttttttttttttttttttttgagatggagtcttgctcgtgtcacccaggctggagtgcaatggcacaatctctgctcactgtaacctctgcctcccaggctcaagtgattctcttcctcagcctcccgagtagttgggattacaggtgcccaccaccatgcccggctaatttttgtatttttagtagagatggggtttcaccatgttggccaaggtggtttcaaactccggacctcaaatgatccacctgcctcggcctcccaaagtgctgggattacaggcgtgagccaccacacctggcttacatactacatacatactatttcttatggcatcctaatgggacttaaaattactgttctttgctgaggtaaggaaatattgggaaaaaaagaaaaaaaaaggaaaaacacaaaggagatattaatagtttaaaacagtttgaaaaccttgggcacattttattatcttatagttttatttagaaagacttattgtctttccatagtttatttttaactgtatcataaagtatataaattctgtattttctcctgtattgatggttattgtccattttagtgtgttatcttatggtttctgctttgttctatgaagactctttaactttttagggatttaattagactggcttttaaattatagcacctaattcaaatatttaaaacttctttggggaaggaacatattttagcatacgtggtactaaagcatttaacaacagtttatgtttttttcttttttcttaaagtttgtgtttttaagcgatattctaaaatgtaaataaaataagtaaaatgagaggaaaataaattttttttctgttattctcataatgagtaaatttttctctcattttaagctatgtctcaccaaccacctataaattatttcaaactcaaattatatggaatctttacaaatgattgccttaaaacttgaataaaactgttcaaataagtattagttataatttctaatagaaataatgtagcactttgcattacaaataactaaagcataacacacagataaatctatatgaactttaataatttgccctaattaaagctataagcttggccttacagacaattttgagttttcgtgtgtttttttaaaaaataagtcaaaattataggttttcagttttgccttatggatataagcaaactgatactgattagtgcagattttgttaaagctgcagaagctaaagtttttaaggaagggattagataaagggaaccttcagagatgatactgaaacagctcacttcaacaaactggtactccttactgataaatgtgctgtctcctgagctaagtcttaggcaaaaaaacacaatgatgacatacagcacgtgtgaaatagatattcttgccttttgaaaaatagagtgcaaaaactttcaattatgttttgaaagccttgagtactgtggataatgatagtttcctgtgcatctatacaagcttttaaaatctcagattcctcatctgtaaaacagaaatcattacacaaagcttgtggtgagaatgaaataaaataatcttggtaaagcactggtgtctaaaagttcaatgaattatagccgtattaataatttctgttgttattattggatattattatagtatcattgaaagtgaattaaacatatacatataccagggtactgtgctggacgtcagaaataagttaaatattccagaagaaacaagatctttataaataatcagaattctaggacaataatggataaacgacttctgagttattgtatacaagtgaccggcaagccttgtcaattctagcttcagttaaagtgggtgattgctggggtgcgtcttggcactgaggcataaaaggttagaggagaaaaaatcagctgggactgtggtaaaatggaagctgggaccttggtccgtcgtcaactggactctccagtcttgtagtcttgtccagattttcaagggttttgtttttcagagtagcatgcagtcctcttgactattcatatatacacacaggtatgttcttatccatcaaggtctgctctttgctgtaacagaggtgtggaatagataggagtcttggagtgtactggtggctcagctgcatagagaatcattcctgggtattctagaatctctgccagtttctgtctctgctttctccttgaggccaggattgtgaaagtgggcttttaaccaatactttcacaatttaaagtcaccttttgtgagcctccttggcactcaagtctgccccccagcacactggcatctagtacacacacacagtaactttgtttcagtaattaatcacattattgatatcagtgaggtcactgttttcacacaagagccaattaaaagtaatttattgactacattttatttccactcatatgtatacacctcaatgcagcaccttaaataattatattattacaacttactttgcctttgctattgaaaaggaaaatatcattgagaaaatactgctttttagctactgagccgtttataaacgtccagtttaaaaacatatttgaaaacttacaatgtaaacaaaacactcctagcttatatgttttagttgacacatgttttcctgggatactttgtcccaaacacctgtctaagtatgctacatatgtgaattcattttcttctcataacagggggtaggagatattatcatcaccattttacaccaaggttcgggagttagcaatttgcccacagttacacaacccctgagactggttctcaaatttcagtccagagttcatgttcttcagtggccctgccatactgtcttacattgatatggtgctttggcattcaaaaagtgcggtttgcatgtctgatctcatttcatccttaacatagtatgtggcagcagatagaattttcaatccactttacagatgaaacaactgaggctcagagagacaaagtgttctagtagcaaatgtaaaacagagttgggcccaaaggtattttgttttattcattgactggtgtgtgtcactggctgtcttagggctgaaatagaaatggatcagggcctcccacaccccgcaactcaccagtgctaccagtttcccacagccctttgatttctgcagctgggtttctctagttagtttgaacactcagtgacctggccacttgtctttcatatcttactcttgccagaattgtagaaataggttctatatttaattattttattgattgattgattgattgtgagacagagtctcgctgtgtcacccaggctggagtgcagtggtgcgatctcggctcactgcaacctctgccccctgagcctcctgaaggcttctcccgcctcagcctcctgagtagctgggattacaggtgcacaccaccatgcctggctagtttttgtatttttagtagagatgaagtttcaccttgttggtcaggctggtctcaaactcctgacctcaggtgatccacccacctcagcctcccaaagtgctgggattacacgcgtgagccaccgcacccagctgctatatttaattatttaattcaactattaatactttgtgttatactttatgaaggaactttgatgtttctgtttcataatgttaatgagactgacgttacaggtatccttcattccaagatagactacgttccagatttaatgattttcttggctagccttccgggtttttcctaacaacaaaggtcttcctgaggccaattcatcatgtggctacattgaataagtgaatatttctatttgatggtgacttcgaatttgagaaaaaccccacaaaacttttaagtataatcaagatctactatgtaagaagtatggccgtaagttaatgaaagcaacctcgtaagtctcatgtgaaagtagtttaccatagtgtttgccttcatatgttcttagtcccttctttattaatttatttttgttaattactgtgtcctcataatgatgttcattccacaggtagtgccgtccagtttgcttataggggaatgttgaatctgtgaccttaattatggatcacagtggaacttctgtgaaagtgaatgtcagtgctagccaggggctgtgttgtttatatcacgtaggctcaagtgaataaattagcacatagttctgaaattcagaagctgattttaagaacatattgatgaaccaaagttgtgtctcaatatgactttgtggttattaggcaaactcttttaattccatagaggacagagggtagctttttccaccatacagtgttaaataatattctcgctccgtgtttgtgaactgaaacaaaagatagattgaattgtaaagctctcttgacaaatgagcacgttttactttcttcctgtatttttcttctcttggcttttgtgtcctgtgctttttcccaagcagtgttatgcaaatgaaccaattaatggtagataaaatggtcttcctacctcgctgtgtctgtaactagaaggacaacaccgtaagtcacgtacctattcagcgggttctataggccactgtgagggtctgattagcttgactgtggaagacaatcgcagaggcatctgcttggttaattttgagagcaaatttaccagatggaggctgaagatttaagtgattagaaggtagtagattggaatacaaattggattaaaagaaattagattgatataaatcgaattgagtcacaacagtttgtgttgttcgtaccaagggccagcagattatgggagaagcagatgctccaatgagataggaattgatgtggctttgacagtccatctgcgaaggtctgaatatcgagtacatccctaatctccctctccatttatcaatgccataatgttaattagtacttcattcattaagttacttacaggagaaaaaaatctcacccctatcccctctctgctcgagaatttgttattttgccaagaactggaaagctctcttcagctgagctagctacagttgacggtaagggtagacctgtgtccttttcctgatgcatacaactgcctgtggtatgaatgcagaaagcttgaaaacatttgctcgtgtgtttctcttcataaatatatagttatttggaagcttacattattgcttaagcattattccactaaaaaggagtggatatattaatcggattacataattatgtatattttacattatggtttttataaggtattcgccggagttgcctgttttgtttaatggctcaagtatttgacattaatattgagtggtatttttcctccttgaggggaaagatgagaaaaattttgttctcatgattctgtgtgtttatactcacgtgcatgtttgttgtgtgtttgacatctatgggctagtttattagattatggaaaattacaggttactgacactatcaagtattttgatatccagtgtttgcctctgattgttatagaaaaaaagttaaatgaaataaaatgaatataaacacatcactgtaaatgcttgtacttatattgggaatttgattctttacaatccaaggggcattgacacaagagtctcattattacgccattggccacagcagtgaaattcagcagaaggcaattctgtcttggatgccatccaaaggaactgagccagtggagatccaaaggtgatctcacctctgaggcagcttgagagtgtgcactctaaggatagccatgaagaaatgcccctgtgtattcataaccatcaggcaaatacaacttctggagactaacgtgatgagctgggcaaaaatggaacatcaaatcctgtgatgcaagaagcatatcattaaaggttgtgccaagtcattcagaaataatcatgatacaggcaagtgtgggctgcctgccagtgtgtgagcacgaagaatttctatttttgttatgttgaagggaggcagtggcttgtgcaaaagtgtgttaagtattgtaacattcttagtttactgaagaaaattctatgagcaatgagctcttcaggcaatgtgcttaatgtagaagtgctatatagctataaatggagatgtagacacagatacatatggctgttccttattcaggctgacctggaattctcctgcatcctccccaaactccaatgcttgggtggttttggtaatcactcttaatattggctaaagaatccaatactttaaaattccccataccttcacttcagaaggagaaataccctgccctccaggaaccaggactgaaactgaggtctgtgagaatccagattctatgcacaccaactgcataggccctatgtttaaaaacaatgcagagccggtatttctaattgtatactaattgatataacttggtcataataagagactgttttaagctgtattccaacaaaatttaaaaaggagagggaaaaacactaacagattagcctgcaaagtataaagcatagagcagaatcacttcttgtagtaaagaaaaattgctaacatttgttattgctattgtgatagtgattaagtgccatctaaaaataatttagtattcagaggtcactccttgttcctgttttgacacttcagttttcagcctaattgtcagttgtctaattggtggtggttgtcttcattaagaaacatcagtacatcaaggtagtgctcactgagcctggcaaagtcatggattatgctcttagccctgcctgtgtttctgtgactgatcattgggtatttcatatcttttttagcccctgtgaggataactaaagaaattagttggttgtaaactaatgataacagggatacaacctccccatttcctgattgttgatgaactttagactgttgatatatttctcctgtgaaacatatcaaaagatatattaattaacagatatatatatatatgtatatatttacactcatatatacaatttctttcagtgtttggtacatttgattcaaatgctacatagtaacattctatatatatatatatacacacacaatagtgtattgtatgtacactctagtatgtacaaatgtacttgtgatgagtgaatgtgtatttatgctactacacttaaaacatttttttttttggctaatctcacaaggaatgtccagagattaaattgaggcccctatttaataggagattctttaaaaaatatatacagtatttaaatgtactcacaccaaatggaaaaaaaatcagccagattatatcagtgcctccatcatcatttcgggattcatatctgaggcagttggcccatggacctgatttcaatatgggcagtttagatacatatgtcaggcacaagctacctcgatgaaatagagaactctgcatctcatttctccccctgcagtcagcgtattttttcaaattttcagtgaactaaaaaaatgagaaacacagccaagttctaatatagtaagtgatgttctggcacctttgaccataaatcagtgtcacaaagacctcatggcagcctgagtaaattctgtccaaataaacgctgagccccagcgtggaggttcagagttttgtacttcatcgtaacactcatgaggcaacttgtatgattctggatgcgtaagatgaacttaggaaagtcccaatttgtaagtcaatttgatgaataagtagatttattctggccaagggagtataaaaatttagaaaaccccataaaagtttgagatttgcctgggcaacctactttgtgtttgtttaaagaaaagcaatcactaactgttccaaaatccgtttgcattttttctaggaatggagtgatgaggaaagggaaagaacatacctggaagagagaaacgatgaggcatttaggataatgatagtgtgaaattatgtcgagagacacagatggtgactgtggaaatgagaggcagtcagttccagacacaaacctggagaaagaaggaagaatccacagaaatgtatgcctaagcggttatgatagaaatggaagagttaaaccccacaaccgggattctgagcattagggacctggagaaagatggagttgatgtcaggaaggagagatgatgaaatatgggacgaggagagaggtgagggtttcattcttagatagatgaaccttgagttgatgactgagcattcaggtggtcacccgaacaaagcctagaactttccttagctggagatactaaacccacatttggctgttgttgtcatagagataatacctgaacaccatgagagggaatgagttctctgtggaatgagtgaattatcttcattgaagggaagagtagacatctaaggcatacataccttgggagctgttaactattgggtcagaaattattagacaattcacacttctagttcactagtttacataaaactcaaatatttttttctgttatttataatggaaattcgtaacaaaagtaaccagtaataatgttcttttaaaaaaaatttcaacagcagtgagcgcatcactaaaacactaaaattcagttattattgcctcatttgaaagtggggaaaattacgtggaatattaggcaaacatcattaaactcttaacatttgtatacttttcattttcttccagattttcagttgctggttgtttataagatccaacttatcagagtttgatatattgaatattttatggtaaaggcaacttcctacattttagaaataccaccctgttcgaagctatcattattctgtgtttcacaaaacttatcactttacatttttatacctctgcctgccagcatttttctttccttttagcataatccagaataattctgtgttccactcttgtgctttgtgacaagaaagcattgcatttcgagagtggctggaaggaggttaattccatgtccacatggtaataacctggggaaacctggggatgatcagtttcatttgatccctcctctgataaggcttcaaagtaaatgggctgagtggaaaacaacattattccataacttttctctaagctgcagatgttttttgacagactcaaggaattgagactcatatattttagtgaaacataattcaagcagaaaaagatcatttgaaaacgtttattgcactcacatttgctgctcttctccattcagcagaaaaataagctcttttttctctgtgcacacagaatcttttaactgaaaactacactcagtatttgtgttgcagcagtgatgttatctgctggtcattttgctctgaaacagaagacatctcctgaaaggaaatttaaagttttattaaatgggtcactaaaaagccatcaatagatatcataaatagacacaaatgaagagaaagtagatccccaaatgaaaagtatcctgatcattaaagtaacttatattctttatctactaaaataactcaagtttgcaatctaaatgtaaccactttgcatagccttactacagttgtcacatcaaaactgttatgattggccaaataaaactggagaaaatgtttttattaaagacgtaaatttatacttatttattattttaatgcattgcataaagtgaaggcaaaatacaactccaaaattttctataagattctataattttgtaaacagagcttattccaaattttagagctatttgcaactgataaaacatagcctctttttcaagctattttatgtcacaaatcttatctaaggtgtttttggtggagtaaacacttaacaatttaggtgtatatcctccaaatacccctgaagaaatatgatgctgtcacttctgttcagtttggccaactgtgaaaatccattcattgtcagtatggtacaaagacaaagccataagcccgagttgtatttggatacctttataagcctcctttgtttccaagatacaaacttcaggaaagatctccaaaagccattgtacaatattaaataagccaactcgattatggccatttccaccatccaagaggaaatctttcttttcatctttgggatcagtatactcatttttgacttgggccttttatttaaagatacacaatttcataaaggtgtcatttagaaatttctaggaaaagttattgctttaaaaggatgagaatgattttgttttgaccatctcttgaaactactggtaaaagtgcatttcagataatattcccattcctgtcatctcataagtcatgttattgtgccctcaataaagtttatttaatatcccttagttatctctaaacttataatggaaaagcaaccaaaaaaataaatagatgcttcctatgcattaatcatggagtcattccaagatttttataatgaaaaataaacagcgttggtatatatttcagtaaaatagtttagagggacacagagttattaggcatcaacatttgctttaaaaaggccgttatcttatagatcgtggttcattgtttttaggggggttacagactcctttgagtttagagacagaggttatactaataaaagagttatacattataataatgcttatactagtagggaacatttattgagtgcttgctgtgtactcagcacatggaaaaatctcattcaatcttctcagcaatgttattcgactgatactgctatgttttatacatagggaagcaagatgcagagaaggtaagaaatttgcctgagttcacacttcttttcggcatttgaaaaagaaatttcaagtcagtcctactgacagatgatttctattaactaccaaaaatatactttatcatttcttaaaaacgaacatgcacatatctgcacaaaattttgcatccggtgcctgcagtaccatcccttacctccattccacataaaccaatccatgatttatgaatcacatttttacaaataatggagtaatgcaatgatatttgcaccttaggccaaattctgtagtaaatgaatgttgattagaaatgaacaaggctaaaatcagtcattgtgtgcatcccttggacatgatgcaactaacgcgtttggctcatgaaggctataatttttctggtcgtgatttagccattattcctttaagaaactattggattgtaatcttattttccatctgtcttttaaaaatcctttctatacttatataccaaaataagtttgtctgaaatttcaggtaggatcattgaatctcaatttaactttattatgaaatattttggggtacaggaaaatttatcaagagtttctgacaaatgtattaactaagtatttaacaaagcttagcacacacatgcataaaatatcattgctggtgggaatggtgttttttagacattgacactgggtcttttggcatcttcagttactaagattaatgctactgctacagaattttcagaatatagaaacagaaggaaatataatagaaagtcaaaatgatatcactccattcagagtttatttaagtaaaatccccttttctggagacacactcatagtcttcattaaataaatgtcaatggtttttagaaaattaaacattattagacaatttaatgatttttgagattgtttcattgcatcaccttttgtaaagccaaatgcaatttcaaaccacatgaaaatattataaatatgataataacaagccagattttaaagctgtcttcctggaatagggattgtttttgtcattgaaaggtaaatctgcataagccatgaaaacctctgattgggcagtaaatcacactttaaagaataccttcaaccatgtaagatgtagcaaattgatttgaaatagtattggatgaatatccaggttaatacattggctcctcactgaattgttggaaatgaatttataaagtagaagagtaatttgttattaagaggaaaatcccccctaacagttttctagaaaccttcagattaggagtttcaaaatttatcttcaatattatatatacatgtgtgtgtatatacagatatacacacatatatacatgtacacatatatacatatatgtgtgtgtacatatacatatgtgtgtatacatgtatatatacatatatgtatgtattcatcatggagtcataggaatgttgtatatatatacacacacacatatatatagatgcacacatatataaagacacacacacatacataagaatatatatatttctattgtatattcatatatatattcttagttgtccacctgtggttcgattgccttcagcttctgactctaacttacacaaaccaagcctgcactccctacgggtgctgaggctctacctgtcactggggcccacttgctcagacagtcagtggctcaattttgatgtgggcagccaggaaattgaatagcattttaaaaatgtgattaagacttagctgataaaggcactgaataacatgcggtagtggaggaaaaaacaggggaaaaagtgttctaattttcatatttttagcaatttctgttaatggtagataagtaaagacctgagatacaattgtgaaattcaggttgaaagttttatgaatctttattacttaccttcacctgaaagatcaactcattcaccctaattaaggaaggaaattttaaagatctttgctgaatgctgaaggttttattttacataattaattacatatctatttatttgttacattttattttattttaagttctgggatacatatgcaggatgtacaggtttgttacgtaggtaaatgtgtgccatgatgatttgctgcacctgtcaatccatcacttaggtattaaccccgtaagcattagctatttattctgatgctatcactccccacgctgcccctgagagaccccagtgtgtggacatatttatttttaagatacctatccaatatagccagttagtctttggttaaaatgatttgtagagcaatgcatttactgacaatatggataaattttatagaaatttaggaataaatttctaaggtacgttttcagtcttttaaatcattgttaacttttggagggttttctaagaattcatgtgatatccattgcttttgacagcagatacaagacctacaaaggccaacttttgtaatctatacatttatcaaaagtatgaacagtaatctaaagtgtgtattttttaaagtatgtaccctgtgttcataaatttaaattgctactcattatgctttcttttagatatgtctgttaagatatcattaatgtgacagccataaagagtatgatcatgctacagaacaatgagactgtagcaatttactcttccacttacctcaagtttgggatgaataaatagtacaaaaaaccagtttaggtaattgcttaaggtgatataactaaccatatattggtccagataaaaagccaaacaaaaaacaactgaaatctagtgcttgggattttctaataatattttagacttctaaaatgtgggtaagaagaaaaagtcatcctgaaaacagagcttggacccacagctaagacaagtatatccttctagttttggttgtgagaaagaaacttcagttctttagtactctatttttcctcctcatctataaaataagggtttgtaaaaggacctctgatagcttaatcttctgttttctgcatctggaaagcaaggtcacagagatgttgcagggtgctattttgtacaactggaaactttcagaatcaaggctgcctgttgagtttgacaaacctcttttatccttatcagttccctttcacactataagccctttagttttaggacactgaaaagttattttgaaatttttctaagaaataagtagagtttctaggtctcaattttgattttgtttcaaatttagacttattaagatggcactgctgtgcttccagaaggaataataatcttataaatttatttaggccaatggcaaattaggaagtctcctgagagagttttagcaaatttcaaatggataaaatggacttcgtgttttccaaatattgatcttctcagcatatcctaccacatcactggacctctagaaaaaaaaagttatctcataatacttttctattccctcctccctcataagcaaagtaagctggaatttaatcatcatgaagaattcaaagatggaaaagttgttatggacagacttgatggattgatggcatgattcattaattccattaaattgcaaattaccttagctcactaatcaatgtagacagcatttgcagtggcactgagatatgtttccttcagtgaaggaaattttgaattggatatatttttgactaacgataaatagtaacaactaattctttggaaatctagtgtaaagctatcagcctggtccagctaaaatgtatcaagcaataaaacattaatgtcagaatcatcctcagcaaagataaactattgactattgtcaatgggattatagagttttatgggctaaattttggaaataaagtttagagttggagtatttgtcatgttttgcagaaggagaaaaaaatactacactgaacgcttactgcccatcctggtgatccatatatatgatttcttttaatcttctaaaccactcttttttttttttttttttttttttttttttttttttttttttttttttgagacggagtttcgctctgtggcccaggctggagtgcagtggcgcgatctcggctcattgcaagctccgtctcccgggttcacgccattctcctgcctcagtctcccgagtagctgggacgacaggcgccaccaccacgcccggctaactttttttgtatttttagtagagacaaggtttcaccgtgttagccaggatggtctcgatctcctgacctcgtgatctgcccgcctcggcctcccaaagtgttgggattacaggtgtgagtcacagcgcccggcctaaaccactctttatagcattgatgtcctgatctacctgttacaaatgaggcatgaacgttaactgatcaataacctgtgttctttatttgtaccacactgcctccttcctattgcgatgtgtcaggcaaccttcaccttttcgtgtagtgctactgtatctgtcatatcagcaggtggctctgatcacattcagaattgaagtaatcctggagaatcttcctgggttaattctatttatatcgttttggggaacaatattttgttaaaacagacatagttatggctagaacatactgttacatacatttttaagagagaaaaatgaacacagcatagaaattttgctggaggaagtatatttcacactctgtccctaatttgccgagaatttcttcggccctcagaaaaatttagaacagcttgaaatacattgcttggcttgtggagggactaatagctgatagggctatccagtttgtaaaagaaaaataaaacttggttcaaggaaatactatactccaactcaatgaggcagagacatttactctgtaacacatgaaatgaaatcaacaagtattctaggtgcattttcctcctttattatactacgtgattgaaatctcttcctgaaaacaaatgttctctggcactcactgcgaatgagtggttactgactaaagaaaactaaacttaaccatattcatgaattataatttatacatcaccttcaaaaatttgaagtgctaatataccactcaacgttgtaaaatatcaaatattttatcaaaaatcattacaaaatcattgtttgagagtctctgagaagcagaaataatccattatgcaaattaaggtgcttagaacattattcacagatgcgtctgcatctggctgacgaacttgatgatgctgtggaatgctacatctagccaggtctaagtgtgtgatcttctggtaagcatggaaaaaatgcagcttcttggaacctttcgctggtaatttctgatgcaccttgttcactatggagactaagaatctggtggccaggtaaggtggctcatgcctgtaatcccagcacttctggaggccgaagcaggaggctcgcttgaggccaggggttcgagaccatcctggccaatatgacgaaaatccgtctctactaataatacaaaaaattagccaggtgtggtggtgcgtgcctgtagtcccagctacccaggagtctgaggcacgagaatcgcttcaacctgggagacggaggttgcagtgagccaagatcataccactgccctccagcttgagtgacagagtgagtctctgactcaaaataaataaataaataaataaataaataaataaataaataaataaaaagaatctgtattttaaagaaatatcttagtgttcacttcggcagcacatataccaaaattgaagcaatacagagaagattagcatggtccctgggccaggatgacaggcaaattcatgaagaattagaaaaaaaaaatcccagatgattctgatgcaggcagtctgagaatcaggctttgaaaaacgaggaaaatgttttctgctgaaattatgactagcgacattcatgtgatacattttattgaaatgaaccttagaagaggtctttggaattagcctagatgccatgtgcattctttacttggtgctccattcatttctaaagaagcctggcacattttggattaaaggtcatgagttctaattctgcttctcctatctattcaattatggacaatttatgtgacaatttcacaacttactttcttggacagtaaaaataaacatttggatgttcatctttaggatcctctgaacaatttttgttatctctcttttattataaaagagagaaagaatatatatagtttatatattattaatatatattattttaattaaataatatatattttaatatatattattatatataatatataaatttgtatatattttaacaatatatattattttaattaaaacttgactgattgcccaattaataattgagatataaaaagataccagacatgatatcagtcacaagcgaaattagaattgtagatagttattttcatacatcgcttagtatatctgttctaataggaatctttgaataatttctcattatatgggcaataataacattgctgtcaaactaattttcatttgaaatctgtagaagagatatttataaatttataaatttatttataaaataaatttaaattaaaaatgaactttgtaatggaaaatgatatcaggtactcttgagcagggtgggcaaaccttggtaaatatttcaagcttcacaggctatgtaagttttctttgttaccacttcctcctcctcatcccccttctcttccctctccccctcctcttcttttaaaaacattgttagctcagagccatacaaaaactgatgtgagcagtgcttatcaaacggtattgtgcatacaaatacctgatgaagagaggggaatcttgttaaaacgcagattcagatttcagatatgctggtatgggcctaagatcctctatttctaatacacctttggatcatgcttttgttgctagttgaggggctcacactttagatgtccaaaatgttgaggttgagctgtttcatggcacttcctgtgatgaacaacccccactcccccttactgttttgttctcagtccccagtgagttttgctgacaactcagctttattttttgaccaaataatggagttgttttagccaataacatagaatacccagtagtttagtgctccttgataatcttaaaggcccaacatctttgggaatatgatgaaagctacacccccaaccccacaccaccactactgcctcccccttaacaataatactcatttccacacacagttttaaagattccaaagacttatgcattgggtccatcgtaaagaccactgctattgttatgtaatgtctgaatttaagaaagctcagaattaatccccatatttttaataacattgtaaaacttagattgtaaagctgtatttttgtatatctatgtctatctttctaatctatctttctctctctctctctaatctatctatctgggtggtgagacctttaaagttcactttatgtcctaattatctattgcaggcctgatgatttcattagaacctaagattataaatgaagaaaacagtgttaactgttgttaggagtgagcacaaattgttacacaccttttattaaacttgttcacagtgctcttttatctatcaaatttttaaaaattgctggagatataattcatattccacaaaatttacccaaagtataaaatataataatctttattacattcacagagtaatgcaaccatcactgtaattaattttagaatattttcatcatccctaaagaaatcccatccccattggcagcacttgcccagacccccttcattccccacttccataccccagccctaggccagcattgatctacattctatgtccgtggattttccttctctggacatgtcatataaatggaatcgtacaatatatggtccattgcaactagctcctttcacttatattttcaaagttcatctatgttgtagcatgtattattaatacttcatttttaaggctgaataatattccattatatggatatggcacattttatttatccattcatcatggatatttatgctgttgattctttctttgttatccattcagttggtagacatttgggttgtttctacttttttgactattgtgaataatactgctatgaatattcatgagtaagttttgtgtggatgtatggtttcattctggggtgatatatatctaggagtgaaattgctgggtcgtatggcaactacatgtttgacattttgaggaacttccagattgttttccaaagtgactgtatgatttaaattcacactagcaatggatgaggctttcagtttttccaaacccttgacaatacttgttattttacattgctttgattatatatgtcctagtgggtgtgaagtgtatttcattgtagtttcgatttgcatttttctaatagctaatgatgttgagtatctctttatgtggttatggctatttgtctaacttctctgtcaaatttgtttaactacttattctaatcctttgcctattttaaaatttgattatttatatttttattgagttatgagttctttatatattctagatacaaatccattattgggtatatgatttgcagattatttttctgattctgtgggtagtattctttcaagcacaagtatttaaaaattttataacatccagtttatctctttttttcttttgttgcttatgcttttggtatcatatccaagaagccatcacctaattcaaaatcataaaaaacttgcctctataatttcttgtaatcatttcatagttttactttttatatttaggttgtagatgttctttgatgtttttattaaagtaggagtaaaattacaagaagagtgtcctgatatgacagtactataatctttatgtaacatagtttacatatattgtaatgataaatgagtaaaattcttcgtgtgctcattggacatactggagtttaattttattgctaaatagcttagctattttttcactttttcttttataaatcaattattttatattttatttagtaagtattagcatatttcaggtcttattcagcccttatccaggcctactgcctaataagttagtgcacaagttgatatagtaaatagcaccctagtagctatttacttgcttacttttaatagtagaacagttttgcagtagggagaatgtaggttactgtgcatagggagattcatggagaacaaaggggctatctaaacagatgattgtaacctactatatgcctgttacatgaaaagtgacataaaactcttgatgtattttaagatcagagtctacagctatgtgtccagacctttacattgagaatatgtttctgatttgcaacctacttctattcagccactcatgtttaaatactttggggtctttcttgattatgaatttaaaaattcattgttacttttgtattctgtaaattcctcattgctttaagacccagtactcatgatctatatcctttattattgtgatgtatactgtaattacctatctagatgctttggatctctttagttttttttttaaagttctgacctgtgaacagtaaattactcttttgctttagatatctaacacttgtaatgtatacattcttttttggtctgatgtgattaaaaaaatagcaacttttaagagttattcctcttcaaaaaaataaagttcatttaagactaaattaaattccctttaatacattaaaacatgtattttcaattaatactgagagtgaactgaggtaacattgacaagtaaatattactgctatctgttgaagagaaatgtgctcatattaggtgattggttggaaaatcttatataagagcaaacttttaagaagtgcttatctatataatcattatgtccccatatatggtgattcctctcagcatctcctttttatttacttggagcagctggtagaacattttcatgaataatggtaattgataccatataaatgaaaaatattcaaaataacacattatgcaaaaatttgattgtgaaatatcaacagagccttctcttcctatttcttttcttttctttttctttttttttttttgagatggagttttactcttgtcactcgggctggagtgcagtggcacaatcttggctcactgcaacctctgcttcctgagttcaaacgattctcctgcctcagcctcccgagtagctgggattataggtgtccaccaccctgcctggcaaagtttttacatttttagtagatatgaggtttcaccatgttgggcaggctggtctcgaactcctgacctcaggtgatccacccacctcggcctcccaaaatactgggattacaggtgtgagccaccgtgcccggcctctctttcgatttcttacgccccttatggccccacttttattgcattcacagggaagtcactggtacgatctatctttctttgtactgtgcatggtgatataccaaattctgtcaagcattttgatatggtatatttttccttcttcttttctacctaaaccatcatttcccaaagtcaggttctttttatttttctcttgaactatttaagtaaatcacaactgtcttcgtgtctccgttgctatcccttattgataatacagactacaagtatctttcgattgtacagacagtcatgtcactgcccccttaaaaatctgtgagccgtgtaaaagaatagtcatacccctgagcatggcacaaagccttgtctcaggctccaagactgtcttaaaccttttcttgctgtatcagcttccttcctgattatgaaatgtaccatgcacgtaactgtcatttccttgtccttttgctgatggtatctcttggcatgatgcttttttcttttagttgtcatttttcattctttacggctcaatctaaatgtaatttttttcggggaagggatctcttattatgcttaatttagggttaacttttactttttttctttctgcctatagtgcatttcttatatacctctatgcagcgtattgcattttaacatacggatttatacttgagctcttcagtcaaacacacctgagttcaaaatcctgcctctgctgcttgcctcatctacatttctgggcaactgacatcatttcctaagcttttgcctcatctgttaaatgcagataatatttgtacataatttacaggtctctttttgtgttagtctgataacatattggcagcacattaaatgctatctatgtgtgtcttctagctgcttgctgacgtggctttcttccccagtgtataataagcaatctgaggacaggaaattagtcttactcatcttagtacccatgctgatcccagaagaacaagaaagtctcttgttctcttttacttttgcttgtcatgattcatggaacacattaaacctaactcctttgagttaacatattaatttattggtatcgccctatcctgcaaaggagttgagatgacttatgagatgcatacacaaaacgaaacataaaataatgttcagttggataatcgaagagtttaatttccccatcaggaacccaagtgaaaccgagggtttagataaggaaatgttaaagcttgtctttattccgtcatgttttgtaggatcgcgtcttcgccaggaggactttcccccgcggattgtggagcatccttccgatgtcatcgtctctaagggcgagcccacgactctgaactgcaaggcggagggccggccaacgcccaccattgagtggtacaaagatggggagcgagtggagactgacaaggacgatccccggtcccacaggatgcttctgcccagcggatccttattcttcttgcgcatcgtgcacgggcgcaggagtaaacctgatgaaggaagctacgtttgtgttgcgaggaactatcttggtgaagcagtgagtcgaaatgcgtctctggaagtggcatgtaagtgaacataatgaacctcatgtgcacatttacttttatttatttcaagtaagttttgatgtgttcccatagacgctgaaacctaaagaatcaatcaacacactgcataattttacttggtcttcttcagagaagtctggtcaagatagtatcaagccagggtgttgtagtaagtttgtttatatgaaatcaagatgaccaatatgttattataagaaagcaggccgggcgcggtggctcacgcctgtaatcccagcactttgggaggcggaggcgggcggatcacgaggtcaggagatcgagaccatcctgggtaacacggtgaaaccccgtctctacaaaaaatacaaaaagaaaaaaaaaattatccgggcatggtggcggcgcctgtagtcccagctactcgggaggctgaggcaggagaatggtgtgaacccgggaggcggagcttgcagtgagccgagatcgcgccactgcactccagcctgggcgacagagcgagactccgtctcaaaaaaacaaacaaacaaacaaacaaacaattatgccttaaaatttttgcactcttcagcttccttgttgtcatgtacgtcttcaaagataagagaattgggagatttcaggatgctggaatcttatgtatatagctatatatattttctcctaaataatagctcatgggcctgtgtctttcttttggtaaacaaaattgtacttttctttctttcttttttttttttttttttgagacagtgtctcccgctgtcacataggccggagtgcaatggcgcgatctctgctcactgcaacctctgcctcacgggcttaagcgattctcctgtctcagcctcccaagtagctgggattacagacaccaggcccagctaatttttgtatttttagtagagacggggtttcaccgtgttgcccaggctggtcttgagctcatgacctcaggtgatccactcgcctacaatttcttatgtagctatcccaatgaagtttttcgttctcaggcatctgcttctgatttacagtttgtgctaagaaacctggaacccccggatgctggaaatgtataactccaataggaaaagactaggagaatcctaagacccatattttttattttttgtgaagtgccttgagctatgagcagtaggactttagttaacaatgggattttgtactggccaccaaatagttttatttttataaaatgatacttcaaaaagccctcaaattaaatgcaatttgaaatacacacacaaaaattcaagaatgcaaatatccatacctgttccatttttgttttgaaatatctaattttggaaacttttcaaacatattgaaatacctcaataccaaattttattgatttttttcccccaacagacccttttatggtgaatatgactggcattattctcccattttcaagataaagaaaatgatgcccaaaaagtttaggtgaccaagattcagacaataaattaatggggatgctagaccaggtcctgaatcttctaatttttatttttagggaattgtgtcatatttgaagaaacactctaaatgaaatctggtctattttaaatatataaaaattaagaaattttaatttttcatttttaaaattctatctactcagcagcaaataaggtgtttaaatccttaacaaaattttacttttcaaaattaaagtatataaaaattgacctgtcattttgttgtttcatctaaaagaattgctttcttttctaattgcgtcattaataatgaatcaaactgttctggtgggaatattttaaaccatgatttttgtgtgtgtgtgtaatgtgacagtaattttttttattttgaagtaaatgagctttaagaaatacttgaattactcatgacctagagaggaaaacaagaaggcttgcaaattggattagggagtgaataaaatccctttttctaatgccatgtcaacagttcattccatttgaggcatcacaaggtcaaataatattcatttatatgttgctcatctctttccattcgctcatcagtcttctatctttccttatgtgtttcataaaacatattaatatggaaatttgggttaaagcattgtgatttttcactacctattggtaactaatatgtattttcataaaatgacagaggaacagctgtagaggaacaacttcagattatgttaaattggccttcatattttagaaaactcaacataaatactcattgtggtgcattcacttagtttattaatagaaggcggatatccactgaaagaggtgttaaggaatagcaatgaagacacattccaatgtattctcaaagagctcacattctagttgggatgacaaacatgtaaataaagagttactataataaattaaatatacaaacaataaagcctattataaagacatgtaaaaatactacgcaaatccggagggaagacatttaattcttcctagataggtaagcttaagaaatgattctaagaggatacattactttcacagtgatttaaggtcatttaagaatgtcccaggtggaaattgaagtgaaagaccatccaggtagaaagaatggaagcttaaatgaacactgtgtattcggagaactgccaggtgtctggatatgaggttgagagcagagtaaattggaaaggtaggcatgtgctgaataaaaatctaagctattttgttatgagaaaagagaatctttgaaagagaattgaagattgcattaaaggtatgatgattgaagtcagagaggcattaagtagctgtcaaataattcagaaaagagttgatgctagattctgaactgaacatagcagtgaagattgaaaggaggaaacagcttgaaacatatttaggaattataaactatgtgacatgatcaatgagaagtagaggatgattactagatttgttttgttttgttttgtttttggttaagtgactgggtatatagtgctaccatccatagaggtgaggggcaggtacaggagaaataactctagggaacagaacagtatggtaaacgttagctgtattgtttgacataccaatgaaatagtaagcttaaaatatctcaagtttcattaaagaaacagcttcttctagagttgaggggagaggtctttctgagataggtgttgaagccacggaagtatatagaagtagatgtgatttccaggcaggctgtgttcagggagcagttaataagggctgagtccaattccagtgcttagaacagtaatatttagtggtggtcaaggcaagaaatgctcatgcaaaaggatcagtctcaggagaggtatcagagtgatagaatatgggcagtgaagtggcaagaataatcaaggaatacattaaaaaataataaaattggggccaggtgtgttggttcacacctgtaatcccagcactttgggaggcccaggtgggtggatcacttgaggccaggagtttgagaccagcctgggcaacatggtgaaaccccgactctactaaaaatacaaaacttagccaggtatggtggctggcacctgtaatcccaactactcaggaggctgaggcaggagaatcactcgaacccaggaggcagaggtggcagtgagctgggatggtgccaatgcactccagactgggcgacagagtgaaaccctatctcaaacaaacaaaccacaagagtactaaacatggttgacacgatgcaaatcccaaatgatgatcaaataaacagtacctgtgggctccagtgatggggacagaacagctgaagagcgagtagtggtgggatggaagtagcaaatgctgccgggtctttcctagaatggagctctgaatggagcatggagaattagagcagggtacctcaacctctgcattactgacatttgggatcagaaaattatttagtgtgtgtgtgtgttgcgtgggtgggtggattgtgctaggcattgtaagatgtttagacatacctctggcgtttgttcacaaggtgccaatgggattctccctagccctgttgagacaaacagtatgtctccagacattggaaatattcctcaggagagaaagtcagttgagaaccactgacctagatgtacctaagtagtcaagaatgtattgatatgtaggacataaacatgtcacaacttttatcataaaatgattattgattaaaaatatggaattttttttactattttttattcacattagttgtcatttttaatttcaaaaatgttcgattctactatgatacgaaatgtggaatgttattgataaccatctgtcttgactgattttttggaagtcagccagttctttaccatactgcattcattttggtgtttgttttcctttaatacatgcttcacctttatgttctggaacaatacagcagagggaaaaaaattcaggaccaatcattgcaatgaatcacctcaaatttgcttttatttttttcttagtttgcaaaaaaaaaaaaaaaaaatagctatccagaaagtgttttttgagtcacttgacctcaaaaataatctctaggcaaaaaatgttttttaaatagttagaaaacagttgcagagttaataagcaagaggcctggtagtcaaaaagctaatacatagttttccaatgggaccaccaggagagccatggtgtagctggtgcagataaagtttccgttctgaacactggcgctccctgtttatggagcagaaggagcacagggggtcctcacagagattgtagctgcctgtgatgcagctgagtcagtggcagcctctagagatggcagctgtagccccaggtggcaaatagatgacagcagcttgatctatcgaccagggtaagagggggttctggcctaaatgaaaattcatgaaaaattgatgaagtccccagattattttttccgtttccttttctcagcactgtgccagtgcagagagtagagattaaatgaggtgctgaacgctttagtggcaaggaggttgtggttcaaaggtcaggggtcacatagaaaccaatctttttttttttttcttttttcttactgctaaagcaaaacacaagaaacttttcagattagctgtgatttacctttgctttgataaataaaatgactacatgttcaaaagttggcttttgatgcagttacaagagagaacagatgtgattcataattcaagtatggaactggaaatagattgaattccatgacttcaggatgattattttttctttttctcttattttttgtcttctgtatgaagactcatgctgtatgaaagtcatttagagaagaagaaggtcttgcattatttatagggttacagattgcgagaatagcaaagctatggaacactgtccaaacataatgctcctgtttgcttaaatagaaaattaaattgatggtttatctgtacaaagaagagaggctacagaagtagactgactttagtatgagagggcacaggtggcactgaaaatgaagacaaggtaaagagcttccttgatctcctcaagttaataaatatgtaaatgtttgttttttattttattttggctgtaaatgcatcttatctaggcaaaatacctttacacatcataaagacacaagataaattaaattgcaaaaagatcaatccatagagagctttttaaaaaaaatgcttaattgagatatatttaacataccatatcatttactcatttaatatatacaagcaatgtttttggtgtattcatggggttgtgcaatgaacactataatcaaatttagaacattttcctcaatcctaaaataaactctatacccattagaactcagttcccattcctgcaccctctcaccccagccctaagtaaatgctaatctactttctatagctatacattttcctattctggacatttcatatgttagaatcatacaatatattgtcttgtgtgactataatagcatcttttccttaacattaatgttttcaaggatcctgtttgtttagcatgtattagtactttattcttcattattgctcaataatatttcatggtatcaacataaccactttttatttatccattcattgtatgatagacatttgcattactcccactttttttctgctatgaacaatgttgctatggaaattttgatacacatttttgtgtgcacatatggtttcatttgggtattctcataagtttatgcctaagagtagaattgtcgagtcatatggtaactgtttaactttttgaagaatatatatgtaattattattaagtgtagattaaatgatatttactggtgcattgaagtaactgtatccaactcacctctcaatatgaaacacagtcataaaacatttctactgttttatccatattattatgtgactgttatgttagattttctatgtcgtatgtccataatttcaggtaagagtcaactatttaaaaatatagaacaattaaccatatggaaacaacggatggccacaaagttcctaataaatccttgtgtaacttctactagactgttttcagtttggtcccaattaagttggataatcttactgtttgagtcttcacttcattttctgttctgtttgtatttgttctgaaagctggcaatttgtcttctcagaagctgacgttacccttcctgagaataactgacagtactttcttcattctcgggttactttctcttccaaatatactgaggttttttctttcacttgtcaggttcagactaagaaattaatgaacaattatactagaagtcagttaagtaagtctaagagtgggaaaacaaagaactattatcattctctatctttcttaaaacaaagaagcacacaaacaaacatatcaacttaaatgcaaactccgtggcgatgagttggactggaactaatatttacaggtgaggaccaaaaagaatataggagcaactttcgttttttgtaattttctccatttgcatttctacaaatgtcaggtgagatttcatatatttttggtggtgatggtgggtggtaggggaggaggatacttacacagctgaaaaacgctccctagctccaggtacttcacaggataatgctaatatgttattttggctgttttgtgagtgtgccttttaattttgccatactccatcaaatactttcaaatgcagtctctcctttgatcttcacaaatgaaggtgtgaaattgctacacctggggaacgtgtatgaatttgtgatctatttaagtatgtataatgctgtattttgatacgaggtttatttctgttgattgaattaactgtattcaaactctctctcaacaagtctcaagttgccattcactgacaattagcctgaattaactctgactcccaggaaagcacataaatgaagtgaagtcattgtgtcctctacttttcaaaaatttattcccataaacagtataattctgagtatgatcctgaggtctgcagtcaagtagatcctatccataaaatgacaaggaaacatattcatagtgatactaagagttcaggagataaaatatgttgaggtctgctccggttttcgatcccagaaacccttttcatataaagttaagaaaaataatttaggattttgaatttatttcttactgtaattttttgtttgtttgtttgttttgagatggagtctggctcagtcacccagactggagtgcagcggtgtgatctcagttcactgcagcctctgcctcccaggatcaagcgattctcccaccacagcttcccaagtagctgggactacaggcaggtgccaccaaacctggctaatttttgtatttttagtagagatgggattttgccatgttgcccaggctggtcttgaactcttggcctcaagcaatcctctctcattggcctcccaaagtgctgggattacaggtgtgagccaccgtgcccggcctcttactataaatttttaatttattaaatttcagctggtgtgtagatgcaagttgattttactgaaaatgtaggtaggttgacattagcttaggaaatataatttcgtgcagtaactcatatgcttttctcccaggatttgtgtttcggcagaatacagatttccaatttcccttctttagatctataattacttaaggaaggttacacttcttttaagcatgagtcagtatatatgataaggcctttacagaattatagaagtaaaaacaataggtgaagttttgtttaactatgaaagtttttgctttatagatgtttctaacagtctatgatttagctgctaagggatgaggttcaatagtattaagatattctctccactatataccattagaattgatttttcctcttaggagattttcaaaagcaattctgaaccacccatttctgaattaaaaatacttatacatttttgtcaattagatattcatccactttttgtcactgtctcccaaaaaatactctatgaaagcattactgagccccaggttgggttgtttctctaaactatttgaagttttctaacatagtcctcctttgtctactaagacgtcagtagtttaacaactctggatgtcttagtctgttcaagctactacaagaaaataccataaactgggtagctttttaggaaaataaatttatttctcatagttctggagcctataagcctgagttcagagagccagcatggctgggttttgtgaggccccacctcctggttcatagacggcatcctcacaaggtgaaaggcactaatcccatttagaagagctctgtctcatgacctaatcatcttccaaacgctccaccttcagtgacatcaccttcagggataagatttcaacatgtgaattttggggggatataaacgttctgaccacagctctggcctttggagagacttcaagcaagggttgtaagagaggcaggtgtttggatgcaatgacagacagggcctggaaattgagcttaaattaacacccaagtagagaaaaggctgttctttctcaccgatattggcagccctacacatttgtcggttcctcatctgaggagttaaccaactgcgaattaaaaataatttttaaaaactaacaaaaatataccaacaagaaatattacaaatcatgtggtatagcatctatttgcatatcatttacatagtattaggtattataagtaatcaagagatgatttaatatatacaggaagatgtgtagctatatgtaaatactatgccattttataaaatggacttgagcatccaattcaggggtcttgagaccagtctcctctggataccaaggaacgaatgtgcctctttctgagagccaggccgtttcctagtaatgcaactataaaggcaagcatcacattttttgtgtgtgattatctaacatttaagtctgaaccaagattttggaataaacgttacagtatctatatatggaaatgaaatgtaactattttttccataacatgaggtatatttgatataaaccattttatataaatctgcctgcctcattttctttcttcttgctttctttgcttattcaaattgaacaagtacattatacatatatatgtgtgtgtgtgcatataaacatacatatatttttttcttaacatgaggtatatttgatataaaccattttatataaatccacctacctcattttccttcttgctttctttacttattcatattgaatgagtatattatacatatatgtgtgtatccatgtttatatatacatatgtatacacatatgcatatatatgtatacacatatgcatatatatatgtatacacatatgcatatatatgtatacacatatgcatatatatgtatacacatatgcatatatatatatgtatacacatatgcatatatatatatgtatacacatatgcatatatatatatgtatatatgatgtgatattagagatgtgatcccactcactgtgttgcctaggctggtctggaactcctggccctatgtgacccccccctaccttggcctcacgaagtgctaggattacaagtatgagccatcagggccagagaatactttctcttaaatcaatgtttaaacatctttgttgggtttcctaatcgttaagagtaaaacgggttaaagagcacctctggtgctgggctgcatatgaggagtctgagtcgcctcaggtggcagtgaaccttccaccctggtgatgtagggtaggggccttcagacagggcatactgcaggagtgaggaggggccgcaagttgcttctaggtgagtctgaatgaaagatggacttagaaaactggaaagaagtataaaagcaaaaccctgaggttgtgcttggccagatttcgagcacaaataatgtattagcttaattggggagtagatgtagggtagtagagggagataatttaaatagcgaggtagaaattagtaatgactaaacgaattgatgagctttcatgttatcctagaacccaagggagcactgtttgatgtgggcttgttatttggaagtgaggtgtaaaaggagacatgataaacacagtgtggggtagatgggagcccaagagtgtggagggaggaaatctactgtatgttcaggtatagtaggatgaggattaagttgattaattaagttcagaataggaaaagaggagataaaatgttgaaaaaaaaggttgatagaaatttaaaaaacgcatctgtagttcaagtgaagatttaaatttagtttgctagagttttgtacagtaccttctactggtcggtactcacctaggtgttaggatacagatacttagaacaagctttgtttgatgggtatagagtttcagctggcaagatgaaaaagttctagagatctgttacacaacagtgtgaatatacttaacactactgaactgtacacttaaaaatggctaagatggtatattttatgttgtgcattttttttgccacaattaaaacatgaaaatattaacaaaacaaataaaccaccaccacaacaaaaaccaaggcatggctcttgccatcaaagaacattcaataggatggtctagaatgtggtatatgtgagagtgagggaggaggagttgctctggtgtgaaatacagaggagaaggaggctgactctgcaagagaatgtggaacaggtgaaatgattttgctagggagaaaataattaataataatctctggggcttgctaagggccaggcttatttctgtgtttcacacttatggctgattcagttctcaaaacaaatctaaaatttgggtactattattttctctctattgtatttgaggtacacagaaaggagagctgggatttgaacgctggcagcctagctctcaagcctgctttcttaattactatgctaagcatcctcactgatttacttgaacaagcaaacaaaatcatttgacacttaaaagagtcattagcattgccttaggtattttacccagaaacagttattcaattgtataaatacaatgatgacccctggaataggtgaagtccaagagtagcattttggcgcaaacaattctgtgattcctgggatatgacggaaagaaacaacagaaagagtaatcttttctatttttttatttagttacatattgacatttgagagctcattagtttattccagtaatttgattttctctgtacagttcctagttgtcaaatattagcatcaagaaaatccatcactttcagttctcattgacatgtttgcaggccaaagcagcttggagattaagaatccaatttataagacaagtcatctatcattgaatatccaaagataacttgactaagttttatagaaaaagaaatatgataatagcaatgatatcttactactttaggatactttctggagttttttgagtcattaacatatttatatgcattatttcattgctatatgtatttgtggacatttgctgacttagatagtttcaaagttcaatacatagtatcattaacattggtctatttgactttcaaattactctttttatttttttatatttaaaaatgaatcaaaggaggaagcatagccttttcaaccaatgatgctgaattaaatatccacaggcaaaaatataaatgaacagaaccttgacttaaaccttacaaattatgcaaaaattaatctgaaatggatcatacagttaaatgtaaggcataagactatatatatataaatatataaatgtaaatataagtatatatgtatatacatatatatatatagagagagagagagagaggcaagttctcactctgtcactcaggctggagtgcagtggcgtgatcacagcacactgcagccttgacttcccagactcaagtgatccttccacctcagtcttcccagtagcttgtgctacaggcatgtgtcaccaagcccagccaatttttgtactttttgtcgagatggggtttcactctcttgcccagactggtctcaaacttttgagctcaagctatccaactgccttggtctcccaaagtgctggaactacaggtgtgaaccattgggcctgacttaaaactataaaatgtttaaaaaataacgaaggagaaaatcctttgtgtctagaatttggtgaagaataaagcattaaccaaaagacaaaattaataaatttgactttattaaaattaaaactttaattcttttaaagatcttgtttatggaaaaaaaagacaagctacatacagggagaacatacttgcaaaccacatatctgaaaaaagcatatctagaatttataaagatatatcaaaattcaacattaaataaaactaataatctgacatcctttttattttaaaataagtatacacaggaagtatgtctactactagagatactagtagtatctctcttagatcctgtgaatctatacttagtacaaaataaaatattaaaattagttgtcgagctatcttaagtagacattaataatatacataaaaatgaatttggaactgaatcgttctttggaaagcatttgaatgtttgtttttcttaaatattgatgaattcatattttgagtgtccatgatctgttaaaaatcttattcaaattcatgtatttactgttttaaatttatacatttaacttgtgatacattctgtgtacagtttcatgaatttatcttcatatctttgatttttgttacatcgcagttttttagtttaaggatagattttatttcattttcttttttaggggaagggaaagaaaagagaggaatgtttgttcatgggagtttggcaagaatgcccaaaacatgacttaatgagtagagtgcattatggagctggcaagaagtccctactttaaacgaggttaataaagagatgcaatgcgtcttgatcctttgctgctaaaattatgcatggattattgtgaatatttctaagtacctgtttaaattcaccattacaactgaaatgtcactatcggagaaagatcagctgggcgcggtggctcacgcctgtagtctcagcactttgggaggccgaggtgggcgggtcgcttgagcccaggcgttcaagaccagcctgggcagcacggtcaaaccccatctctacaaaaaaatacaatagttagccgggtgtagcggtgctcacctgtagtcccagctagtcgggaagagcccaggaggcggaggttgcagtgagccgagatcgcgccgccgtcgcattccagcctgggtgacagagcgagactcgtctcaaaaaaaaaaaaaaaaaaaaaaaaggagaaagatcaaggagttttggggggtggagggggggacgcaggggccggagtctcgccttgtcgcccaggctggagtgaggtggcgcgatcttggctcactgtagcctccacctcccggattcaagcgattcacctgcctcagcctcatgagtagctgggattacaggcacccgccaccacgcctgggtaatttttgtatttttagtggagacggggtttcaccaggttagccaggctggtttccaactcctgatgtgggctgatgcgcccgcctcggcctcccaaagtgctgggattacaggcgtgagccaccgcgccctgccgagaaagatcaaggatttaagactatgtcccaagaaggaaaagctaaaggaataggaattattgttccaggagcattaaagacatcagtagatcctatcgttcctacccggcacctcaagaactattctcccaaagagagaatacatttattctatttaaccttaagaaagaaaaggatcagtggataaaagtttcagcttttcctcggtgtgccatacggtgattatgctatatgtgttctttcctgggatcttaaggaactgtgggccaaccaaaacaacataacctaataaacctaaataataaataaacctaaaaagttgcataaaatatgttttgatatggctttgccttacgtttttcctcagaggaaaactgaatctccaggataatgaaacaaggtaacaagacagttctgatgccctttcagttgcagaataattctcagcactttcctatacacaaggaattcaataaagtagaaataattttcttaaacttagcattatcactgttttgaaaagtccttgaaaaaatcccgtttgtgcatacgtcttgcacgtcttatttcaaaatccattgagattgtaagcaattaaatcaattgcattttgtagaccaacccctcatttgtaacatgtaattccccaggacccatgtgtccagattcaagagcagcttgatagaaagactgatttatttttattttcttcctgggtctgctttgaatattcttaaaagaaggaggaaaatgctgtgtttaatattcatacaggattttgtattaaaagcagcttctctcaaaagcctgttgttaagaaggactacctataaaggggtcaacttgtgaaatccttcctaagtacttatttggttcttggggattgatggataagctgatggagtctaatcttcaaatgtgtatgtcattaatagagatgtaagaatctcaatgtgctttgtcttttcctttcctgacacattataaggaaaagctttactaatgaagtacccaatggcaataacccattatatgctagaatctctctttgtatcagatgacatgcaaatgaactgttctatttctgtggagaaagagagacaaggagcggtctagttaatcatacttgaggactgcatggttgtcttctgggaaatattatcatgattcattcttatttaagggtcctcaccctatgcataagaaaatctcccattcattccatttgggtttgatgttaattataggggcattaacggaagctttctcataagaaatgaatataggattaaatcagaaaataataaggcaacctttagatgaatcaggtcatgatagagctatacatgtagaagctggcaggttggaggaagtttagagatcctcagtccctttgttgtttagatatggaaactgagtcctggaggagtgaagtgacttaactgaagtcccagctgatgagaggcaggcatgagatgacaaacgaagtagcctctttcatcgggcagcaatgtagagaaagataattctgggagtttaagagaccacgttctgaccattttctactattaactactcctgtgatttggggcaaaccttttaccttctctggatctgttttcttaaatttgaggtgagactagactaagcatttgccctctggaaaaggggaaatctaagcaagctcctataggagattagtgtgtgattattattccagcttagttcattggaaaaaagatatttctaaggtatcatgtatattttgttttcaaaattgaagacaccagccttggatatcaaataaatttagtagcacttttaagctaaccttttccctaagccatgaaaagacttttttcttattccagaaaatattttattttatttttatagcatttctttatgtgtcttatagttggcaagtaattgataatattgctggtaaaatgaggcatttccttaatcttacatgtcttgagaaattagctgttcatgtatccatgtctacacagtcctcgttcaccttgtgaccatgtaattaagtcatttttcttttccaatcagccattcaggtctaaggcaaatggttttttgaaagattatgcacaccttgtaccagtacttctggtccctttaggtttaaagtgtacaagtagagattcctagtatatcaactaaattattttcttcctttaaaagagaaaataatttttttaaaaaagcaaagaagtaatttttttactcatatatttgacttacaccttgtatataaaatgttttgttaggtgaaatgtattttatctatttaccaaaacattttcacccaaatagcataattttacaagtagcagtcatatattaaaccaacatcacatttgtcctctctttgaacccacattatctgaactactgtaaagatctttttcctgtgagtgtttttattttattcatttttttaaaaatgttatttattttgtgttatattatcttcctggttatatgtaacatctttccatcttagatatgttggaaactccagaaaagttttaaaaaattaccaacagaaataaacaccacttcttccattgtgttttaatttcatttctgtcaactgtatgacttgaatagacaatctgtggaatgaatttagttttagtactttaataaaataaaatataaaaatactacacatgtaagtaaagtaatttagagaaatttcagaactagtttttctatttttcaaagaatatttagaaagcttaaataatagcttgcacatgtactcagaaaataggagtcatctaaattgcaaacttgtttaataagttcttccatatatgagcgctatgtcatcttcaaagttttcatataattggcatagtgctaaatattttataacacctctgtaaaataagttaaaatatttttctgccacaaaacattgtttttttagctttctaactcttgtgatatctttgtgaatattagccctttctctactttataaaccaagtaacaaatacaataagcctcacattttacatagtaaaaataagcggaatcatcattactccgtgaactaaccgaacttttatagtccctttaaaaatgttcatctgttgttttgtttgggagtttaaagatagtttattctgcatttaaagatactgtttatttcagtacatagatgcatttgaaactagaaagcaaatttagaatacttttgtatttgtttgtgattatcagtccaagataaaaatggtttatcttatccaactagtctttctttacctataccagagtcctcagttggagtgacctttggagtggctggtgtcttgggtgatgtagttaatgagatctagcgacatcatgaccctgaccccttcgtggccctgactcctctcatccatcttcttaaccccacaaggctgcaagtcagtgtgtagaatcaggattaaacaagtgtgaataaacaagttcaagagttttctgcagggctgccagtgcatggcagtagcaaagtaagacacagagaacttaatacctgaaatgctctttgtgcacctccacgaatcctgttggagaaatcagtaatgtttgtggtcagcgtagtgcgtctaatctcctcagttcgctccattcctggacagtgatggcagttggtctttataatcacatagctgttggcacattcaatgaaagcatggctgatctatcacttacccaatgtcacacattgctaaagcttttatctcattaactgtgattaatgtttgtatggcatgggcttgtcatgtaactgttcatattcagcaattgtgaatcccttagtttacttgatgactgaagggtatttctcgtttcagaagagaactttatcttaggggcccagcagcctttttgcaagccaccattgtcacatggcttgagaactgtgtgatgtagcccttccttggctccttctccattactgtccttcagggtgttacttgccattaaacttggacacttagaaaaaaatacaagaaatgtagtagaacttcaaggaagtatttacctgtaattctttcgtctaaacattgcttttctaatatgatttccaattaagtctgtgttcccaaagtcagatggaaaggggtagagatgatggatgcaggtattttcttgcctttggctacggttcttgtctttttctgtgctatgcttggcaagtctttcgccttagcccagggcagcctttggtaagttgaccagtcagtgattaaacatatttatttagttcagtgggtcagagctattgcgacagatagaaaattactgatggattatcaatttcagcacctctgacatctggcctcagtgtagtccatcatctgaggactcataacacattttcttcaacaataacatgctcagctacctgtgtgatcacacagctgaatatcggaaagattttgttcagatttaataagacaaaagttgcagaaatcagacgagttctgcacctatacttgagaatctaaaagcacccagtggtttacacacaaggctggaataagaactgacttgcactgtaaatatgctttgttgatttttgtgatatttttataacatttttacacttacattttggatttgatgaaatagttacttggaattattttggaaacaatgtgacatataaaaataaaaatattacttgtttcaaaatattctattaaaaaatttaaggcattaaaataatggttttaaatgtttggtctactacagtgataaaattaccaaaataaaaccccaactcaaatacctatgatactaaatcttttaaattataaacaagatgtgaaataagatttgcaaaatttttgtgtttattgttattgctgaatggttcttttaacccaagggagttctagtaataaagaataacaaccttattgcaaatgctaatctaacacagaaatgtattctattcctctgtccattttactatatctcagtataattttcttcatatctgtatttcaaagttctacataaatttaagaataatcttgattcatttttcaaatgattaaggttagcagtttgttttatggtaagtttatgtcttttaaaaactggttatatttgttgagaaattaatagattgtggcagagaatacattgtaacttttattttggctttattctcatttgtaaatctttcatgtgattatccctaaggctttatactccttgcacctaatggcctactttctgatgagcctacatttaatatttatgtgtgctgtcataaaaatatttttgaagctaaaaattattcttaatcttcatatgatgcattttcacacattctcttgaattactaaactgataagaacttagaaatgttacctttgttcacaaaataaggattgagctctttgacattgcagtttacatttattcactaatacaccagtgctatgtgccattaaattgaaaggccctttggaatgtccagctttttacaatgtgatataatgtggcaatattacaggttattgtgggccattatttattgtcaaagacttcctgatttgtcttagaattaagtgaggtttcttctatagttctgtggaaacctttagtagttgactatggcatttaattaacccatctctcctttgatatctcagagctggcttggaaaatgttgggatgaattctagtcacagaatatgctcagtaatttagattgggctgaaaaaactgctgtggatgttcaaaaaagacacaatttaaaaaatgagggagatcagattagaatatgagtttgatttggaaattcatttgagcagttgtagggaagccattgtaacattttttccttaaagattaatccctataacaattagaacactaaacatttattggttttaaattcttaaatgtgatgcctagcacttatgcttcctcagatgttttacacagttattttaaaattggagatgctccctacgtgcactctatttcgcttgatgcccaagtttccttttgattttactctacgccattgacttctctctgaaatgacatgtattataaactatacatgacttgtcaggagcaggtcaacagatatttttatgtaaagcaagcatgcaataacagaaaagttatatacagtcacgcattgcttaacaacagggatatgttttaagaaatgagacattaggcaatttttacattgtgtgaacatcatatcctgaacttacacaaacctagatggcatagtctactacacaccttgactataacgtgtagcctattgcttctagcctataaacctgtacagcatgttagtatactgaatattgcaggaaatttgatatgatttggctctgtgtcgccacccaaatctcatcttgagttgtccacttggggagtaagggacctggtgggaggtgattggatcatgggtgagggttcctgtgtgctgctctgatgaatggtagtgagtgagttctcacgagatctgatcctttaaaagtgtttagcacttcccccttgctctctcttctcctgccaccttgtgaagaaggtgcttgcttctctttgaccttctgccatgattgtaagtttcctgaggcctccccagccatgcagaacagtgagtcaattaaacctcttttctttataaattacccagtctcaggtagttctttatagcagtgtgaaaacagactaatacaaaattgtaatacaattgtaagtatttgtgcacctaaacatgtgtaaacgcagaaaaattacaataaaaatacagtattataaccttacgggactatagtcatatgtgcagcctgttgttgtttgaaacatcattacatggtgtatgactgtatattattttagcataaagattacatggatcaaaccagtagcatgaacacttgttcttccatcaaaattaatcaacttagaagaaaatatttatgaatgtaacttgatatgggtcaaagtttctttaggtaaagaagcacggaagtaaaatctccagatgctttcacatagaaacggatcttatctgttacctcacagggaaactgagaaattaagcaaagtaatgcatatgaaagtacgtcacaaactataaagagctgtaacaatgcaagtattttaatgctgtgtgagttttttggtacagaccaagaaagaaagaaaatacatagctatccatttttagaggctctggactggcagtctaagagttgcggttttatggaattcacatcgacatgtaatgatttttcatgtgagcacattgacattgtccagtttcatatagtaaaatgtaattcagaaagacactgagaaccacagttttaaagtactgccttccttctaatgttcttgtcattcaaatgtccttgaaagcatttgaatcagtaattttgaatgactgttatgatagaatgtttaataaaccctattaagcatgaattattttcttcacttctcttacaatactggattagtgttttgaatcatcaacaaccttgatttctatactgaaattccattttgttagcatcatgatgaccgataatgattacaaatgtgtagagtaacaattattttaacgtgtaatagacattggcatttattccatgtgtccggcatgaacatttgtcctacgggcaaggtagtttggagagatatggcaaagaactaagtcaatgatgttgatatagcaatctaataactttactttgatgacctaaaaagatttaggcattgggagaatctggaaaattatgaagcttctaaaatgtgtcctgaagagattcaaaggaaatcacatttttctcctgctctggattgattcatactataatttacctctcataaaactgatcatatgttaatattaagttaatagttgtaagttgatagtaaaattttaaatgtggagtagctgcacaaaatatggaagaaaagaatttgcttttattctgtgaatttaagattagcctgacgtcgttatgctcattttagcagttgcaaagataaaattcattggcatagctggaattacagtgataggagttggctttgaagaaaaatcaactttgccacctattgccttgtctgtattcaaaatagtatacattttagctaagtttgaatgtggacttaaataaaaaccaaaactaaaagataagaaaaagcaactgagcagctttatactgagcagaacagggaacttaaacaggcattggtattttgaaattgatttacatgtagccagctttgtttaccatactccttacccttagaaacccaaaataatttcttattagtcagtgttatgagcaaattaatggtggaaagaatgcagatgttttattattattattatttttgagacggagtctcactttgtcacccaggctggagtactgtggcgcgatctgggctcactgcaacctccacctcctgggttcaagcgattctcctgcctcagcctcccaagcagctgggattacaggcacctgccaccatgcgaggctaatttttgtatttttagtagagacggggtttcaccatgttggccagtctggtctcaaactcctgacctgaggtgatccacctgcttcggcctcccaaagtgctgtgattaaaggcgtgagccaccgagcccagccaaagtattattatgctgacctgaatacatgctcaggttttgatattcttttaaaattctttcatattctgtcagcataatcattttaactaatatccatttcactatgaattcatgtaagtccttcattggttgaaactgagtggggaatggaatatcctgattttaaaattttctgcttaatgatacctattacatttttaattggcttctactggaatggggaaatacaattggattttgcatccagcaatcttactgacctctcttgggttctctgtgaaataattgttttatctgcaagtaacgaaaatttctcctatttgaataaaagtcttatttacttaaattaaataataaattaattaatattttctgcttaactacttaagccagatttgttttgtttaagccaccatgctctgttgaaatttttcttgtaggtattgttttatattatatattagtgttggaattgcttggatgattaagatctcatcagggtaataattctaagtgtcagttttctctatattatagaattatgaatatactatgttactctacagtgtaaaattcagttttcatccacataaattgagctttaattatgttctggaaattttcatacacatttcatcttcactgcaagccactgatatttagaattttattattattattctttttgaggaaatttaatggcagggtagatttttttaaaaaaattgcccaaagcctaacagctagccagaggggatttttgaatttccatgtgttagttcaatgacctggatattttttccacttcacacaatatctagagtgtttaatgtaaggaagaattcttaggattgatctctttgtgaatataaagtgcaacgagactttctgattatgggagttcaggatcttgatttactgagatgtaactctcttgttctacacagatgaagtagataactatttttaaacactgaaaggtgtgtgtgtgtgtttatgtctaaagagagaggaaggtagtattaaatattaatctgctccccaactctaaaaatgtagactctttgatttgtggtcatgaacatattttcttgtttgatttcaaatttcagtctagtgtcccttgccccttaggctgcagatgtcaatttgtggtcatccatgccgatgtgtaaatgagtaagtgttgccccggcaaagagctgaggttataatttagccgtcgctgcccctttgcttttgtgtggattaaaatagctactatgtaaaatcttcattaattttcatattcggagtatatgtagaaatccacaaagttagctaatttaaaatcagattattattacactcatagtaaacccatagagaatggccacttaaaaggctgaagtcccgtcaaacacctttttttaaagggatgacaacataaaaaatgaaccaatgatgcctcaccttctcagatctgttccacatgtggtgttgtggtaatattgtgagcactgaagtattaaaacagttttgtcttgtgttccctcattctgacaggccaatgacataatgtcgacaagccatctctgatagattcaaaattgaaagtgaatacactgcctctttttcctagttcacactaatggtgtttgagtcaacgtgctaatttcactgcttccaacatacagtcctccctagtaagtctgggaatagcttgtgaggggctttttttttcaggctgcaaagaactgtttgatcaaagtcattactttgttattaaaggagaagaatggagaggaatcagcaataaaagcaaagacaagtttaggatctgaactctgaaaagcagtttgccaataaagatattaactctatatgatttaatatttccacaacaatgttaatcagttgattttcataaacatacatggactgggagtattaacaatagtaaaggaagaaatttagtgttctgtgaattgatttttagttctatgccatattatacagtcctataaaggaagataataagctataaaaggaaccagaccttatcacccaggcaaatttttgttggtttgtttgtgttttttctgcagcagtttccaggaaatcaaaagttttgcttctctggctatataattcaagatgattcatcaaattattgcttttacaaaggtgcaaaaactttgaggagttagaaaataattgaggttgattattggagcactttggaagtattttgttcatttatttatttaatcactgaaatagttactagagctttctgtgaatttagcttgttttggtgtgtattaaggtgtggcccttgccttttgactgcttgcacactaatttgaaaaattagacatacacatatgaaactgtttaacaattctagagagtggacaagaaaatgataaacgtaggtaagggtagaggacagcagctttcatatatatatatgtatctatatagatatatagataatctatatgtatctagatatataatctatatagatacatatctatatagatgcatatgtatctagatagatatataatctatctatatagatacacatatctatatacatagatatataatctatctatatagatacatagatacatatatagatacatatatagatacacatatctatgtagatagatatatagattatctatatagatacacttgtatctatatagatagatatgtagataatctatctatatagatatatatgtatctatatagatatatatatgttcacaatggtgtgtaaaacatacgtgtgtaaaacatttgaaaaactgctttcttgcaataaaatcctactggaaatcccagtgcccagtgtctagatgggttaaaggcagatattttctgctcctttcgttctggatacttcaaagttcaaatgattgaaaattatttttgtaggatcagggaggcttgagccgaatgaaagatatgagttagaggaggtgatgaagcctccttcttcagaagatgtcttttgaatggaacaaaatttgaaaaattggaagagaggaaaatggagcatatcagaaggaaatagcacggtgaaagtagacatttcaagccgggaaagagtagcgtttttggactgtgagaagacccatgtgataggagtagagtttatattactgattcatgaggagcctgggttaggagaagccaagctaacaggagccacaaatgccaggcatagatatttcgaagaccatccaggagtcagtagtatgtatatattcaggaacctttgaaaatggacatgacacaatgtgatataacataagttatataaatgtggagttgtaggagtgggttactgtgcaaaatataatcagggtaggaaaaacttgaggggtctgttgtattcttgcattcacttttggtaataggtatactggcttcagaaatagtagtgcagttaccttaattttagtcataaactaagtatacaacttgtttaggcaaccatttttagttccaattaaaagtaacaaataaagtatccattataatttcttacagtttccaaggtcttaccctctcttcctccctcccttcttccctttaccttttctctcttcttactctctatctttattctccctttctttcttttttccccctttctttcctttttcctcttcctttcctctttctgtatctcttcctaccatataatatcctggacttttactcattataaatacttaactctaatatgatatgattatatcctcatattccagtaacatcagaattccaatgggaagaatctaggcaattttaagatatataatttaaataatggcatgtccctacttttgctcattttccaggtagtttttagatacaagctttctttgctatgaaacctggaactataataaaatttaggccagatattcacacttagtggaaaaaccatattaactataatagttgtggtctgtctgcaccacgccaatcacagtcacatgagtgtctgtggatttctgcttctaagggtgctgtttatataaaccaggtgactatagtgaaggaagagatttgcttttgaagcataaatcactacaaatttcaacctgtccaggacttatatcatctgtaggtgtttgttttgttaattactttgcatttcattcagatgtggtgctattgctttagtattctaagattaactctgctgaatttgggggtcaaggtctctatcatttgtttcactgataggcacacaatattctttcttcttaacgacgaaaagattgatcagtgaaagaagacaaacgctgaccaagctacacatcggtatttatgtccgcgtgcctgatcaaaagtgtgatctgagtgaatctaaacttttcagcatgaggaaatatgaaaaaaagtgtcttagatatagaaaaagtttgcttcaccataattataatgctttttcaatacaggtatttaccagttatttagtatataataaagttgttgtatatatataacttaactgaagtataagttgattaacagccaattttagagtgcaatttttagtaattcatatcataaaataaactatatacaattgtcataaaaatatggctatgtttagttcacttctacttctgaagtactattagttgtttcacttatataattaaaggaaaacatgtttgcagagtctagagcctacaaattcaaaactggttattatcatttattcagctcccagcgattgcacacatttgaccctaaatgacaaagtaaatgaaagccctttttcaaagtaatacaatcagttcaaaaaatattgtgctaataaagttatacattctaattgaaagattgatggcaatccatttagttgttactaggttatttgtgacagacagatgcagagtaacctcattacagtcagaattgtgatgacttgtagctgaggagaggaataaagctttaaaccattgtcacagtccctttccaaaacgtattcaaagatgatttaaaagaaaatatatgaccattaaatagaagttcgaattggttacctaggagtgttattatagaagcaatgaagtaatcatctgtttgatccacaattggcctacttaaaattcacaaatcagatttacagattccaatttgtgtaagagaaaaacagtgccaaatactggattaaaaagattatcccttgtggtttggcatttttagttcatatttttagttgttttcttcttgatcatcaaatatatatcggcttattttagacatttctgcccacaatcaccagttcatgataaattattccacagtattcatttgtacgttgtccaatagtttaaagtcaggctttcagcattagtacccaagggaactctatcaacattctgaagttatgtaattgagaaaaagaaggaatatgggtggatatatatatatatattttttttcctttgaaagatggtgaagtctttgtgggatatatttcatgtatatttgattttgaaacttcttttttttttttttttttttttttgagatggagtcgcactctgtctcccaggctggagtgcagtggtgcaatctcggctcactgcaacctccgcctcccgggttcacgccattctccagcctcagcctcccgagtagctgggactgcaggtgcccgccaccacgcccggctaatttttttgtatttttagtagagacggggtttcaccatgttagccaggatggtctccatctcctgacctcatgatccgcccgccttggcctcccaaagtgctgggattacaggtgtgagccaccacgccaggccgaaacttctttttttcttaatgaaaaacaaggtagaaatgttgacctacaggaagctccacctgctcctcatagtcttcctactgcaatatttgcatgtatttctaaaatttcttatgttcaggagcaccttttttgtttcaaatgtgacagtccggtgctatgcttggcacataaaacccgttttattctgatcacttctcatttgtggtttaatcttgcgcacagttgtccttgcctctctcctgtctcagcatttgagctttctgttactcttgtacatactgaactttttcttgtgctcctcactatcaccaccatgtcttttattatagatatctttcaccatgaatccttttattatagattatttttcaccatgaattctaaaattctcttacattgacaaaagtactctttgcaagaagactatttaccaacttgaaagaaggctaattctatttttttaagtgaatttctcaaaagaagattttcattgtgtgggtaagtcagttaaatatctattgggtatttcttatccgctagtaaacttaaaaaaggtgttctttctaaggtagtgtctttccataaagttgacattttatctttcctaatcaggaaaattaaggcctcattcccttgtaggttgtgttatcagttaaggctaaagttttgacttatccaagcaggtgaattaaagaatatgtaataatagagtcttaaccaacagaacaccagtcagttgagaggttgtgtgttgaggtgaaagaccaaggactgaaatgggaatgaaggaccttccattcaatcctagttatagatcatttaccaaagattacttactagctatgtaaggcctcagacaaattatttagtgtctgagtcacagtttttcgcctataatgttaaccagctttgatggttctaaacttataagggtgtggtgatacttatattttataattaaacgtgatttattcatttatgattcattaagatagaaaatgtttcaaaaattatacttacttctcatttatttaagcaggtgattatgggaggacttctagatgccaggtgcatatccaggtgttaaggctatgtcagcgaataagctagaaaaaggcctcctagagcttatattctcagtgcttacctattcagtgcagaagcttgaaacctatatgaatgtaaacacagtagtcctttcctcattgctttctaggggcgctatcctctcattagtcatttaggagacctcttggttatcagatcaaaaaaacatggtatatactgtacagtataagctttggtactatccctggtttcagatatccaagtgggggttttcgaatgtatccctcatggataagaagggactgctgtacacaaaaataaaactactcaacatttcactattaacaatatgtggatgactaattttttgcacgtttttgtgtgtactgtgttttgcaatatttttttcagattgctggtgtagtccatctattttgctttcttgtatgaattacataaatattttcccatattatgtttttcttcaccatgatatttaatggtggacctttcatcccatgttctgtgctaattttcttaattctttgtcattggatatttaggatgtttctagtttttcagggttgcatatgaatatatgaactatgaagaacataccgtgatacaaatccttgtgctcaaccttggttatttcctttgaataaattcatacagtagaattaccagtcagtgagtatacataaaaatttaaacttccatcaaaaaatatctgaaaattcaggcttactcatttcttttccttggatattttcctttgctaatatgataggtgaaaatattattgcataataattttactttttatttctagtgaggctaaaagctgttgcgtgagtattggcttaatctttctctttttgtgaattgcctatttatgtttaagtgttttctccttttggagtgctctttttagaaacttttacaactgtctttttttctactaattatttctttatttttagtaataattattaattattactaattatgtgtctttatttttcaactttattaatgtttacttgtcaagtaaaacttgtatatatttatggtgtacagtgggatgttttgatatatgtacacattgtgcaatgactaaatcaagctattaggtttatgcaaaagtaattgtggttttggaccatgaattttaaatcattataactaggctcaaacacatctttattaatcaaaataggaactattacaatcaacacatttttgccaatgagaaataagtttgtttattcctgtagcataaaaatctgtgattggggatttgacgaactcttggaaagcattttctgcattctgcaggttgtggaagcgtttttccctgcaaaaagttgtcgagatgcttgaagaagtgatagtcggttggcgagaggacaggtgaatatggcagatgaggcaaaactttgtagcccaattcgttcaacttttgaagtgttggttgtgcaacgtgcggtcgggtgttgttgttgagaagaattgggccctttctgttgaccactgtcaggtgcaggcattgcagtttttggtgcatctcatcgatttgctgagcatacttcccagttgtaatggttttgccgggattcagaaagctgttgtagttcagactggcagcagaccaccaaagagtgaccatgaccctttttttggtgcaactttggctttgagaagtgctttggagcttcttctgggtcccaccactgagcttgttgtcactggttgtcacataaaatccacttttcattgcacgtcaccatcagattgagaaatgacttcttgttgcatagaataagagaagacaacgcttcaaaacaacaatttttttttattattgctcagatcttgaggcaaccactgtgcaagctcttttatctttccaatttgcttcaactgttaaacaaccacagaatggttgacattgagttcttcggcaacttttcatgtagttgtaagagggtcagcttccatgatgactctcaaatggtcattgtcaacttccgatggccggccactgcactcctcatcttcaagcctctcgtctcctttgcaaagcttcttgcctcaccactgcactgtacgttcgttagcagttcctgggccaaatgcatggctgttgttgtgaattgtctctgcttctttacgacacattttgaactcgattaagaaagtcacttgaatttgctttttgtctaacttcatttccataatctaaaataaatatagaataaacagcaagtaataagtaattagcaaaaaaaaataaagtgagaaatgtgcattaaaatgatgtataacataaccacatttatttatgaatgcattccaatactaaacggcaaattttaacaatgcaaaagctgcaattatgtttgcaccaacctgatatttagcacaggcatcacctcacatacgtgtcttgtttaatggtgaaaatatttaagatctgagccattttcaagtacatacattattattaactacagtcaccatgctttatggagtttttattgatacgtacttcaatgcttggtatatatgtaacacattatcctctttccatgcacctctgtgtgtgtgcataaaggtttttcattttctatgtagaaaaacttcaaagtaatcgccatgattttctagtgattgctttaaaatggaaacatatatgattttccatcatttatatatgaattattttgatacactgacagtatggttagcattacgttgtgcaaacttctttcgttaactagttatggaagtgaaatttttttatttctgctgttttttcttattagagtattagaatttcttactgctttttcctttgaaatatatatattattggataagtttgggacactgccagccaaaagtgaaaatggcattaatgggactgagatgtacagatccagcatattctctatgtgggtatcatttctacctttctaattctaatggcttggtggaaccttaggcctacactggatctttggttgaaagatgctcccctccacacatacacacaaacctttccctctgagatatgctgaaggcatctgaattttcttccttagtattcatattttagagcaggcaaccaaaaaggctatgtataggcaggttcttttagccttcagtagcttgctgttttgttgtgttctaatggcattagatgtttctagataagtctgttctctccagatttactcatatctagcatgtttttcatacagattacttggctgtatccaggtggcatgtacgtttaagatagctgcattagtggttaaagaatgctaagcaaaaacaaaccaaccaaccaacaaacaaaaatcaatagtaaaaagagattggagatccttaggagatattaaacctgccagtaacataaggggaaatatgtaaccttcaagaatccataaacatgaaaagtaagttgttggtaagctctaaactcaatgagggaaggaactatgtatttctttacattaaaaaaacctataccacatatgaaagtgtctagcatagttatcaatgctccataaaatgtgttgaatgagtacagcatagtctccattctctttttataatttacttgtgagactagagaatttaggaaatattcttttgtttatcagatttgacaatttaatttttaaaataattaaattaattggaagaaaattactacaactttctggtagagtgtttatatacgtttgtgagtagctgtgttgttttaaaagagtaatattctaaaatagtgtcattaaaatagggaaaatacattattaagttataaagtgaattcatttgaaatcagtcatttaaaatatgtttaaactggattaatttgggtgcatgttttcctttagaataggacctaatatattgccatggctcactcttaaaattatgagaattaaaagaagcttattataatctttacccacaaaatgcatatgatttattatagggttgtgatttttatccaacactcttgtattgaatgatgatgtttaataatattgtaatactgtatgtcagaagatttattgtagttttgatttctctgagccaagagacagagtacttggatgtgttttggtggttgttgactgataagcaataaaatgatcctacatagacctcagtggtaaatgtttttccaactctctctgattaatatgggttttttttggtgtaatatgtcaattttatcagatttaaatttatcattaaactagctggtagtttcagcccctggaaaggctattttgtctgagctatcatattttaagcaatattatttataccacaaggaaggtcctgatgaaaaaaagtcattcttgattaccgtttgatcaaccaaaaatgtctctataacattagatgaaataaatgaactgtatagctgtaggatttgaaactttcaactattgcaaatagatgagtagaagtttccattcactaaagagtcactacatctcttttggccactgatttttttttttttaagtacaagagtctttattctctagagtgtgaaaatgtctacaatactgtgaggcactggaaaaatgaagattactaaagatgaaaaataattcatgtaaaccgtgtgtggtaagtttacaatatttttgagtttaattcaacaaatatgttttgaacatcttctacatgttaggcagtgtgctaggttgaaggtttacagaagtgaatacatcttaagagagagatgagtggagaggagatgtttatggttgctccatatgaaatagccaagcatagaagcatgctgtataaatgctccatgtacagttagctacgaataggagcatctaaataacttttaacttcttgcttcttataatcttcaatacgtctctgtgcttatttatttatatagcaaaatgcatcataggacattgtgtggcaattatggtttataagtacaatgtcaaagttttttgggggtcattgggagcaaaaagctgttagagatttgaaaggcaaacacatattatggaataaaaattttccatttttttgtcaggtaatattttgagagggtagcgatgaggccactggggaggaagagaatttaacatatatgtgattttcaaggtagcaaaagactctggaacccacattgtcccatttctatgaattgcatcatgcctttgttaaaatcactgtgctaacaataagatttcactcagggaaatcaaataacaactctattaagaactttgaaaccatcaaaagaaatcttgacattatatttatcaaatatttgaaatctacgtataaaacaaattatgattaggaaaggaattatgtggatgtaaagaactgtgtattttgcaaaaggcaaagaaacagcaatttagtactctgctctattaaaacacattccgtcctgggattcctttagtttttatatttattcctaatgaaaattcaccctgtaattttgcttggtattttaaaataacattactgagaaaattggacatatttagtagtacatagggataatttctaaaatacaactataagtatttacaaaatatagtaatttttagtgtcctaccatatttgtttgttatatatgttgggagagatgtcattttcttatctattttattcagaaggaaataaatctgatgatgctcatatattttcaaaattccaagcaaaattgttcagaaaaagagttggaaacaactgaagtttattctgttttatttcccaaaattgtatcatagaaacataaaaacaatctaaccaacatggagaaatcccgtctctactaaaaatacaaaattagccaggtgcggtggcacatgcctgtaatcccaactactcgagaggctgaggcaggagaatctcttgaacctgggaggcagaggttgcagtgagccgagatcacaccattgcactccagcctgggcaactagagtgaaactttggctcaaaaaaaaaaggaaaagaaacataaaaacaaggctaggtgatctttatgagaaaatgcttaaaagctatttccacagagtctttttggtctttttctccatgataggtaagcttttaaaaaccgaaagaattaaaaaatataccacacatttgactttttatttttgtagtaccgattttggtcaaagcattcttgaaaaatttaaaaacacatttgcgacttttaacctagtaatctattcttctcagagagcataataagaataccttgctttccaggtatctgggattatggtaccacaaacaggaaggagaaactgaaggataaaggttaacttaggattgggttttttcaagaagtttccagtgttggcacagacacaggctctatctatgcccctttcaattataaaccaacagctctgccgtgaggatatcgtgaatgttcacatctttacctgtcaacacttctgaaaccctttcagcacctatgtctcagtctattcttgatcaaagcatgacctgctcactaaagctttcataagataataatttaataagaaactcccagccagaagacaaaggaaaagattgtgaaggaggccactgctaatttccctccctacataatcaaatcagtacagctatccagccaggactcataacccttaataagtcactctactcgattaagagaaattgattttcctctactgtggatcatagtgattatgataaatatggtatctgccgttcactgcgctccccgggcccaccccccgtttgctgccagtgtccatctgtttgcaggacggcaggtaaacgagctagagagatgacgccgtgtcattaactgcagttggtatcagtgctttgacagctgtggaattgagtgtttccgtagatcagcctagaagcccgtataagaggcttgcgcagcaattacacctcctgacaactctaccagcagccttcaacatgcaaaactcctatgctgcgatttttaattgggaatagggaaagaaaacagataggtgggaatgactgcagtttgaactctagttttaggatatgaagagtgatgtatagaggccaaagagccacatgctaccttcactagattctaacttgatcctaaagttatttggagtctgtggtgggtatgtcttattgtgatctctgtaatcaagtctagatttccagagaaatcaatctctttttaatttaattaatttttttttagaaacagggtttctctctgtcacccaggttggagtgcagtgatgtgatctctgctccctgcagtcttgacctcccaggctcaggtgattcttccacttcagcctcctgaagagctgggattacaggcatgtgccaccatatccggctaatttttttttttttgtatttttagtagagaaggggtttcgctatgttgcccaggctgctgttggcctcctggaatccggcaatcttcttgcgttggcctctcagagtgctgggatttacaagcgtgagccaccacacccagccgcaatatcttaatacaccaatgttgactgtagaatgtttctgccctttcttctcactcacctgaagaatcttgaagcagttggttttattttaatcattttccatcactgtacatcattcaatagtgcttgatattttaacatcagtaaacaaacaaacaaacgaacaaaaaacaggaaagtaatatattctgtcagagcagaattattcaattgcttaaagttttcatataaactttccatgtagcatgttgaatgtttgtttctataattaaaaatacctaagattattgactgggtatctgaaagggattttatacagcacagtacatagagtagcaataataaagatatattttttaccagcttttgcctttgtgagtattttgggtttgggacatggttgtacatatttcctgtttatatattctacacataatgtggtattacagaatgacgaattatagaaagatctggaatattattcttaactaaggaggcagtaagataattaaggagacattgaaagtagacttcagagttcttttcataaaataatagatttatttctcttgattaaggtttttatttggcctaagtctgacttaagatttttataaattagcttcatcattaaataccaatgtactattttttatggtatactaaattgttgctccatttgagaatattctaatagtattagggaaagttagtcttgttaattcatatcttttcctatatatgaataagaaagggcataaaatatgctttttttttttttttttttttttttttaagaaatagggttttgctctgtcacacagactggaatgaagtagtgcagcctcaaactgttgggctcaagtaatcctccaacctcagcgtccccagtagctgggattacaagcatgtgccactacacccaattaattttttttttttttttgagactgagtctcactgtcaccaggctggagtgcagtggcatggtcttggctcactgcaacctccatctccctggttcaagtgattctcctgcctcagcctcctgagtagctgggactacaggtgcatgccaccatgcccagctaatttttgtatttttagtagagatagggtttcactgtgttagccaggatggtctcgatctcctgaccttgtgatccgcccgcctcggccttccaaagtgctgggattacaggcctgagccaccgtgcctggccacacccagttaattttttaaattattttttgtagagacagggtgttattatgctacccaggctggtcttaaactcctaacctcaagcagtcctcccactttggcctcccagagtgctgggattgcgggtgtgagcctctgcatccagcctcttttctaattttaaagatgaactggagagtttcactttattctcacgactcttattgcagagtctactctcctttaaagtaactttagtgttgttacttcttagcttttctcaagaaaataaagccatcacagtggaatttgatgattatttttttttgagacagggttttgctcttgttgcccaggctggcgtgcaatggtgtgatctcggctcactgcaacctgcacctcccaggttcaagggattcccctgcctcagcctcctgaatagctgggattacaggcatgcgccaccacgcccagctaattttgtatttctagtagagacggggtgtctccgtgttggtcaggctggtctcgaactctcaacctcaggtcatccgcctgcctcggcctcccaaagtgctgggattacaggcgtgagccagggcccccggccgtatatataacatcttaagcacatttaatttgtctttaatttgcatttaactttttgtcccttgagaaataacaaacaaaatgatgataaaagttgttaaaactctggctgtatccccactgatttcgagggacatcctcctgttatccaggggagtctaattgtacagtctgttgagcccggacaagtctgtgcttgagagaaactccccagacgactgcctgcctgtaagagacagtgaggaaacgcaaggcaggagacacattttcttcaattttatctgcgtaagcctgaaactttatgcattgaaatacagccagatatattcataatcatctcttagagcttggccatcccagtatcttcagttctgtgaccctgacagggaaggtcattggtgcagcccttccaagcaaatgcagttaaatttaacagaattttttttttcaatatgccagacacagtggtaaacgtgtaatataaagattgctctgacactcgtttgaatctgaacgactaccaggaaccttccttcttattatccaaagcctttctcttgcaattcactctttcttagcttttataataagggttgactacttgaaaatatggttcaattgtccttaccagcactataagcaattttagtttctcactagttttcatttgcttttcattttttgcaatgaaacccatcacagtctattgacctactacaattattaagtctattttatttgtgattatagtttgtgaaaatacaattaattactcatattatcaatgagagtacaatgtagcataatttccaccacacgttgttaatttaccaaactacttaaatctgatttacggatttttttctcgatagtagtttagatgccgtggtactttcaagatgatgagagaatcatgaacagagaagttcctttcaagtgaaaaatgcagctgtcgcagaatctctagtgtatccaggttagaatatttaaaactatgtattcatattagagagacatcatgggatatgataagcagaaaagagagacactaattgtgaatagataaaaggattcacatatgtcttaaaactttcaaataaaatatgcagagtgagtttttaaaacgtttttcctgtttatcccttgtttaatgttccgttttagttctaagtcgatcctacaactaataacagatatgaaaagacttggaatgattgtctctgtgttctttgtgccataatttaaagtggccagaagcaagcaagtggaataaacaggacaattgcagagtttatggaggattaggccaattgcaggcttccacacttagggaggagaaaacatcctcatgaatatgagattggaagtgtctagctgtgagaaaaggaaaaaaaaaatgtctgactctggctctgtgttgcaaagcatgagggtctctgtgctagaccatgacttagcaaccgcgctgtttttaaaagtatttgtgttgtaagaatttattatataattatattctattaaaggtagaataggagcaatctggccagttctaatcactgaatctatagtacaatttgagttgagatgaaacaaaaacagcaatagaggaaaatgttaagagtttttaatgttactgagagttaatctgattatgcttaagactgtggagttggagacaaactgcttccaaattccctgattaaaaaaaattgaaaaattttattttatacaagtaattttctgatgttgaaaaccttgtattatacctccaaaatctgaatgttttaacaaaaggaaaaatctccttccatgtactttattccattaatacactccattcatatttgaaaattattaaattttaaattcaatagtggattgtacttggagcagttcatctaaccagccatttacctagggtgtattaatactaagcagccttgcagccacatctaccaatgtattaagagcctactaataaaaatatgatttactgcctaaagtttctttttgcatccttcatcacttgtctgatttggaagtgtggtatataatgcagatatgaaaccagctcaaagttaacagttcatagctgtaaagatcagtgcatgctcacggcagaacaattttcagagtatgttggtattattaccattttgcactttctaataaaacgttttgttcatgtaggctgtatcttctgcactcaggctttaaaaagacctttcatccccactttctctgaagttggacagcagccgcagtagcagctgcctctttagtcactttgcttcccctcattttgataattatgggcaaaggtcaatcattttcccatcaaggcaaatcctgacaaccccacatgtcagagcctaagttatagatgacatgcttgtcaacaccaaaactcagagagtatatctttacctcctcatgaccagctgaaagtcaaaaccctactgcaaaccagaggcaggaggggatgaaagaagggtggctgtttgccctgactttgtcaactgcagacatagttccaggcagatttttgtaattttaaactctataaatgaacaattacattccactttatacacatgaactgtgagcgtcctgattgaatgcaaatgcttctgttaacaacatgacctcgtagtgccttagacggaaagactttagttttattgtggcgattgttcttaaacctagctgagttttttagattaagatgaaatgttttaaagctgggaggggggacaaataatgatcttttaaaataataactagattctgggtgaactaaaagcctggctaggaccattataggaatacagacactcaattcagttcagtaaacactgaagggataaggagacagacattttatttatatcatgaaattggatattaaatttgcactgctcagattatgtcagatattgatttagattcaattacataatacctcccagtatccctagaatcagcattcaaagaaatatgcattagtgagtatggtggtaactgggtgctaaaagcctaggccaagcaaatcacagaactacctgcaatggaaagtttgtgctccaagggtcctagggtatttgaatttctgaccatctatcaacatgttacctacatgtaccttcaatactcccaacactttgtcctcccagaatatgatatgaggttaaaatttagcccagggtcccaatttaatatctactgatggcgtccctttctttatataatcaaacatttttgtaaaattatttgggtaattttattacaaatactttttaggggctttctgtttcaaagaaacctataataactcttctttttcttcttgttagaacaataataaatcctcctatacagtaaatcattacctcctcacttctcacttgtttaaatcaaaatttttatttactgcattctatgagtgtcagatagtgagttacttacaagtatgctgtgataaattggtaataggacattcattgtcaggatgaaagaaaacattactttccaagaaagttatgacccaatgtgataatttaggattacaaagaaagtgtatgaagtatttcctgaaatgaacaatgtaatttgatcttatagcaagtaatatttatcccagattcttgagaattaaagtctgcatagaaatgtaatgcgttgtgagtctatgattctgtgttgtagctgagcagtacttactctttcctttatatgctaagatgggatgtacatataaagccccccccccttgtaataggcttataacagatgtactcttttataaacagccattatccttggacgtatatctgttcaggcagaatgacctactattggtcccactcttgaagaccattgctttgcttgtcttctgctctggtccattgccttgttgcctacattccagttgttcaccttccatgatgcccgtaagaagagagtcaaaggctgacaaatgcacaggtgttttctcacttttcttacatcctaccccctctcagttattcattatggtaatggcactttgtgatgtgcaatttctggatttatgacccattcttgataagcatgaatctggactgcctgtgcatctttgataaggttctagttggatagcagtgacctttctggatgtaattctgggaggaagattaaaaagcagtccagaaagtgacaggtttgggacaataacgtatgaatttggctctgctggcaggcaagagatgtaagccgtgataaattagaggcaaaccaaacaagcttactgaatgatttttcatttctgctacatccttgggtaaaagtctattgtatgaattgcactaatactgccatattcctctagccgtgtgttagactacttgtttactaattgcataaactggcaaattattccgttaatgtagttttacagtaaccaaaggctgcatactcaattaaaaatatgggcaccattttgcgtacttgtgctgtcttatacgttgaacagtcagtgagcatttggaagagagtcatccaaactcataaaaacctctctctctgtttctctctctctctctttccttccaccccctttctcatatttgtatgaaaagctattagaaatttccatatatatacccaaatcctgaggacatcttttccaagtttagagagttaaagatggattataaagagaatccatttatcaaggtaacttgttaatacactgtccttaatattcttctgtatttgataaagtcttaaactcttaatatatgttccatgttgaatatatagcagaaatacacttgtatagataattatgtttattacgtatttaaaggataagaacacgtacactgacgtgcaagcacatataccccttcagagaaagacagacaaagatttgttttcctccaaagtgatacttctgaggagtgctaatatataataacctaatcttaaggacatgactataataaaggctaaaaagcagttttgtcaggtggctttgtaaatctgtcttctttgctattggagcctgttgcttatacacacatggaatacaaaataaattgtccacgtagcaggcaaatcaatacgcggtggtccctaccaggattaatcatgggaggagttccatcaccactcacacatggctgcattcagggtgcacagggcctattacttctgcatctgtctttaaagggagccctctagagcttgctacaaggggaggagaaggcagctacctcttctgagggcctgaggtaggtcagacaccaggctaggcatgtgcacatacagagttctgttccagtctcaatgcaatgcagcgacctgtcgctagtagccctgtttttacaagtgaaaagagaagtgtgtttccctgccccttcctcagcagaaagtctggcactcagcagtcactctgtcaacggaaaacaaaatgaataaggccgggagaaatgaagtaactcacctaagattgtactaattgaaagcccagcaaatccagatttgaataggactctgtgtgtcttaataccagcaagcaaaccaataaacaaaaagcaaactgccagctgcagtaccttatgacagctttgcaatttacctaccagacaccattttcttaaacagcagcttttttttttttttttttttttttttttttagatggagtctggctctgttgcccaggctggagtgcagtggtacaatcttgacaatcttggctcgctgcaacctctgcctcccaggttcaagcaattctcctgcctcagcctcccgagtagctgggactgcaggcatgcaccaccacacccggctaattttttctatttttagtagacattgggtttcaccgtgttggccaggttgttcttgaactcttgatctcaagtgatccatccacctcagcctcccaaagtactgggattacaggtgtcagccactgcgtccggccccacagcttttttgaaatataattcatgtaccatacaactcatccatttaaagtgtcagacatcactttaatatttatattttatacttactataaactcagtatatataaaatcatagtgcctcttcttttagctgtgtttaatacttatggactgaagacctgttcatttttaacctaagtagagaaaatatagagtcgagagtatttttctcgcttgaaatcagtagtgcctatttttgctaaattttttgattcctaattattgctattcttcctgcatttctctgacatccatcatttcttgcccatttttttttcatattttttagtattctggtgccttcatatttttaccatactggtgtgtcaggcattgggactattcttagaagttgttttgctactctattccactctgtaaacttacggaccattgaattgtcctaaaacatttactttctccatgacacgtgctattcttaaaataagttatgtcaggttaaattaaaaagaaaggccttcaatgactgtcagtgtcctgcatgatccgatcttaccttatttagacaacctttccttttgtaattcctatcagaaaatgccttttctgcacagaccagccacttaatgtctcacttacagtaatgtttatttctaactttgtggcttatctgacttgtttaaccagtttactctcccttttatttccctaattaatatgacccaggatgagaattaaatagtatttcctttatcaaggcttactctcccacacattctcctaatacctttacctaccttgcaatcctgctgggcttgcaatttgtcccccatatttaactcttggcagacagcggtcccatatttttttcctcatgagtatttcctatgtggacatctcgactctctaacaattttaaatttcttgagaatctgttccgtgcctgatttctccctcagcagctttctaccctctttgcagtatgttcttcttaaaataatacattttgatttgtctcaactatatataaaacgcacatgcataggcatatgtacatagttttgtttgaaaagaaaaaagatttacaatttatttaaactttgtaaacttcaaataaaatattggatcaactacattaactcacattggaaaggactctactgatgaaaaatatgacaaatatatggcactggggttttaatgtaaagttagtcactaatttttagaaagtaagctgactgggagaaggaggtgtagataagtagattttcatcaattccaagatacatgcttttgtgataaacttaaatataatttagttttctatcaggcctcaaataccagatagttgtgggccttgtgaaataattttttattaatgccttgccaagtggaacatgatgataaaaatggatagtagctacttctctcatcatttttttgtcttattttaatctctctaaaggtaaaaacatatattatgataggaagtagtcagttgccctggcacatttatttttttgtcattttctcttaagtgttagtattatatacaatgaaggtacttagattcaaattgaaatgaataaagttaattggctttatacctggtttacagttcagagtctctatgatagatacctggagagtgactagtatagtttagctgggtgtgcatgggctgaatggataatatgaagattacatttttatgggagtccaacaaaggagttctaagtaaaagtgatctgtgagccttaaaaaagtattaaaattaaataaaatgaatattgattcctgagaaacatgtttgaagtttgaaccttctggctctaacaattatggttaacaaaaaaatgtgtatttatattttcaaggatattattgtgatttcttgtagctaacgttctgaaggaaccgctgtattttaagtcatgtcttttggcttgacttttttatatggcatgaagttctaaatagctttatacaattaacagaggcattatttttaaatgttaactaggctaggttaatattgtttaggcttttacgtgttttaaaatactcccacatactctaaaaattaagcaaactatagaactatgatggatctagtaagggagcacttttcttggtttatcatcattttttttgcctccatcacacatcgactgaatgagataatcgatggaaagacttgaaataagtgtggcataaacacatcagtttatgtgtttctagaaaagatcttttctgtcacagcaaatgccatggtaaaattcttattttttaattaatattccctcatgttaacaatctaacagcatgcttattcatttgttcttcagtccagtgtggcattattgctgtttgttggttgaacattggctgtggtctgagacgcctggtatcttgagtttctgaggtgatgctgtcatgctcttcacctgcctgaggtggtgattagaaagcacagttacagccactgctcaagtcatctgaaaatttccttcctgctaaatgttacagggtagaggccattagttcttctacaagctacaaactcccagcctgctgccatgtcatgaagccagagaaatcaaaaagccacctactgaccctgcctattgtctgggcttgtcgtcttctgtcagtagtgtgccacaatcagcgagatacacatgtacctcctgcctgctcagggtttggccgccccctgctcccagcacctgtttgcttatacatgagctttgcatgtttgaatttaaatagacacaggagggtggagagagggaggaagggcgatgcctctgtcagccgtgggtcattactacagaggagacaaacccagcgagcagggaaactgggaagcctggtaacgtggtagtgggtgatgaaagatgagtattctccatggaaatcatttttttccccttttaaagttgaatggggtgggtgattattaagacaagattaataatcattttgattatcatatctatcaatagatgatttcttcaattacatagagaattataaatcagatgatgaattgtgacctgggtcttttccaaagttacctttccttgatctcttccaatgatgtcattgcaaaaaattgtctaatttatcaaaaaaacaacatgaaattcaggtatgcgtacaggtgtaaaaaggccaagatttggccaggcatggtggctcacgcttgtaatcccagcactttgggaggccgaggagggcagatcactgagatgaggagttcaagaccagcctggccaaaatggtgaagccccatctctactaaaagcataaaaaattagccgggtgtggtggcacgcgcctgcagtcccagctactcagagattgaggcacaagaatcacttgaacccaggaggcggaggttgcggtgagccaaaattacgccactgcactccaacctgggtgacagagcgagactctgtctcaaaaaacaaaaaacaaaacaaaacaagaaaaatggccaagatttagtaaatatgtacactggggactcatatctgggatatatgcaatatgcacctgtttatggtagaaatttttttacctaagaagaaacaatactatcatctttctatttcaacttgtttactaaattataattttcttaggtttagcaaatgctcatttagtaattgtgtcatcctgcatctgggcttctaggctttgaattagaaaatctgagactgcttgctgcctttggtatttattagttccatgaccttcggtgagttctttaatctgcctgaagctcagtatcttcatccacaaaaagggagcactggtgcccacttgagggggccctaaagggtggaaatttaatgacatgataattgtgagtgctcttttcaaactgtaatgtgttatataaacatcagatattgttactattaagactgatgtcatataagattaaccatggtctccaaaagatacaatactcatagtttcattactaaataaacttttaaagtaaaaccaaaatactttcaaaaataaattgtattaattattaccaccataatactgaaagttttatggaaatatttcctctctaaagcacaccgttgtatgttagaatgttttcctggtgtactcttttactatgtgtaatttaaaaagtaattctagactatcaagatagaattttattataatattactgcttaatatgacactttcttctaattttattgtgccaagaatttgtgcaaaagttacacaggcagatagttaccttcttttttcctttgggttttcaatacgtactctaacaaaggaaagatgaaagaaatcagggagaagatctggcatttagaaacacacactccctcccacacacacatccactccgaaaagttataaaggatctgttgaatttgggggataccttgaagaacttcaagctgtcaccatttcactaccccatgcggtttgagcaaatgagcagccttgaactttgcacacagagacgcgaggcctgggcagaaggcagtgcatctgcaggtccttgcatgactaatttcctgtcagcaagtgattttattatcatttaaataagaatggataataatagctgtaaacttggcagatggctgaattggtaaattttaaaggaggtaggtttgaaatacttctgtgcttcctccttcaatgccttcacccactccttaagccccgtggcaatcaactattttggttaccacttttgatttaaccactgtgttcattcctatcgattaaaggggctttaatagcacaatattgtgatggctgtttaagcagaggacatactgtgtttcattgcttcttatttacactgggcaagggggaagcccagttattggtaggtacttccctcttctaatcatttctgcatgaaactttttttctttctctcttcactcaacgcttaagaggaaaggaaaactacttgaacttcttagttcgtatttctcatataaagttaaaacaatgtataaaaagaactattgtgtattcagttctcatgttcccattccttaatcaacacaggcttatcaatacagcaataaatgaggacagtctgaagcacaggagagatcactaatattgcagccaattttctttcctaaaaagtacaggcgcaaaaataattcatatcagatgaggtcttacaaatattaaacaccattatgtcaagcaaataccgctaaatatgaaacaaaatattgactctattacataatatagttatggttaacaaaataaatctaatagggaattttaaactaccaatttagcttaattaaaaggtacaatttcctcaatcctgattaaataacagtaaaagcatagattgaatccactccctctgagatttttaaaagaatgtttgagaaagcttgatgttggagttataattacacaacagtaatctgcttattcctttgacttaaggtattaagatcgctactaaccaaagttcattaattgaaagcttggagacaaagtaaatttttttttttttttttttttgagacagtctcgcactgtcacccaggctggagtgcggtggcatgatctcagctcactgcaacctctgccccctgggttcaagcgattctcctgcctagcctcctgagtagctgggacaacaggtgcacgccaccacgcctggctaattttttgtattttttagtagagacggggtttcaccatgttggccaggctggtcttaaactcctgacctcgtgatttgcttgcctcgggctcctaaagtgctgggattacaggcatgagccactgcacccggcccaaagtaaattttaatggtatctcgcaaacatatgtgtgaagatagtagtatttaatgtatactagccatgttagcttggggaattagtatttatgcatgcccttactaagctttcttagcaggtgtcttcatgcttagaaaagtcaacttgcaacccgtgtgtaagacaaaacatttgtcacgagttcagtacttgtcaagtgggatgtacattctcagaggtcaatagtggcttataggagatttagatgtgtctgttggcattaatcagctacacacatcactctcatccaactcacagcttgaacttccttacctaccaatatctgtgttggctgcctgaaaagcaaactgttgagcaacagatttaagaatagatgattgacttggttccattcaatcttgtcccagatgtgatctctattaaatattttggtgattaggccttattcctattttgctttttttttttctgcttttgtgattccattgtccattagtgttgtggttctcatttcctttctctctaaattctgcatatttatttgttaatgtactgtatttagtgtactgtttaggcgggattacaaataacttgtgaaataacaggaaaattgatgaaaaaagaaagagcaaaagacaatgcttcctcaggaaaatgtcacattggatgattattttatttgttcctgattttttccttttctgcagatacatgattatataattgtttcagttatatgaaacaaaaattagatgtggaggaaaactctaaatagggaactctaatgttcttttaaaatgaagaatttaacgaaaacactcaaaactcccctgctgggctcaagcaggttgaaattaattcaagacggcagataaaatttttaaccaggccgagtggagatgacggatgtgacagctctcagttaaaatgtcttttagtggcgaatgcatgcatattagtcaagggatgtgacatagctgtcccgggtgagagaaaatgaaccaatgaccatttgcattgagaacaaaagaaaaattctttatagcaaaacgtaaagaaagacaagtaacttgaggtttcatatttatttgttcgtgtttgacaatatttttggtaatctttttactgcaagaaaacctctgaaagttagcacaaacatatgtttttaagcagtgattcttttctttctcctccatatatcagaaaataaatgttgagtaaaatgtctgtgcccaggaaagtcaggtaaactatttttttttcccttgcaaagaacaacagaaaagtatctgtagatggtcatacttcaaaagttgtagaaaaaaagccttaccaactgaaaactcagtttcaaatttgcctacatgaataaaatattggaatgagaagcctttttttttttattataagaacactggctccctacttttcttctttctaataataagacaatttggttgtgtattataaagcaaagcaaataaaacaaaaatggatgtgattctatgacagaatgttatagggaaggaaaattatttggaaactacaattggcaggatttgaccatgtgaaagtcaagtttaattaactttaggaacagatgctttcaagacatagcagttaccagttagagctacaagtataattgagttttatagtatagggtttatttttccaattaaaatcaaattgcattatcataattttgttattagaagatgtaacactctggcttaaaaggggtactcaaatgtagacctagatcttgtcctcttttgatcaaaagaaaagaatggacaaagatgtattttagtctcaacattaaatacaatttccactttagaaggtagttgttacttcctttaataatgtatcctccccaaaatggtatatgagaacataaaaatttattacaacattagagccaaaaatagaatacaaatatttgtatacaaatattcagtgatgctaactggattcagaaaatgctaccgaattaaaattataatttatctgggtcttcagtgataaataggaatcccttacttaagggagatgaagtttatttaaggcgaggtaaatggagaagtaagtttttctcctgtatttttggccttttcttgtctctcttttctggaattatcaagctttctctcattcagatgaatgctttgtgaatcttctctttttgaatctgcagtgtaattctatgtggacagacagctttctgttaacatacactattttgacagactacaacttgatttgctgttcaggctttgactatattcacattatggcttaagtattttctttcatagtcatttaccaagtgcccaacacatttttaaatcagagaaaaatacattttatttactttccatgccgagctcagcaagaaatggtattttctcctatgtcttgcattaaaaattgcatttgcaaatggcatatttagatgatgttgaagaaattaagcaatatcagttgtaccttttcatagtgtaaacatgtaaaatttctttaaataggaaaatactattggttttcttggaatcgctcccatttaaattctatcctttagatttttttcagtccaatgcctttgcaaatttctagtacacactttctactactgtaactttagtacatcctcagttttactacattacttgaaaacatgcatttttaacaatctcctgctcttttgcttttgattttctgggcatattcctgttactcaatgtattcattcagcagagtacatttatgctacaactatggactacctgttcacagctgtagattattcagaatcttcttgatactgataatatcttcttatttacagtttgctggtatactgagaaaatgcagtagaataacggaagtacaatgtaagccatataaatcatttaaaatttactaggttccatagtaaagaggaaaacaaaacagctaaaattaatttaatactatatttagcctaatatcccaaattttatatcaataggcaatcagtaaaacatattaatgaaatatgttcattcttttttattatactgaatctttgaaacccagtgcatacttaatacttgcagcacatttaattctaactagccagattttggtgatcaacagccaccgctgactgtggccaccatactggatagtgccactctaagaccttgatactcaaagtgccccatgaacagagagcatccacatcacctgtgagtatgttcgttgtatcaaatctcaggccttatgccaggcctactggatccaaatcttcctttcaacaagatcccgaagttactggatgcacattaaagaaagaaaatcactgcatttctggtttcccaaatgtatagaacattggtgttaatattactgcctatgacatagattcttttccaaacagctttattgagataaaattcatattccttataactcacccttttaacatgcaaagctcaatttttttagtgtattcacaattgtgcaactatttcagttatctaacttgataatatttttcttaccccagaagaaacacttctacccatgagcaatcactcagcacttccttctttgcccagtgactgacaaccactgatctactctatctatggaattgccaattctggacattttatataaatggaattatttaaggtgtggtctttcagtctgtctcgtttcacttagtataagtacattgatctgtagtctttatttcttttgatgcctttgtctagttttattaaaggagtttaaaaatgcttcttcttccagtttttggaagagtttgtgaagaatttgtgttaaatctcctttaaacgtttggtagacttttccagtggtgctgcctgggccagagattttcttgcaggacgttgttttggttatgaattcaatatcgttactggttatatgtctattcagatttttttattttttcttgtttcatatttgatggattgtatctttcttagaatatgttccatgaatgaaatatggtcattaagtgaattgaaaaaggcaaacacttttcctttaccattttcccatgtattttgcagtcaagatcattctttgtaattaccattgtgacagtactacaaccaaaatgagcctttagaagtgtgtaatttctgaaattaaatttatctttatgaattttcgaccaatgctgaatagagaaagatattttattttgccacagttgacttcctagttcctgatcacatgcaataatgagaggaagccagactggaaaaagatgtctccttactaaaataatggaagaagtagcccccattccttccttcgaaataacaacaacaattctaccaacacgcaaaaggtcagagccacattttcatggtataaatgacatctaggttaaatccttatattctgtcttggatgaaacttgatatgattcaatccaaccctccatctaataatgattctttgacatttctattttataatcgggttatagccctttaattttcttgaatgtttactataacaagacaatcacctctcataaaccaatctactctattattagataagtctaaaatttaggagaatctttcttattttaagtagaaaactgtctcctttctatacacatttagttctggctctgccaatatgagcaggatggaacaagcttacttcatctgctacttcacagcccttcagatatcagaaaaagcagtttcttcttaatagactgctaacagaattataatgggatcaaactgaaaaaaaaacttgtgagaacataatctacactaataataatcccctaatgcacttccacttgaaaaaatacacatagtttaatgtatcttctatcaatttctaaacatgggtttttctttcttagtacgaaactgttaaaaagcaatcaataataaataggtacagaggaaaaaaacaggcagtgaggtatgtttagctaaatatgtcctcaaagtgttgattttaaaatggcttgtttttagacgctggtgaggctgtgaagaaaagggaacatttatacatccttggtggggatgtaaattagttcaccactatggaaagtagtttggtggttttggaggtttttcaaatagcttaaaacagaatgaccattcaaaccaacaatcccatttctgggtatatatccaaaagaaaacaaatcgtccaaccaaaaggcgcatgcactggcaagttcatcacaacagtattcacaatagcaaagacatggaatcaaccaaggtgaccatcggcggtggactgtataaagaaaatgtggtgcatgtatgccatgaaatcctatgagccataaataaagaaaatcatatcttctgcagcaacatggatgcagctagaggcttatcttaagtggatcatggcaggaacagaaaaccaaatactccatgttctggtttataagtgagagctaaacactgggtactcaggtacataaagatggcgacaactgaaactggggacttatagatgggggagagaaagagtcagggaagggttgaaaagctacctattgggtactagactcagtacctgagtgatgggattatttgtactccaaacctaagcattacacagtgtactcagttaacaaacctgcacgtatactccctgaaactaaaagttcaaaaataaatattcatttttaaatttgggaaaataaataaataaataaataaataaataaaatggattgtttttgaggcaatgaaattactggacgtatggtcagtgctcagtaaactttagatgactgtggtatataggaaggcaggataatggtcctcaatgatgtctgagtcctaatccctgaatatatctgtgcatatatcagattcatagcaagggggaattaaattagcagatggaattaaagttgctcatcatctgactttaacatagggagattatcttgaatcatccaagtgggctcagtgaaatcagagagtccctaaaattgaaagagtggagggggataagggatcagagtcatctgatatgagaaggacttcacttgctctagctggtttcaaagatagaagaaagtgcctgccaaccaggaaataaaagtaacctttagaacctggaaaaggcgagggaacagatagtcccacagaacctccagaaaccccgtaaacaacatgatcttagcccagtaagactcatgcagacttctacaggtttctatgataaatgtgttgtttaagctggtaaattgtagcaatttgttacaacagcaacagaaaacgaatacacatgatagttatttaacagaaaactaacacagctactctgttctggattcaggtctaattactaaaacagttcttttgaaagtcaccagttatctccatgttattaaactctgcacattttcagtcttcgtttgacccctcaaaagcacttcatgtcgttaactattccccctttcctctttaaagtacttgttatctttgccttccatggtctttcacttccttgctttctttttaccttcttgacctctttcgtggtcccttttacagctcagtccacctcagttaaacattttagagccttctcctcttcttgctcaggagctctcatctgtggtcattgcttttattgccactctttctagagagcatgcaaattttcatcttcctctgggcctctcttctgagttgtacccacataacccattgcctacctgaattgttttttctttgtcttaaaatttcttcatctcaacatcatccaaaccgaacttataactttcctgtccactgggcaccattctccttctcctttcaaatccaaggcaccttcagtattgctataaattttgtgtctttctgtactggttgagaagggttgagattgggtagaaaatgcatggcaaatgttgtcaggtttgattttactttagatcgtgttaaacaatgtaagattgtttatttatgcatatgaatcattttgtatttttcataattaaattgatgtcaatcccaattttattgaatcccaagtatcagctggctcagcagtcactaagaactgttgtgaatgtgctattgtacctatgacactggaaaaccattatgagttaaaccaattgtcatacatattagttatttgaaattcagtgggaggaacattttcctgtgtattgcaagttgctgtgagaaatgatcagttttctttcaaggatttcagttgtgtatgtgaaataaattcttaacatttttaagctcctgtaatattgcaggcattttactttagtaaaatagtaaataaaatatacttcatttaattttaacaaatttctgctggtgattagtactttttaatatatttattagaatattaattagaatatataaaaatatttattagaatatataaaaatattcattagaatattcattagaatgtataaaaaatagaattaagctagttaattattaaaaaggcaagaatttgaatagagttcttctgtttctaatgcttatattatttttatctatatcggttgttcccaaagtttggtccccacaacagcaacatcaatatcactcgggaacttggtagaaatacaaattcttggacaaccaccccaaatgtacttaatcagaaactctgggatggagcccagtaattggtattgaccaaacaggtgatgtcaatgatgagtctgcacattaaataggccctacagatgagtttgatacacactaaatgtagaaaaccatattgttataccactgattatatgtctatagaggtgatgcgcccctatctttcttattattctcctttgactcactgatttttgctgctaaagcagaaccaggaaataattcaatgttttattccaacttactaagagatcccatacttaacaatgagtattcctaagtatattaaggttagcatataattgaaaggttaaaatatctaaaattcaattgaatgttttcactgtaaactatattcagcttcattgtcttctgctgaaagtcttattttacttcattatggcagcttaatgattctccaattcccatgttgaatttccaaggaaagaaacttataaaaagtttatgctcggggaattcttttgctttctgtgtgggagtggagcagttctttacacatcttccttacctccattgaaaaagacaaggtaactgaaggctgttggagtccatggggtgaggacttgttagcaattagtaatatgtgaagaaactgtctgttccctattttttggtatgctgaccataaattgatttgagtattcttgctttactttattgtaggttgaagggagctattgcttatgaggaaattcattgtgttctaaagccaattctaaatcagagtttgagacactgtttctatattagagattatctatattttattctggagggcaaaaattgccacttagatattacatgtcagtgcatatatatttctaaatttctcaggggagttgtgggagataaacaataatagtacacagtgaaagtccttgaatacggccctgattgtcccttcttttagcctagatgttcatatttcagttgtttgatttaatgaatagaaagggaaacataataattacaactcaaaattctcatatgaaatgaatctaatctcattcaagttgtctagtccctaaacacagtcagtaaaaggatactttagagctgttctcttgcaggctgagccgaggagtgaaaatggttaactgaaaactttgaaggatatttaagttgaccatgtgcagtgcatgtattggacaccagccaggacccagtaaaccccctgtgccaacattgggtagaactcattgataaccaaaagcagttagtagaacctgtctcagtgagtacgttggtcaatacaggcttcatgggaatggcccctgttattaatgtttgaagactatgacttgcccttacatggctgtgatttagagaactacccactgaagtcactgatgtagttcagtgtgtgaaaaacagacggcaaaccatatgaggtaagttaatacatgtaactggggatactgcaggaaggagacagttgaattctttggagaaaaagtggtttacaaattgaatacattaaaaatgaatattattactggtttactcatcacataaagaatagggccaggggataaatacctctctagctcttgcaactcaagagatgtttttcatatcttagataataaatacttgcagtaggtttagctcataactaaaagtatgtgctaagagactcccctagaagagtttgtcttccgacatgctgaattgccctggggttggtggcagcttaataaaatatgtgagtgttcagtgcggagctgttaagttatttattccacttctgatactgcatgcatgaactgccactgtttgatgaatcactgaagagaatgggaactgacaaacaactcttcctttagcggctgatcacactgacagcatcaatagaaaaacacatcatgggttctaaaatgccacattttcaccgtttaccctgaataagacatgaagctctttaaggaaagcagtagtacgttatcattaagggccagctgacagagaggcaagtgtgctttgaactctctcaagtcatcattcttaatttcttctcttcttagatggaaggcccacccacatgggttctgagcaaggcagggactgttgcaccttttaaaatctcattgatagattggtttcatcaacacccatcctgactcctgcccatcgggagaagctcctattctcattagggtcctgtaatgtctgcagctaacattgttctcatgcaaatagaatgacacagaagatcagtgccatgaaaattcaatttcccccaaccatcattaccctttttcttttagttattcccactccaatctgcaggaggtaatgtgtgcaatctgctggtactgtgcaagatgattactacattttagtgatgaatttcccagctattgcactagggggtgttttagcaggttccctgatacacctaatgtagatgtggcagtagtccttgcagtccttacccagctcttccatagtggatttccacaaggagtggatgcctggtcagtagaacttgtattcaatactgttcattctttagtcatcagtggcacttgtgaaagtagtgatttgtttaatgttgtctgaaaaataaaaataaaatatatctctacctgtccaaattgaaggattaaaagctctgtcaaaagaaatgtagtaatttttgtctttagtctatgatcaaacttgggtaatttaataaggatgtaaaattcagggtagctcatataaacatattgaaattataaaagtgtgtaagttaaataaaaatcctgttttagaaagaactatggagaagtcctacttgtgtgcagctgaaaagtaaggtaattaccaaagtatatttcaaattcctatacttaatattatcctttatctttgaagtttcttcagcaatgggattaaatatgtaaacattatattgtcagtggtttattacgttttagaagttctttgtttcttctgaaattatccccttgcctcttcattagtctggaagttagctgtaagaaaaaataaagggagagagaatgaagaaaaaatatatagattcaccaggcattacagatttgtatgtatgcccctgttcaccacaaacacaaaacatgattatagtttctctggcgattattagcctaataataattgtaaagggcaactatacaaaacacgattttcaatgtaatttttataaaacttatttatttcacaaataaatagatataatctttcccagtgaataaaatactttacatatggtagcattttacgtacaaaggtgactaaaagaattcagagttttaaacatttatttgaaagaaagaatgataattattttataaagtttttttggaaaatacttttttcttacacatggtgatgatgtatttgtagataaattgtatttatgcaattccattcacatgattttgagatattttcattggattgattactggctgaattagacatttttaaattactgaaatgtaccctcttaataatatatccttataattatgtcagagaggctgatataatgaaaaaaggagtcaagttatttctttacctgaattattctgttctataaactgatatatgtaatacatttcagtaactgtggcgaaaccatttagactgtctatgggacacaccatgcagtttagatgtgagcagttgcctacatgtggtacagaaagtcatatttgaactacagttttagtaccgctactttaagatagattctgagcatgtaattactgcagtcttggcatgtaattaccccggagttacagtttatattgacctccagaaataatgagactgtaattttaaagtaaaacatagaacttgagtgtaaaattgtatgttgattttgaactgcttgcattgtgagtttgttctcctgaagaataacttattactatgataattatcccagtttcctatggattcagaatatgtagagtgttattaaagcatcctttatgactgagtggttaactggttccacagataggtaaaagaaggagtactccagtggtttgaaagaagctgctgattacaaaagctccctccctgtaagcttcatggcctgcacttctcagaaagatagactcaatggagcatgactgcctagggcatctgggtcccaggaggttttagttgtttgtttaggtgttgagaaaaacacattatgaccgtaataataattatgtgtttggaattggatttttgcatctgtaacacaaagttccatcttgcataaaatgcaacctcagcaccattttatgcttaatttgcatatgaagcaatatgggactattcaaatataggcttcatttgactacgtaccaccagtgttaatttagtatagtattaaatgtctctgatgaccactcttcaagcaatgtttggactctttattaaggacaaatgtgtgtacacactcttagatgatattaaaactaaggttaaaagattttaaattattttcagtagtgtgtcacttttaaatacttttgcataacctgaagagagtaaagtagttgaacattatttagatagtgatttcatagcaattggttttttattttctgaaatatagcccagagatattttattttttgcttattataagaaatcacatttcaaaatacacaattcagtttgaaaatcagtaagttagctttatttattcccaggtgttttctgaaaatacgttttttttttcttagcctttcttaaggcaagaagcagtcattcaatttcccttattcttttctctctccttcatctttctcctttcttacccctttttctgttgtcatggttttttactaaagcatgtagttcttcttctgtacagaaacattccatgtaatcctcaaattaataacttcatccaaattatctacaaagtcatggtttgacagtaatgtacccacaatatttctctagtgcaaattcagccgtaccagtaatgtgttaaaaagtcatctttttctaaagaagctatagatataattcatctcttcttgaattcaatttgtaaaaatttgagagttaacttatcatattttaacttggaacatttgcaaaccttcttatgtcatagcttctcagtattaaaaaaaaaatagggcatatggcagaaaaccatactctgtaaaacacgacagctcaggagaaaaaaataaaacagcttaagaacaaatattatgtccatacactaataacaacatggtgtatatttgtactgtattttttattttcaccatttaatttgaaattattggatggtttaaatatataattctgaatggtggatagatattaaaataatatttagcttcataagtattgaccttacacatttagatgtcctccagacaaagaatgaacatgaaggtatcgtgctaggaaaagaattaccgttgtcttctgtgtttcattaaaatagctttcaggcagataaacaactgtttccgtacgtaagatccaagaaataccattttatggatgccaagttcagcgtcttagtgagttctggaaacttacataatggaaacagtacacacctgcctctgtgtcactctctccctgattaaaagtgatatggctaaggacatgaagaaccatctccctcttttatgaatcaaataacgtatgctttataaatgttatgtatttattctttcctctaataaggctacacatgggtttaaagcattgaggcctgcgttagggagatcagcactagaggtcagagacattcagaatcctgcagtttagcatttagcaatgttactttcttttttcttttcttttttttcttttgagatggagtcttgctctgtctcccaggctggagtttagtggcacaattttggcttactgcaaccttggcctcctgggttcaagcaattgtcctgactcagcctcccaagtagctgggatcacaagcatgcgccaccatgcccagctaatttttttttttgtatttttagtaaagacagggtttcaccacgttggccaggctggtctcgaactcctgacctcaggtgatccgcctgcctcttcctcccagagtgctgggattacaggtgtgagccaccgtacctggccaagggtattacttttgagttttcaataaaggcagtgttacagattttgcttcatttgaattctatgcaatgtttttgtagttcctgatatcaaagatgtctatcagcttttaaaatgtatatagttaaaggattcctcttgccatctaaacatgcatcaagaataaagaatctatacatagattttacaaaagttattttatgttacataaatcattcagaaatttctattcattcatgtaaggcagaggcatagctgattctgatggtagtcctgctaatcattcaactgctaacttacagagagtccaataacccaatgtcatatgttgtgttgttgtgttgtaaaccattcatttcacaatgctgtgtatttttaaactctttaatcacagaggtcaactataattgctggcatcaatttagagtcctcctgctcttttctttcataatgttccattgtcgcatgctacagtatttataataatttgaaattataactgtatgttcatgtgtttgatgtctgttttctcaacctgactgacaattctatttgttttgttcaccaacttacacctaatatttggacatggtctgggacacatactaagagctcaagaaaagtgcactgaatactcatggtttataatctttgaactgaatatcttactgttactttttttaaaaaaaaatctatatttcaaacttatttctagcatagtcaaaaatggtttctctcaaaggatggatgtatagctaggcagacatacatacagataaaattgatatattcatatacacatagagttctgttcttaagttgtaattatgtttgaatcaactacatatttcatcaacttcccactgcatagaaacagtctgattagaggatccattctaatacagaaacatacatagatgtgtagagatgctacatgaatgttgatactctggttgtgatattgtgctataggtttgcaagatgtaaccattggtggaaactaggtaaagggtgcaatttatctttgtattgtttcttgtagctgggtacgaatctacaattatctcaaaataaaaaataaaaaagtggtatgtggcatttgtgtaaaaattgaaccagacgtagaaaatgaggtgtaaaacaactctttttattattactttagcattagtgacattccatatttatcatttgcacatttaaatagtagggccaggctggtataaagcctttttaccgtccgggagggaggtggggggtcagccccccgcccggccagccgccccgtccgggagggaggtgggggggtcagccccccgcctggccagcagtgctgtccgggagggaggtgggggggtcagccccccgcccggccagccgtgctgtccgggagggaggtgggggggtcagacccccgcccggccagccgccccgtccgggaggtgaggggcgcctctgcccggctgcccctactgggaagtgaggagcccctctgcccggccagccgccccgtccgggagggaggtgggggggtcagccccccgcctggccagccgtgctgtccgggagggaggtgggggtgtcagccctccgcccggccagccaccccgtccgggagggaagtgggggggtcagacccccgcccggccagccgccccgtccgggaggtgaggggcgcctctgcccggctgcccctactgggaagtgaggagcccctcagcccggccagccaccccgtccgggagggaggtgggggggtcagccccccgcccggccagccgccccgtccgggagggaggtgggggcggtcagccccccaacccggccagccgccccgtccgggaggtgaggggcgcctctgcccggcggcccttactgggaggtgaggagcccctctgcccggccaccaccccgtctgggaggtgtgcccaacggctcattgagaacgggccaggatgacaatggcggttttgtggaatggaaaggggggaaaggcggggaaaagattgagaaatcggatggttgccgtgtctgtgtggaaagaagtagacatgggagacttttcattttgttctgcactaagaaaaattcttctgccttgggatcctgttgatctgtgaccttacccccaaccctgtgctctctgaaacatgtgctgtgtccactcagggttaaatggattaagggtggtgcaagatgtgctttgttaaacagatgcttgaaagcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaatcagtgataatttgttgatatattcattagttgtccacattccctaactcctatatttttgtaaacttttaattgaagtataacatatatacagaaaagtaacaagaaggcttaagtatccagcttgatgaatttttgcaaactgaacacatctgtatcaccagcacctggattgtgaaatagaccatgaaaagcaccacagaagccctctcatgccgtatctcaatctttaccaagagaacctatcttctgactccatagagctgtcttcttttatccccaacttttctatttttaaaaatttcagtatatagaaatttcaaagagtaaagagtagcaagcattacccatcacctagatgcaatatttgttactattttgctgaagtctatctctctctgtatgtacaacacgtaccatttgagtgtgttatttgcagatggtgatactttacccataagtactccagcatgtatctccagccggatcaacatggcaaaacccactctctactaagaatacaaaaattagccagatgtggtggcatgtgcccgtagtcccagctgcttgcgtggctgaggcataagaatagctcgaacccaggaggcggaggttgtagtaagccaagatcctgccactgcactccagcttgggcaacagggagaaactctgtctcaaaatttaaaaaaaagaaaaaaaagaaaaaagaaagaaacattcttctacataatcacaatattttcacactcaggaaatttaatattgatataatcttattatttataaaaattccataaccagatatccccaattgattcaattgcatctatcataatgtttttgacacaagatttaattcgggattatgcattgcctttggcccaatatctgtttttccttttctcttgttctatctcttagtttgaaaactttttccagccttttaaaaaatatttaatgacacagaagtgttttttttgtttgtttgtttgttttaggcggagtctcactctgtcgcccaggctggggtgcggtggcgccatcttggctcactgcaggctccacctcccgggttcccgccattctcctgcctcagcctcccgagtagctgggactacaggcgccgccaccactcccggctaatttttttttgtatttttagtagagatggtgtttcaccggttagccaggatggtctcgatctcctgacctcgtgatccgcctgcatcggcctcccaaagtgctgggattacaggcgtgagcccccgcgcccggccgacacagaggtttttaagcagtccaggccaattgtttcatagatagatgcctcatacatatttatgtctcatagaaaaagttacaaatgtcaactcattgctatttatgatgtttctttattctttcttgcacttacatggttcagcatctggcccgtaggaggtaccaaatggtgataagttcattatactatcagtttaaaatcttgtctaccagctctgtgacaaactgtacaaatttgagtaagcctgttagcccctttagacctaaatatctcatctttgagtaaattgactggattatcttccattgataaaattgtgttatttatttaaacattgtatttggccatgttaccatatttgaagttagtattactaccatggaatggaaaattatataaatatttcatcatctagtattctgaatagagtatcaactaattgtacaatcttatgaatggttaccaaagaatttcagaacattctgtgtagaaaatatagtataaaaagtctttgcaattgctctaatttagacttccaagttgttaaaacatcttttgaagacctaggtggcctcactgctaggtatactctctttattcactttatctgttgcatcctttatagcctacttgggaactttttttccttgagctcccagcataagagaggctactggggtggcagttaaacccatatgtataattttgccctgtatttcatttcataaatatataagtctttttctgtattcttcaagacactgaattttctgcatgatatttaggccttaacaagttatggtagtttagaaaaagatatttaaaaaacattgtatcttgttgtgtacattagtactgttacaaaggttaatacatatttttttaatatgctgaattagcccttgggtcttctcacttaacaattttgacaaggttttatggaagttaccctgacacttccattagttattggacaactggaccttcttttctaattgtcttccaaaaaaggggacatgatgtttctctgccgcattaactttgttgtttcctgtaaaacttagcaggcaaaaatctgagcttgtaaatgagagacttgtcttcgtcttgatcagagacatgaaatttgcaatttaaatgagaaaaaataatgaacttaatgcataccttgaaagaagtgttgtaatgtgccaatttggttctcataaagttgattctacacatccctatgaaggtattgattgtgtccatgtagtaaagctgagggtgccgtgaactcctcagtgacttggcatttcatcgttacagacaatcagccttccaagcacttggcttaacatacctccagcccctaaatacatgacgaagtcagtggcagaatggctgtgcaagtagtctggctcttaaccttaatgctagccttggtcttatgaaatcttgttattaagaaaacctcatggctatatacagttaaaaatgaatgtcactgtgaaatctctacttttaaggagttatctggcctccattggtagtatttgcctactcatatttgtcaagttattctttgaaaactagcaggaagaataggaaataagaagtctgatttgaaatcttggtcttccttttcttatttcctttaccccagagacccagaaaatggagctagctacatttctcacacttactgtcatagttacatgtttatattctattagttgtaattatttttcacctatcctctcattagaatgttatacctatagagcagataccattccagttttaattttttgccccgactcctagtaagtacgtgacctattacagggaacttaaaacaaacaaaaagtctgctgagtctgggatgttttaaggatcgaaggaacatgttggtccaatttgccttcacagagggttacctctgctttctaccgaatgtgaattgctcccatgtgattttgaagaattccagtctacctcagggaaggaccacatgtaatgccagagtctgcaaacttggcagcttttaccctctctcatctgtgggattgttttgtcctgggtttagatagctaagtgtctgtaaaaagattctttttgtcattaaggagcaacaggaaatggagagcagcagtgactccatttccagtgtctaaagaagaagacttaagcacaaagtaaggactttccctctccacttgtttaatataatgctctgattgcatccacacgtatgcaaatggaaacattcagattccagctcctaaggacatgtgaataaatgaaatatgtgtccgtgttcttatttgctgagtgaatttatgaacaagtcaataggctgttacagataaagtgattatttaacattgtgttaaaaacttcacttggaaacttggattatttcttaatatttataattggctatcttagccaattatcttagatacctatgattaaaatagccctgtttgaatttttgtcttcaaatttgtcaagttttagtaagcatgtgtcattatctaccagaccacctctaaattaaaataaaaagagataatcagaatactgacttgccaagttgtttgtgaatcacacttaccaggtaccagatttgtagttaaactcctcccagaatttttccattagtgttatagaaatttcacatgctaaatacaatgcaagtatatactgttaaaattttcagaatatcgtttctgaaaattactttgctccctgcaaatccaccctactcacctgtatcatttgagtgaaaacttttctgtgtaactgtgactgagcagttaaaccagaaacctgctttaggtaaggactgccttgatgtttgcaatttttcccacttttttcttttcctttctttttttattttttcattttaaagataaaggtcactctaagaaggtagttcctgagttaaaagtgttccatagggttggggattacaatagaaacagacaccgttccccaccaagggggcaggagttgagcatgagcctccccactgtggtcgtcctggggtctctggggggtgggatggcatctgacagtgatgggcttttcttgatggcttcctttctttgtacctaactctggtccataaatagagcatcacatcatgctcccagactgacaccggggaagcttcataaatcagcaagtgagtgttccggcatgatcctttggccactgccttccctccagagctgacacctgtcaccttttaaagagtgtacattctctgtcactgtagctgattcctgtcttttctttattcattctcatatgctgcctaggtggtattatctgggtggctgcccatatattatttaaatcattaccagtatggcctaggtaggtttttaattatgcctaaaaacttgatagttccagatagttattgggtatacaactaagaatataatacaaaatgcattttatttttaaaagaacatacatatgtgtttaacagatctaattatatatatatttataatcaacaatagaatattgcatttaggtggcttataaataataccttaaagcacttaaaatgataagaattcttaagaatctgtaagaatctgagagttaaggaaagtgctttgaatatccttagactgttaccttttccaataagtcagtaagcattggtgatttgttaatattataaaatacgtatcttctctgtggcacacgtcactttattggagaaacatatgtgactcaactcaactgttatctggtcctattttgccctaattatggtttctatttaaatggcattatagaatcgcttagcttttaaagaggggcagtggaaaagatctgtaaaacttcagcaagtctataatctacatgagcagaaatttacctctcttaaatgtctacatattaatgacattaaaaataaaataatcgacccatgttggggatttctgtgctttccccaaatgaatgtttaaaattttattttgaattctattaaagtgaataatgaccacaaggtgtttgtaattggggagatagtaagtgcaaaatacaagcagagggtgcttaaaaagaacaaaaaaagtctgtttcttattgattggcctgtggtgggataaatgtgtggcttctgcctttaatggaagctgattgttcagggatgtgccggtgagactggtcgattcttgagctgttgtttactgggaaggacaatatgaattttctagagggatgattggtgggatgtcaaggctgtcacccttttctcctcgtcactgacagacagcccggtgacaattaccagtgatgggacattgcctgcactggcatatacactagaggatataactggcaaacaacaagagaggaaagcactcctggaaaaaagatataatcagcagttgtcaggactggttacatatctgatgtctgcataacagggccaaggcacattagctttaccactggggtaacatgcagcctgcttcgtcctgcttagaaaactgatcttagaaattttgggaagtttagaggataacaagaattgttggcattctttctacttgacagttaatataagaaaaaaagtattttacttattttttctaattaaaataaactttgggaaattcaaatggactggaaagtagatatttgtattctttacagaaatagttatatttgtggtatgtttcctcatgagttaacttttatgacttttcttgccaggcttctgttattggcaaaagtccaaatggacactaataagttgtgttgtacaggtatcagaatgagagactcaattccataattttgccagagaagcatcatttaaatggtggagtatgttctatgctaggtaggtagtacacagacatatccaccagattttctataaagattcttctgtcagtctcatgctgtctatttccttccgttccattgcttcggaatttcaaataagtttaaagaaaaagatcagcatttccaaagcctaccttaatgtgtagagaaactaatacctaaattagaccacctggaataaaagagccgtcaagtagctgtatttatttctcagcaagagactattctttgtgttaatttacaaatgtaacttatttaattaatcatgtttaggctaatcacctcttagagtcaatgtattctgctggaagtttactgtttggaaaaattcacaataagtatagttttatacagtcaaatttacatatttttgttctgtaggaattagtcatctctttccacccagggttttcttaacatcaaaatgaaaatgtctccgcatgctcaggtaagaagatttttgtcagtttcccaccaaaatatggactgggaacaccttgtaagcttctactcaaatgcctaatgaggattacttttttcataattggtcactgtagagatgaaaataattggctacctaatgttggttatctcctatctgtgtggcatccatgacttacatcagatgtatttctttttttgtgagaattattttcttaaatgtcttttctgatttttttttaaaaatgtgttaattacagaatttggcaaacattataaagtgcaaataacggtatgaaaatcatgcattattctaccattcagaggagtgcattgttaacattttagtattttttccatttggcttttgtttgaagattttaactgtttacatttgtgtatgttctgttgagtgttttcagtgatgccatttttcatcttgaatcaatatatagacaagtagtgtgattttggtagtgtccttttattttaaataagtaggttttaatactgctgagtgattacatatggaggttatttctggttgggcttataagattccatataaaagttataattaatttccttccttaaaccaagggctaattgattttccattgcactcattaaaaatagatacttagcttttcagaagattgtctcagaaacccaaggcagggcccaggccctctgggatgccatcaactgaccattccatcagtcctagaattgtgaccctcctacttgtcagaactgaagtatttatcccatttcccagcagataaacatttgcaaggcaaataataaattagccattaatcagaagaatgtttgcattcgatgaactctgaatggagtggagatgtcaggtagatagacaaggtaaatcaacatggcagaatcaatcacaaggaagagccagccataatttagaaagcattgacccaaatatttaacgactttggaaggtaagaacattttgtaaaggaagaaagctatttagaaaaaggtgtgggtagattttaataatagatagcaattaagttttaaacatttaaggcttcagcctaatgatagacatttggaagtttgatttgaaaaaagagacactgtcaaatatttatttttaaaggcccgtgtgttcaaataattttttctttcccaggagtgctctcatgaaatgtacccacattataattttttttcaaaaaaacaatttagcaagtatattgttttaaaagcaagaagtgaccttgttatgttggtgttctttgattcctaattgtgtttgccccttcatgtgtatgatgcaaagactttcagattgagagtctgaaagtcccatgtgttgagctttgcttggccacttaataatcatgtggtcctggggaagtaacttaaccttttatgacccgcaatttcctcatttgtaaaataggtcttggcaccattcatttttttacgtagaagacatatgtgtgttgtataaatttattctaaggcattattcatattttaaaattcttaaaaaaatcagttattgttacatatcttgttctcatgtctaatcagttagtgcatatcttgtttctgaaaatgttatacctaaagggattaaaaggctcagtggttataaaaaacaatattatttctcctaattctcatgaggttagaaactacaacctttgttttcttagaactgaccatcagggaaattgcttttgactccaaacacctaccatctggcatatcctatcttctcattataatatgtgatgcctaaatttgtgagacatcctggactctccacatgtgtgtttttcatttcttgaccccaacgtagaagaaaggatggaagtaaatggaataaacataattctcaccgttgctttcctagttcttcatttctcacctactcactttcttcccatgagtacaattctatcccccagttaggttgtgcagatgaggtatcttttcaagtaatgacacctttaaaccaaaacattaactgagtcctgggtgtccccctccccatagctttgcttgactaagaaaattcttctaatccgaaattttaaatgaaaacatgtaatgttgattaacattgcctgaagcacagagtacgattaaaatgttttgagattttagaatatataaatcactcatgcaaaaaaaaaagagttttctttatacaatctagaaacaattatattagcccgtattaataggcttcaaatgaaaaacattgaagccaatacatttcaactgggtgttcatgctacttgctgtggggttttttaaaaatttatttctagttaataccccttatccccatgccatctttgtctttctgtcttagcaggtaactttaacctaaatttcctgaagaaataggaagttattgtatgtgaattatttattgcttacctcaaaatttctccaaatcttcatttatcatttcctatttctgttctgatactcatgtctgtgactaacaaacctatctgcttatgtttatgattttcatttactccagtcgaaacctgtcaaatagctactttttcagtctcattctttattaattcttccttacaatataagcatacccagttctcctccatcttaaacacaggagagtatagataaaaagaaaaattctataagatttcatggagaaaaggaattatgtttagctttggatttcaaaaaggcttcataaaagaaatggcatttaaaaatatcctgaaacactaatattataaagcctgttttaacataaatactacttactgtcaccatacggtttttgtttttaaagttgctcacttctaatacctgaggctacaataaggcacataatcttcctaacagtttcaatttataactcatatttttcatgacaaccctgtcaggtaagttgtattactattctcattctgccgatgtggaaactgagtcaaagaaagattaaacaacctacctgaaactatatatttagtagtaattgttagaaccagagtttgtacctggttggctccaggttctgtgcctggccactattcttattgcttctccacatagtacttgcatatatgattaaccatgaagctgttggctttagaagtcttgcaaatccattttcagaattagtttgggtttttgggttttttcggggttttatagagcatcaatagggaaatagcatgaaataggaacagaaatgtagattggaatgataatgtagaggtccttaaattctagactgaagaattctgacttaatttaattggcacacgatgaggaatcgctcaaaattttgaacatgaagtgatattgttggatctacgtgttagcaacagtggacagttggaggcaggaagtgtgtgaaatggataatcatttagaagctattgcaaccgtgtgggtgagaaaccaggaagcctaaatcaggaaggtgactggaaaggagatacatttgtgagaatggtttaggtagcatttacaggattggccaagctgggatagtcatagatcaaggcaagcagggagagaggtgactccaagattttaaatcataacttagaagataaggagctgctatctgaacactgatcaaatcagcctgaatatttattaataatttgggaaatatctgccttggtacatgttgactttgatatattaatggaaatttcagataacgttttggaaacgtcattctgtaagtagggagaaaaatcagagacagaagtataattttggaagtatctagccaaaggaagttgaaaccatttgagtagatggaataatgaaagaatgaagtatggaagctgaggtggagaaagcctgaaaaattagtctgtggtaggacctccattaaatcagcaaatagcaggaacagaaagaatgagctgggtaagaagagctccaaaagattgagggagaactagaataaggaagaatcataaacaataaaaggaaagggaattctaagaagcaagagagggtcaaaattcatttacttcagagctaattgagaaaaaaaaggtgtttaattcatccaaaatctctaaagaaaaccttctgttggccattattacagataacctttaacaatgataaatgtacagtaactacttacatatgaatgagtcagtgaaaatactcggacggatttttccctttcggtgcattcagggtctgtgtggaagaattaatgctttcagaatatttgtttgtaaacacaccatctctaaagaaaattttagggtttctattgattttttgatcaggtgttcacatatgtttaaaattataatggaagtcaatagataaacgtgacttggtgtacaatatttacctatacatggcattctagaagcatatatcattagaaagatcacaacatagtttgttccattttatgaattgattcttatttatctctgctgccaaaaacttgtggatctcactagagccacacatgcttaaacttaaaaaacaaaaatattttagattagtgaaatccaaaatttacattttacattttttaggaataaactgcattatattaaaactgtatcactggtttgcttgctagatcagaataaattttgatccagaagtctgtgacctcttgtttggatcaagggttgtttcttatataaaacttacaagttcaatactgagactgaacaaagccaggaaacaaaaatataaatttgatatggtctgtttgtagaaaagacaataaaaatgttgagtacttatttacaaagcatgtcttcaaatttttctttaaagaatctgtaggtaatctgtattgtggattcattaagtttttgacttaaaaaaatggaaaaaacacaaaagtaggaaaaagagatttctaaaaggttattgttaccactggttacttgtaaacctacagttcactttgcactaaaactttggatatgtctcattgattagaattttataatataaaaatgcagccaaaatattttgagttttgcattttaacaaaatttcaagtccaaaacctctgaagatgttttttctcattgaactaggcaagtcggaaacatactcttaatcctgtcaatggttctgagagcctctctgctttaaatatatgataatactttgtttcatgtcatcttattattggtagtacagtcatccctcagcatctgtgagagattgcttccaggacctccaggggatatcaacatccatggaggctcaagtctcttctttaaaaaaagactttaaaagtactgtttgcatacaatcttgtgcatcctccttcatactttaaattatttctaaatcacttataatatctaatgtaatataaatgctatgtaactggttgttatactatatttttttatttgtattacctttaattgttgtatggctattcttaaattttttgccaaatatttttatctgagcttgattgaatccacagatgggggccattggatatggagagccaactgtggtttacagtctagttttctatttttctagttaaatatataagtagaaaattaaatttttaatcaataggcaaaagagagcaaggccatatactttacaaagaccatgaatgatttgtgaagtagatctctttcccccttcatgttttccaataagtcaacacaaatctctcttccatttataattatgtacgtatatgtgctaaataaatattatgcttcccattcatacttctgcaactccttcattattttctatttccttcattcagctaatatttttctgaatatttatgtgtctagaagtgtttaggttcaaagagagagcagtagacaataaagacaaagccctgtctctactgaacttcctggggaaagagctcgattgaaggcaaatctataaacaacataaaatttaagattaagtagacagtaaagacaacatcacagaagataaggggtagaacatgctgttgaggtatgggcgcgctacaaggtaggatagatgaagacaatggagaagagcaatgtgttgcatactatttccatgccatataatccagatttatcttacccctccattgatcgttttgccctgtagatctgaagtttccaatgcacaaagatacagtggcagaatacctcaaatctctctcaaatctctgccatttagaactttttgttgatgcctagatggttggctttgtttcttaaagggaaaaagtactctttcagtgtgtttgctctcaactcatgctcaacagcaatgatctcaaatctccaacacttgctcatcaaaaaatatatgctcgcgaatagatttcagtgcttcagattaatgaaaaaatacccatccttactaaacaggtgagaatgcaagctcaagagagccagcaaagagaacattttaaaaaatgttaggcactaataacactttgaataagtgtcattttttgaaataaattttataccccccacagtgtgtatataattatatattgccatgtacatattttaaaaaataatttacataggacatatttgactcagattgcacttaaatattctcttaaatatactcctgaagacattcttatttttagtgctttacagaaatattttgaaaataggaaggctactattagtaagagcaaattgaatttgagtttgatttgttaagaaatacttacgctgttctctctagtcttagtgtggtttcagcattagtcttactcgaggcagttgaatactgatatgattgcagataacttggcaatctgctaatggttccaggaggttcattttgatgtatttagtgaatcttaggtaggtaggtatgtactaacatatcatagtatgtggtacttactatatatattcctcttatttacagctagctacaaaatattgcttagaaacactgaaaatgaaaggctatttttttttaaaaatctgtcttttcctaataaaaattcaagagctttaatatttagtaactgcctttaggtttagtttgtcagtgcccttcacgcgcttaataataggcttcaaaactcctggtcacttgctaataactcttcacttctcgggagattgaattgctataggccagttttcctaataagcctgcaaaaaaaaaaaagttaaattgaagactcatgtacgtatttccttttcagctattttttatacattgccatgcaaatatatttcattttttcatatagctcatgaatgtgcatgaatacatacatatgcacttaacaagaattttgttttgaaaaaaaatactgtggtatatgagaaaaattgtaatattttaaatgaagatattagtaccagagaaatagctaatcaaatgtaagaggcaagaaaaaaaaggccacacattaaacttgtgcatcatcaagatttaaaaaattaataacattaaaaacagttggttaacattcttttcttttgctatctatgtcccgtttcttttaaaccttgaatgtaacatataacatttaatctcctataaaattgtaattattttccaccaaaacacaaatgagtaaacataaacaaaacagaaacaaagattggcctttatggaggaattacatgtgactacaagaagagattttaaacaactgctagggtgcggttaaactgtctcttacaagttgcggttctggatgtactctgttaaggagatagtttcatgaacaggagcccgtttgtaattagataaggaaaactgacagcagcagttgagttagtggctcccatggaatgacaggtattgactgaaccctgggctgtgtttgagatggggagggagtcgataaaagcatcagggcttgtttggagtaacactgccagcaatgctttaatttgccgcctggaaaagagccacagacattcttcccccatgtttagtgttgatgagatctaacacttacatttaatcttctgtttaccactaaaaacacttgtaagtggtatatggcaccacaaagaggaaatagaacagggaagcacattttgtataaattctatgttgcagcccaagtctagaaaaaaacacctcatttgaatcattgaatcaagtgtggaaggaaaagtttaacaacaacaaaaaatcagtttagaacaaatgttttaactgattttgaagaagagatagggagtagaaaatgtttctaaactaccttttgaattctctctctctctctctctctctctctctatatatatatatatgtatttttttttttttttttttgagacagagtctcactgtgtcgccctggctagagtgcagtgggatgatctcggctcactgcaaccttcacctcctgggttcaagcgattctcctgcctcagtctcccaagtagctgggactacacaaattctttatctatttttctatataccatattggtttaatgaaaaaaagactgtaaatggaaaagctgtgatgttcatagacacattagggatgtattattatctctacataatttaaagattcaattttgtactctgtttaaaagcaaatgtattcttattaaatacttcccagatatttttgaaatgtcttacataaaaacatatgtatatataaattctatgataaaatattaatgtatagttttatatgtggtatacactttgacccataatatctacccataaaaatccacaaaagcacccagattttaatactgaccattagagaactcaagcaaaatgatttttgaaaaagagttacttctggaccagatccaacctagctgcatttaacttgctgccaaactcaacagacaccattataaaatttgcacctacttattattacaaattcaagtaatcccctaactgtgaccttcagtgcctaattaaataagggcagcatttaaaaatactagatgacttcaatcttacttagttgccagtgcttaatgcttcccacctgttgtaacacagaaaatgcccaaggtagactgcaatgcctttggttttgccaggaaatttcaaaagcttagggttttgtagtgaatccacactaaactcctgttaggctcaattagatgatgtactgagattatctgacttgttgtggagataattactgtaccagggatgagaggccacccatgcttccaggggaagctcattgaggaggctctttccctatttccatatatattccaaagctgtgtgtgtctgtggaaaatgaattcaccagtgactgagaatacggctctgaatttattaaaataggacttgctgtgctgaaagaattttatttcggtatataattttaagcatggaaaattaaagaaaatcaagagataagtataatagctagtactgtctcacacacgcctaggatcccttagatgtgtaaaatgtatccccccttctaaagtttctgcagaaattaaagagcagaggaattaggatttaaccaaataaaatgtttcgcttgaaaatgcattaatgaatactgtaactaaaagaaaatgatgctcaatattcttgcttttagtgtttttcagaatgtatcaataatgttggatcgcattattttagtatatgtaaattttcaaatatttaattatagtgaaaatattttaaaatgcgaagtctcatatcaattacgtaacatatttttgcaccaagtccaataaacttgattcagtcagccattacataagtagggacaactgttaacatctctcttactggtacaatgattgattgtagttaggataaccctgagtacttcacgtttcacaaaatcagtatgattttagctatatctatcctactgttatgaaagtttttagtcaccttctgatattttgtagatggttatttctttgtatacagttgtttcatgcatagagcttcattttatttctttgcaaagaaatatttaatttatatttgtcagcttttgtaaccatgattaacaagactaattgagattaaagtactgcctatcaaaaaatttccaacagttgggactgaatatttgggcaattcatatgaatttatatttatggtggtggaaaaagccaaataattcagaatttacttgttcattcaacaactaatgtttgagaaccatacttggggttaagctgggacaacaaaagtatacacaagttcctttcttaaaggatcgcttgtctaggaggagagaaagacatgtaaataaatgattgtagagtacagtgtgatcagcacagtaatagaggcatgtgcaagcttgaacagttattctgaaggagggagcaattaattctgtctgagatgggacaggggaaggattgaattcgagcccgttcttttgaataatacatgaaagagcactagtccatcctcctaaattgagtagtttagccaaagagagctgccaacctatcgatcaactgatgagaagacagaacttagacctagcaggcctaaatgaatagtgagctgacacaagcaggtatcagtgccatttgtagctttatccctgaaactgcaatgagttggtgctctcaacaatctctccatagagactctgtgttcccacagctgaagaaactttatacaaaggtgttaagtaaagactgtggagagatgcaggtaactaggtggataaatggtattatatgagacctcctgaatgcaaaaacttttcataaaatacaagtcaccaaatctctttgaatgaaaattttatttaagcatttctgtatgtttggtaaggtattctccctatcttagggaatagaaggaataaacaaaatgaaacaaacaaacaaaaaacctttacttgattttgttctctgcctcaggtcattataatctacccggtcaggctccagactgtctctgtaatttcatactctgtaattcactgatgctggctcctgttttatcactaagccattaagctttctcaaaaataaaacaaaaaacaaaaaattgtatttgttctagcctccaaagctgaaacgttctttcctttatcttctcccccataagctttaaaaatttcaggaaatctagaattccacattctccaatgttgctgtagggattaccttctcaactggacatatgcctgggtggtctataatacttatgggctgagttatttcctcacaaacttcgaatgttaaaattctaaaccctagtgtctcagaatgtaactggatttggagacagggtctttagagaagtaattaagttaaaatgaggtcatcagggtgggccctagactaatgcaacgggtgccctcataagcagaagaaattagaacacaaacacacacagtggaaagaccatgtaaggtcataggaataagatggccatcaagggcagaggccttagaaagaaccaaccctgctgaccccttgatcttgaacttctaggatccagaattgtgaaacaatatatttcttttgtgtcggccacccagaatgtggtattgtgttatggcatccccagccaactactacaatagagatgacaggtattgtttgtgtatttcatcagttcattagcattgatgttttgttccaactggagtttcttaatcacctcttgtgaacatcatacagattactgttcccagagtaagcaccaatacattgctgttgaattgattaactttcttttcatgttttcaaatgatatgccacaattcacaagttgatttgcactgtgctgcttatcacattagcacacagcgtcaatttttctgctgtctttaaccaccatatatttcacattaggttgcatatgagcttagtatcttttcccttctgatcctggacatcattagataccatgaaacaactgaacctccaggataaaaatatttatagctctgctcattgaatgaagaggagcatgtttataagatggttttaatgaatgaaggctctggaggttttcttactgctggacaacataacctgaatctccagagctggttttcactaattacaaagtgtatgcgttttctccttataaatcttgcatcagctttatttttaaattctgagatttgtgaaatactgggtcttttaaatcaaaaatgcaaaactagaaatacagtcattcatttaccaaaaaattttgaagcagctatgcgtgaagcactgtgggagatagaaagatgaattagaagtggactttgccattaataactttacattatgataaagggaatattatatgcaaaaaaggaattatgagtgagtggaaaaatatatgatccagaagtgatgcagacagaatgtgaagaggtcaaaggatcacttctgtttatgggaaccaaataatgacttctggaaagttggtgattgattttagcatgcctaaaacagaggatggggtttgggtttgcacatcagggagatagaagagagaaaatttcaggatggtgggacaatgtgagcaaaaggtaagaaaatatatgtattttcaatccttatctggatttaaagaaaacattgaaataagtttgcttaacattagttaatccttcagtgttagctttaagaaattataggaagtaaaaatacatctactgtttctgagtatgggtttcacatgaaaatgtgctgcgtcttttatgtatacaatgaattatgaagaaaagctttggataatatttcaggacctataattggacaagtaagactgagatgatataatgcttatttttgcatcctcagattctagcatcatagatggcatgtagtagcttacagaacttcttgatgaattcgttgtaatttcagcttgaaatagctaagtagccatagaaatagagtataatgcatggagcagatatctgaaaacagatttggcaaaatttgacaagtctctgggttcagcgctgccataaacagaattgtcaaatatgattttaaggcttgaagctgggatgagaggtagaatgatagttccatcaaaaatgaggacaggagtcagtttattgaaagataatgacttcatttggtgatctgctgttggaaatataggatagtggataggcatcttagattcagatatagataaagtggagaattatctctttggaatggttgttacagacagattactgaaggggaaagtatagagagtcaaaggtgatgctgaagagcaggtttttagtgaatgagtatttttgaaggagagaagaaacggaagcatagaaggaaagaaggcagtagtcagacaaatagaaggtacatcaaaacgtcagtaacaaaaccacaatgtaataccacgttagtcctgcaagaatggccataatcaaaaaatcaaaaagtaatagatgttggtgtggatgcagtgaacagggaacattgctggtgggaatgtaaactagtacacccattatggaaaacagtgtggagagtccttaaagaactaaaagtagaaccaccatttgatccggtgatctcactactgggtgtctacccagaggaaaagaagtgattatatgaaaaagataactgcatgcacatgtgtatagcagcacacttcacaattacagaaaggtgcaacctacccaaatgcccatcaatcaacgagtgaataaataaactgtgatacacacatatatatatatgtatatatatgatggaatactagtcagccataaaaaggaatgaattaatagcatttgcagcaacctggatgagattggagattattgttctaagtgaagtagctcaggagcggaaaaccagacatcgtatgttctcactcacaagtggttgctaagctatgaggatgcaaaggcataagaatgacacaatggactttgggaatttagggggaaaggatggaaaggggatgaaggataaaagactacaaattgggtgcagtgtgtactgctcgggtgatgggtgcacccaaatctcaccatcaccgtgaaataacttgctcatgtaaccgaacaccatctcttcccaaataacctatggaaataagtttttttttttaagtcagtgtcataggaataggaggttagaagtagacaaaaatgtttaatgtcatggggagattaaaatgaagttagtggggaaagacctttggttttgaagaccagaagctttactggtgatcttgtaaagagcaaattctatagattaataactttagattctaactggtaacagagttaagaaataaatgagagattattaataaagtaggaggtgatggtttacaggatcagcaagatgagaagaaaggccctttggaatcaagggagagcatgcaggcaaggctgaggaattgaagtaataatagaaagctagtcagtgaagcagtactttagtcaaatgcaaaagagattatacggagcacagagggcagtctaggacttttacaaaactaaggatgttgatttttcccccatattgagagaattgcttttaatagtcatctctttaagtgtgttaacaatccttgaaggctgatattaataatttcattttagacatcaaaactgagatttttttttgagagtaagcaatgtgattccaaagatataacctggctttaaaacctgcagcctttctactattaccatcttgttttttaatgtttgtcctgactgattagctaattttaaaaatgctttaacttcctttgattaggcaatattatttatagattgaactggcttgctgaattgttacatgttacgtaatgtaatatgaaccatgtcaatgtcagctgattataactcacacttgcggtattcaagaggcaggaagtgaaagctataagttttctgtaatcattgtcacaaatgtaatcgcagctattgtttcttctgtaagattctcattgaagtaaatgaaaatgaagacaaatgaaaacgaagacatcaataagactgatccttcattgtaaaaagctaaaacaggaaagcagtatcaggattaaataagacatctatattaaaatatttcttctatgaagtggataggttagaagaatatgaaattattattagatcctcttaagctaacttatctatctagattaacttgaaactggccattcagcaaagtgcaaactattaataacacattcaggttaaaatgaaatatacctaagatttgtttttgccattcttaggcatccaaaagttctgattggtatcccaaaggcccaacatcccaattgtaccaaaactttgaatacagttcaaaataagtacacttaaaattagcaaagtctatgtcaaaacagtaaaatatccttatatttatgatgattgctttttatctctatagttgtttttggtctcgtttttacaggcaggtgaatataatgacttgttgcacttataaaatacttcagtcccactgcagaatctgtggatcatccttacagtcgctgcctcatgagcaatgctacatattagtattttttgaaaagactttaggcaatctcttcaattttatttattttggcacttggaatctctcttcatattaaattgtagaaaaagcagctctgtaattattttcagtccccaaaagttcagtcttttcaagaataaaaaagtgtattatgtttaaaatgaatgtatagaagtataattagtatatttgtattttctttcatcatagaccattgaaataagtagcagaaaatgactttgcttttttactttaaaactcagtaagggatgaaagttggtaggtaataaaacatattaaatgtaatcaagaatactgactgtctaaatgtacgctataaataaaattatttccaacctctctattaccataaactattagaatagtattttcaaagaaggtgaatgagtaagaccataatttttgtaacattaaacataagaagtcctagatctattatgtcttgcttatgtatcaattatctttgatattatgtggattcttcttctgaattatcagtgttactaaaaaaaagaaagagacagaaagatttgaaatgaagtaggcttatttacttatatattatttgctctgaagggtaaaagccaactaaatggacttacaaacatacggaaaaattaatgtataggatatttttccaaccaaaggattaaataatatgaaagagaaacactaatattagtcaaacagagctacctttaccctagagagttattaaagtctagatgtgttttatatgcaaaatggcctgtcaggattatggaaaaaaattctgacacctgcttctcatcagtgccccagaaacaaaggtgaagaaatgggtttctgagcatgggactgcattgcttcctgggtttgtcttaaaaatacatgtgtttttatgtggcattttcatacttatgtatgagtctttcattcgtttaaggcagaaaaagtgccagtaaaagtaaatgtctagtgctaaaacaaaatacacccttttcaggataaaactggcaacaagcattttattatgttgtaagagaacatttttactgttttctcatatactgttacatctctctacattctgtgttcaccaaaaatttaaaaatcactagtcctgaaattatgaaaatcggccactagaatatttgactaatatatttttagaattatagtcttacatagagccaaatagcagactagaataaaagggattattttaatatattttcaaacaatgcttggtaggaaatgataacatttctagttcaagatcaaatatttgaaacttgaagccagattacttttgtaatcttgtgtgtgtgtgtgtgtgtgagagagagagagagagagagagagaaagagagagacttggctttctgattcaaaatacagaactttttcttatataaaatacgtgtttaagtagacatactgtgtcagacactattaaaaaatgactgagattattccagctgaattagaacccttctcacagattatcacagtgatttggcccccgatgaaatttctgagaattttatacttgtgatgtaacaaattttgtaaatgattattgtactactttgttttggtttgaaattttaaactcttacaactaggtatgatagggttaacatgtggaacatcttgaagattatatggaaactgaagaagttacaggtttgctgagacaagaacactgaagataagatttgtaacactccctcttagaaatgaccatggaaagatgataaatgatatttacctcatatgtcatgataactgttttttaaagaagatatctgtgccctctgttatcaggggtatgggaacatgcatcacttacaaacactcaatcaccgtgacataaagaaatagcaaaccttgaacatgtcagaacagtgcctgttcaatctacttctgtttcttgaacaccgagtttattctcaatattgtatccccaaaacaagtggtctttagaatatgatgtttactttctggtgagacttttgtgaaacatgtaagcgggtatatgagtatacacagtatgtaacaatttaataaaaatatattttagaggcaaaaactatttcgatagaacagcaatgtatctgtagttgtatctttacttaaactgttaatatttattgaatgctttctatatgccagatgctttgctaagagctcatattaaacacaggctggtactgtttttactcccattttacagatacaaaaactgaggcataaagagattaaggagttcaaggtttcccagatgtagttctaccttaagtataatttaccacattatttgaattttctgatactaaattcaattggcttaggttactggtgttagcactcttgtccgtgatctttataaagtatacacttttcatctccatgaaaaagaggaagtagtttgggttgatttaacattgactttgaaatgacgtatttgttcttctgtagtaatatagtatttttctgggggaaaatttgacccttgtttctaaagaatgcatgaaatttctgcaaagatcctatctatattaaacatgggttgtattccaaacatttatgaaagactagtgtacaagtaaaattggatagttatctcaaagttactagaaaattctagctgtgctcagaaaaagtcttgttttgtaggtatttgcaactttttcagagttgcattatctgtgtgtaaaatataaacaagaattctgacctctattcttaactgttgcaccagatgtttctcaaaataaacgatattgtctgagtgctctataaacagattccaacctgaatgcctccttttagcgtccctcccaatttaacacataaatatgaactctattttcttttcagacaaaacctgtatagtgtaactttttttacgagaaaacagtgaaatgtagcattataatctgtgaaaaacaagcaggatcttggcaggcagagtctagcaaggaagtcttgtgttttggctgaacatactctggacttttatcttggctaaagctttttttaaaagaacatgccttaaaataatttgtttctgctgctctatgctagattttgaagagttttatttagtgcctggactcctggtctatgaggaatgtgaagtctgtatacaaaaccattatactgatgacactttaaggaacttctaagatggtagtaaatttgtgttctttatataaattatagaatgatgtacaagaatggttaggtaacctttttaaaaggtgaatagtcctgctggcaagaaacataaatatgaacctcagaaaaaaatgcatcacagaagtccatttttaaataggtgctcctggaaatatttcaaatgttgtaagcaaaaaatcaaaacacagaacttcaggaagataaaaacgaattaacaaccttgctttttgactatagactcccattaaatgctaaataaacacattatacatgtgtgggatatttatctaagttcttatggtcagttaatagtaatagaatacactgtaatactagctacatgtattaatgacttactgggtgacagacattttgcttcgagtatattatttcatttaatcctgaaataaccctaatcggtattgtaagtttaccatgaaaacagattaatgtgagcaccttaattttttgacctgttgtgccactggttagtccagtagagagccataaattgagcagagagccttaattgctcagggactcggtgataggcctaaatagtcatgagggatttcactagatcattcaactctttaaaattgtggcctaagacagataggaactgtgatctctagggataagaggctaatacattaaacttgtataccatcttgcttttggcatttaccatttcgcccttgtattccattttatctaataaaattcaaggcacttggagttttttaaacgtggatattgctgaaagtttcatctaactgggcaaaggctacaagttatgatttagttgttaattagacttaaagaacaaagctaatgctgttccatttagtgagaaaggcctctgaggacctgagaactgaccaatattggttctcctgctgggaaaacactatgcataaacaagtccccagggcttcattactgggccttttacacaaacacaaaatgcatcttagtttatttgaaaatccttacaatgaagctttattgcatatctataaatttttcacgttgacatgtcaaagacttgtaaaagtatactggcgagagaacgataaacattataaataacactttccctttaaatgtaagatgattgtagatagtacacagcatggtcataaaatgaatacagttctgtttggggaagcaattgtgggaatgagtagtaatgtctaaacaggatggcaaactctttattgagaaagtaagcaatgtaacattatttagcgaagttggatatgcaatttttgaagattaggagacaaggtatgtcattttatttggtgattttattaaaagacagttcaaaaataaattttaaatgtcaatatattctcaatgatattattctatctttgcaagtatttttagtgttctgccttatgtgtatgttttaatatgctgaacatgattctttatttaaaaaaagggaaagtacattttcctaagaatttaaaatgtaattccttcatttcataaagtccgtgggtcatactactacaaatttctctactttgccatgttttttatacatatttcttaggaccaattcctatagaataagtataactttaaatgttgaatgtagctattcaagtttggtcatcattggaatgttagtatttctatttatctaccaactaatttgaaccactgagtaaacattcttagctaaaaattgtttcagttattttctactggtcatgcagatatcaaatgtggggctctaaactcagttatttctcattaaatttggaaaatcttttccattttatgaacaaacacaattcctttttttttttttttttttttgagacagagtctcacccaggttggagtgcagtggtgcaatcttggctcactgcaacctctgcctcctgggttcaagcaactctggtgcctcagccccccaagtagctgggactatgggactgtgccacctcacctggcttatttttgtatttttgtattttaagtagagatggggcttcaccatgttggccaggctggtctcaaactcctggcctcaagtgatccacctgcctcagtctccaaaagtgctgggattacaggcatgagccaccaagcccggcccacatttccatttttaatatatactgtgctttacaaatattataatatgttttaaaatatgttcacagaagcacctggtctgtgaatggcatgccagcattaaaaaaaataagcattctttgaatatatatttagttttttaatgtggtaggaaaatcaaagccagagggagtagaaacaaaatttgtgattttctaaatacttcttggctgcagggaagaaaccacgtcccaggcgaagtcctacctaatttgatgataaaattacatggaagggattcttgttggcatgaggacctaccaagatggtcaacagataattcaaaaaaaaaaaaaatttagagataaggtcttgttctgttgtccagaccaggttgtagtgcagtggctctatcatagctcactgcagctttgaacacctgggctcaagcgatcctcctacctcagcctcctgagtagctgggaatacaatagtacaccaccatgcccagctaagttttttttttttttaaagacagggtcttgctatgttgcctaggctggtctcagacttctatctaacctcaagtgattccaacagataacttttgatgaatgtgagaacctttgtaatcttctatgtacttacattaaccaagtaatttcacagacaaatttccttctttttgctaattgggccatgaccttggagtagcaaagggtgaggacaggtcatgacctaatcagcacagggaaataaaattatatcatccctctggtttaagaatttgcaccatagggaattgctctttgaacaagttcttgttctgactgatgcaaaacccctgatgtttcttaaaatttatacaaatttttccagtttccataaaactggaagaaaaaaaagaataaagtgaagcctaccccctcctttttgaagttctgcatactaagtatagtgctactaggaattatttatttgacaaataagtattcatctgttttttaatgtgaaaatcaggaactatattttcagatatttagattaattttatattctgttttgtttttcccacacaactgtcaaaatcaaaagcaaataaaagcaaagtaacatgttgtgtgagatgacagttgatgacagacaccaatgggcatgaatattgattcaaatattttgtttttattatttcacatccaacccagaaacatttgtataataagctagttcttatagttacagttgacagtaggatcagtggcagcttaatccaatcaatcaatttacagacttgctccagattctctgggggtctctccactgaagatctcttcttgtcattggccccattcctgctaattaatgcctagttgtcctgtggtccctggacctactgttctttacgtaagttcacttatgccaaacttaacatggctattagttacctttggcagctcctttctttggctgttacttaatctcacttccatactttctggttacttcagactccttcttacattaaaatcttctgattacatatactagatttgtatttaagatttattttagtgactgcagaaaaatgagttcatttattcaactcaacaagttgaattcattacttgaattcattactgggaattcattaattgacatatgtatattcattgggtaaatcttgtttataaatctctttttaccaatttgaaaaagaactctaaaattttctggaatcagtgttaggttaactgtgattattagtttattctgtctttgacctgttttattgtttaaaactttgcctgaaatgattgatttttggccattaggacaaaatagaaaatataaaattgcattattgggttattagaaatatggcattggatgaaggaatagttatagtataaagcttgatttgtaatattttatttctatcacaaatgcatttttatagtaatcattgtattagtataaatatttaatttccattgttggaaattaaatattacatggctcttggaagaaagaatttcataatataggggcaatgtaattaggattttgcatgttggaaatggcagtaaaatctatcaatatattcccttttataaatctcaacccatgagagaaatgtggtgttgcttcctttcagtgcctaaccaccccttcaaatatgtttttctcctagtttcattacattcaggtaaataggacgctatacagagtataaatctaatattcttttttccccgttaaatttgccatatgagcaatttgtcattgcatctttttatattatatctgacttgtttacaaaatgtagaacattttattatcttgatttttacatgtccaatactttggtgaaatggagaattacaggaagtcaatcaatgaaatattaagcagttataaacagaatgatgtaaacatttttcaaaggaaattttatttaagttaggtttatatagctttttctctttcaaatgaaggtaaatgcactgatgagcagttcaagaaaaaaaatctaaactgacagtaaaattgcaaatgaaattaaggaaaaaggaacagataacacaaaataattttaaagattctcttctttttaacaattggacatttaaagttcctggaagtatagttcacagcaaacattttaaatctgtcttatctatattaataaaacattctaggcttgctttataagaaaactttttagaacgaaatataagcagttttagacttccagatatagcttataataattgtctgtacttgccttgcaaaattatattacaagaagaagcacacttgttatagaagtgctgaattgtatggaacctaaatctgtcaagttacctgtctttcaggtccgtctccccacctaccagacctcattatattatcccgaaaagaacacgatctctttaaggctaggcaagtattgcgctgatgagccagggactgcccaccaattggcaggcccattgggtgataaatgtccaaggacctctaggctgacgacacatttttcatcattaatccagcctattgtaaccagggccactcacattgattcggactagggggcatcatctgctgttaagagggtgatgactcgctaaaaatgaaggcctgaaactaatcaaatatatttagagccttccctggcaacttgctgggagagcagcagtagacagctaataggggagccccagacaggtagcgcggtgctcaccatgctttgtatgggaatgtgagaaatccatttggaagcctgttgtgtaattccagctattatacattgtagtacgaatgtctgtaggattagtccaatactacggtatttgaatgttgcattaaaaatgtagttgagaaataccctgctttttttttttttttttaacctggaactcaattacaaagaacagagaattcgcaaacccagatctctttggaattgctaaattgtttttgtgtttttgaaagtttgcaacagatggtttgagacatatgcttaatatttattttactgaagttgcaaaatttgatgaggagggcatcttttttttttccatttgcagaactcaacaaatagttatgttttgctcttttatactttttaaaacctaattaatgtgtacttaatcagaatatacttaaatacattgtggcagttcaagggcatatgtacatgttatttattgatttttattattaattcatgcatatatattcattttagataaatctttattattttaatttgcattaataaaaaatggcttgagttaagtcataggtggagttgcaaacttgtttgccttaggcaaatgtagaaaaatatgttctttatttcctgcttacacctgattaagcaaaatcaggtacaagtaggaaatagatttaactgattagactcgttcaatggaaaatttcacttatatattgagcctaatatatcaaaaaagggcaaaatatgagaacaatttggcttaattaaaaaaaaggagacctaatgaaattgcttttgataaagaagaaggtagagaaaaaaaaaacaagaaaaagaaaaagtaaaatgaataatgcagaccctccaattgttcaagcagtcctaatgttctacacaggaaaccactatcttctaaaatattttatggaatcatgaaaaaatatttctgctgggtgggaaggcttccgtgtgatttctcttgaagaaagtcttcaatcccattttgaaatctcaattcctccaaattccaaagctgaaatttcacacctttcatgtttgcaagttttaatgagaattatatgtatacttaggtatcaactgcttctagtgttggatgagcttaggtggaaagcttcattaatgagcaatagacaacctcactgaatctacttcgcaatgaatattcagtctggagttcatcttaactgggtccatgaggcacactgccaaaaagcaacttgctattaagcatcaggtaggagcagaaaagagactgggtaaaataattacgttctttaaaaaacaagtttgattatggaatctatttaggtcctgttggttctagtgaagttgagtcagggctagtaagaaaatgtctggaaaaagaggaactgatttgaacactgctgacctttatgcttctgccatcagaaagggggtgagacttcaacagccaatgcaaaggaagctgagaaaaaatcaatttagctttctctgctagacagaataaaggtctctaaagatatccatgttctaattcccagaaaccgtgaactgttattttatggctcaaaagggattgtacagatttgatttaattagggccttgaaatgggaggttatctcaggttatctgggtgtggccagtctagttacatgcacctagaatgtggagaaccttccccttttgtattcaaagggagatgtaattatggaaggcaggtcagagagatacaacattgctctctttgaagatgggggtgagggggaatgagctaagtctatttgtgtatttgtactccaggccctagctagaatgccagcttcacaggggccagaattttgtcctattcacatttgtatcactggcacccagtacagtgcctgacacatagtaggtgcttcataaatatttgattgaataagtgaactagtgaacaaatgaatcgattactacgggcacagtttttcaaattttgataacccataagcataaagaaattgcatgatctccttgttacttacattctttatttataaataatgtctattcatcatacattaaagcaaggggtgattgatagagaatagcaggaaggcctggtcagggtggtcagcactgagaaggaaacatttaagttgaaactcaaggatgagaaagactcagtcttataaagacctaggggaaggaaattttagacagcaaaaaccacctgcttaaacttcctgagatgaaaaagcagttggctgatttaaagcaatgaaagaaggtccggtggctggagagcagtgaacaaaggctagagttaactaatgggaggttagaaggtcattgtggcaatgtcccaatagtgggacacttgaggaccaaaggaatgagttcagattgtacatggctttttcagccgggccccaaaatatttcttagaaagacattttatttacggccaggcgcagtagctcatgcccgtaatcccagcagtttgggaggcccaggtgggcggatcatctgaggtcaggaattctagactagcctagccaatatggtgaaaccctgtctctattaaagatacaaaaaaattagccagacatggtgctgtgtgcctgcaatcccagctactcgggaggctgaggcaggagaatcgcttgaacccgggaggtggaggttgcagtgagctgagattgcaccattgcactccagcctgggcaacagggcgagactctgtcctaaaaaaaaagaaaaaagaaaaaagaaagacattttattttaccaagtattttgtaaaaatatgctctatgttaatgtccttggcattcaatggtccctaccctcaaagattccagactcaagggagacaagtgtgtaaacagataaataaaatacagggtgatacatacaaatgacattgtaaccaacagcaatgattcccagcaggataatattcagtggaagataaagtgtttgctcctctggtgaaagatattttatcatctcatgcaagattccttcctggatttttatctctttgaggcagtacccactccttcactttttcatgcaattgttttccctcttattttgccataccttggagtttttatctaacaagtcttaaatcatcattgcctgtttcccttggaaaccaaggagaacctggttgaacaccagttggggaaatagggatgttgcctgagcttgcagatggtaggagcagacacagtcagccaccagtctttaaatgacggtggtcaggaggtgaccagggagccaccacaagcatattcagagaaaaatcatataggcaagttcagctgtttttattacaggttgaaagtcagtgatttcttagccaaaatggttgatgtcttgttctttagctgattcatctattcatagcggacactcagtgactgaggctgtttttattctgatggactcagtcaccattttttttttttttttttttttgtgacagattctcactgtctcctcaggtctgagtgcagtggtacaattacggcccactgcacctcagcctcctgtgctcaagcaatcctcccacctcagcctcctgagtaggtgggacaacacgcttgtgccaccgtacctcgctaatttttttttttgttgtttatagagatgatgaccccactatgttgccaaggctggtcttgaactcctgtgctcaagtgatcctcctgtctcagcctcccaaagtgttgggattacaggcatgagccactgcacctggcctaattagttattctttatattccattgaaatatactcttagagatattgtaatggaaatattcttattacatattattgcatgcaacaagtaagtgaataaaagagcaggattttatttatataaatttaaaaattatacacttttagatgtataagtatgtataaaaacgacattagaaggagacacacaaagctatctactatttgaaagaagattgcatttggaaggtgttatgaatgactttccttctaacaatgtttttccaacattttaaaatgtagtagtaaagaaatatatgctaataatttgtgtgtatgtatatcctaactaacatattttatatatatatatatatatatatatatatatatatatatatatatatatatatattttagtttctataggtaaagggaataaagcaggaaacatttgaaagattccaaatctggttacttttggtaggtgtcgttattattaaatcaattttagagccacgaagaaaaacacaataaatgcaacttttaaaaatttcaaaaattaaatgggtatcaccccctcatcagtcatacaaaagttttccaaaaacaatatttatattgtgttatgtgcaggctgagggtcccatgaacagttcttttgtcttgcataaagacgatgctcctagtctacaggcagaccagctgttctttccattgtaaagctttatcagaagggctatagttcagctcctttcttagtcaccatatgactttggacaatgaaaatgaaaacaatcacaatgagaatgttcttaaaaggagaaatacctaaaagccattttattttctgagatggtatatggtgtgttagttaccagtaactggagggctgatatggttaagcacattgtgtctgaataacataccaactggcaagcgagggttaccacagacaccataggccaggcacaccttttgcccaccaaggcctcaaattccaggcaatgcataagtacacagtagcacaagtcttttggctgaaaggattatatataattcgaatgcaattattaaacttgctacctctgtcattgctcctgttctttctagttatcatatatgaagctcctactaggtgttcatcattatcactgacctaactagtgaagctatatgacttcattattcttataacaactttgtagggtaagatagtattaacctccttatgctcagtgtggaaaaccaaagctacagagattttatgtaacttgctcaaggtcacactgctcataaaatagaacaacctggagttgaacccagaactttctagattttgtgctctttctacaacttcacattctttttctttttagtgagggaatacctgaccatttcgccactaagaagttttataaatgttataggataatgtaagtggaaaatctttccagaaagcagcaaactccattgcagcgatttgtgcttaactgggaacttgagcacataataacaattacagtttaatttttcttattttttaagttatatttatgatgttactctttgtgcctctaaattgatttaataacaaggccgctgaacctttgaagaccaaggaacatgataaaatattttagaaactcatatatttttacatttgaagatataatatcaatttttcatatttaagttttacataaaagtatgttggtctgtttcctttcactgtatgtgacattgcaatagggcatttatttctgtgtgtcttagcatgtgcatattgaactgaacttgtgcatattcattgtatttgttgcctaaaatttatataatagctggatcttgattttgaagtcatgggtattatttccatgaggggaaaaaacacaaaaaactagacttgtattctaaaatctacagtaagaaacggtgagatataactgccaacaaccagcttcctaaatattgtttatctttagatttttgccttgatcttcaaggacaaaacaagttatgggtggcctaatgggttttactaacttaaaaattgtacatttagattactcacaaattcctaggattaaaacaaattatatatacaagctatttagagctaattgaggagtgtgtatgtttctcaatctacatttttaattaaagcaatagctttaattcctgcatgcctagataggtatgcacattttagaagtcaaagaaagagtcaagaatagtatcaacgatcagagggaagccatccaactgtgaaactactggtcattgagttttttctgagttttaaccatatgtgttaatagcatttgttatacaaaatgttgatcattgtgactgtacaaaatggtatcaacacattttctgcagtgcacaacacttctacctcatgatactttattctaatttgctttatctgattacatctacattttagagtgatagagaaatgctgaatggtttgaagaaagtcaaattaatgatacttctggaggggtgatatagtaacaactactagtgtttttaatatacatctgtcatccttttcattaaaacttagggaaatgagctgggaggaggttgttctgaaatatagttatttctgtccttgtaacttcatcatttgctttaaaaattattattcatagataatttgttttttcttagcatgagtaatgaaatctaagaaatctaagacagccctcaacttattacttgactccccgacttcattcttttccatcttccttcctctattctctctttccccattcccttccctccttccttcttcctcacattcttcttctctttctttcttctttatttccttcattcatcaaatatttattatagtgcctatcaggtgcctccctgggtgatggtagcagcttcatgaaatgaaatttttcaccttctcaagatcacatgaccaagtttaaggcaaaggccttaggacagaaaatactcatccaggacagtttctagcagagctgtggttccgaacttttccagcagagatgcccttatccacagtgtattttagcatgtaggaaaacataatctcagccactcacaggaatgtagctggattggttggcagcagagagctttcaatatcaagtcatggtgtaaagtcagttgggatttgaagggaggtatgtctccctatcatgacgttttgttttatgtccagcgaatcaataaaacaagtaatttattgttccagttccaaatatgcttaaagaataaaagcactgcacataaatgtgctaccctaattgtgtgaaggatttatgtgatttgtaaaatattttttgctagatcactttatccacacttctgattgtgttgactaacaaaattaagtaatctttgatgcaaacatgtcttgagggtgattgatcacactcagttcttgggggtggggtactgttacggcatattgagaatttgcaaataatcttaggttaagcatctgtttttttcttagactgcttactgtgtaaaaataaatcaggttttatatctttgggaaggaaaacctgaataaggaagattgatgtgtaaccgagttatcggaagccaatgatggtgctgaaatttaaaatgtcagttttacagtgtttgaatatagtttctctgtaaaagttactgaatcagacttgtctttttcaagaaaccaaatgccaatttattattcacatagatttcattttttcgtcccttatactacttcacatttttattgaaagaggcttcgaggcttctctttacaagacattttgataatgattgtgttgatagtggcggctgaaactgccgctgttggaattgatttagcagtattttctcattcagtttttgctgcaactctatgagacaggaactttattcacaccgattttgcagataagcaaactgaagtacaagtgaattatggatgtcttcaaggccacacagcttccaaaacttatgcccttaattatgatgcaaagttgcctctctgcatggaaaaagtaactttaataaaagtaaggcctctcttttggcaactatctcttttaggataaaatacagcccacaatttggcctggccttaacctcatgaacacaacttacagaggagataaatgtgctttatagtagaaagtaaataagaatgactcaccatcttggttatgtaaaatatattgaggtctattttgagttagggctcccagcaaaacctggtttaattcttcagtatcctaggaggaactagagatgtaggttcagcaacccagcacaactccatttttacctctgaacctgcttcctcacaatcaatagtaattccctgatcataacatggcattcagtgcatgcaactaaaatatgttactttttttttagcaaaatatgctacttttattttgttcacattatccaaactgtaagaatttttactttaaataaattatatttgatgcttaattgatagatgataaagaattaaggttcagctttttttgtccctcaacaaatatgtgaaatcatttttatgatgcatttatggcaagagttttgtagctttaagtgccatgtttttttgttaggcttttataattttaaaaatctatatgtttaagtttgtattttgaaactttttagacttctaggcctcccttcatttctaataaacatagaaaaatagttaataatttttctagaatatgcaattttcatccttccttttagaggtccaattgactatccagtgggccacctgacagcatgttttataatttagtgttttctctcgaattgtaaatgtgtccaccacaacaaaaacatacgcttcaagacagattatccatgttgttttgttgaaaggtgtaatactgcccaattaaattaactaaaatttaggtagggagataggaatgggtcaagattcgtatcagcagttcaactgaaacgcgacagtccactgattccccttgcggggcctgtgacaggggtgtagctcccctgttcagttgctgcggctgctcagacccctgacgggaggggagcacagaccggcaggtgcaggagccgggcggggcaagtgctctgggctgcagccccgtggtaggtagtatctaggagtggatgcctggggctccagtgttgcaatgctcttttagcctttctgtccgcagacagcttaagtgttaaccagctcagtggaaccattaccttttcaccagggcagagggctagtgtgacagctttctgtatcctgaattcttgtccagtgtcccagaaggatcgggtcacacatgggcttgaaggatgaatttattgagtggcggaggtagctctcagtggggagctgggcgggggcaatggactgggaagatgatcctcccctaaagtttggctgtccagcggccaaactcctctctgagcacccccagcagaactcagctttgtgttcacactccttctcttctctctctttctctgccgtgccgttctgctgttcatctgcttgtctctccatctccttgcctccttctctgctcctggagcctggggttgggagtttatgtgggtacaggatggggggacatggcaggccaaaaggcaactttttgggcttgaaaacagaaatgcctattccccctaagggcagcaggtatccagacttgagggtggggcctttgcatgggaaccttcctcttctaccgtatttccctgtctcctctccatatcacatgcacatgtagtcttaaaccagcttaataagttgcactattgtagaaacaattttacttttttaatgtatgggcaaaaataatactgccgattatatttcaaagataaggaactcactttgagtgaagataaggcaaatattgaaatatatagaaaggttctcacttgaaacatgcgtaagatcagggttacagggaataagaatgtgttagtttcctagggtgactgtaacaatttactacgaaatgagtggcttaaaacaacagaaatgcattatcttacagttttgggggactggaaatttgaaatcaagggacacactccctctgaatgccctgaggaaggatccttctttgtgtctccattttctggtgccctcaggcattccttggttgggctgcgtaactccggtctctgccttctcttcacatgctgtcttcgctttttttctgtcttaacatggtgctcttcctgcatctctctctctctctctgtttttttcttattttattttattttgagacagaattttgctcttgttgctcaggctagagtgcaatggcgcgatctcagctcactgcaacctccacctcccgggttcaagcgattgtcctgcctcagcctcccaactagttgggattacaggtgcccgccaccaagcctggctaatttttgcatttttggtggagacgggtttttaccacactggccaggctggtctcgaattcctgaccttgtgatccgcctgctgtggcctcctatagtgctgggatgacagggtgagccaccgtgcccagacctttcttactataagactccagtcttattgtattaaagaaccacctacccaagtatgacttcatcttaacttgattatgcctgcaaagactctataccgaacgtggtcacatttataggtactgggatttagaatttcaatatatctttttgaggaacacagtctcactcataaagaagataatatatatttttaaaatttttatattatttctttttggaataaggtaattttaatgctagccttttttgcatgaaattaatttagtagtactctcatcagaaaataattacttggcatttttaagtttttgatggacattctaaataacgttgcaatattcttgaattgatagagaattcaagaattctgtaatccattgatgaaaccattcaagaattccagaatccattgatgaaagaagaaaaacatagacaaacagctcaaaccaaggctatgcattatgtgggaccagctcgttaatggtacacagtattttttctgctttcattaatggattggtgatttcaaggacactaactaacctttgcatcataaacattttgtacctataaactacaaataaagaatatagtttaaacaatcgtatgcaaatatgggcataatattaattgaattgatttatttggcaacgcaaactatagttataaataatataaagactatttttatttatgttttgtttttctcacttaccacttatctgcttctctaatcgtctctcttataagagatctaaaattttgaaggagtttgggatatgggagcatttaactggacaattatttctttttctatctattttagttagaatcattctaaaataggataaactttatatgataccaaaaatccattcggacagtcacatttttcatagtaagcgtcaatttaaactaactcttctatatgacataagtcagaattaaagttttgatctgaattatgtatttagatgcttaaatgcctctcattaacttaaggtttttgctaatgcttctatcttttgttcacttagccatcattttatctttaaaatatgcataggaatgtacataagtggagtcataacatcatttttagataaaagttaaaaatgagactgtaattcatttttaacatatttgtatgttgtggctgtacaaaatccaaaagtattttcactctccaatggggatgatgtgcagctcccaaaatggaaatagaggtaacgttccagtgatcataaaaggacagtcataagcttttagtgtgcagcagttttaagactatcctcagttaatgtgaggcaattgcagattcactgcatctgagtttaaacctctcactactttgagtgaagtctattaatgatatgccttccatgcagctgacattttaagatccttgctgcttttcaaaacgcgtgggcactaaagatgtcttcttgctcttgagaattgatttcatacacaacaggagcttgtgatggattcgctcccactgtgggaattgtccgtgagtatccgagggcaggaattggctcagataaaggatctatcctgagcgctctcctgtaaagagtaagatgtgcgcattagaactagctgatgccgagtttaattcccagtctcttttgtgattctaaaccatttgacaagcctctgcctagtgtgagcagattgatcaggaaatttattcatttcatgaccttgtctactcatttatagctcttaaaaaagtacctcacctggaactcaaagctccctaagaatttaaaagttatgaatatatttctttcatctataaaactacattttgctttggataaaatatctagcatttgaggagaatttcatgttagcgcaattgattaggctctatgttacatagatacatcataaattgcttttataataaatttatgttttcttttgttttaaaggacatggggattgagttgcaaccaatagatacagttacacaagccggcatggtcaatagcatgtggatagctgataacaaacagtactagaattgtcagtgtgttttcattgactcctgacctgttaaaacttagctcctgaagacccattagactggacaaaatatacccatttgaatggacagaactaacaggcagatactattattataaagccataaatgagcaatcagtctcatatgtgtttgaagatagactatagattatggttctatgccttatgatacaattactgggttatttgtgtaatttgaaatttgggttttaagaaaaccatattttcttatttcttgaggagaagaaagaaaaccgatatggttggtcatagtaggtaatgagaaaaatggcagaagatgagttcagagagaaaggcatgtccagatgacattgggctgtgtaggttaaaaccttagtacttggacttcattttatctgccaaaagaaccactggagtgctttaaataataacctgatatgtttcatatatttttgagagatcattatggcttatgtattacaaaaaattctgcttcatttctgacaatttataaaatgatttcaagaaacagatctcacatgtgattctttgaaaagcaggcacgatcttctaaagtaaataaagatttttgtacagatattcatctattatctattaaaaactttattccagaattatctggtaatgttaatttcacacagccaatataaacagtaatgaagaaaatggaactcagttatttttgtttcatgatctatgaatctaagaccaaataaattataaaaaataactattcatttgccttagataatcaaaaaacatctctgttgctgattatcaaaatatttatattacaaaaaggttaatggattagtgtcacataaaaacatcttaactgaaggcaaaattgcataacagtattttacttttgcaatgccatctaattttcaatacgttcaaggtaaaaaaaagcaataaaatggaaatggcaataaacataattcattaggcacacactccactttatgagatgatgcaatgaatgtcattagacaatcaatttcttccctggttggtcatttaatggtagaaccagtgggccgattataacgtgggtatgccatattgacaaccgaggcaaattaatatagtggaaaggacactcgtttgagatttaggaagccttgatcagcctattcaactaaagagttgcacaaaaaccatgtttgtggagttagtttcctaatctacaaaattagaggattgaagtagatagtagatccaaaatgctggtccaaggatgaatgtcaggctggccttatcagaattattaggataacttttaaatacaattgattcccagattcttcactcagaaatacttacttattgtgtccagagtggggtctggacagagatttgtaaaaatcacccaggtgattctaatgtgtggggatcttttacaacagatggaatgtatgaccccaaaacatctttctttttgaaagaaaaatctttgaattctgtgtttctctaggctgtttccaagaatctttacattataaattaggctacattacatttgtggatttggtactaaagctcaagatttttttcttctgctttggaggtaagcttatgctttttctatagttagcagcatcctgcacagacatttgtacaaatatctcaattttccttcttcattgtggaaaattgagacatttgtacaaatatctcaattttcctccttcattgcagaaaatggcctaaaaatttgcatgcattttagcctagccattttcttctagtaattattcctaaattatgttcaaaaatgtatgcataattaatgttcttcaacatattttgtaatagtaattaatttaaaacattacaaatatctacaaacaagacataggttaaaaagaattttatgataataatataatattgttaaaaattgtcatataacaatacaatataccctacaggacttaaaatttctgttctagaacaatatttattgacataaaaagtattcaccatatattgctcggtaaagaaacatcaaatggtattcccctatgtttctaaagatgaaaaataaaatctcacaaataatttttttattatactttaagttttagggtacatgtgcacaacgtgcaggtttgttacatatgtatacatgtgccatgttggtgtgctgcacccattaactggtcatttaacattaggtatatctcctaatgctatccctcccccttccccccaccccacaacaggccccagtgtgtgatgttccccttcctgtgtccatgagttctcattgttcaattcccacctatgagtgagaacacgtggtgtttggttgtctgatcttgtgatagtttactgagaatgatgatttccagcctcatccatgtccctacaaaggacatgaacttatcattttttatggctgcatagtattccatggtgtatatgtgccacattttcttaatccagtctatcattgttggacatttgggttggttccaagtctttgctatcgtgaatagtgccgcaataaacatatgtgtgtgtgtgtctttatagcagcatgttttgtaatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctctagcacctgttgttgcctgactttttaatgatcaccattctaactggtgtgcgatggtatctcattgtggttttgctttgcatttctgtgatggccagtgatgatgagcattttttcatgtgtcttttggctgcataaatgtcttcttttgagaagtgtctcttcatatcctttgcccactttttgatggggttgtttctttcttgtaaatttgtttgagttcattgtagattctggatattagccctttgtcagatgagtagattgcaaaatttttctcccattctgttcactctgatggtagttccttttgctgtgcagaagctctttagtttaattagatcccatttgtcaattttggcttttgttaccattgcttttggtgttttagacatgaagtccttgcccatgcctatgtcctgaatggtaatgcctaggttttcttctagggtttttatggttttaggtctaacatttaagtctttaatccctcttgaattaatttttgtataaagtgtaaggaagggatccagtttcagctttctacatatggctacccagtttccccagcaccatttattaaatagggaatcctttccccattgcttgtttttgtcaggtttgtcaaagatcagatagttgtagatatgtggcattatttctgagggctctgttctgttccattggtctataactctgttttggtaccagtaccatgctgttttggttactgtagccttgtagtatagtttgatgtcaggtagcgtgatgcctccagctttgttcttttggcttaggattgacttggcactgcaggctcttttttggttccatatgagcttgaaagtagttttttccaattctgtgaagaaagtcattggtagcttgatggggatggcattgaatctgtaaattaccttgggcagtatggccattttcacgacattgattcttcctacccatgagcatggaatgttcttccatttgtttgtatcgtcttttatttcactgagcagtgctttgtagttctctttgaagaggtccttcacatcccttgtaagttggattcctaagtattttattctctttgaagcaattgtgaatgggagttcactcatgatttggctctctgtttgtctcttattggtgtataagaatgcttgtgatttttggacattgattttgtatcctgagactttgctgaagttgcctaccagcttaaggagatttggggctgagacgatggggttttctagatatacaatcatgtcatctgcaaacagggacaatttgatttcctcttttcctaatcaaatcccctttatttccttctcctgcctgattgccctggccagaacttccaacactatgttgaataggagtggtgagagagggcatcctgtcttgtgccagttttcaaagggaatgcttccagtttttgcccattcagtatgatattggctgtgggtttgtcataaatagctcttattattttgagatacatcccatcaatacctgatttattgagagtttttagcatgaagtgttgttgaattttgtcaaaggccttttctgcatctattgagataatcatatgttttttgtctttggttctgtttgtatgctggattacgtttattgatttgcatatgttgaaccagccttgcatcccagggatgaagcccacttgatcatggtggataagctttttgatgtgctgctggattcagttggccagtattttgttgaggatttttgcatcaatgttcatcagggatattggtctaaaattctcttttttttgttgtgtctctgccgggctttggtatcaggataatgctggcctcataaaataagttagagatgattccctctttttctgttgattggaatagtttcagaaggaatggtaccagctcctccttgtacctctggtagaatttggctgtgaatccatctggttctggactttttttttggttgttaagctattaattattgcttcaatttcagagcctgttattggtctattcagagattcaacttcttcctggtttagtcttgggagggcgtatgtgtccaggaatttatacatttcttctagattttctagtttatttgcatagagttgtttgtagtattctctgatggtagtttgtatttctatgggatcggtggtgatatcccctttatcattttttattgcatctatttgattcttctctcttttcttttttattagtcctgctagcggtctatcaattttgttgattatttcaaaaaaccaactcctggattcattgattttttgaagggttttttgtgtctctattcccttcagttctgctctgatcttagttatttcttgccttctgctagcttttgaatgtgtttgctcttgcttctctagttcttttcattgtgattttagggtgtcaattttagatctttcctgctttctcttgtgggcatttagtgctataaatttccctctacacactgctttgaatgtgtcccagagattctggtatgttgtgtctttgttctcgttggtttcaaagaacatctttatttctgccttcatttcattatgtacccagtagtcattcaggagcaggttgtttggtttccatgtagttgagcggttttgagtaagtttcttaatcctgagttctagtttgattgcactgtggtctgagagacagtttgttatcatttctgtttttttacatttgctgaggagtgctttacttccaactatgtggtcaattttggaataggtgtggtgtggtgctgaaaagaatgtatattctgttgattttgggtggagagttctgtagatgtctattaagtctgcttggtgcagagctgagttcagtttctggatatccttgttaactttctgtctcgtttatctgtctaatgttgacagtggggtgttaaagtctcccattattattgtgtgggattctaagtctctttgtaggtctctaaggacttcctttacgagtctgggtgctcctgtattgggtgcatatatatttaggacagttagctcttcttgttgaattgatccctttcccattatgtaatggccttctttgtctcttttgatctttgttggtttaaagtctgtttaagcagagactaggattgcaacccctgcctttttttgttttccatttgcttggtggatcttcctccatccttttattttgagcctatttgtgtcgctgcacatgagatcagtttcctgaatacagcacactgatgggtcttgactctttatcgaatttgccagtctgtgccttttatttggagcatttagcccctttacatttaaggttagtattgttatgtgtgaatttgaacctgtcattatgatgttagctggttattttgctcattagttgatgcagtttcttcctagcctcaatggtctttacaatttggcatgtttttgcagtggctggtaccagttattcctttccatgtttagtgcttccttcaggagctcttttagggcaggcctggtggtgacaaaatctctcagcatttgctcgtctgtaaagtattttattcctccttcacttatgaagcttagtttggctggatatgaaagtctgggttgaaaattcttttctttaagaatgttgaatattggcccccactctcttctggcttgtagagtgtctgccgagagatcagctgttagtctgatgggcttccctttgtgggtaacccgacctttctctctggctgcccttaacattttttccttcatttcaactttggtgaatctgacaattatgtgtcttggagttgctcttctcaaggagtatctttgtggcgttctctgtatttcctgaatttgaatgttggcctgccttgctgggttggggaagttctcctggataatatcctgcagagtgttttccaacttggttccattctccccgtcactttcaggtacaccaattaaacatagatttggtcttttcacatagtcccatatttcttggaggctttgttcatttctttttattcttttttctctaaacttctcttcttgcttcatttcattcatttggtcttccatcactgataccctttcttccagttgatcgcattggctactgaggcttgtgcattcatcatgtagttctcgtgccgtggatttcagctccatcaggtcctttaaggacttctctgcactggttattctagttagccatttgtctaattttttttcaaggtttttaacttctttgccatgggtttacacttcctcctttagctcagagtatttgatcatctgaagccttcctctctcaactcgtcaaagtcattctctgtccagctttgttccattgctggtgaggagctgcgttcctttggaggaggagaggtgctctgatttttagagtttccagtttttctgctctgtttttttccccatctttgtggttttatctaccattggtctttgatgatggtgacgtacagatggggttttggtgtggatgtcctttctgtttgttagtttttcttctaacagtcaggaccctcagctgcaggtctgttggagtttgctggaggtccactccagaccctgtttgcctaggtatcagcagcggaggctgcagaacagcagatattggtgaacagcaaatgttgctgcctgatcgttcctctggaacttttgtttcagaggagtacccagccgtgtgaggtgtcagtctgccactactggggggtgcctcccagttaggctactcgggggtcagggacccacttgaggaggcagtctatctgttctcagatctccagctgcatgctgggagaacgactactctcttcaaagctgtcagacagggacatttaagtctgcagaggtttctgctgccttttgtctgtgccctgtccccagaggtggggtctacagaggcacacaggcctccttgagctacagtgggctccacgcagttcgaacttcctggccgctttgtttacctactcaagcctcggcaatggcgggcgcccctcccccagcctcactgccgccttgcagtttgacctcagactgctgtgctagcaatgagcaagactccgtgggcataggaccctctgagccaggcacaagatataatctcctggtgcgccgtttactaagaccattggaaaaatgcagtattagggtgggagtgacccaattttccaggtgccatctgtcacccctttctctgactaggaaagggaactccctgaccccttgtgcttcctgggtgaggcgatgcctcgccctgcttcagctcatgctcagtgcactgcactcactgtcctgcacccactgtccgacattccccagtgagatgaacccggtacctcagttggaaatgcagaaatcactcgtcttctgcgtcactcatgctcagagctgtagactggagctgttcctattcggccatcttggctccaccccacaaataatttttttaaacaacctaatgcaaaagtaatttaatattaagctacttctatctctaaagaggtggaattacaaaatattattttgtttttatttagaatgccatatttttttcaaaatatatatttattgcttatattactgtatttaaaaaaaatcactcttatcaagtgtgtcagatagattagggagaccagggcataaagccacttttattcttctcaacctgaaaatgtaaagatccatttcaagacaccaagtaattgatgttagagcttcaagggacaggacagagcttgtcaagggaaaattagagtggtaaagctgacacccatacatgcaaggcccttaatctttctttctttctttctttcttttttctccttccttccttccttcttcttttcttttctttcctttttttcttttcttttctggagtctcactctgttgcccaggctggagtgcagtggtgcgatctcagctcactgcaacctctgcctcctgggttcaaacaattctcctacctcagcctcccaagtagctaagaccacaggtgcacatcaccacgcctggctactttttgtatttttagtagagatggggtttcaccatgttggctaggctagtctcaaactcctggcctcaggtgatctacctgcctcggcctcccaaagtgctgggattacaggcatgggccaccatgcctggccgatttttctactgtcaacttgaaaataagcatacttaatgtcagcatggacctgatttagccatgtaacatttggctgctgaaaaagcatgatgatgtgttttttgctcctggtcatcttctgtcaatagttctttattttgtcctagtttcatgttgtaattaatggaattatatttgaagagctcaaaatgaaatgcttaattatattcagctgcaattacagtgattaattgatccaaacttattagcatgacacctaaaggaaaccagttatataaaaattgtaggaggcaatactttgagtatgacactcatgtgagctagctatctagattaattctattttattaaattgtctaagttttacagcttctggaattcatattggaaacccagggtctagactaaactgttatttcataaacaaggacaaaagaaccgaaaaaagtaaatgaaatattacagacaggagtagttctccctcaaatgagattatctcattattttgaaattatttatatgtttcccagtttggatacattgtcagctcctgattatccatgccaaagatagctttaaatctccaaaaagagattttatcaaatctatatgcatttcccaaatcccaagaaaattatgagtcatagtttagagcatagacatcctgtttcagttaatgctttgtagggtctaatcatcatgtatggatgtgttcaatccccttgctctggatgctttcactggactgggtattaaaaagcaaattcttcaaactctgtacttccaccatgcctgcccacctcatttctttaatatgccaacctccttctcatactaatgtattttgtacatttctgcctggaatttttctcgatccttaggcttttcttgtttaattcctaccatccttcatagctcagctgaaattatacttttttttttttttttgaaatggagtctcactctgtaacctaagcttgagtgcagtggcgtgatcttggctcacgcaaactccacctcctgggttcaagcagttctctgcctcagcctctcaagtagctggtattacaggcacccacaagcatgcctggctaatttttgtattttttagtagagatggggttttaccatcttggccaggctggtcttgaactcttgaccttttgatccacccaccttggccttccaaagtgctgggattacaggagtgagctaccgtgcccggcctgaaattatactttcctgtagaggaagtataattaggttatcatgtcaccctcttcttttccattataagtattctgcagtcgtagtgacacatttatttgtgactgactaatgcgtctgacttttcctttacaatggaagtgctacagtatcaagagctgcacattttcattgacactctacatccagaatccaacacagaacacagcacattgaaagtattttattaaatgttcttgaatgagtggaattttcatttttctaatatcttttagcagtatgtttgatcgatttttgtttgttgtttgtttgttgagatggagtcttgctcttgtctcccgggctggattgcagtggtgcaatctccgctcactgcaacctttgccttctgggttcaagtgattctcctgcctcagcctcctgagtagctgggattacaggtgcctaccagcacgccccgctaatttttgtatttttagtagagatgggggtttcaccatgttggcaaggctggtctcgaactcagcacctcaagtcatctgcccgcctcagcctcccacagtgctgagattacagacaggcgtgagccaccgcactgggcctcgacttctttttagatagagtgcccattgttgctccttttcatccatctagtagttctccttcttttgcaatttggttaaatgattataaccaaacttattaagctttattttatgtgtaaaattttgagagaatcatcttgactgtgtgtatgtgtgtgtatatatatatatatatatatatatgtatctgtgtatatatatatatataatctgtatatatatatatatatatatatatctgtgtgtgtgtatatatatatatgtcacctgagtgctttcttttgggggtaaagtatttgactgagacactaaagatttgaattgttgttctgcattttactattgaccatgggccttaaggaagtcatttagctcctgttagcatcagtttgctgatttgtaaaatggttaaacagtagtatttgccgtctacaagtcacaaagctattgtgaagatcaaatcacatatgacattcaaaaatgctttgcaaatgttagccctttactaatttcagtccatatcaaaaatccacattgtgtagaaaatttgtagatctttgaaattacataatcttaaaaatatttgtgaaatacgagatgtagatctgaatttctttaagacaaagttctttagtaatatggaaacaatgacatatccaagcagaagcatagatggcaatagaatttgttcagaacatggcttcagaaaacatactaatagttctgtttttttgtttgtcttgttttgctttgagatggagtctcactctgttgcccaggctggagtgcagtggtgcgatctcagctcactgcaacctccgcctcttgggttcaagtgattctcctgcctcagcctcccaagtagctcggactacaggcacgtgccaccacgcctggctaatttttgtaatttttagtacagatagggtttcaccatattgtccaggctggtctcgaactcctgacctcatgatccgcccaccttggcctcccaaagtgctgagattacaggcatgagccactgcgcctggccgagaaaacatactatagcttttcacagacaaattggcaacttctccatacataaaaattacattttaactgcaaatgaaaatatagacatactaagagtaggtaaaaaattgattattaatttaaaattaatcattttaactcaatgctttacatatattaaaaagtattcatttatatatgtcattttttatacgaataaaatatttaaatattataatctctattattttaatatagttcaattagattccttgtggaaattataaatgattctctaaaaaaataaagtcattattctgtcaagatgattaaatggacattttcctaatcttctagttgaaccattgagtcttccagtgatgtatacttaaaatcatgtaagttataaataaactttcatggtaggtgtaactaacttcatctgactcatgaagagagattagtatctcttttatcatttagacgttaatgaactttcagtcctacgcagcaaagttacccattcatctttttgaaaaaaagatgaattattgttgaactcacctcctaagtattgctatgttgtataatagtagaaataatagtagaataatagtagaaaccatactttttctattataaaaaaatagaggaaatagattggaaaatataatctgaatgaagtcaaagttagcattgagtgttaaataccattgtcagtgtcctttacatatgtaatggtaaagctttccaatgcatcttgggttgcgtgagctaaatacttttggcaaggaaaacatcagttatatgaacactgcagacccacataggcctggtgtacagctttgtctttccatggctctagtggttcatacctctgctgcacttgttcttgactgggcaccctctgccagtgctgtgtgagctccccaattccttgctgtccttatgtggttccgtaagctgacatttcatcattcagaccaagtagatagaaggtgttgcttactcttttaaaatgagttgtataggattacattgttttatttgataaccttttggtaaatacagcagaaatacaacttcagccagtttaaattaaaaagaggcttttgttttaaagctagtaagggtgacactgatcgaatgtgaaagaaggaagcagaggctaatattgggattcaggctcaatccagtcttttgtgtatctcatatctacacctcccacaaatatttgttgtccgccccctcttctctctctctctgttttggtctctccctagattgatcttcttatatatcttcttgtcatgcatcttacctagtgttccccaaatgaaaataactcaatgactattctacgtcaagtgcccatccattcaccagttcaccaagatatgtaaaaacttggcagtttggaaaagatctataaaataacaattcccaaaagaaggggatttctgtgaagatacacaatagttgtccaaaaaaatatgctatatatttgttttaaaaaattgatagcccaatggactttttcttttttcttttctttttctttttctttttttttttttttttgagacagagtcttgctctgtcaccagtctgtactgcagtggcacgatctcggctcactacaacctccgcctcccagattcaagccattctcttacctcagcctccagagtagctgggactatagccacccgccactactcccagctaatttttgcgtttttagtagagatggagtttcaccatgttggccaggaggctctcgatctcttgaccttgtgatccacccacctcggcctcccaaagtgctgggattacaggcatgagccaccgtgcccggcccaatggactctcaatacactatcttactttaccctcctgtccaaaagcactaggtggaaaagagatgttacatttatttttaaaagttgagatatagatcatatccaaaacctgctatagaaatatactacattgtcaatatgaataattaggtatagagaatggcacctgcttaaaatcctttaatctcactgatttggtgtgtgttgtttccccagtgggttacatgttaccgataacctgtcagaatttgaatatcgcagaggattttcaaagtcagaagaactgagtaataaggagatgaaagactttttcagaagacttttttttaaatggaaacttatttttaaatatagaggaatgtaagaacttgcaagtaagagtgaattggtttgcaaagtagattctgttttcccttcatgtgagctttattggtttatattctcttcaaattttcttcatgtcatttggaaacaactgctgttcaaaaactatatcttcatatgcaagcatttactataaaacttttctttaatgtgtttaaagcatttctttttcacttaaacatttttcctttattttaagctagtgataagacagaatggtgatatgtccatttgcttcatttgatatgcacatttgttctatgggaaaatgtggtctactcctaatttcattttcgtttcctaaataagaagacccattaaaaagcagacatctggtgtacaaagcacttaaagctgtagctcccaaggagtgctttcttccctctttaaatatgcatgaactgttgttttggtaatccacttcaccctgtcaaaatagaatcaaatagaatatatgtgtgacctcttccccttctatcctgggaaaatgagtttcaagatcactgaggtgtacagtattccgaagccttcactttccgttttattcaccctgaaagctcttacagttacagaagcttaaagtttagctgaaatctactttaataatagctacactgttttagttatgaagaatgactctatgaactttaaatatttgaatcataaagaatgaatgtagactttcaaaaaataggctttgaaaggagtttaagaatatctgtaccttcattgatttttttatatcagttagagctcaaggtttttaatacagttacctcaaaaattctgtgtgcaaaatagttacatttaacggatattgaaactaaatatggttaacttattttcctaggagaagagaacaactaaaacaggcgcaataaacatttttctttttcagttgatgcacatttaatgtcagtttgcttccttgaaatttagacccacattccccaagattgagtcctgtagaatattaactttccatattcacctactctgttccatgcaaaaggatgacatgatcaaatggtacataccttgctttctcctatagattcataattgaaatttggatattatactttctaacaatgcttttagtaaatatatctgtgctagcttggttcacccaatttgcctaagtatatttaacacctaaacattaaagaaaaatcacttttgaaatctgtgacctagattatgtttatgtgcagattatatcagaaaatagtacaaaactttatgaagacaagagaagtatctcattttttcttccttctggtttggattgtttattttaataaaattatatcagtctgatttggttagcttggaatattgttttgttattgttctataagtagctgcattatccataatagttcatatatatcttatttgtgtgtgtcatcctcaatactgttcaaatattttaagggagacaaatggatacttttgcttttagaatctatttacaagttttattcttctaaatttcagtaaatgagtctgtgccacttctatgttttaaggtatttttggatttagagtacttctaaccaatgatcatgaaagtagtagtctattaattttaaatcatattttctaacattgtctattaatgtgtttttgacaaatgtgatgcctatgagaagacagcttcttcactagaggaaagtaaaaggagtttttgaaccttgatccaaatctctgaatttatttaccatgttgtcccaatcgaaaggcattgaacatagtttttcacaagccacaaatgtttgagtatcagagctgaaagattgcctaactaagtaaaatacagtatttacaggatgcttggggaaaagatatctggctaatttaaaattatgccagtgatattctttgcttatccatttgtgacaaatccttatcagccttagaaaatgcacataataaagtacagagaacaacatttgcttattctttaaacttatagtcttgtaatgctgcagtgctatcacaacgggtattaatgatcgttgtatttattgtatatttgagttaaatccatattaatcctagggtttatcttaaaattgtgtgtgtttctttgtttgtttgtttgatttatttggaaggtgttttttgtttttgttttattttagaactaaactcctcaaatgactttatttactagcttgaggtgtctttctcctaaaacaacagaaaaagtcatgatgaagggctgggcagaagaatcttgatagtttgaatttcaaagctacacagattatagataagatatactttatgttattagacatttatttttccctagataagaccgctgatagtggatgataagactgatgaataatatttgattagtcaagtttccatcaaatataggaaaagttttaaattgtagctataggtttaacataaatagccaaatttatcattatatgatttttttacttttattgtgaaaatttttaaacatagagtattagaaaaaagtagcataatgattgatacataatcatgagctagatataatcataagtaatattttcccacaatttttatctatccctcctgttctttactgtgaagtacattaaagcattcatttcactgctatatacttcattgttcacaaaatatatacagacctcttcccacaaaattattaaaatttattgtaggcactttgttttttaagtgggagataaaaaataattggaattactatgctcatgttgtttcattgtactgaaagcaaaaatggatttttttcaaagatatttcctcccattttacttttattaatagattctaattccgtcaactttgcgtaatatagaatgatgaaaaagccccttttcattccttctgatagcttttggattccattgctcagagaaagcttgtcttcaacaatatgctggaattgtgtgaagtcttgttatttttttttctccctgttcttcaaagtacaatttcttgaatgtacctgcagccgtgcattatcaggcaacctattttataaattccataataaattaaataagcacctctgtgggtcatttttgattaacctgatttaaaataaaatgatttactaaagatttagagggaggaaatactatgtgcttctaaatcaattctatgcatattcactgtcaaacaattgcatgtaatagtgtattaaatacacttaatagtgtaaaaaaagactcactgcaattgaattaacacttgcaagcttataataatgtttaaaagccacaaacattgaagtaaaattcatttttatccagaaatagaatttgtacatatgacttcctgctatggagattttatcacaggaagatgttcaagatgtttaatttaggacagcatttcttctaagttcagattataaggaggagcattttaattagaatagtatcatgagactcatgtaagcatatgatattacacatcggtattttccctatagtctggaacattactggaatgaaaatttagagatgcatttttacttctccagcacatgcaagaaataatacaacatgaatccttttttattttaggaatgttatacccacaaaacattgaagtatgttttaagttaagcaaacaacaagttttgaccaagaaaattagaaaattaaggttttcttagaaaacaaacaaaattatggcaagaaattactgtcctagtaaaataagatgaccctatatggaccgttgtacgtgaatatttatgtccttttttttttcagtttcacgtatattctttaatgaacacgagaatacagttttagttttcatttgatggcagttttcttcactctccatttcttcaccacctcctcctattttcttccccttttttctgctattcctccactcttcattacacctacatggcttagagttgctggtagattttggtgcccatgctaaaatttgaacagaaggaacagtataaagatgagctgaagtaaatcttgaacacctactattttgccttcttatatcatctcaattgacaaagtcaagattgcagactgccttgacttatgatggggttatgtcctgataaactcaaggtaagctggaaatattgtaagtcaaaaaggcatttaatatacctaacctacccaacatcatagcttagtctatcttaaacatgctcagaacacttccattagcctgcagttgggcaaaatcatctcacacaaagcctacaataaagtgttaaatatctcataaaatttaccaaatactgtactggaaagtgaaaaccagaacggttgtacaggtgctcaaatacagttgctactgaatatgtattacttttgcaccattgtgaagtcaaaaaatcataagtcggtgactgtgctcggttaaaaagtagtggttgctgaccaacttcatttttctttaacagcttcaattgtgatgtcaaagtaaatgtaacttttttcaacaaatttttgtcctttaatacaacaaaaatgttgcatcttaaaagcattttttaatgaaaagaattttaggcttacaattttcttgtaacagtggaaaatataggctctgattttcttttttttgtagtgcacaaaggtaccttttcttagtagttaagttgttttaactacctcaaaatataagttaaaaaataaaagcaagaaacatgggctaaaaatgatattgcaggtggtcataaaccgcagttaaaacatatgtctttaaaatattcacataagattcagacatagcattatacaactttttcattttgccttttacctccaattccatttagaacaattaagaaaaataccttcaactatattatttttatggcataaatgaatttgaacaagatatttcaaaaggtaaatattgaaaaaactctactgcaatgcattttgactcctaaaataggattgtgataaaataattaaattttgatattttaatgcacttgaagaaacacccagcacagcccatttctaaggaaagaacaagttaaggataacataaaatgaagttgactttttgtaaaggtgatcttttcacttttaaaacagcactcaatgattctgccagagacagtgtctacaagtgaaaacttgtttgtatgtgatgggtttgactgacaggttggatcaagttgaggtggggaattggggtggacaaaggagaggaaacaggttatgctattcactcaagtcaatcaaataacctgattgttctttcaactgccttactctgtcattgactgtcaagtcagtcaaaatagtgaaactagttttcgcatgtatgcagagatttattttatgacgctattacctcacccttgtaaacacagacataacaaatatctaagtccacatgttgaaaattatacacaaatattgcagatgtttatgggtgcagaggtatgtagaagagaaaacatgctgaacttaaagccaacactgtaatttcctaatgtttgacttcctatttgacagagactgatataattgatcaagcatacactaagatgcttctttagagaaacattcagcagtatttttctgtattatagtatccaaactagtaatatttacaggaattttatttttatttttgtttctttttttgagacagaggtttgctgtatcacccaggctggagtgcagtggcatgatcacagcttaatgcagccttgaactcccgggctcaagggatcctcccacctcagcctctggagtagctgggactacaggcaaacacaaacacacagctaatttttctatttattacaggaatattacagagagtttgcattaaatagctcagaaaacaaacagatattgtattacatgcacaaacacacacacacacacacacaccctttttttttaatttcaaaaattactttgcccactttttgatgtggttgtttgtttttttcttgtaaatttgtttcagttccctgttgaacaatgagaacatatgggcagagggaggggaacatcacacactgggacctgtccacctgtcccagggttggggaaaggggaggggtagcattaggagaaatacctaatgtagatgacccgttgatgggtgcagcaaaccaacatggcacatgtatacctatgtaacaaacctgcacgttctgcacatgtatcccagaacttaagtataataataaaaaaaaaacttgcaagattaaaaagaaaatcttaacaaaatccaaaaacactaaagtgagtcaataagaagacccaattatgtctgatctcttgaagttactctgctgaaatgctcaagtccaggttaacctcatcaatctaaatggattagcttaattcatttaaacttagaaatagttgaactactcatttttaggtctcatgcaatttacctgtgtgactcaacatcaaatctgtctgctaggttcatttggcatgttttgtccctaagatatctgccaaaccaatgcaatcaacctctcagaagcttttttcatatttaagaactgcttttaatttctaagccttcgccatggtttctgtcatgtatttctcacaaatgacagctactgatatggcagcagctattggttattgggagggagatgggactcaatgttatatagctatgtatcgttttgagattattatatgtacattacctaattctctcttcagaaacatcccgagagtattattactactattactatactccccagagtagtattaatactatactattaataacagtgtactataatgctaatattattactatactatgaacagataaatcagtggaggcttaaggacattaaaggaatggaccacattgcgccaggtgtggtggctcatgcctgtaatcttagcactttgggaggccgaggcaggtggatcacctgaggataaaattattcttttattctactaaaaattaaaaaaaaatatagccaggtgtggtggtgggctcttgtaattccagccacttgggaggctgaggcaggaggatcgcttgaacccaggaggtagaggttgcagtgagctgagattgtgccactgcaccccagcccaggcaacagagtaagggtaagactgtctccaaaaaaaaaaaaagagagagaatggaccaaattggactagctcatcatggtgacagaataggaaggggagaccagtgcttgctgcagtctggggcaccgccattctctccctgtgctgccaatttttcttccttctaggtgatatttatttcaacccgttgaaatcaagaggttattatttttactgacaatttattattgagattccctccatgaagaaagatcaagtttttacttcaaagggatggtaaaaaaataaaaattgtttaaccatccttgtcttaggcttgatggtgaaagtataaattaaagtaaactactgttttatctggtgaataaaaagcttgagctttattaagtgattttctcttggtattgggaagtgtatcttttactctagggttgttacttgaatcacccatgctagacagtttttttttttgagacagaatctctctgtcacccaggctggagtgcagtggcataagctcatctcactgcagcctggatctcctatactcaagggatcctcccacttcagcctcctgaggagctgggactaaaggcatgcaccacctggctaattttgtttcctttttgtagagacagggtctcactatgttgcccagattgatctctaactccagagctcaagggatcctcctcccttggcctcctaaattgctgggattacagacgtgagccaccacacctggcttacatagctttttttaaatacaagagcaacaacaataatataaacgaaagttattcttcaaacgtaacattaacctagatttatttgaagctgaaagtgaatgcaattgggtgtgccaaaggcaatgtgggaaaaacaattaattcctttttgttagaattggacatatgtattcgcaccaaatggaaccattgttagggcatattacttttctattagtttacttttctattagaatcattcaagcaaatctcaaagtttttatctgaaaattgttttgtttcaaatttctttaatgaaaatactgtaaggttggcttccacattaactacacggaaactaaagttactagaaaagacaggttagttattaaattgagaaagacattgaacacttgatggtaaggaattatgcaaacaagatccgggttttcctaaaattagacttttttaatgcaaaattactcttttgcgatctttttatgaaaataattaacttagcctttagcgtatctagattttgattttatgcattatttttagcaagtttctaagatactaccttcataggcaaattgatttttagttaaaaaagaaaacaatttgtgtgattgaacatgtgcttggaagttagtaaaaagaaaaatattgctttatttagaactgggatctactttctcactagttaagaatccttctaggcccattgcggtagcttacacctgtaattccagcactttgggaggccgaggtgggcggatcatttgagtccaggagttcgagacccacctgacccatggtgaaacttcatctctacaaaaaatacaaaaattaaccagttgtggtggtgggcacctgtaattccagctactctggaggctgagacacaagaatcgcttgaacctgggaggaagaggctgcagtgagccaagatcacgccactgtactccagcctgggcagcagtgagtgagactccatccaaaaaaaaaaaaaaaaaaaaaagacactaagctaaaagacactaagctaaaataaaagcctcatattatcttaaaaagtggggaaggatacacacttaggacccctgatgaggtccccttatcctttattgggtgctttaattatatgccttactttattctttgagtttttaaaacctcacctcctactttactaagaaaatagaggtggccacgctggaatcttttttcacctgtaagttcttaatacattacattattattttttttccttaaaatctcaggacagacttgactctactgttttaccccgccgaaaatcccgaattggtgtttctatttctcatcctgtcagccttctctggagtgttattttgtcgtttttgactttgatacctctatttgttttctctccacggattctttgtctccactcacaatctttgatcagcaaaaagtagattattccagtcttttaaattttaagaatctggcctctatccttgaggctctactgaaaccactctctccaacgtcctttaatgttttacccagtccttgttttctgtagctttcaaattattgactatcctgtcatctttggatatttttctttctttgaattcagtaatattatacactctaggttctcttcctatcatcaactttgctgtattgtttcttcttgccgaaattccatttcttttcatcgctatttattacatacctgctatgagtcgagtacttttagtgaagctggggatacaaaagtgactaagaaaatgtcctgctattataaagttgcattctggtgaaagagaaataaagtcaattaggaaacataaataatataatttaagttggtggttaaattctatgggaaagtattataaattaatggagtaggtggccagggagagctatttagctggagtggtcaggaatttcctttcttggtgagtggcatttaaatggagacccttttggcctctcttagaggctgttctataaagtcctgagtagagaaactagtggaagaaaacagaaccagtggaaagagtgagagacaagaatggtgaatctgataaaaatggattctttgatttgtaggagaatggtttgaggacatgggaaatgaaaaggtggagaccatgagttaactgtttctaaaagcaggctctgatatgcttgagatatgcgatattaaaaatgcggatattgtgacacatttgtatgctacatggaattacccaggattgagggaggcattacctgtgcagaaagggatggtaattgttggagtgaactccagcaatgttggtgctcttggtattttgttggttgtttttgtcaataatgtgatggtgatggtctaacttgtactttggtaagttatatgtatgtctatgtctttcagtagattaaaattaaaatatttcttactcttctttgtcctgcccatgattgccttttctaacatctagtgcagtgctcaaaagtgtctgtagattttggttgcctcatcattttcaaaatgtttctgggtttaagcctaaaattatatatgatttcatttaatgtgaacaatggccttcaaattaccaataccagttgcatctgaggcatattgaagagctttaaatccaagttattgtgtatgaaactagtgcttacaatataagcaggtggaatacatttagtctacttatatggaaaagctaaaggggaaaaaagtccacaaccgagtcatataatagtttttaacctaacttcctggtcagttttcagctctgcatagctactctgattgattgttgccccatcaactaatatgtttgaaaattcaaagtgaataataccatgaacaattcagtaatatcaataaggtgaagcctgattgtattatttttggaatatgattaaaataatgcaaaagaaataatccttgcccccccctccactttttttatttttgtcttcagcagttctgtggtttacaggtagcacatctgaagctgttatgcactggtaaaaccaatgtggattacaagaatacactattaggccctggtgacaggagacaaaagcaacatctgcttcctaggctttctgtgttacagaagagaaggcctgcccatcactatatgtaaaatcactgtattatccagtgcctggaatactcatattaggatctagaagctagttgggatttaattgtatttcaaattttagtataatactagtataatacttttatatcagtatcccatgttaactgtatatgcactttattattttaatatttaataattgaaatcaagtcttatgtatttatgtaaatttttatatgttacattcatatactgatgtttatatcaatttagaaaagaaaatgtgagcaattaattcttattaattaccttatatctggttttcgctcaagaaaataatacttaaatgaaatgaaatttatttgcttctaatgtctacataaaagacaaaatatccactagtgaatccacacagcatacaaatatatatgttaaaatttgcacaacttaaaaatatgcatactgtatttgtgtttctgttttctaaaataaaaaccttgggatttataaatattcctgaagaaattccttgtatttcctagctgaattagttctgagtttggcatttgctctttacagcctaaccagggagtggaccattagttttcctggagctttgggactttgggtttttgcctttggaaattaaatatgtaatattgctttgtctgggctggcttaggacaggatcctcccttcattccagggcaacgtcaaaattcacagaagagcaacagttcatattgtctattgaaatcaaatctgattcttccccctcccatctcccacgcctgcccttgggattgtgacatcattaccatctcaagaacccctagggttgttttccctgttaaaatgaagtgagattagggttctaggagagagcagtcaaatatttgagcactaatcatgcctggatgtcttttactaattttcaggcagtggaattcttttggtttcaagattacaccacagtcgtttaatgtaaatgtggacagaaaagaatacaattaggtgaatcgcacagacaatctgcttttttttcagcaatccttgaaatgaaagatgcatatattagaaggttatctggcatatgaaagggacatttatcccccaaggagagaaggaaactacttaaaagaaataaggttttattaatatttttcaattaaatgttgcactttctttatccttttgtaattttcatgttgacctatgtaagtgctttgttcatgtagcattcactctttcttggcaagtcatcagatggagcaagtttattgaaaaagaaacagaattaaaaattcaatgacaaaaattcaaatagtgtctgtttagagcttatcttcttaatgttagggcttttatggttattggttggggacttttgggagtgtttcttaatgctcaggtgggtgatgccagtatcaagggaagcaatggcgttactttaattccaagggttttgatgattgcattatgtttaagcattgtgaagatatatatataattttagcgtacaaaagtgaagcagttttgtgattgaattatttaaattagaaaagacagaatagcacaatcatacaaaatgaaaggtgctttctttatatcttctcccaaaatatggttaatggaaaaacaattactttttattatattttggtcaattttgtaatctatggtgataaacaatattcgataacctttattaaaatacatatttgggagaatatcatacatagaattatgactaatcatgaaaggctgaacagcattcaatgctattgtttttaaatctataaaatgaagaattgctgcctgacctgcaagatttcatccagctctaaaatcttatgcattctataatatgagaggagaatatttttttttttttttgagacggagtttcgctctgtcgcccaggctggagtgcagtggcgcgatctcgactcactgcaagctctgcctcccgggttcacgccagagaggagaatattttaatgatgtcaacagaatttacctaaacataaaatatgaatgtgaacctattatacctttatacattcctttttaatgaattactcaaaattgtgatatcatatatcagcaaaataataaattcaactatatattaaagagaaagtctcagatatttcagaatacttatttaaaaatatttctaccatgctttctgccaaaaatgaaatgtaattcaaaagcatccattggaaaaattaaacctctttctgccagaataatctagtgttagcatttcatgccttcttaaaaacagattttatttttcaaatcagtttgaagtttacagtgaaattgagaaggtatagagatttcccatatcctcttccccctagacatacataggccccctcactatcaacatcccacactgacgtggtacatttgttacaactgatggacttacattgacaaatcattttcacccaaagtccacagctgatgttagggtgttgaccaaaagagtcaaactctgtaaaatatttgaagagatttattctgagccaaatatgagtgaccaatgacctgtgacacagccctcaggagaccctgagaacatgtgtccaaggtggtcagggcactgtctagttttatacattttagaaaaacatgagacattaatcaaatacctgtaagacgtacattggcagttctgtctggaaagtaggggcaacttaaacgttttctaattggcaactggctgaaagagctaagctattatctagagacctggaatcagttgaaagaaatgcctgggttaccatgataagataagagttgtagagaccaaagttttatcaggcagataaaccctctaggttgcaggcttcacagagaacagacggtaaatgttcatcggacttaaggtctgtgccagtgctaatgctggtcagcttttcctgaaatctgaaagagaggagggaatgatgacgcatgtccaactctcgcttcccatcatggcctgagccagtttttcagggtaacgttggaatgccctggccaagagaaggggtccaaccagatggttgggggtccttaaaattttatttttggtttacatgggtacactattggttggtaggcattctatggacttggataaatgcataatgatatttatttactcttctggtatcatacagaataattccactgtcctaaaaattctgttctccatctattatccatcctttccactaacccttgccccctgaaaaccactgatcttttttaactgtctccatagttttatcttttccacaatgtcagacagtatggaatcatatagggtagccttttcagattgacttcttcagtaatatacatttaagtttattccatatttcattgtggcttgataaccattcctttgagacaaggtattgctttgttgcctagattgcctaggctggagtgcagtggtgcagtcacagctcacagcagcctcaacctcctgggctcaagcaatcccccaactccagacactggagtagctaggactacaggcacatgccaccatgcccagtgctttttaaattttgtatagagtcactgtctcatcactttggccaggctcttctccaattcctgacctcaagcaattctcctgccttagactcccaaagtgctgggcttataggagtgaccatcatgcctggccacttgacctttcttttttttttttttttttcatttttcttttgtgtttttgagagtgtcttgctctgtcttccagggtggatggcagtggtgtgaccacagctcactgcagtctcaacttcccagcctcaagcaacctcccatctcagtcccccaagtagcagggaccatactgtacgccaccatacctagcttttcttttctttttttttctttttcctgtttttgttttgttttgttttgtgtgtgtgtgtgtgtgtgtgtgtgtgtgtgtggtggtgataaggtctcactatcttgcccaagctgatcttgaactcgtgatctccaatgatcctcccaccttgggctcccaaaatgttgagattataggcatgaaccactgcacctggtgatagctcctttttaagtgctgaataatattacattggatgtaacacaagtccatatagtgtatctatctattcacctattgacatgtcagttacttcgtagttttggcaacattatgaataaagctgctataaacatctgtgtgcagttttgttgttgttgttgcttttcagctcctttaggtaaatgccaaacagtggaatttctacattgcatcataaaagtatgtttagttttgaaaggaactgccagactgcctttccaagtggctgtaccattttatcttctccccaacagtgaatgacagttcctgttgatccacatccttgtcagcatttggtggtggtgttgttctgtattttgcccagtctaatagatgtgcaacggtatctcattgttttgatttgcatttacctgacgacatatgatatggagcatcttttcatatgcttatttgccatgtacacatcttctttgataagatgtttgtgaaagtctctgacacaatttctaatcagatttttttttgctgttgagattttagggttctttatatacttgcataacagtcctttatctagtagatcttttacaaatattttctctcagcccgtgtttgtctattcattcgctagacatctatcatgtagcatatagtttttattttaacaaagtccattttatcaattttttatttcctagatcttgcctttgatgccatatctaaaaagtcattgacaaatccaaattcatctagattttctcttgtgccgttttctggaagttttatatttttatgttttacatttaggtctgtaattaattttgaggtaacttttctgaaggaaatctggtgttagcattccatgcctttttgataccatttatccctgaaaataaagtctacatcattattattttccattttgccaatttgattgggaattcttatgatttaaaattttcttaatagctttctattaaaatagatttgaatgaaaaaatatttctatgaggaacatttacatttctaaatatttgttttaatataactccaagtatattttaaatctaattttcttttttagaaacagagttcatttagtaggctaaagctactttcctaatactatggtaatatttaatttttttataaatataatttgtatgagtttgggcctttttaggcaaacagaccaccttggtcctctacatatactttctcccagtgtatattcagtatccgctatgtacatggcatcatagtgacgtagatgtttacactggagcaattctgttttctcctctacttgcagatagaggaggtggcagatatcttgagcaattatcattcatttccttgtgtctctaaggatgcacaatcatcccttggttccaggaccgcccacctccccaagaataccaaaatctgcagatgctcaagtcctgcagtcagccctgtggaatccacagacacaaaaagtcagtcccccatgtccttgggatcctcatccctctgtgtctggaattggtgggttcttggtctcgctgacttcaagaatgaagccacggaccctcacggtgagtgttacagttcttaaaggtggtgtgtccgcagtttgttccttctgatggtaggacgtgttcggagtttcttccttctgttgggttcgtggtctcgctgacttcaggagtgaagctgcagacctttgccgtgagtgttgcagctcttaaggcagcgcgtctagagttgttcgttcctcccgtccagagttgttcattcctcccggtgggcttgtggtctccctggcctcaggagtgaagctgcagacctttgcagtgagtgttacaactcataaaggcagtgcggacccaaagggtgagcagcagcaagatttattgcaaagggtgaaagaacaaagcttccacactgtggaaagggaccccagcgccttcccactgctggctcaggcagcctacttttattcccttatctgaccccacccacatcttgctgactggcccattttacagagagctgattggtccattttgacagggtgccgattggtgcgtttacaatccctgagctagacacagagtgctgattggtgtatttacaatcctctagctagatgtaaaagttctccaagtccccactagattacctagacgcagagcactgattggtgcgtttacaaaccttgagctagacacagggtgctgactggtgtgtttacaaaccttgagctagacacagagtgctgattggtgcatttacaatcctttagctagatgtaaaagttctccaagtcctcaccagattagctagatacggagggctgattggtgcatccaggaatcccaagctagacacagagtgctgattggtgcatatacaatcctctagctagagataaaagttctccaagtccccacctgactcaggagcccagttggctttgcctagtggatcccatgccagggccataggcggagctgccagccagtcccatgctgcgctcctgcactcctcaacccttgggaggtcgatgggactgggggccatggagcatggggcggcgcccgtcggggaggctcgggccacgcaggagcccaccacagtggcactcgggcatggcaggctgcaggtcctgagccctgccccgcagggaggcagctgagacccggcaagaattcgagtgtggcgcgggtgggctggcagtgctgggggacccggcgctccctctgcagctgctggcccaggtgctaagcccctcactgcccggagccgtcagtgccagtcgcccgctccgagtgggcccgccgagcccacgcccacccggaactcacgctggcctgcgattgccgcacacagcccgggttcctgcccgcgcctctccctccacacctccctgcaagcagagggagccggctccagcctcggccagcccagagaggggctcccacactgcagcagcgggctgaagggctcctcaagcgtggccagagcggacaccgtggccgaggaggcactgagagtgagcaagggccaccagcacgttgtcacctctcacctcgaatactgtatttttgacccactgttagctgaatccagtgatgtggaacccatggatatggagagccaactgtatagttatttgattaaatttatacttctttactgcctttcagaaaagttgacatttctgctgaaaagaagctgctaatctttacccagatagaacagagaaaatcagagttgaagggacatgtttagggaaacttgtacaatctaactttataaagcagcccaagtgtcacatgaaagtgaaaacacacaatgaaaatgagcatcagcctccagtaattctaaattttatctacaagtgtattcacaacttactttttgttattttttctgatgattagccaaaggtcagggatgattggcaggtacaacagttcaaatagaagtagttcacaaactgcctgtaagcctttcttgataaacagttttgatgaattagtaaataaagtgttttattttatacagaaatctctgtactttttcatatttgatcatttgtgcgtccagtgacatattgtagacatatacattcactgaacttattactggttgccaagatagtaatagcaaaatctcaaaagctgcatgacaggaattattcaaatagttctatatactgataaatcaaggtttaactatacaacaccctctagtccaatgaaagtagaaattacctgtgaaaattacaatttattttgaatgttcacaaataatcttatctttttatttgtaagtttgactcaaactataaactacacaaataaaaaagtaaaataattatagtaagtagccaaattttattctagttttcttgtttcattcaaattcagtttgtgctccttaatgataacactattgtcaataaaactttacactttaagtgactttccacagttttcccatctgataagaatggtactgataaataaaaaacaacatgcactatccatcttactttcatagactagagataaatcattatgaaccccaattggcagaggagaaaattcgggtgcagacaagttaagtcaggtggcagattcacacaggaaataaatagtggctatgctcgtataaaaacatcaatcttctgacctctaattcagggcttttccagcactgcagtatgattaatcaataccaggaagcaaactaagtatcaagaaaagatcatccatttgtatcagtctttcctttatgtggttggaatctaaaacaccaagtgcataaaggaatcaaaagtcggaagctttgaccatttgtgaacaatcttttctgtattattaacaggtctgatgataaacacagacatttactaggcccaaattgtgaaaaactttgtagacattttgctaatatgcgggaaataagctctttcttttagcaacttactttgattttcttttatttttatgctgctaagaaagcactcagatgcatgctgaaatatgtattaccttatggattgcagctggcagggactattagtgttaaagattcacacatttgaagtaagattggatacatttatatttgtgtcaggaaaaaaataataatagaatttaagaatttaaaatgtaaccaaaaggcagaatcatggcttttggctgaagagattagcagcattcttctctgttccctttttttctgaagcttagttttctagctaagttttggcaaacaaaattcttttctgtggtatgtattctattttaacatcttccactgaaaagaaaagataatgatataaataaagcaatttaaatcaagtctaaggtataggaaggtatttaagaaagaagcaaacattctctagatgttgttatccaaaatatattctcttttgcagtttactgaaataatttcttcagtgtgtgggaatttcctttgcatccagctttactatagagatgacatcacaccaacagtgacacgacttgtttacaagagggtggtataaacagcaaatgttcttccttaaaacagatttcttgttgaacttcaacagaaaaagaagcgtaaatgtagaaggaagaacaggagatagtctttaacatgtagggtaaaatctaaggtagaggagagagcagctgataatgtttttatgtgtttgctactttattaggaagtctacttccttcttttccatatctagtagagtcttcaagttgtacattgtctttatattaatatataatggcctattgtactatgtcttaatagtttcatatcttccctggtttacatgaattaaatgagagcggtaacatcagaaaaggaaagagagagagagtgaatatgtgtgtgtgtgcatgtgtgcgtgcgtgtttgtgtatgtgtttctgtgtctatgagagagagagagaaaagacagacaatgaaaatgaaaataaatatcttctccaacctatcttagccaactttctgatctaggatgttaggacagtcactcactgaaggaattttagttatagcaaagcgtcatccatctttttcaactgtgttaactttaatttcccataaataataatagtttgcagaatacatctcagattgtacctgaccatattgcaaaataataatttgcttcttgtgtaagaatcattatttaagactaaataaaactaggtataagtaaaataaattaaattcagccctttgaataatcatttagatcatgactgctaactgtagtctagtactaattaaagacctacatggttatttttcttagaacgtgagaagtcttaggagcaactgtttgaacaccctgatctggagggaggagtccttaccaggagatttctggagctgggtgtggagggtagttcagtttccacacattagcccataagagaaaatcatctgggtaaaatagggtgactattctggacacggtcatggctttgctactatagtcccctccatttttcttgggagatgcattggtgcttcgcaaagctgtgcagtcattgaaggtgctcagcactggtttttgtcattaaaatacttgagcttgaaacccagcactgtcaatttagtgagcgcggccttacacaaagttatctaatttctctaagtttcagtgttatgatctatgacacaggttagtaatccctcctttataggaatgtttaacattaaataatgcattaaaagcactttagatactattaatctcaaggcaaatgtcatgttatgtggtatggggcatataagtttccctggcattctcaaaacctgaaccctacactccagctcaaagctccttatagacaaggaccatattatgaaattctgttgtgtttttcatagtataggatgtacacattgtgggatttcaaaattggattgcttcttggtatcaagtatccaaattgctcagagccatagtagtaaaacaatggagaaacagtagtgactgtatcattataatatacgtaagtgttcatgttagtttgcttaacatttattgaattcctgatacataaaaggcctcaggctaaattttgtcaattatataaaagtaccttttcctcaataaaggcaacttactggaagaatcatgttttagtgggggaaattaacatataggctttataaacaaatgaattaagtgctaaagagatgaacaagacacatattgtaagatatcagaaggagaaatgataggggaagacagtagttgtcaggaaaacatggtaaaaatacaactgttggacttaggaaggatttcagtagtttaagagacaaaaagataggaaaacgtttagcatgcgcaaagtcaaagtcagggatccataaatatcattgggtgtgtaatgaattgttagtagttggatgggggatgctaaaatataaagtgagagatccttcatatattttcgtttcctacccttagttccagatattgatagagatattttagaaaatcccaacttaaggccaggcgcggtggctcatgcctgtaatcccagcagtttgggaggccgaggtgggaggatcacaaggtcaggagatcgagaccatcctggccaatatggtgaaaccccatctctactaaaatacagaaaattagccagatgtggtggtgcgcacctgcagtcccagctactcgggaggctgaggcaggggaatcgcttgaacctgggaggcggagcttgcagtgagccgagatcctgccattgcactccagcctgggtgacagagtgaaacttagtctcaaaaaaaaaaaaaagaaaaaaagaaagaaaagaaaagaaaatcccaactgaagtatatgtgaacaaatgaacagctttttttttttatcaaaaaagcaaaggtctttgaaataattttattcagattttgctcacaaatattatatttccatttttatttaaaattatgaggatgatggctaaaagtaaaatgaaccaagttttgtgcatgctgcattttaacaagttgggtgtctcattggaatgcactgccttcttgttccacatttatttttggaatttaataaggcgcctgtcatatctgcctcaaggctaaaaaacatcatgggggagaaatccaaagtactgtcatgtttgagtgacatggagccaattttattttatttccttttcatggggggtggctcaaattagccaggctcacttctgaaaacgcattgctacatcatctgttctaaaggccttgtgctggttaacgggtaatgacattgcccagtgacatttgttaggtagatttgactcagaaaaccaggggaggattttcattaaaaaattaattctgtgcattttactgcaaagctcattctcatgatagattctggtacagtgccacatatctccagaattgggtctggttacgtgagaaactttggaaggtaataacttctttatttcttctttgtgctcccagagcacataattaacgtactgactcatttagctcaactctccaaaggatgaagctgtgtggatacaagggagattcagagaaactggcaaacaagtatggtttctgattctcattcgagtgagggaaaaactctgccattttcttcttctttcttttaagttgatgtttagtacaatgtgactgtgtttagcagaacataatatgttaggattacaatggaaccatcatatttttaggaagtttaagtgagacttgggatagatgtcacagaatgatgttgccatggctgagttagtcataaaattagaaatcacagtaagctgaaggatgtctgaggcataaaaataaaccatgtaccatgtaatgggtgtgttattgtaataactaagataagcatttcaaatgttttactgattaaatcagaattaagtcctgtgttttttagtagtgactatcaggaagtagattgtttaaataacatgaacttaaaacatgtaaacatagtaatttttatgttaaaaatatatagtgtagacaaaatcaataatttgtagctagaaagctctttctaccttcatttaggacttcctgcctcatgggtaaatggaaaaggaatagtaaatctaagcaactttttcatgagtttataccttcttaggcacaaagagaaatctgtgatctcttccctgtatcctagaagacctctgcgacaggagtgagaattgaatttggttacaaactactgagagtgtatgtgtatgtgtgtgtgtgtgtgtgtgtgtgtgtgtgtgttttgcatgttggctaagtatggaggaagggaatcattgtaggaaaatttaatcctgagattttgtggctacactcactttaaacccaaatatgtgggttggatcaatccttggttatatatgggagatcacttagtggtcaggccaggtctaaaccattaggtattgagccactatggagcaaacaaagagaaacatgagacttcaaaatgagcccacccccatgttaaacgtgctctacacttcagcatgctccagggactgtgaatcagaaaaagtcaactgcattttgaagtgtcggcacgtaacattttcttttcctttgttatggaattccaaaactatactgtacagattacctaatatattctgaaagctatcaagcaagcaatgtaacactttttttgtggacaatgattttaattaaataaatgccatttcttggagacaatttacctcttgagtatagctggtcttcatcttattttacacaagctatctcttgggggcataaatttccaggcaaggaaacaggaaaatttattggctatttgatttacatgtttattgggctctccaaaggctttactatttaactggtcattgaaagtagaacaggggtggggtggattatattcaatttaatggaagatttaggtaaagtcttttgaaggaaaaaatatgggtcaacttttaaaatatttcactttcagtaaacaattgtatctattattttagtggctatctaccaagagctgaatcattctgtacagactgaattctttagtccatgtctcgagttttaagttttccatgctaagaagtgctttaacttaaatgtgtcaataatgatgctgctgtggaattgtgtcatactattcccacgagcagcccagaatagctcccaggcttggagtctaatctttattcctggaggtggcaagagtaggttgtcatggagctagtggagaaatcagcagactctatttatgtggcgagggagaggatacagtctttcttctgtaaaattttagaatgaggctgttccgcaaggacattagtctgagtgctttaaaaaaagagcgtgtactctacacgtggaggctcaataaagtttgtttacagtgctgagagtgattccatattcacatcccaaatataaggccagttgccatccttcaattattctctcacaaatacagtggctcctcctctcttcagtaagagtaattgtatcagttagagaatatttcctttactaccaggaattctgagaattagaatcctcttccttgacggaaaggcactagattgacaattttgcaaatgcacgtgctctctttttgctttaggttatcattcttgcggaccatttcccttagtatctcgaagcgtctgactgacagggtttgaatcccagatctgccacttacttactaatcctttgaaactaagcaagtaaaagaatgttattaaattcataatactgataggaacaggatgcagggagatcctgggcagaagacagtgggtctctggcgagggccccaccctcaagctgaaaagcctggaaccatggccaaaagtaagagcttgcatccctgttttcctgctcgaatgttgcctttccacccacagccccaccccacccccgtcctgtgcctgtaaaaaccccagagctcagccagcagagaggagaagcagctgaatgtcagagactgggatggatgttggagagaagtggtttgacttcagagggacagcttaacggtgtagcttcggagaggagtccggtggggatggcccgactctagaggaagatcaccttcttgctccatcccctcttcacctcccctttctgctgagagccactttcactggcaatgaaatcccctgcatttaccatctccagttagttcatgcaacctcattccttctggatgccagataagaactcgggtgccacgagtgtgggtgcaaaaactgtcacactgaccctccgctgagctgttaacactgaaaaactgtcacactgaccctccactgagctgttaacactgaaaaactgtcacactgaccctccgctgagctgctaacactgaagccatctgcagatggcaaagctcaaagggttttgtcatactccgtctggggcttcaggggtcgcgagcacccccctggaggctgtcgcggggcccacatggagttttgctcctgccagcacccaaaggtgctcaccccagctcctgcgctcgctcacctgcgccccctcccttgaggagtggaagtgagaccaaccgagtgagtccagcgcgaaagcagccagcgaggtccagggcctgtgaggtccagggcctgtgcgctccagttcccgcccacgaagggggcaggaaatagctgcttcaacatcacttgctcttttttttttttttttttgaaggaagaattcgtaaaataagtttggagatcacttgaacataaatattttggaatatgagcccactcataaatgtgaaagtcattacttttattttttaagacagggtgtcagtctgttacccaggctggagtgcagtggctcagtctcagctcactgcaacctccaccgcccgggttcaagcgatcctcctgcctcagcctcccgagtagctgggactaacttctgtgtttttagtagagaaggggtttctccatgttggccaggctggtctcaaactcccgacctcaggtgatccaccagcctctgctcccaaagttctgggattacaggcgtgagccaccgcccctgcccacatttttgttttaatttgggtttttgtcacagtgagaactggaaaaaaacaaaaacaacaaaacaaaacagaaaaacctctgctgaattacctgtaaacgaccttatgataaaatattctgttttgtcttctctgtatatatattttttacaattgctttagtttcagataatattctgtacaatttgtaatttagagataaataatcaaatattcatacatatatgaagcattaaagaaaaatttcaaaaactctgaaacgtcatggcatccagtaagaacaaagtttctgtaggaatttgcatagaaaaaggcagctggacttaacatagcatctcacggcacctttaagaggtccttagctatagcagccagccctatcttcatattgcaagagataattagtttcagctgaatactcccatccatcactttaaaatgagatattgactcaaattttagaagttacaactttttttttatttaaaaatgttatagttgcccaagtacttaaacatacaaaacttaaacctagttatatatttgctaacttaatttacatttaagtaatgtaaaacaaatatcagtcagaaatcagagtgtttcttttaaaacaattgtcttacaccaatcaaatttgaatatagctactatattttattattattattattatataggacccatatgcataaatactgaaaactaagacctggctataaagttactaagtgttagatttaatgggttttttttttcctgattttccatatgtataaaagttttacttgaagaactctgcatttaaggaagcatccaaagtaatttttttctataaaaacacagaaaaactgtgttatagcataccagtaatgcacaaggagaaagtcatattacagaattaaaatattgctattacataaaaaatgctataagattactttaaaacctcctacctagattgcttcaactgcaattcagaataacatattaatttaaatctagaaaggcctagaactgaattctgtctcagcttttgattgattcagttttcattcttggtcaagttatttaatattgctgaattttagctctcctcatctgtaaaatggagaccctaaggctacctggtaagatcattttgaggattccgtctggtattgtgaaagatgcctggtctgtgctattccatactgggcctccaacagatgtttagcctttttcccattgtctccatagtttcataaatggaaatgccttttcccttcccctttaatatccagcctccttcacaccttctcctgctggcgagacgttgttaggttccatatatccagccagtcaaagtctgtgtgtgccatgactgagttgtacacataaaatagcagctgaggcagacacggtctttttttccccggaatcacacatccatgtgttaactgactgtcttagtctcttgtgttttgctaaagcagaatacctgagactaagtaatttacaatgaagagaaattgatttggctcgcagttctggagtttggaaagaggagatgcatctggtgttggccttcttgctgcagcattccctggcaaaaaggtgggagggcaaacaagctcacatgagagatggagggtaagggggctgaactcatctttttatcaggaactgactcccactataactaagtcactccatcataatagcattaatccattcatgagggcggagtcttcatgacttaatctcttctgaaagatcctacttcccaacagtgttgtagtggagattaagtttctataacataaactttgggggtcattcaaacatttcacccctggctctccagggttgcagtctcatgtctgcagctttctcaggctgcagttgcaatctagtggccctgcagttccaggagctcaggggctgctccactctcaaggcttcactaggcattgccttagtagggaatctctgtgatgaacccacccctgtggcaagtctctgcctgggcccccaggctgtctgatacgtccttggaaatcttagtggagattgtggccattaaaccgtggccccacagctcttccattttagggacctgcagatttaatatgatgtggacatcgccaaggttttcagcttgtatcttctagagccatgggtcaagccacacacacctggactcgcttgaattacaagtgtggtggccaaagggtgctgttttggaattcagggagcagagttctagggcagtgcagggcagtgaatgctgtggtcttgcaggcacctctctcaaaacgttgctctcaacgccctagcttgcttagaagatctcagaattgcctgataagatacggtcattatctctttatcctgatgaagagaatctggctttcttctgtccatgttaattactttaggaaagggttgcttagccacacccttagtgatatggatttgttgcgtcccgacccgaatctcaccttgaattgtagctcccataattgttgttaggagggacctagggggagatgattgaatcacgggggcggtctcccccatactgttcttgtgttagtgaataagtctcacgagatctgatggttttacaaggggtttccactttcacttgactctctgtctgtctgccaccatgtaagatgtgctttcgccgtccaccctgattgtgcgggctccccagctgagtggaactgcgagtccgttaaacctttttctttatgaattacccagtctcaggtatgtcttcatcagtagcacgaaaatggactgacagacttttttattatttacatggccagcctggaaaatttcaaaatctatccattttgcttccaattataaattttatctttaaattattttttcttccctaattttattgtaagcagtcaaaagaagccatgtagcactttgaacactgtgctacttagatatttcctcagccagatatcctagtacattgctcatcagttttgcctttcagtcttacgacgtgaacattattctgtcaaatttttgcaactgtataataaggatttcctttactccattctccaacactttcttcctcatttttgtctgagatctcatcagaatggccttgaatattcatatttccagcaacattctgatcataaccacttaagtaatcccttacaaaatttaggctttccctatatctcttatcttcttatgagaagagaccactcttttttaaataaacaaacaaaaacaattactgactcagcaacaagatgtgtgcatagcttattcatgaatcaattcattccttttaaatgacacttgatgcatttgaaagagcattttatatatcattattaaattagaaatagaaccaggcgcagtggctcacacctgtaatcccagcactttgggaggccgaggcgggcagatcatgaggtcaggagatggagaccatcctggctaacacggtgaaaccccatctctactaaaaatacaaaaaaattagctgggcgtggtggcgggcgcctgtagtcccagctactccggaggctgaggcaggagaatggcgtgaatccgggaggcagagcttgcagtgagccgagatcgcgcccctgcactccagcctgggcagcagagcaagactccatctcaaaaaaaaaaaaaaaaaaaaaaaaatatatatatatatatatatgaaaaataaacagacggttttaataaatgaattccaacctgtttagaaagagtactctatttgataaaataatattaaattaatttgtatggctagctgtactaatttcaaattatgctcttttggaaaaaaatatggatgtcccaaagttaacattacaggtatttgtggggcattttaagatctaagttaaagagaactaggaagtgttctaagtaaatttctgagacaccacagggtaagggttctcagctagcatgtctcgtgttacttcagatggctgtcagatgctcatatctgattctgtaaaaagtggattatctctgaagtcatggtttcaacgtgcaaattttgattttactgagaatatttaaaagataattgtggttcctaagagacttttaaaaaatggatttagaaattaactgtaaaagttcaaggaagccaagcaagcatttctatgagttgaattatgtatttaaatatacttgtgtggaaggggtatgtaaagtcagatcagctagagaaaaatgacttctcaagaagttattcacataaagacctatgtgacataacctgcaaagtttaatattcactaaaagctctattccaaaaataatattaaattttatcatcttttaaaaaaattaaatctggtattcttaatctattatgaggtgtctgtcccaatgtgaaacaaagttttccctaggtgggaggactctacatctgcttgggcaatggaaatcatatgatttgagtgatgggcctggatgagtttaaaatcatgaaaagcacaattattttcttctttgtcaatgagaaataccaataaatgtcatcagagaggcaatggcatattcttgtgttctaaatatttgggtcatttccataaaaaggctgcagttttcagagacaaatgtgaatcctgaactctagaaccagatcatattcataccactagaaatagaggtaaagaaatgacctagaattatgaatataaactgatattatttacgaacctctaatctgtaatatttgaaatattttgttcaaaataataaagaaaaagggtatatcttggacataatttttcttatgctattctgtttttatactttgcttgagcactgtaaggagactttggcaaagtagtcagcatttaattcatttgaaaaggtaatgaaaatatttttgtttttcctttaaagatatatagcctgggcaacttagcgagaccctatctctacaaaaataaataaatatgtaaattagccaggtatggtggtgcacctgtggtcttagctactcgctgaggtctgacaatggcttgagcccaggagcagttagaggctgcagtgaactgtgattgccactccactagagcctgagtgacagagaccctatctcaaaaagaaagaaaaaatagttttctgctcttctagtgaatagtgatttccacattaagtcaatgtattcattttttaattgaatcaatacaaagcctaatttgtctaatgcagtagatattttccagagagtaaacagaggaagcagctttacaatatattaagcaattaaaatacttctttttttttttttactttttgagagaatgatgattttggacccctctcctatggtggaaacttaacatctgaaaactgaagtacaaaatattctttttttagggtcttacatgatgttgaagttgaatacctttcggaactattagagaggtggagaaaattgttccactttttaaaatttggttttattataagttgtgtttattcttaataatctttagtttgttgtcaaacaagattgagaagttaaagcgattctgatatcacatttgttaaaggcccactctgttctaggcacttatttcacttacttttatttaaccattatttccatattgaaccagcattttctcttgacataaggggaaactgagagtcaaaggggttaagtgtcttgctccgagtcacccatcaaaaagtggcagaataaaaacaaggtcagatcttctgacacaaggtctaatgacttttccattcaacttcaattgccagttttgtgtgtaataggggcaggttcctctatctgtcttttctgagagggaaacgtattccgaaatgtaaagtttaaactgtgctgttaaaaggaagaactagagaaggtgagactttccactaagattccaaagatataggaaagtaaattttagattaacactggggagactggattttcttttggtaaagggacagagaaatgtaaggttacccagtgaaatatgaactcagaggaacaaaaatctatttggaggttttgaaatcaaattaagttacatgagtccaaaatgttgagcaagcctttcttaaaggcacctgtaaatgtaaagaaaaaagttggtaaagtgaaaatgataagaattcataaaatcagcattctgtaaagtgcgtgaagttttaaaaccaattcaactatgagtagatgtcatgtaggcagggaatatagtaaagccccattctttggagttgctaaccatgtgaccacaaatctccactgccaccttgtggtggtatgtatatttcagagacaggctctgaagaaaattgacctctgaagtgctgagaggtaaaataaaaggtgtctggtggtaaccaacctcccactttctgaactcaggaaccagacagatttggggaacacaggatccctcttttggagttactatccaaattcctaccatagcaatttaggagataccatagatttggagagcagggctattatacagacatcacaagggtgaaaaccttgagcaagagtaggaactgaattttctttcagattcttttgtgttcatggtggaggaagatattctattttcaagaggatcctaaatatccaatgcagttttcatctagaaaaaattttaatctattctgtataaagcaatgaggtaacattctcgtcaaaggaaatcctatgggtatgtgagaatggaaggcttccagtcacttctttacatttagttgcattcataaacgtgaccaatggtgtttctgtctagagcttaatgggttacttccgcttatacaccagttgtgctttcaactctgagcatgacatcaggaaatgtgtttgattccaaaatgatcaattacagaagcatgtgatagctaatgtgcctgtaaactcattaaccgaatgaagccacctaattgtcaacagttcaacagaattttgtctgcaggttatttgtttttaggtgtcagtggtattcctgttttaatttcgccagcagaagtgggattaatagatcaaaatagtattacagcacatgacaatagatgacaagcaaagacaaatctaaaattattctgattgatcattctataaatgtaataaaacatcagtacttaagtgtagtcatcatttattttattttttatagtgctcaaaaatatttataatgtatctgtgctaaaaacaagtctctaccaactgcataacatgtaatttgagcaaattatttaacctcttcccttttatgcacaatgaagataacattaacatcattaagaataaatgggtaataaaagtaaatcatgggacattctcaataactgtgtgtgtgtatgtgtgcatgtgaaaactataaacaaaaaaaaatctcttttattcagcagaaacatcttgacatcttatatcttaataaacctgcaagttaaataagaggagggcttaagcattagtacaaaaaactattatacagtgctttatttgtggagaatattgatggagaaaggaggaaagaggaaaagcctattcccaagagaggcttctgcgaagagcagagcatgaaaccaaggctctcgaggaacaccaaaacaaacaaactctggcagtgtctgagtaagccagccgtctttctctcaataatttttattgtgcacccagtgatttctcaggcaatttttagagccttttggaaagtggtctccaaattatgcactaatacaacactgctaatgaaagccctcattgcaactcattagctctcacttttttttgctaatccacaaattctgtcctatgtggtggacacctggcagtacacccctcagccccatatctcagcagagatgtaattgccaaggcctggagcgaggtttcatattacctagacgtgtggcttatgcaagctcttccatgagactgtctgttgtcaataattaagagctatcaaaacacttggctaatttacacttgataatctgaaatgagggcccctgtgatcaccagcttctgtcttattatttaaatacacatagtataaaaaaagcagaatggggccaaagcaagccgtatcagggaaaagaccggctttccagcaaacaagatatagcccagtggttgtaagcaagtacagcacaaggctgaacaaacatggcccagtgagtgctttttatggctgagaagcttcacagagcaggtgggattgtagaggatcttttgaacactgagatgtggggacctggcaaagtttaattggcaagctgttgtagtcaaatgcagagaccatgaaaatgggcatgcgttatggacatgagtagggagctcgcatggtatttcaaaaagagtgattgctagaaataataggaaataactatgtatgaacagaaaagaaataaaaccattaatttttaggaagtgcaaatagtcaaaataaagaagggcagtgcagtctgtatgtaaacagtgaaaaaccctttgcacagttgtacttgggttttcagcaacattagcttagcataggaatgactgcgtaactaatctcattatttgttcagaattcagggcatttctgattttctaattccaacttacaagataagagataagtggcgtaattgaagatgttgttaccagtatttttggttcgtattatgggttaaattcagcaatacatactgagaaaaaataatgtgtaataacaaggaacaaaaccttttgataataatatgtcaggatatgtcattttaacctatctgataaggaaagtgctttgttataatgccatttaaaccttttttagctaaaatgtcttgactagaatttggggaaaaataacttacattaaactctgctatactggaagtgtatgaaaaagagtattgattttataacctgttggtgagacacatttccttgtgaatgaaaatacagtgggctgtaaagtttgaagtaaagtgtcaacgtgtcagagtaagggccacatgccgtgaaaaatgtgtataagagatttgaaaggcgcatgtagttcagattcacttgtataaagttcgagtgaaagtgtagctggaaattttaggtcaacactcaagttaaaagcaagattactgctggcttaagttataaccaaaataatgagaaaatatactaaataacctgtgagagagggaaatatgagtgctataaaagtttaagtctgttactttttacctaattgtatattcctccccaatatttttaagtttagaaattgagaaattatactcatttttgtcagaggaagagatagttttaaaagtccaggtaagattagctggccatggtggtacacacctgtaatcccagctgctcaggaggctgaggaacaagaatcgtttgaacccgggaggttaagacttcagtgagccgagatcgcaccactgcactccagcctgggtgacagacggagactttgtcttaaaaaaaaaaaaaaggaagaaaaaaaaagtccaattaagaatttcatgcctttcaacacttccttttgctgatcctcttcttttaaattccacctcatcttcaaagtctagcatcaaggcctccttaatgaccttctagctatgaataagctaaatatctcttctcaacttccaaataccattctttgggaatttatctatgtacaagaaggttgtcttggggacaaaatttcttttaattcatggatgctttgcaaggagtttccttacatacaaatccttcttgattggatggtgctggattctgtctttgcttctttctatattctcccacttcacattccagctctgctgaacagttgactgatctctgcacagtcagttctcttttcctggattgtcttttcctgcacgtctccttggctaatttcttctaagccttcagctttcatttaagatctcacttcctgatactctcctcgtattcacatccaatttaacgactctgcgctctgttctcagaaaattaccttctgctattaagattagtatttcacacacctgttattgcctgctttcttgtctgtctccttgaacagaatttcttctctctctgagatgagaatcataagattcatggtcagtgctaaaaaaaattaagaatgcatgtaagaattagcgttcatagaatgtaagcaccatagaagttgcgaatttgttttgcgtgtctctatatctctggtgcttggaaccatgcctggcccacagtatatcttcaataaaatagtggttgaatgaatcagtgaataaagaaataaaaatattatgtattttaaaaagaaaacaataggttactaagaggttgtgttataaataatgattacagctgaacgaaagtactaaaaatgtaaatgatgacaaaatgatagatgagagtaaatagaacttagtatttggaagtaaaataaagagcaggaacaaaaaaggatgattgcttactagctgctgttcttagacaaataaacccttattctctgaaagtttaccttagcatttcagcagctgacaataataaaaaggagtaagaggtatgaaaaattacatgtcgttttacaatcacttccgtgctttgtctgtttgctccattgtgatggttcagatggttccatttgaccccaacctctagctgttccaacctcagaaccaatatttattgccacatatgggctgcgcatggcagctgcaaaatccagatgccaagctttggaatgtatttttacggcagcaccatctggggctctggccagccttctttattgtctcttgaatgtttacactaatagctttgctgggctgtggcactacctgtgggacacgctgagggtcaggccgtttatgagctcatcttgtcattctagttagaatttccctttaaatgtctctcacctgctatcaacttattccttttaatgtatctacaatgtctgatgaaagtaataaaacaggtggtcatcgagactaggaaagaaaaggactgttttcacagcggtgggtccatgttattcatgggttctcagcagcccatttgtgagttttggggggaaataaaatactttttcaatttactgaatatattattttgcttatatttcattgaaatagaagatatacattattatagcccttaacccaacttactggagtagcatattgatctctaagggaggtgataatactccacagcacaaatgaacagtattttaattcctagggaaacttaaaaaaatagtttatttttagcaatcaatgagttgagttatttgaagattcacctgcaacttaggatggataaatgactatttgtgatccttagaaccatgatttagggaattcctcaaaggtgattcaagcagattcatggttttgaattgtgaggaacccgtcattctaaaggaactaatgcaacacgaagattcagctcaagtaataatttagcgtgttatatccagcaaagggaatcagctctgagagtttaaatgacttatccaaggtcccacaagcggtagatccagagtcaaagtgaagatgaagtttgtccaattattcgatgacagtaggacttgtcaggagagtcaatcctgatcatcgagcccccgaaatgatgaaatgacctgaatgattgtgcgacgtccctatttgctttcacggccccgacactcgttctgccccagtgggtaacctcaccttttgggggtggctttgtgggtggaggctgtggagcaggactgcagtcagacaaggaacatgaaggaaactgcgtttgtgtgacctcttggaagcctcctcctggtagctgggcttcctgggattgtcacagagagactgccatctcagaagtagtgacaaaattaggcattcccaggctcacggtttctaatcaatcagcctgtcacgtatctgaggagatatttcagagtgaagatagcgtatgggaaagcaatttccttggacttctgcctctgagttctatgtctggagtagaaatgaggtgcttagtgttaaacaaagccaagtagggagacagtgatgtgactcttatgcatgcctggaccaaaatggcaaatgtgtgcctggggaagccacaggaggctcccagaagcagccttccaggttctgcagacacttaagaaaacagccacaattaggtccaagggaagggtgatattctctccaaagacactttaaataagaaagagctgttaaagctttcctgtaggctgaggatagaccttttaaaatgatatttagtctcaggaaaaaagaagacatattgttataatgtgttgtcagttctctaaggaaatggcataaaaaggagattttattgtggcttaatcctttgttctggagaatctgcgcttttatatacagtatatattttaatgaaaaccatgacaagattactattcataaatcagcagtgaaatactaaggacatagatgctcacagctgcatgcatgtgtgcaggaggtgaggggggtggtgcatgtattttttcaaatgggttcattaccacaattggaagaaaatcaatgcaactatggcaaaacctcattgctttgttgccaaaggatttctgatttcatttttttttttttttttgtaagacagggtcttgctgtcactcaggctggagttcagtggcataatcatacctcactgcagcctcaaacccctgggctcaagcaatcttcccaccttggcctcccaaaacattgggattacaggcatgagccaccatacctggcttgatttcattctttgtgtgaaggagataggagaagggctttcagcactctgaagtatccttaaattgattgatgtattctcaaactctctgaaaaatagtggcttcaagttgcccgcctcataatttttgccacttcaaatttgtacattctatttctggttggaaaataaatacttcacaaaactattatagttggacacaaatatatcaacaactccatcatttcatacaatagctggaggatatctttgagatgaaggtcaagcaaacattctcaagtaaagccataggttatatgtggtgggtaatgtccagtgattggaaacacatcagaggagctactattttgtctttgtttggaaatctgttttgcagattgaaaaatgacagcatcgtgatacataaattactagagacttacaaggaattaagaaagtaagtagtaagataaatgatcaattggaacccaatttttcttgcatgaagtactcacaaatgagtacttgtgctgataggtgtactgggagttgtgtattcacaatgagaaagcataagtgtctttggatgggccttagctatacatccttgtaagtaatatattacaactgaagaaatccctgaggtacatctggcagggccccagcttcaagttgaacctgaagtagagagtgagcttacaactcttgcgcatgagtgcacacacacactcgcactccaaaaatatatgccaaaaaaagcttcccagaaaaaaataatttaaaaaaatccctgaaagctactggaaagtcatacatatgttaaatttggtcatttagcatcataaattgaagttggaatatcatgaaataggcagatctgatcctcccacattccccagcatttacaggaagtctgagacagcagaggttggatggcgatgatggtgatgatggtgatgagtatgatgaatgtgatgatgaaggtgacagctaacctttattgagttttgctataaactaaatgccactctaaatactttaattcataaaattctcacaacagtttattttacatctgagaacactgagacacaatgcttagattgtctgagtaacacagtaactaaatgcaagattctgttttctacgttgtagtgaaataccatcgatctcagtggaacaagttgcaaagtaatttgtagaaccattaagtcaattagggaatttaaaattctgaactatggtggtagaaaaaaagccacatttcaaatagacatgacttcagagaggcaaagctaaaatttaagccatttacttgccagtttttatttttattttaatatttttaagttttattttaagttcagggaaaatgtgcaggtttgttacataggtaaacttgtgtcatgagagtttgttgtacagattatttcatcacccaaatattaggcctagtacccattagtaatttttcctgatcctcttcttcctcccaccgtccattatctgataggcctcagtgtgtgttcttcccctccatgtgtccatgggtccatatcatttagctcccacttaggagtgagaacatgtggtatttggttttctgttcctgtgttagtttgctaatgataagagcctccagctccatccatgtccctacaaaggatataatcgcgttcttttatggctgcatagtattccatggtgtatatgcaccccattttctttatctagtctatcactgatgggcatttatgtggattccatgtctttgctgttgtgaattgagttgcagtgaacatgagtgaatgtgtctttataatagaataatttatattcctttgggtgtatacccagtaatgggattgctggtcaaatgttatttctgtctttaaagttagaatttcttaactttactatgaaccactcaaaatacttgaatttgcacatgtgcatgcacacacacacacatagttagtgttacttaatctaagcattgtgtcttggtgttctcagatgtaaaataaactgttgtgagaatttaatgaattaattatttagagtggcacttggttcatagcgaaactcaataaaggttagctatcaccttcatcatcacattcatcatattcaccaccatcatcatcaccatcatcgttatcaagttaccaacctcatctgccaatttttaaccccactgccatagatgccactctaaatactttgtaatttttaaattcagtgcttttaacaaatggaaaaaacagccgtgattttcttctaaaagatttttaaacaaaaattatataagtagttataaaaacaggagattgttcataaatcttgatctaggtaaaaacttaaaaagacccagagaaatttcacttttcacctttgttggtcttatttttttaacaactcctgactttgttcattgttcgccgaatccatctcggcttctttgatttcacaccacactggttttgtgcgattgccatttcacatgaacatctggattttttttctcctgtgcttgtgcacatttggagaaagatagtaattttcatccaaatttattctactttactcagccatcagaggaatgttaactgtacatgttcataatgtttttttttaattctaaaaaagatctatgtctgccaggaagagaaatatcctttagtttgtcaactggatccttctagaggagtcaatagtatttttgtttttgatatgatcttccatcaccattcacagacttctagaatcacagcttcatatgctggttaattctaccatatagatacatatatagtaagatggaggcatttctctcgagttcctttaacactctctgtttctttgatattcttcttagtcattgctgcacttctgacaagtctgaatagagagttgtctttttgttaattgttgaatagatgaagagtatagttaagatattatatttcaacatttttaaaagctataatgcggcctgttcctttaggtgtatcactatagaaaaatctctttattcttgttcctttagaaataccttgaacaattagaaaatttcctggattgatgattgcccattttgctacttaaacactaaatttggtcacatgatctgatggaattggaatatggtatcattaaatatctgttgcaactcagaaaccaatttcttctaatgtgctcctccaagggcttcatttacattgcctgattcatccttacatccctatgacataaaagaagggcaggtatcacattatccccattttccaattgaggcatctgcgaccagaaaatggaggcacttgcctatagttacacactatgtcagaggcaggagtaggcaaagatactacttttgttcactgccaatccacccttcttttcattagtcactagcctccttatttcgtaaggtgtaggccattagaagattgatcttgtggggaaaataacatctgttttaaaactcaatgccttttacaagtttatatgccttgatataattttaataggtgcatcattgcctgcttttctttatgagagatgatataaatatgaaaaaatacacttgcagaaatgaaatgaaaataataaataaagccctcttccatttccattattctaagtcatgctccttgagacttcaatctcaatatgatgttaatagaaccattagatatgattcatatcatacataagacattcctattgacaatttcatcttgaccaagggtcaatggatccattacaatgcaaatcttactgtatactttccatctaaatcaaaagaatttggtcttgtgtccattctaatatgtttcatgaagtagaatccaatctcagacatgaagtacacatctgtttctcatactaaatcatgcctgttcctatttgctctcaatttaaaagataattaattacgttttacatcaatagactactttggagtatttaaagaaatgcatagggtttatgggaatccaagtttgcctgtttaatacataccaacctgcaagaaaaattccttcatggatgtgcatctcttaattttggggggtgcatgtaaagctattctacgtatttggtaagatatgcagaatcaggacatgttccaaaagattacctaacccagtcttgtaaagtacaagaacacactgaggtttcaatcagtttttcagataagctgaagaatgtctcactaggcacaggattttttttaaaaaactttcgcttttccccatgctatttatttctactttttttttttttaatcttcatctcttattcctgcactcttgggcatctttcagaatccttctctattcagtgctctaagtagcttataaattgcaatctaaccttgatatggacaatcattgagcccatttctggccacctttaagtttcagggctctcctgatcacctgttatctcttccctttccttgtccgtattattttccttctagaactgtactactgcttctctctatttgtgcaccacaacagaaagacctgctgctgatgagggcttcctgttacagatgaggttaaagtagctgaggaatagctgaacaagaccttacgtaaaggccttttctcccctagggttccatgacattgcatccatactctggtctcaccatgctcctccatcttcctttcttctttcttggaacgttgggtagtgatgaactttggaccaggaagacttctgtataaatccctgatctactaattcttgcggtgtgatcttgggcaaatcctttaatcttgtctaatccttagttttgtcatccataaaataatgataataattatccacattggaagattgttgtgagaaggaaattaagtgatttatgtaagggtcacaatgcctgactcaaagtaggtatttaagcatgttgttgccttgctccctctttactctctctttttttcccatttctctccaaaatattcgattttgtgaaacaaaaaatgttgattttttcaagctttccattatccaattacatagctaccaactgatgagctgttccaatatttatttcttttcaaagcgctttacttcttgtgggttatcgacagctagacatattttttcctctttcagttatgaaagatattctcagactcacaaagctttaaattttattcaagacattgaaacataaaagttcagggattattcaatgatgttaactattgaatgtacacaaaaatgatcttacttgcaatctagtttgtatgctgtttcaaacatgcccaggactcccaagttcaaaggttctctctacacgtaagcggtagtcaaaaatattagttgttttattgcggacagccttaatttatataaatggaaaacatctaaaactgcaaagtacaatagtccagaaagttttcattagcaatccagttcttggacatcacagggaaactcggcagaaagaaatgataagttaattgttgaaatgtttcatattcccaggttcagtttcttacaggtattcgcacctgcctcacctgcacctctgttactctctgtgacatgttccaccaccctggacaagacaaatgtatatttgaaagaataagggtgcttgttagtgggtaggtgtgattatgggaggcaattctagtgaggaaaagatgggttggcgtatggggcagcagtgaagaaaaataaataaaacagtttatttgtagtgggactgatccctcttgctcatgcattagtgcttggctacaggagagtagtaatttattgatgcagatggctatgtaaagtgcatgcaatttgtgagggggcttgacccttgactgatgggccatatgttgtaaagccctaggggcgtcatttgcctccgctctcttcctctctctgtctctgcacctatggtccttattcaatcaccacatattgaactatagacttaccaactcccccaataaatctccaactaatggctcacaaaggccataacttaaccctttctacacaacagagcacattattttgcatcatgatcacactcagtgaaataaaagataaatattatatgacctgcctagaatagaaagcaaattgttgtaaaatgctgttccctgctgggtattcactgcatttggatgtagtagggttgctttgagcttgctgaattctatcgttatattctgccatgttataattacagcttactgttataacataattcttaaacactgttaatacaccacactagagaaacatttaatgttttttaattagcttcttttgtctgagtcttcttttttccctagtaaaatatggaacatatgctcaatgaaaaaatgcatatatttttattctcatgtagaagcaagtttttataaaatatattagggcatttgtatggaataacagaaaaaaagtacagtgtacgttttaaatactcactgtgctctgaattttctataggacccattccagcagaaagacttaatgaaattattcattctccactgaagcactgggatttccttataatgtgggctgtctgagtcctaaatgccacctgaaaaagagtttaggacaccaagactagaaaaaagtcattgctgcttatctattaacttcattttttcccatccaatagtaaaactgaataaatgatactaatcagtaatgtgcacatcagtacaatttctctaatattaggaataccagtcagttgccttatgcttattcccatcacttggataagggagcagaaggtgtcttccttggaatcttgagacaacatcactgcaagcaagaagcagacatctattgctaaactaaagttgaatttttgtatctactccttttccccttttctgggcatggctcttggtagatttagcagcaatttagagagcctgggggagtgtaggaagaccacaggtttcaccagtgcatagcccatctgtagaaatagttgtcagagctgagtatctctagttatattctatgtttgtaataattagcttcccagaaaacaatttgtcttttagatagcttgctagtacagtgttcacagcttgtgtgtgatatgttttatataatatctctgagcatcttaattcagtaggaatataatgtttgatttctaccagatcaggtttcatatcctgtgttggtataaaaaataggtttcataatttttttttcctaatgcataatttccttacactatagtgaaaatccagctttctgaaccaattaaaagaaagatgaaatttcatgtacacatatgctgtgtcaaaatgttcatttatgagtcactagtcttatcaacatggataactgatgtagaaaaaatattcaaatatacagaaaagaagaagtcattgtcttctgtcctaaacccagtagacctaacacatacaatgcaggcagaaaggaaatcagcataaataaaccatgcattcccaattgaatctcaataatttaaacataaatcctttaggctttggtaccttttttccacatgggcttttcttttggatttggcgttcctagcatcatttagaattcatctgcgagccacaagtaaatagagtttccataaaccttgaataaacaatcccctttgaggttatattccataatttaaggaattccaatgaaaacatggttggtaaggagttttccaagatgtgtgtgtatcaatatatttgcctataaaaaggaaccaacatgttaaagcataaattaccaactttcccgcatataccatatgcacaagggagggacatctataatatatgtatttctgagattgacaacaagaaaggatgaattgctaatattctgcttaccatgtattcaaaaagtctccatagttttcagaaaatgtggtgagaaaaacttttctctcttctgatgtattttctctctaattataatttggcatctagaatgtgttgtttcttttaaaaataaactaaactgcatagcaaactatattgattttaaaagccctctaattaaaatagcaacttaacagcaaatgaccatgaagtatttaaaataaaaaatgatgatgtaaattgaatgtgtcaactaaagttggtacaaatgaagattaagagaatagttaccttcatttactctatgtttcatattatgccttatcccagttcttcagttagttaatatagctataatgagttcatactccttagaagcagccaacagagaagcttttctttaagaacattctaaatggttcaaatcaataccatttcctaaataaaaactttcttggctcagatttaaaacacctatggctgttggcttattctttatgctagcccaacaaaatgccacgtaatcttgtaagtaagactctgccacattctgatatcaacattgtcaatgagaaaactctgtgtatatacattcagaaacattcaattataattcgcctcttaaagtcatataactatctggtattacattgagttatcactgaacatattaattaaaatgcctcagtattgaactcagtggttcaaactgtttgtgtaacccaaaaacccttaatcattgacatttgaagattgctgttggtttttttaactaataggacaaaatttatttttagtacaaaaataagatataagaatagttacttaggattgaaatggcatgttaaatactaaaggaaaattggaatttgttttgttttttagaatggtttctggccaggtgcagtagctcacacctgtaatcccagcactttgggaggccaaggtgggcagatcatgagctcaggagttcgagaccagcctggccaacatggtgaaaccccgtctctactaaaaacacaaaaagtagctgtgcatggtggcttgcgcctgtagtcccagctactcgggaggctgaggcagcagaatcacttgaacctggaaggcggagcttgcagtgagccaagtctgtgccattgtgcttcagcctgggcgacagagcaatactctgtctttttaaaaaaaaaaaaaaacggtttctatgtcattgttgaaagtgataataatttttatgtatatgattttatgagaaataatattttaccaatgcacatatagggtacatttttatattttttattcatgaggatttccacattttttgtgcaaacactatatgttatcattattttgtatcttctatgtaatatatacaataaatcaacaaatatttattgaacacctactccgtgctaggtgttagaatgataacattgaataatattatctcctctgccttgaagaactttcagtgtaagctaccataatatttacctgaggatttttcatgtttttctaacagtttataaaattcctatatttggaggctctccagaaacagacggaaagggactagtgaaattatagttgaaaggtacagtgtattttgggggacaaatatttatgttattgtatttgttttctatgatatttttaaaacatggcactattcccctgacagaagtgaatttgccaagcattagcctagggtgtttagaagtaacagctgaaggattaaggaaacatcagcattgagtgggaggaattcagcataaagtgtgattagagcctccacagtctgctattcttagctattcattccctgcaaaatcacatcagtaattttcagtgacatttttaattgtccctgtacaaaagataataaagtagaagaaaataaaatcaaaagtgagaaaattcaagtactactaagatgtaccctggtgtttgttggttgtgggtgccctaaattacgtattaacagagaactgccttgtagtaaaatttgatgcccccatgggccctgactttacctttatcatgtagtttcatcatttcaaggatctttccttatggttaaccccttttcatcttctgaacaggttcttacagccagagggttcgcgtgctatttttagcgtgcttctttgagtggtggatagtggttgggaatttctttgcctgctgcatgaatacacttccctgcagagtgtacaaagaagcacttaatttcgagcttttcattttggttagtgacactgcaaacatagcacaggtggctataattttacaccatgtgagtaaaaatactatttttctttccccgtcaaccttcttgtctgatcgtcttaaacccataagatggggaattacagaaactgatattttaaattgatgaactagtttaagatactctttgaaaaggaatccaaacttgctatgtaatctgtattagtctgttctcacactgctataaagaaatacctgagattgggtaattcataaagaaaagaggtttaactgtctcacagttccacaagctgtagaggcagcatggctgaggaggcctcaggaaacttacagtcgtggcagaaggtgaaggggaagcagacatgtcttacatggcaggagcaggaggaagagaagggcgggggggaggtgtcacacccttttaaccaaccagatttcatgaggactcactatcacaagaacagcaagggggaaatacgcccccatgttgcaatcacctcccaccaggccccacctcaaacacaaacactggggattacaatttatcatgagatttgagtgggaacacaaatccaaaccatatcataagcaaaatgtaaaattgttaaggatggggaaagatttataaatgtagggttcaagttagtgtaaaagcgatagcattgtccaccagtgactgttactgggcctgtatctttatcatagtggatcatagttccattattgtaattatgccatagttttgtaaaaacctttatctgttatttgagatataaaatgttgctatctggcaatttttaggttgtagtctcatcttttaggttagaaagtatccttattttataaaaaatctctctctatatatatttagattaatcttctattaaggactagatattcatgttcaaacattaggttttcctgataatccactttttagataatctcagtttttattttagatttaggggcacacattacaggtttgttacaggggtttactgcatgacaatgaagtttgggtatgaatgatcccattactcaggtagtgagcatagtacccaatacgtagtttttcagaccgtttcccttcctttttcccccgtctagtagcccccactgtccattgttcttatttttgtttccatgtgtgcacaatatttactttccacgtataagaaaatgtggcacatatacactatgggatatgtgcagctgtagaaaaagaacaaaatgcatatatgcagcaacatagatgtgctgcaggccattaccctaagcaaattgaggcaggaacagaaaactaaatgccacatgttctcacttagaaggtatctttgaatggcgttgtcagacaaactcaagcatggatccttgctgaagtaccagaatcttgactggttatggttcaaaaacaactgaatagtattcacggatctgagtcttagatacaaaaaatgaaagtaatctagccgttttatttagctggtactgaagtgtagatgatgtattgcataaaattatagcaagtcatacaatttcccttggctagttggtcattccctttctctttatggtttctattcttgtacagatttctaactagtgatacagaacaataacttggatgacttaaaaacattatgctaaataaaagaagacagactcaaatgactatatgcttaatggtttgcttcatataaactttttgaagaggtaaaactggattgttggaaagttgatcagtgctttgcaggggccagggttggggagggaattaactgcaaagaccagagggaactttttggtgtggtgacgatggtctgcatcaccatcgtgtcatgaatgtcaagactcatccaatcttttctaaactttattaattttttgcctgaaaattatatccaacaaaagatgttagaattccactttggtgtgaatctaacctagacaagttgatactttttcctgtttttttttcccataagttaaagctatactgagtttattaatgaagttattaataaaattatttataaccctaatatattcctggttctagctgactttacctgtagttactaggtatttgaatagagtcaattgaagtataaattttaaaccaaaactaaacacttttttcccaagaaacattcgtcacacaggtgcatataaaatacatgcttacatctgaatttgcatataaagtgttgtaggaaaattagaaagcatatggtcttttcttctttttcattgtctaagaagcactaaagccaaataacttggcatgattcttccagttttactctttttaaatagctttattgtcaggcagatggggagtgctagccacttattaaaattacacttgtacatatcgtaagaatgttttatatttattcatgaatataaaatttttagaattggcatttaaaaccaaaaaaaacctgtcatagagttgagtaacaactttatttgtcactttgaaaccactttgaaatatcttgcagcatggacggttgcctaattaatattccaagattcaggttctctttaatgatgtttttaaaagctctccatcttaggaagccaaagataatcatagagtagagattgaattacatggaaagaatgaactttaagatgtggcatctcttccaagttgtattaggaaaatatatatgggaaaacattatcgtatactttgtaataggtactttcccgccctctgtgaagagtttaaaaatcagtacttacactggatagttttcaagcatcattttgtgagtgaataatctgagccaaagagatgtaacatagtccatgaacaccagacagttaaaagattcttctactttagaggttttttaaagactgatttaaaattaaaaaacagatatctatttattcatcacaattttgtgctacaaatttgaagaagtagaggataacattcttttgggtacttaatgaatatttttcaaataaatatctgaattactaatacatctcttagattcatattgcagctagagaaataactgcatcatttgctgaagaacatttgaaaatgtagaatttcttatttgacacatgaaaatatattacataatttaatatatcaatgaagacaggtaaatacatagataactacatatatagatacaaaccagaatatgcaggtaattgactttgaaaatttgtcctgaagacaaaacttttagacagttttgaggagatactatgtgataaggcaaattttataaaactgaagtcaaaactaaaccttctgtcattcaaaactatcatatgtcaaaacgtttttaggtagaactttaatagaactttagcatcttataatgtcatatccctgataaacttgagtgtatgcagagaatctgccaaaatttaatgagcacatgtctgaacaaccattactttgtggctaaagatatttctttccaatttctctccccagtatggttactctgcctctttaatttatccttttaatatgtgcagcaagtgaagaaatagaaagcttgggggaaaatgaactgctataaaaatgcaagtatctccagggtttttctacattctcttttctttatccctctttatttctgttttatcaaataaaatctttttctcctcatagttgcagtatccaaattgtgttttttaacacgtgtatcaaatggataaagtttaatagtataaattgccaaacaaaattggcataagagtttctccaggaccacagtttggtgtacaatatgataccaaatatatcctaaaaattattttctcttaatttagttatagatgaaatgccaggtgttgtattgcaagggtgattaaaatcaacttagctccttggaatctttacctttgtctacataaagctgttaaaggaaactggaacccgctttttctcagtgatgacatccaattgttttcccttatatatagggctatgaaagtatgctatgagtttagcaaacctatctttgcaatgtgtatgtgttatgtagcttggatttgtttcaaaatctgtagagaggctgcaaaatttgtaaccaccttatagaaaagtcaggtgtactcccttccactgcccttcacattttcattgtatccatgctttcctttgcatgttcctctaagataagagttaataagttgtaaaaacaaacaaacaaaaaaaaaaaacaaaagaaaaaatgtctctgataccttagcatagtgtttctgaaccactttccattactgccccttaaaggagtcttttcaacaatttttcctaattgctattcccttgaaatgttactactacagataaactgtacatctgtttatatactgtatttgtgttttaatacataaaatacttgatttttggctcactcccctgaatctatttttgcccccttaaggttagcattgcctcccttgagaatgcaggctgtggcagtattagattgtccactctagtcaggtaggacacattgtcatgtgctgttctgtatgttccctcttttgacttccccttagaaatgctttaataattacattattcaaaggcatagccagccatggtggcactcacctttggttccagctactcgggaggcttaggcagggggatcacttgggctcaggagttcaagaccagcctgggcaactggagtctgttctcacgtggctaataaaaacatacccaagattgggtaatgtataaaggaaagaggtttaatggacccacagttccacatggctggggagacctcacaatcatggcagaagtcgaatgaggagcaaagtcacatattacatggtggcaggcaagagatcttgtgcaggggaacttgtatttataaaaccatcagatctcataagacgcatttactaccaccagaatagtatggggaaaactgccctcgtgattgaattatcttcacctggccctgcccttgactcatggggattattgcaattcaaggtgagatatgggtgcggacacagtcaaaccatatcagcaacatagtgaaaaccttgtattttaaaaagaaaaagagagagagagagaaataaaaatgcacccttccttccttcctttcttccttctttccttctttccttctttctttctttctttctttctttctttctttctttctttctttctttctttcttctttctttctttcttgtctttctttctttctttctttcttgtctttctgtctttcttttagagttcattgcattttttgtcttcaactattattttaagttcaggtgtacatgtgcaggatgtgcaggtttgttccataggtaaatgtgtgccatggtggtttgctgcacagatccacccatcacctaggtattaagcccagcagtcattagctattcttccagatgatgtcactcccaccaccctcccaactacaggccccagtgtgtgttgtttccccactatgtgtccatgtgttctcatcgttcatctctcacttataagtgagaacgtgtagtgtttggttttctgttcctgtgttagtttgctgaggataacaacttccagctccatttatgtccctgcaaaggacatgatcttgttcctttttatggctgcatagtattccatggtgtatatgtaccacattttctttatccggtctgtcactgtggacatttgggttgattccatgtctctgctgttgtgaatagtgctgcaatgagcatacatgtacatatatctttttgctagaatgatttatattcctttgggtatatacccagtaatgggattgccgggtcaaacaggattgtctttctggttctagatccctgaggaattgccacaccatcttccacaatgctggaaataatttacgttaccaccaacagtgtaaaaacatttctttttctctgcaaactcaccagcatctgttgtttcttaactttttaataatcaccattctgactggcatgagatagtatctcattgtggttttgatttgcaaggaaatgcagttttctttgtctatttcagaaagagcacaggggatgggaaaagatgagaataagctagccccctcctctctaaagagagaatttatattttggttcttatagatgacattcttagaattaatatatattccatgaatgagaagccatgtaaatctacttaaacagccatgctaaaggattaaggttgtttgccattatcatctccagtagctcccatagacttccactatgttaatgacaaataatatgtgtatcctccattcaatctctactctggccttcctgataacactgtaactcatatctttccaaaccctataaatagatgcatatttaggggttatgtcctggactgaggtacagtgttgctagaaaataaatataacacaaaacacataaaccaattttatgaattaggctaatttatgcaagatgatgatatgtgaatgatgagaaattatgaattattattacatatattaaatgcttattagaatccaggtacagtgttaaaaactttccatagattttctaatttttatcctcacaataaacctatagatacttttgttatttttactttatagataagaaaaataatatccaaagtgcattttaaatactggtttaaatagctaattttattgatggttataatgcgagaagagattataaaaatcagagttgactaatttttgcttcacttttttatggtggctttctgtcttgccagttgtggagatagtagcaataagtacaaaaataaaatagccaccaggaggaaaaaagacaaacaaaaatatgacttaaattcaaactcagactctaaaattggctgttttgaaactaacaattgttctaatcgtaatcatggtaacagctggcattagttaaccgcttactaaatcatcatcaccttcacagcagcattttcattttactgaagaggagacaaagggttagagatgctaatcatattccttagattctagacctcgatattttattagtgatggtctggattatttgttgttgtgagatgtgttaagggtaattaaatagccttctaagaaaactgaaaacgtctctttttttcacgtaaacaattatcacaatataaaatgagtagaatgtgccatttttttaaacgcctaaatttttagaatcgtatatattttctgaatataattgcccatgaccataaatttttttaactcttttgagtttaatacagtgtaccttttcttttgaaaattttcagtaacttaatgacggcattgcttatacgggaaacattatgcaaatgactcacaatgaagtctgtgagtttagttaagcttgagaaaaagtttgtaattaacaaattagcatttgaaaaagacatttgaatatgcatagtagaaaattccacttaacttgtggggtgtgttcataatgattatttcagaattcatgcatatgcatcttttaacatgcaaatattttaaaccttagtggactagtccagatctggctcatttctgttgtggttgttgttttagttaaatgttgaaaattgtaaataaggcatcatgaatacacatactaacatgtggagtcctctttacttctctttgatatagtctttttaattattaaagacacaatattaaatactttctatttattattacttcactgtggataaaaataacattaagaaaaaaaaatcttggtatctgacttttcctaccaaagtgtataatgtgtactagaatgctatagtcaggacttcatttacctttatgttcaattgtgctgttagaaattagagtttgatgtctcacatacacacacagacattacattattcataaaaagtggcaagaataccttgtgattacttttaaacctctcttatataatatattggcttcattgtaaagtatattttcttaacaattttttaggtaggtcataaccctcctctgtttaaaaaactctaccagttcttgattaattatcagatatgatctcagacctttagttcagcattgaggactgttctccaatacaaagcacctctctcacctacatctcttcacatgttccattctaatctggcctcgattctaattcttatgctttctataaatgcatgatcgctaacccatctaaatgtttagacaaaccgcttttctgccgttataccttactcaccttacttaggctacatgatattttcccttgatgaattcctacagtatttatagttcaactattatgttccctgcaaaatggttatgtggaaagttatagctaatttaaatctagggttgataaatatgtgaattctttgcctttctagatagagaaattatgtcttgttttggtttggccaacctcctaaaatccaataggcaactgaggacagaagattgggcttgacttggcttacacagaggatgggcatctgtttctaatgaactcgtaatttatgccccatcttgtagccaaaaggaattaatagacctacagacataaaaaatgaataaactattttttccacactagtttgtccataacacgacactagaaaataaggtcattacatggtctcatgaaacccctgccaatcctatgacttgatgtattttaggttctttcactttgctttatgtatttgttgtgactctttgacaatatctgatgtttaactttgccttcagaaatttgccatggttcaacttcctttcagtgctcctgccttccttttcagtttattgatagtttcccttgccctagacactcatgtggacactgattacacaaaaccaatcaaaatcgacattggaaaagcaaaataattaagaattaaaatcagccagttcctgacactagctccaaggactagacaggtgacacctgaacagagtggaaaatagttgttgggaagtattccaggcacaaggaacagaatatgcaagggcattcaataatcaatgtctctgaggacatcaagtggaatataaaactagctgtattatcagatatcagaaaggccttatgagccacgcttacactttgcaacatactagaaaaaaagtcattcaaaggttgtataatcaatcctagctgaagatgcttgcaattgttcattttcctataaacatgtatggacagtggataaatcccaaatttttactctgaagcttgtgttgtccagattagatttgctgtttaccttagttttatttcctgaccaattttcaatccttctttcgttacctcccagacacttgctttttaaaaaactatatttttacaaaaacaaaaggacaaaaggtttttctagacagtgttagtgcattcaatacagaaagtttccagttagacaagaattttactgtctctatatgaagacttcactttgcactaaatataagaaaaaatataaggaagaagaaatgtaagaaaaaaaaaaaccaccagaaatagtcttagaaatgcgtatgtttgtacattcatccctcagtatctgtgaggaatttgttccaggacctcccatggatgctcaagtctctgatataaaataacatattatttgcctatcacctatgtgcatccttctatatactttaaatcagatgtccccaacattttaggcaccagggactggttgtgtggaagatgatatttccatggatggtgcaggggaaggaaggatggtttcaggatgaaactgtttcacctcggtcatcaggtgttcaagcagtagattctcataaggagcaggcaacctagattcctcacatacgcagttcacaatagggtaagcacttctatgagaatctaatgccgctgctgatctgacaggaggcggagctcaggcggtaatgctcgctccctcctgctgtgcagcccgtttcctaccaggccacagaccagtatgagtccctggccccggggctgtggacccctgcttgaaatcatctctggattacttttaatatttactacaatgtaaatgctatgtaaatagttaatactgtattgcttagggaatcatgacaaggaaaaaatgtctctacatgttcagtgcagacataatcaaccatttttttctaaatacttttgatgcagtttgcagatatggagggttaatttaattttgcaagctcttataatcaactattgggattcatcattattttcagggtttttctcctccttttatgactgaatttatttttttaaataactgaattactgcataaaatataattattttcataacttataaggatgtatagactgtaattaggctgttgtatggtagctgacaggtactgctgatgaaattttactaagtgaccagaataataaaatttattacacaggttacttcctttagaggttctactttttggtcttcaatatctaacatgctttctttattattaatataaatataaaatagatcttaatggtagggacagatttctctctgtaaatagaagtacaaattttgtatgaaaagttgaagagaaataaatataatattcccaaatctatccacaaccattcatacttgataaaatgtaagtttactgtaaaatgaatgaattattgatgtacttagcaaaacattatatctgcacaaagtcataaattaaacaaactctaatacattttatgataagcataatttgacctgagtccttgttagcctcaaagcataatataatgatcagaaaaattgggggtctaatcaattaatttgaaaatctgcaatgagattattatttatctagagtgaacgctttactagcatacaaataaagtttttataaatgaaatagaataaatatctaattattggaacttttccattaaataactgatggcataaagaggcttctgcttttaaaaaaaaaaaaaatatttgctgatataaacctgagaatttaaatgtcaattatggcaaaaatattttctgtacaactttgttgttttttaaaacattattaatgtaacagctactacatcttattattttcatccattctgcaaatctggtgaatctatttagtctacatctagaacaactagaaaaatatgtataatatatgtatctaaaagggaaatgaagatgcatgaaaatatctaattgtgtaaatactgttaagctagagaattaaagatgataaccccttttcaccattcagccaagcgtgaaggagcaaaagagattcaaaacttcattaattgctctcacacaacgttacaggccacctgcacttcaaagaatttacattggagcagatggattgctgaatgcgatatcaaagaatttcagaatgtttgttttaaaaataacctggattctaaggcaagcaccagcaaagcatacaatttacaaagatgacaaagcttttcttattaaaacttctaaaacgtataagtgaaggcacatttttatctctaaaataagagtatacataccaactactctttaaaatgatcaaagttacatatttaaatatataaatgaaatatattcatgcattatttgaggcttttgaacatacctaactggtttcctttagtaactcctagatcagtgaaatctagctttttcccagtataagttttcacatctctctgattattcaatcttttgaataaagatggtccatatggaaaatgagatttttaaaaaagtttaagagtaactttttttgcagaaactcctttcacttgtcatttgattctgacttgagctcggtactttgattgataggtcctactcgcaatgcactgacagaatccacattggaatagctagttaagatgaatcagagctaatctaaatgcatcttggatcagattatgctttacttttggaacatattgtaatttttgtattttacagaagtttctatagctttacccacaaattaagttttacttggaatttgcatcacaatattttcattctttaaatattgatgtatcaggggtcagaaaacaacaacagctagagggctgaatctgaccttgtacctgtttttgggaaataagattttattttagcacagtcatacccattcaattacttattgtctgtggctgcttttgtgctacaacaatagagctgagtagtcacaatagacagtatggcttaccaagccctaagtgagatatttactatttgcctcttcacaggagaaatttactaaccctgatgtgctagcacatgttataaccttgggtaagttttcttaagctctctgagcattaggttcctcatctgtaatataaagacaccgatggtgtctacccagatgtccctgcgtgtggtaataataatggtacctagccgtgatgattaaatgggataatataagctgttaggaaaaggcctcgttcacaataggtctgatacaaatgtcacccaacatcaacatcactgtcattttctcaggaataatgctaggtcatggagactgagaagagggtttcaaactacattactgtagtctgttcatcttcactagtcaaacaataaagtgggtagcatggttttgtattatgatcatagaatttgaaggtggaagccctgggtatgatgacaatttgccttcttctttgctgtttaataagacctgcagtgagtaatgtaaacactctaatcctctctttcttacctgtaaaattataataatattattaataataatatcatcccccaataggctgtatattgtaaagggccaattaaattagaaatatgaagtagggtaacttgtaaggttgcaatacaaatcaaaggtttcactgcctcattaaccgtacctcacttccatgctttgaactttggggtaatgaatatgtgtaattatttagctaagagggctcaagattaacgcttttgtgtcgagtgttgccacacacatcaacatggatgatcttacaggctaatgagggaaagaagccagaagccgaaggccacagacagtattatcccctttatataaagttctacacctagaaaattaatctttggtgatagaaaagagaatcagttacctttcagggtgtgtggaaggggcatagggtattaatggtagagattgtaggaggcaggtgatgttaccggtcttcttgtgggtataggttacagggctatgttcactttctacgacttcattggccagaacacttatgatttgtacatttcactgtaggtgtaaaatgcttacaagaagaacgaaatattaaaacaaaaaaagagaaaatgaaagaaaacaacaaaagtgttaagtccatccactgatcctgctttcagagccataaaaaaaccgtctgctatacaatctatttacctcgtcctctcacttacaccaatctttctttccacagcaccataaaatctacctacatacatgtaagaaaatgggactctcctttagccagccttgtctcctataccaccttgaatacgtgatgtttgacagaaatgacgttttatttttctctttatataaatcctatgatctccacttttacccaaagccttttttaaactaaagcattatgaccttaatgagactcatagatcacgttcactctctatcttacatgtatcattgcgctattctccaaagttctgtttgaattttattttatatcactccttttcctaaactatgcacatgctcatgaagacaaggcaaaacaaaaagaaaaaataaacaaatgaacaaacaaaaaatccacaggtcttaatagagagataggtttgagtagcaagaaaatatagtttagaaaataaatgttatttatttttgaaaagataatgccctatataataccaaatgccctatataaataccaatgccctatataaaaccaaaaagtataaaagctatgaagagaaaatcaagtctctattttaccctaacctttaggaaacccattcccttctcagaggtaacacatgttgctgttattttgtgcaaactttcattatatctgtgaataatctgcgcatatgcatatagcagtgtgttttacaaaaatggaagcttgttgtagacattaccttatactctatttccataagtgaatcatgtatcttgaacatcttccatgttaataaatattgagtttaaaatacccccaaaagtaatggaagcctagaaacacaaaattatggagctttttttttttttttttttgagcttgagtctcgctctatcaccaggctggagtatattggcgtgatctctgctcactgcaacctccacctcccaagttcgaacgattcttttgcctcagccttccgagtagctgggactacaggcacatgccaccatgcccagctaatttttgtatttttagtaggatggggtttcaccatgttggccaggctggtctcgaattcctgacctcaagtgatccgaccgccttggcctcccaaactgctgggattacaggcgtgagtcactgcaccaggcctatggagcagttttttaaaagaactttgcaaatattataaaattgccttctttacatcatccatgtagaatattccttataaccacttttgtcagtctgagagcgctttttgttttatctatgtctgttaaaccatatgctgaaactgttttctgctttcttcatgaggctttcccttatccttcacagaactatattgaataaatatttagtctattactcttgaagtctacactgaaaaatacttgaaacattactacttttccttatttgtttgtggcattctggccacgagtttgtataaattatgtttcagaactttgggctttgccagatgttgagtaatacgctgctaagatgtaagtacaaatggtttcactcctgactcctttgtacaagtgaaagacaacttggaattctaaacagattagaaatggaggttgccattcgtttgagctctcttagaaaagaaggctctctttgacaaatccctctgcttattagacaaagtgcaaaaagcattacatctggagttcataagccattgttttatggaattgatccatcatacaatcccttacgctcttgaaataaacccatgagaatttaagatgctatatgcacacttactaacacattcactcatacatacacacccctctatgcacacatgctaccattagagacttgtgcccttgcaaaaaaatcttatagcgtagaattgcaacatgctttttaaattgatagttatttttttttaacatcgtttatctttcaaaagacttctgaattcagctacaggaattattcttattcctcgaaacttataaccccctattctttgtactcaaaatgttttgtaatacaacattttttttccattaaaaagagcaaaagtaaagctacaattatttttgaaacacaccatccccagatacttctgaatttattttccttcctcaaatcttgaagcacgtattatttctttcacatctttagaccgttaaaactcaattgttcattctgtgagaagaaaacttaaggaaacattcagcaagtagctttatatgtgggagatggatttttagaggattttaggtgtttgagaagagtttctcatagattctgttgctttcagaattcctcaggatgccattctaaaggatgactgcaattcagatcagcgaagtgctttgatgtcttattttttcttttgcagattgtactccacatgttcagaaagcctttccctagagtataatttaatgtaattgacagtcattgttcctcgaaagtttgaattaaattaacctgagcctgaatgaaactggtaaaataaccacgtacagatttcattttattttcctttaggatcagtgacaatattatgtataaaattggcagttggctattagatcttcattgaatcaccctagatttgattaaaagtagatatttcagtgtacagtaatttaggttcatgaaaaactcttaggtttctcatttagttattgggtttattgaggaacagggtattttatgtgtgtaatgatgaattttgttctttctctttttccactgagatcaaatacagactgcaaaattgaccgagcatgaaattgtttttagaaattgtgggagctagtttcgatggcaagaatcagaggaaccgttgttagtgaaaatgtgtttggaaaggatgatggtagtgggtaggagagaatagaggtagagaggtgttaacataaggcaaaaacattaaactgacaaacacttctctgtagagtagttgatgtgttaagccagcacacttaaaagcatacaagtttttggatagaaaagtcttcattgttctgactgtttttctggacatgtagctggaaaggagactcaaatcttcatatggattttgtgtcttatggtcactgacactgcaaagcaattagccttcatgatggctgtgcttatgcaatactaattaacatgcctgttgtgctgttttccctgtttgaccatgtgacagcccacaggtctgacactctctgtgaaccaacagctgaggaaatttccaacatggcagattttttttacaaaacacacccaaacaaaaatggaatcacacttttcctgaacaactgcattaacagaatgtgttacaacggatctacaattagaggattgcattcatatgtactggggaaaaaaaaggagacgagaccctactcaagcatacggatacaaattgattatacctgggtccagaatttcaaagtgtgataacactgtattatagtatcatggagaatataatttaccagtacaatcacatctagtaaaattatcattgaaagttagaagtaaagttgtcaatatatttacggcaccatgtgagacctctatattgaagggctaatttagtaaatttgtatgtgttatgactttaagagtttgggcattggtgagttttgtttctgtgtgtttgttcctgttgtgagtgggactggaatactatgattaacaaaatcatatacaggcacttgatatgtggattgtacagtctagtgggtgaagttggttgaagtttatttataggctctacaaataaatataaaattagcactgatgtgaggggaggtgcttgatactctgagattgttaatagcagtttttagccagattgtaaattgaggtaagttcctttggaagtgacaattgagaaagacataaagtaaaattgacggttaaatgggtaagctgaggctagagcaccaaagacataaagtaaaattgacggttaaacgggtaagctgagactagatcaccccagacataaagtaaaattgacgtttaaacggggacactgaggctagatcaccccagaaattaagtaaaattgatggttaaatgggaagttgaggctagagcactaaagatataaagtaaaattgacggttcaatgggtaagctgaggctagatcaccccagacataaagtaaaattgacagttaaacgggtaagctgaggctagatcaccaaagacataaagtaaaattgacggttaaacgggtaagctgaggctagatcaccaaagacataaagtaaaattaatggttaaatgggaagttgaggctagaacactaaagacataaagtaaaattgacggttaaacgggtaagctgaggctagatcactgaagacataaagtaaaattgatggttaaatgggtaagctgaggctagatcaccaaagacataaagtaaaattgacagttaaacaggtaagctgaggctaggtcaccaaagacataaagtaaaattaatggtaaaacgggaagttgagcctagatccctaaagacataaagtaaaattgatggttaaacgggtaagctgaggctagatcaccccagacattaagtaaaattgatggttaaacgggtaaactgaggctagatccctaaagacataaagtaaaattgacgattaaatgggtaagctgaggctagatcaccaaagacataaagtaaaattgacggttaaacggataagctgaggctagatcaccaaagacataaagtaaaattgatggttaaacgggtaagctgaggctagatcacccaagacacaaagtaaaattgatggttaaacgggtaatctgaggctagatcaccccagacataaagtaaaattgatggttaaacgggaagttgaggctagaacagtaaagacataaagtaaaattgatggttaaatgggtaagctgaggctagatcaccccagacataaagtaaaattgatggttaaacgggtaagctgaggctagatcactaaagacataaagtaaaattgacggttaaacgggtaagctgaggctagatcaccccagacataaagtagaattgatgtttaaatgggtaagctgaggctagagcactaaagacataaagtaaaattgacggttaaacgggtaatctgaggctagatcaccccagacatgaagtaaaattgatggttaaacgagtaagctgaggctagatcaccccagacgtaaagtaaaattgacgggtaaacgggtaagctgaggctagatcacccaagacacaaagtaaaattgatggttaaacgggtaatctgaggctagatcaccccagacataaagtaaaattgatggttaaacgggaagttgaggctagaacagtaaagacataaagtaaaattgatggttaaatgggtaagctgaggctagatcaccccagacataaagtaaaattgatggttaaacgggtaagctgaggctagatcactaaagacataaagtaaaattgacggttaaacgggtaagctgaggctagatcaccccagacataaagtagaattgatgtttaaatgggtaagctgaggctagagcactaaagacataaagtaaaattgacggttaaacgggtaagctgaggctagatcaccccagacatgaagtaaaattgatggttaaacgagtaagctgaggctagatcaccccagacgtaaagtaaaattgacgggtaaacgggtaagctgaggctagatcaccccagacataaagtaaaactgatggttaaacgggaagttgaggctagaacagtaaagacataaagtaaaattgatggttaaatgggtaagctgaggctagagcactaaagacataaagtaaaattgacggttaaacgggtaagctgaggctagatcaccccagacataaagcaaaattgacggttaaccgggaaggctgaggctagatcaccccagacgtaaagtaaaattgacggttaaatgggtaagctgaggctacatcaccccagacataaagtaaaattgatagttaaacgggtaagctgaggctagatcaccccagacatgaagtaaaattgatggttaaacgggtaggctgaggctagatcaccccagacataaagtaaaattgatggttaaaagggtaggctgaggctagatcaccccagacataaagtaaaattgatggttaaacgggaaggtgaggctagagcagtaaagacataaagtaaaattgacggttaaatgggtaagctgaggctagatcaccccagacataaagtaaaattgatggttaaatgggtaagctgaggctagatcactaaagacataaagtaaaattgacagttaaacgggtaagctgaggctagatcacccagacataaagtaaaattgaagattaaacgggaagttgaggctagaacagtaaaggcataaagtaaaattgatggttaaacgggtaagctgaggctagatcaccccagacataaagtaaaattgatggataaacgggtaagctgaggctagatcaccccagacgtgaagtaaaattgacggctaaaagtgtaagctgagactagatcaccccagacataaagtaaaattgatggttaaacgggtaagctgaggctagatcaccccagaaataaagtaaaattgacggcttaacgggtaagctgagactagttcaccccagacataaagtaaaattgacggttaaacgggtaagctgaggctagatcaccccagacataaagtaaaattgatggttaaacgggtaagctgaggctagatcacgccagacataaagtaaaattgatggttaaacgggtaagctgaggctagatcaccccagatgtaaagcaaaattgacggccaaacgggtaagctgaggctagatcacccagacataaagtaaaattgatggttaaataggaagttgaggctggaacagtaaagacataaagtaaaattgacggttaaatgggtaagctgaggctagatcaccaaagacataaagtaaaattgacggttaaacggataagctgaggctagatcaccaaagacataaagaaaaattgatgcttaaacgggtaaactgaggctagagcactaaagacataaagtaaaattgatggttaaatgggtaagctgaggctagatcacccaagacataaagtaaaattgatggttaaatgggtaagctgaggccagatcaccccagacataaagtaaaattgatggttaaacaggaagttgaggctagaacagtaaagacataaagtaaaattgacggttaaacgggtaagctgaggctagatcaccccagacataaagtaaaattgatggttaaacgggaagttgaggctagagcactaaagacataaagtaaatttgacggttaaacaggtaagctgaggctagatcaccccagatataaagtaaaactgacggttaaacgggtaagctgaggctagatcactaaagacataaagtaaaattgacgattaaacggtaagctgaggctagatcaccaaagacataaagtaaaattgacgattaaacggtaagctgaggctagatcaccaaagacattaagtaaaattgacggttaaacgggtaagctgaggctagatcaccaaagacataaagtaaaattgatggttaaatgggtaagctgaggctagagcactaaagacataaagtaaaattggcggttaaacgggtaagctgaggctagatcaccccagacataaagtaaaattgatggttaaatgggaagttgaggctagaacagtaaagacataaagtaaaattgacggttaaacgggtaagctgaggctagatcaccccagacataaagtaaaattgacggttatacaggtaagctgaggctagatcaccaaagacataaagtaaaattgatggttaaacgggaagttgaggctagaacagtaaagacataaagtaaaattgacgattaaacgggtaagctgaggctagatcaccccagacataaagtaaaattgatggttaaacgggtaagctgaggctagatcactaaagacataaagtaaaattgacggttaaatgggtaagctgaggctagatcaccccagacataaagtagaattgatgtttaaatgggtaagctgaggctagagcactaaagacataaagtaaaattgacgggtaaacgggtaagctgaggctagatcaccccagacacaaagtaaaattgacggttaaacgggtaagctgaggctagatcacccagacataaagtaaaattgatggttaaatgggaagttgaggctagaacagtaaagacataaagtaaaattgatggttaaacgggtaagctgaggctagatcaccccagacataaagtaaaattgatggttaaacgggaagttgaggctagaacagtaaagacataaagtagaattgatggttaaacgggtaggctgaggctagatcaccccagatgtaaagtaaaattgacggctaaacgagtaagctgcagctagatcaccccagacataaagtaaaattgatggttaaacgggtaagctgaggctagatcaccccagacataaagtaaaattgacggttaaacgggtacactgaggctagatcacccagacataaagtaaaattgaagattaaatgggaagttgaggctagaacagtaaagacataaagtaaaattgatggttaaacgggtaagctgaggctagatcaccccagacataaagtaaaattgatggttaaacgggtaagctgaggctagatcaccccagatgtgaagtaaaattgacggctaaaagggtaagctgagactagatcaccccggacataaagtaaaattgatggttaaacgggaagttgaggctagagcactaaagacataaagtaaaattgacggttaaacgggtaagctgaggctagatcaccaaagacataaagtaaaattgatggttaaacgggtaagctgaggctaggtcaccaaagacataaagtaaaattaatggtaaaacgggaagttgagcctagatccctaaagacataaagtaaaattgacgggtaaacgggtaagctgaggctagatcaccccagacattaagtaaaattgatggttaaacgggtaaactgaggctagatccctaaagacataaagtaaaattgacggttaaacaggtaagctgaggctagatcatcaaagacataaagtaaaattgacggttaaacgggtaagctgaggctagatcaccccagacataaagtaaaattgatggttaaacgggtaagctgaggctagatcaccaaagacatgaagtaaaattgatggttaaacgggtaagctgaggctagatcaccccagacacaaagtaaaattgacggttaaacgggtaagctgaggctagatcaccccagacataaagtaaaattaatggttaaacgggaagttgaggctagaacagtaaagacataaagtaaaattgacagttaaacaggtaagctgaggctagatcaccccagacataaagtaaaattgatggttaaacgagtaagctgaggctagatcaccaaagacataaagtaaaattgacggttaaacggataagctgaggctagatcaccaaagacttaaagaaaaattgatgcttaaacgggtaaactgaggctagagcactaaagacataaagtaaatttgacggttaaaaaggtaagctgaggctaggtcaccccagatataaagtaaaattgacggttaaacgggtaagctgaggctagatcactaaagacataaagtaaaattgacgattaaacggtaagctgaggctagatcaccaaagacataaagtaaaattgacgattaaacggtaagctgaggctagatcaccaaagacattaagtaaaattgacggctaaacgggtaagctgaggctagatcaccaaagacataaagtaaaattgatggttaaatgggtaagctgaggctagagcactaaagacataaagtaaaattgatggttaaatgggaagttgaggctagaacagtaaagacataaagtaaaattgacggttaaatgggtaagctgaggctagatcaccccagacataaagtaaattgacggttaaatgggtaagctgaggctagatcaccaaagtcataaagtaaaattgactgttaaacgggtaagctgaggctagatcaccccacacataaagtaaaattgacggttaaacgggtaagctgaggctagatcaccccagacataaagtaaaattgatggttaaacgggaagttgaggctagatcactaaagacataaagtgaaattgacggttaaacgggtaagctgaggctagatcaccccagacataaagtaaaattgatgtttaaatgggtaagctgaggctagagcactaaagacataaagtaaaattgacgggtaaacgggtaagctgaggctagatcaccccagacacaaagtaaaattgacggttaaacgggtaagctgaggctagatcacccaggcataaagtaaaattgatggttaaacgggtaagctgaggctagatcactccaggcataaagtaaaattgatggttaaacgggaagttgaggctagaacagtaaagacataaagtagaattgatggttaaacgggtaagctgaggctagatcaccccagatatgaagtaaaattgatggttaaacgggtaggctgagtctagatcaccccagatgtaaagtaaaattgacggctaaacgagtaagctgaggctagatcaccccagacataaagtaaaattgatggttaaacgggaagttgaggctagaacagtaaagacataaagtagaattgatggttaaacgggtaagctgaggctagatcaccccagacataaagtaaaattgatggttaaacgggcaagctgaggctagatcaccccagacataaagtaaaattgacggttaaacgggtacactgaggctagatcaccaaagacataaagtaaaattgacggctaaaccgtcaaactgaggctagggcacgaagtcacacactgctgcacattggacttgcctcagatgttggttttttgtttgtcttgttttcttttgttttgcttctgttctctttttttcctaaattactgatacccgagtcccatgtctagagtctaatttaattgttcagtgtattccctggacattgagacctttagagtatccccaggtgattgtgatgcatagcaatgtttgagaacaattgctcagaatattctaggccgatggaaaaggccttgtggtaagatgaatcatggcaaaatcttaagaaggctgaaaggttacttgctgctcctgcaggacaaaagaggagggacctgggagagaggcgtgtgcaacatgagactgaatagctggccaagaagaagcttctaggccattataccggtttggtgctttgctgattagcagcaagaagccattcaagtctttcagtggacatgtctttccaccacctcgtgtgaaaaatatggaagtgttgactgcttttctcgcatactttgacttattcgtctgtatgtacctttaaatggacaggattttttgaaattaagttgttcatggagaaactaaaaattttttttttttagtctggagttatcacaaagttggaaaatgtattttaaaaatctacgatggtccatagtcattagatcagtcttcaattctgggtcttccagccaccacaggtggatctgagatgagttgtactgcagtgggctttcaacttgggctacatgtgacagtgacctagggacatttttacaactactgatgttcaggctcaagttagtcaatttacgagtgatagttaagcataatttttgaggttccttaggtggttctaacatttagccagagttaataacaactcacctgctggataaatctttttggatttaattaaatttgggcatattgatcttagacatgaactagagtctcttgatttttgaaaacgaggggaagttaaaatgaacaccttgaggtatttgcttaagtgcactcccttcacagaatagagatgagtcctttacaggcagatctggttaaaggaaactccctccggaatgctgggtgatggacgaaatgagggaaaccttgcctcctctggaagcttgccattggctacatcagattttacatgttgcgttttcaaaagtcagtctctcggatctaactttaaagatatgtacttctaacagttggttctgattatttccccacagttgtgtcaagtccacacagttgtatcaatgcttctgcttttctagacgctagttaacactcagaggttttacatttaacggaagaagaaattgacaaacaaaggaagtaaaggaagtttatgtggaatagaaagggaaggaaacagaccttgaacatgtgtagaaaggaggaaacagactttgtccgggatagaaggcccattgacatgaggaggcatgctaacagaggtcagaaagagtagaaagagtcgttggacatgggccaagaaggttcaacaccaggtagcagctgaatgagtccatcagtggatgggctacctaagcgggtagggcattgtgcttgtgggttattctgcaaatcctcctcagccaacaatgagtgtcattggatccatcaaaggattcagtgaaaatgaagcttttttgggtgaagaattccaaggaaattctgaaggttgtgacttagatgaagaaaaattctcagcatgaattgaataatattcacacgaagtctgaaagttaaaacttagaataagtactgaaaccacaccaactaacaccaggaaacgcagagggccatttactaataactcttaggagttcaagcatggaaaatgattttctaaaggtcaaacttagaagattatgcctttcacctccatgaagtttcatagctggaaaggaactccaatcccaacccctcatttaacaaatgagaaaattgaagtgaaatgatttgccaaactaaggaattcttgagagcaatgcctagagtccagactctctcactcatgagtcttttgtattcttagtctgtcatgctgccttcagaccagggcaaaatatgagactgaactgaagtgggagaaggtttacttcagtcatgggaaaccaccattaagggttatttgttgctgggaaagtacactgttgtaatagctgcactgtaacaatcacagctgactaacagcaagttatcctcagcagagccgtgaacagaaaactttggttgggcttcaggagatgagtttaaattattctctgttacagacaaatttgttattcattccttcattcatctgtgcctcctgtgtgcatgggagtgtgcttggcactgtagaatagataaagcaatagaccctgccctgaaagttcttatagtcagtatggaagataagatatacgtgtacagaattataataaaacactgactgacaaaagtgtcgtgagatctggaacaaatcagtagccaggacatttcagaagatagaggggctatttttatcttctagggcaaacagaattgccagagtcaagattatttcatgaaaaaggtagaatttaaattagacattgaatgataagtaagatgtgcatgatgaggaacaggaagaaagcattttagaaagagggaaaaagagaagcatgaatgaaaaaaattagtgctttttaacaggatgtgaaacattttttaaaatataagttgagatggcaagttggaattagattctaaaatattagtctacatatgtttaaactgacatttaaattgaggacagaagaatggaatagataggtgtggtatcaggatgtgttttggtaaaagcaacttaagagagagcgaagactagtctggagataagaaggactgaaagcctagagatatattagtttgttctcacgctgctatgaagaaatacctgagactgggtaacttataaaggaaagaggtttaattgactcacagttgaacggggctggagaggcttcaggaaacttacaatcgtgatggaaggagaagcaaacacgtccttcttcacgtggcagcaggaaggaaaagtgctgagcaaaggggaaaaagccccttataaaaccatcagattccctgagaactcactcactatcatgagaacagcataggagtaactgcccccatgattccattacctcccactggttctcttccatgatacgtggggattatgggaactataattcaacatgagatttgggtgggggacacatcaggagacttcttagattatgattgcaaaatctcaggtcagactaattgaaaataggaatcagaggaacaacgataataatacagattacaacagagagggacgatagagtggtgagtggcaggcaatgtctgccaactggataaaagtaagagaatggaaatggagaccccaagttggtttcaaagattctaagcctgggtaacaggagggaagacagagtcatgaaaatcaatatgggattcaaatgtttccgtgtcactcatcatattctcatagtttggaaaaaaatacctcactctttctcccaaaaatatttaaatctgccatacatattatatattgtatatgtacaacaggtccataaatgcaaattttgtaactttaatcacttttgcaggttagcatagatttacagcaaaagggaaattgacatagaattaaataaattgtgcagtagggaaatgaatttttttttttttttttttactgctctttctcaaactctagactctgcctagagttttaccatttgctatgctgcctcacatattccaaaaattattctaagaaagagttatttggagagttgatttagtttatagagcagctactcagaattgaaaataatcaatagtaccttaagattcaggctctaactggatatttaggcaagaacccaaacagacagttactcctataacgacattgagtaaaatgtagagagcatgaatgtagcagcccaacccatctgttctttttttctaattttgaagaggttatttttatatcagtctttggaatttttagttctgtctctgctatgctacataaatactgatgctaacagactaaatttaaaaaaaaaataaattgttgataagaggaagaggaaattgcgagatataaacctagccattttcccatttaggtggtatttccttactttttaaataaactctatgacttttactttctcactatctcctctctgcatcagttttcttattaaagtctcaacatttctgataatgaatgtctctagaatttctttacaggagacatttaggggcagctacctaaaacaggagagttggggggcttattttaaacctaaactgaaataatagactatttatttatttatttatttatttatttatttatttatttatttggcagagtctcactctgtcacccaggctggagtgcagtggcatgatcttggccactaacatccacctcttgggttcaagcaattctcctgcctcagcctcccgagtagctgggattacaggcatacaccactatgtccagctaacttttgtatttttagtagagacagggtttcaccatgttggccaggctggtctcgaactcccgacctcagttgatccacccaccttggtctctcgaagtgctgggattacaggcatgaaccactgtgtccggcctaatagacatatttttaaattgaaaatatatattactgattttaaaaaataaagatttctaagatgattttattcaggctttacataagatttttaaagagtccaatttcctaatattattactaatattattatcagaataattattctgggggagactggtgttaaaacagttcccaccatagctgataatataataaattgcattggctaagtgtaatttatgaaacaatgtacagtggaggctcctaactacttatatgaagactccaatcacttctgaaattgcatatgcatgtattacaccaaaattatagaataatataaatatacagcagtctatatatttattcaattatcaattcattcacttatcaaatatttaaaatgttcctatcatacatataggtgtggatatctaaattcgcacatgagcaaagcaaaattaaatggcctatgccattcatctgaaaagttaggcataaacactccactgaaaaatccctttttctaagccctctttgttctcatcatagttaaaatgataccttctttttactttagaaactaacgttcaaatattgtaactcttttactaaattcacggtgtagtggttaaatgtatcactctggggttaagctccccaattttgttacatacttgctgtgtgtcctcagagaaattacttgaccttgctgagcttcaatttcctttttttttttcttttttaagttatttctttcttttttaagaaacagggtcttactctgtcacccagagtggagtgcagtggcacagtcatggctcactgcagccttgacctcctgggctcaagcaatcctcctgcctcagcctcccaagtagctgggactactggtgtgcatcaccacacctgactaactaaagaactttttttttccatagaaactaagtaaagacatttttttttttccatagaaatagcatctagccatgttgcccaggctggtctcaaactactggccttaaatgatcctcctgccttggcctcccaaagtgctgggattacaggtttgagccaccaaacctgacctgagtctgttttctcaataataaaaaaaaagatattaatcgtacctatctcatagggtggttgtaaagattgaactaatgaatacatataaactacttagaacagtgtcttgtttgtggtgcgcccttaatgcaagtttagtattcttctgactgaagccttatttgtcttcattaggtcttccacaggcttactttccttgtctcccataatcacccctaaacaattatgggccatactagctcagcaaataagatcattaaaccaataattgtacctgtgtgtatttctgtataattaatatgcgttcttggctagaaattcttaaaggttatactgatgtggacaccaaatctaagtgataatgccaaatttccagatttcttatttaacatgttccagctcactcgattattataagaggttttaaagtcaactgtaatttcaggtatctattggaaaatacaataaatatcctctaaatgataaaaagatagaataatgcattaatatagctgaaatatagacttggaaggcaacaacagcagctggctatgacctttttattgagaaagtgacccagaaaatggccgaggaaatttcatcatttatttcccacttctgaaccaaagtctcagatgcctttaaatccccataggataaagttggctttaggttgtatataaaatacaaattgagtaagggaatattttttctttactgctcagatgttttatcagctttgaatagaaaaacacactaatatttatttccttaatatgtgcacatcagctttaattataatcaatccttccatagacggatttcatgggatttaatgtgctaccaaatgcaaagatagaacttgctaattctctacaattacacatttatttctgggcatgtgggtataaccgcacctccatgccatgttctttctatattgctacaaagcactatggattaaattgtaggtatggagtaccatattaatttggaagtttgaatgtctagaatattttatatttaagtacagatcacacagagtggacactccctagttaagttgttgaatggttgaaacaggtcaagataaatgaagccgtacgataaactatggaagacaaaaataacctgtctgtaaatttgattttggggctaaggtaggtttcttttgatatcacatttattcctgtgtgaaatataagtattctgtgttcataacagagtgaaaatgtatacatttattcaaatgactaatattaagagcatctactgtgtggacttatgaaataatatatatttattgcattcacaatgcttatatttgagtagagaataaagacaaggcaattaaaatataggggtatcttataactgagtttgtacactttgaccatattttgtacataatgggtggtggtggttgtgttaattaatccaattgtattcatcattacacaatgtgtgtgtatatatatacataaaaataaaatcatcatgttgtacatcttgaatatattcaatctttatttgacaatgaaatattttatatacatatatatacatatatatatgcaagtgctagggataagcagaaatgtatctggggacatggaaggtggctctgtaggattactaaacattttgagaaaaatcacatttcaacttcacctttgtaagaggttgtgctgggcttcctttccaaatgaaatgcggtgtgacagaaaatagactcatgtagctctctttagtgggatagctttctttctcaacatcaactaacacatctcctaggtgtccttaaagtttcaacctataaatattctacctcattaagcataaggaccagccatggacatatgccgctagtgtccactttccttcagagatttagggtgatgagaagataaagggtctgcttaccagatggagcttgtcagattagcaattggagcagagtaaatatcgctgtcatattgttgttttgaagcacaaagaaccccttttgtataacgcatgtgcatatttaatagtttaaaacaaaaaaagctcagcagaaggttggctggtcgttgtacctctagcagagtggccattgcctgaaggcacggtgctgttttcctcataatagggaacattagcaaccagtggcttgagaaaggcagagtcaaatatgtctcttggggcccagtcggccacatgaagtgagagccgttagacgcagcaatgagattactgctccagaaagggtttgccacatatattactgcagaggcttttcagggctgccagcgcactcaacttacaaatgtcaaacatgatttaaaaggttattatactatcaagagggaaggagaatgattttccatcactgaaatttctatttcattctgtggcacataccgcatctcacgaaggccaatattgctaaataacctgcttttatctttaataagtgttttatggaccttaaattggaagaaccatttccactttatttgtattagaaaatttgatcttttctggttgaataacagcatgagagatacagtgtgtgtatctgtgtattgtgcttagcagattgttctttgaggggagtaaatttgtctgtgacgtgtcagttagggagagcgtacatacgtaagctgtagttttgataaatgcatttgtaagtctgcagtattttaagctaaaaatgaccaggtgcagttctctgtactgcattacttatttctctttgggctttattgtgactggtatttaaaacaacctgctttcaacctctctgacccctttgggaatatttatttgctcaataaggactctatttgttggcctcaatgagttaatttaagtacaattgtatttgaaaagttgctcaataaaagcagaagacgatttttcttttattttagggagattttcactcttgttttgtaacatttgaaaaataaataatcttcaagtgtggctgttaaaatgtgcaataaacaccttattgtcaatgtggaatttttaaacattgcctttgcagtcataaaagaggccaaaacaagggatttcaactgcccttttggtagcattcttcactctatttcctagcaaatcactgatggctttttctgagggtgagactgtaaaactgaaggttgcctacatttccaggtcccagaatgtgccatgcacagcaatacatcagcaatctaagctgacacatttgaggatggtgttctcaggtgggatgtaaaaaggacagaaggatacagtctatggtgttgagatattgtctgttccccctttatctgagactctgaagcattaaattaaaatctgtgaattcgcccatgttcacatgggcattgtcaaaattaaattaaagcttatggaaggaaaccttctcagcctgaagagtagcacctttcctccaagttctgcaccgattttgtcatttgccaaagtgcaagtcacaacaaaaggaaaagaaaacaaaccaaaaaaatctttgaattttgaaaaataatcagacttctttcatgggacaatagcactaaaaatttaaatttattcgacgttctccagatggagtatgaaattagctttctaacatttgaacaagagtgaacctgaatatctacataaggattaatatgtatgtctgtctgtgcccttttattcttttgaagactttctgtaatatatactgatttcaggtagcttctttattgttatataaacaaaaataacaaatctagagacacaaaaatatttccagtttaggaaataattagaacattctatttttcccccttcttttaaaaagtaacaatagaaagaaaaatcacttaaatattgaatgataataaatatgttttatcttagttttgaaatttgatgaaatagtaaattcattataataatgtattcatatattcagtaaccaatgacatatttatgtaagtcttgaatgttttaataatcctatttaaaaattttgaaacattattttttctaattggattaaaaactcccttttacaaatctctcacatggtttcttgtaattgaaaactcttatagtacatatgaaatacaattctattaataaaatatgcattcatatacacctttttaaagcattcaattatttgggcaaagcaacgcaaatgtataaactcaaagatataaactatgatggttaatttgatgaaatatatctcacattaaactgtaaaatgaaacaaaagtgtttcttctatagtaaaatcttagcttctcttaaaataaacacacatttttaaaaatcctgtgtgaccctgtcttaaagaggtaagttcactaatagaccagtgaactattttctagaaaccaaattcaattttgaattaaaatcatggtctaaaaagatggagacatataccacatagcataagtttctaaaacttatgtcagtccatatatgggagaaagttatctttctactatgattctacaataaaaatattcatttatatctcacaacttagtaaataaatcagaggaatgtttaatcttagaatggctgcagtgaactggacaatcattcaccccaacatttttttctagaattcttaaattgaaaattaaatgtcatgctaatagtgtttcgcttcctttagaaacaaaatcattgtttacaaaaggcactctctttgcatctgacaatacgcaatttcatttttcattctagttatccttaaaaaatttaataatgcattcttgccacctctttcccaatgccaaaatagataccttgtcaccttaaaatatttcacagaacaattacagcctttaacatgcagaacatagctgtctgagaaatagggcactttctggtgcttgtgatatataaacttcattggataagaaatcaagtgcctcctacatgcatcctggcctcgttaatttatgttgatggctggtatgaaaaagatagggaggtggcaaactggtgagttgtctctgaccaaaaagaattatttattttgttggaacaatgtaacctaacactaatattactttttatttaatattggaaaattatacattagataatgttttctagaaattaagctagctattttaaagtagagtttaccatcttggctaagggattgcaaacataaaagcatacaggggtgaagtgaatcaagtcaaagtgaatggctgcagtgaactggacaatctaagctatcaccaaggacatgtttctttcaacagtctactgacagccttccccagggctcccattgctggcttcttcacgaaggcctgccattctttatactacttatcaggctttttgaaaaagcaggggtgggggcaaggtgcggtagctcacacctgtaatcccagcactttgggaggctgaggctggtggatcaattgaggtcaggagttcaataccagcctggccaacatagcaaaacaccatctctactgaaaatagaaaaattagctgagcatggtggcgggcgcctgtaatcccagctactcgggaggctaaggcgggagaatcacttgaacccctgaggtggtggttgcagtgagctaagatcacaccagctactcaggaggccaaggcaggagaatcgctggaacccataaagcggtggttgcagtgggctgagatcgcaccactgcactccagcctgagcaacagaatgaaacttgtctcaaaaaaagaaaaaaaaagtaggagtagggatgtttttgtcaaatctaggaaatgtgaaatttcttctagaaaccacctgaattatattaaaaatattgacaatatatgagtttttaccttgatgaaaggagatatttctttttttttttttttactaaattgcttttatacaaagtctacaaattaaatctgcatataaggagagttaaatttaaatattaattttaagatttttggaaaatgcggcaatcgttcttttcatgtgagagataacaagtctaagccagatatttagtcatgttctatgtaggcaggaagatctcatctggattccctggccttcttggcattctgactcacaatgtcttcatcagttttctagtgatagatgaataaaagcataataaaagataaaccaagggcatcgtcaggtgttcaggggagcctaggcattagtctaggtgggagaaagaacctagacttcctaagtggcctgggactcccaacgttgtgtcagtgacgctggatatatccaaatagactgataggagagccctggcaggagaaacagaggagcatggatgctggatactagacatcaatactaaaatatatgttgaaaaatttaaatagtaccagttctgaacattcttgtggtttcataactttatagagctatgatatatactaaagataatcgccacttatcatcttcagtgaaacgagtggggccagggattttcatagctttccaaaatctaaaatgcctctattgtgcacagaatttgtaggttacttggacatactgtatttctctcagattctaactaattcttagagaattgtatttctctcagattctaacttgtacttagagaagttaaataactgactatatagatacatgtatagaaaatggttgatctgggatttaatccaaggtcaagattaagacttaaccaagattcagtcttgatccaaaacttttagtccaatattttctcgaccataaatcaagaggttaaatgaacattggattctaattctgactctactaatgatgggcataggtacccatattatagggctgagattcggctatttattgtttttttttttttttgctttattttgttttgttttaatcccaagtaatttcaatttatagctaggattgagaaccactggcttaaaatctaagaaaacttaatttattttccttttcctttactttcatatatattctaataaatgccagttgttactaagctttacatatatatactcacaatacataaatacgtaaatacataattcacagaaataagtttatgtgcttaattatccatctcaaaagcagatttagaggatttaggagaaatgcagcatgtgataccaattacaagaagaaatgggaaatattcttttgtagttggttgttcctaaattctggtgttttcatctggagggactgaagagaacttctatccattgattatctatgatgtgccttcatgcttatggagagatttattcattcagattctcctggaagaagccactgtgtgataatgaaagtctcataattagggttgccaagtttagtacataaaaatacttgtattaaatgtgtttatctggtaacactactactaagagcttggctctcaaattcatctctggtccaggtttttagctctcttcccagatgagtcatggcaactgccctgtctgcaaaggcaaaacatcatccttctcttctttagagacactgacctagctgaaatgtttctctggacaatccaagaggaatcaaacatttacatcagcaagaaccacatttgtgtctgtgatactgttgaagggtccatagagagataactgatttttaaagcagtggtacttgtaaaacagcaacagtaaggcttaaaataaattaatgccaaaagtgatttccttcattccttaatgtaaaatcttcctgcatgtaattcatagtaactgaaaatggaaagtaagtggtagttagacagtagctcttttttccattaaaaaagtttaaaagcttcaagtttgttttctatgtacggtctaacatggccatgcagatattcttcattcaaagttagatcccctcctagggtttcagtgactgaaagaggaaaatttcctcttattttacgtttcctttaatggatcacgtatcaaattttatgtacacataaactcaaattaagagcccgtttattgcgaaattgtccttaaaaagctaaatctaacattggtaaaatttagtccctatttgtagcctgatggtatctaaaaaaaagttttgggtaaaagtaaatctctacaccttcaaattgaatgttgcagccaattgagaacctatgagaaattaaattgagaaagatgtttttgaagacccatttcgggagaaatgaattcctgtgtcttgagaactctaaagcagataagaaagcaaggcaatggatctaattctgtttggagcataaaattcctgaaattgaggatatataagaaaagattgatcttgtgtctatttgtcttgaagttcagttcaaatctggttctggagaaaaagaaagatattaatttccagacagagcaattgtgtctttcagaaaaattgtgcatttcttcccaattgagatgtctcaaaattaaatggtatggtgcaaagcttcattatcttgtttctcttaagattcaagccttttttttcagaacagttatccaatatcctaatagatgaaacataatttagaacaaccctgtattataagacccagatttaccaatacaatatctatttaaatatagaattactatttaatatagaattcagtgtggatagtagttttgagctttaagtgaaaaaaaaaaaataaaagaacagaaactccataatggattaggtctaatacagccttttggtcatgagtgaagaggctaatgtaatatgagcactcatgagtaatcagatgtcttctgatgagtgaattgaaatgtcatagcagaagtaatccactatacattttattatgaatttttgtgggtaggtttaaatttattttctggctcatttaatttatttaatcaaaacaaaatctaagatgcatggaaaaatcaattttggtaataagagatttaccccaatatatttattcatttctaatgttttctttttctcattagttgactgggttataatttttgcttgtcattctttatagctttgtttctggtttttgctaaaggccacaaaactacatacatcaggtatttccaataatattgtactattgtatgtgcaccggaaatatcccggtgctttcggtagctccaatcaaatatgtcttatacatgatttgtcagattccacagataaactgtatatttgcaaaactggattttagaagatttagtcaattagaaatatatgtggctatgtaattggcttctattgttttgctcttaactcatctaagatctaatgctaagttcatcatatcatcatgatctttggtgagaatgtaattgctgaaaatgttttgaaaccactgggtcagtgattaagaacgaaagggattcagcgttaaatcaaagttcccatacgacagtcatcttgattcacaggaaatggggattgaactgggttcacttgaaaagtactgaacctcttaacttctcagggttcttgttgtatgttagtaggatatgctttaatgtggatcactaatctctttttcataatcatttgtttctaataaacaactgtctcattctttcgtcttttcatacatcactcaaaacaaatgactcagggccgggcgcagtgggtcacgcctgtaatcccaacactttgagaggccgaggtgggcagatcacttgaggtcaggagttggagactagacagaccaacaagatgaaaccccgtctctactaaaaatataaagatagctggatgtgacggtgcatacctgtaatcccagctactggggaggctgaggcaggagaactgcttgaacctgggaggcggaggttgcagtgagctgagatcaccccattgcactccagcctcggcgacacagcgagattacatctcaaaaaagaaaaaaaaatgattcagaaaattttaaaattttttaagtttttatccttcttgagcatatatatgtgacagccaggggaattccagatgtttttcagcttatttttatgtctgacaccagatactacataaataaaaacagttagaagttttgtttattgagtatttttgtgattacatatctagacaactttcaaaacaaccagtcagtggtttcaagtatgctttcatctccatcttgtatcatatcattcatatattgttggcaaatgatgagttttacctgtattatttggaagcattttatgaagccagttttagaagttcatttaaagaaacagaaaagctcatatgcctgtctctaaccaaggacacaagagcaagtgaatgagggtgttttaatttttattttttgtcttacttttcaattcacacataaaccaatatggaagtagtactatctaatgtggaagatagaaacctatatatttttaaatatttttgagtgagtgtgactagacaagtcagatagtttatcattttcattcttaggccataaagatccctctggcaaactgaagagtttaatgactacatattttcttaaactttaactgtcttgagtgaagggtacacatagtttgcactattggtgagtgaaaatgtctaccttaagcaaagagaaaacagtcctcctctgccatgagagtgaatagagacatacatgtcagaattcaatatggcagctactcatggaaattattcagcacacacattttaaaaactcagaaatcttaattatcaccaaatctaaaaaatctgtgtcctttatttaccttttctgttggcttttagactcatgcttaatttcatagctgacagtgcaaagcttatcttcatttcttaaaatttctaattggaacccagcagttgcatccataaaagaaaatatttcttatgtggaaatggtgtagcctactccactttccatcagataaagattaggttaaacattaaaggaacaagataaagcataggtgtgcatttgctatttcaagtaccaatttctattttatcactcaggatgggttagagattctgtgttaataaacagtcccaaaagttcagtggtttttccatttaattttttaattgatacataacaattgtacatatttgtgaggtatataatgatgttttgatacatataatatgcagtaatcatatcagggtaattagcatatctatcatttcaaacattaatcatttctttgtgttgggaatattccgtatggtccttctaactatctgaaattatatattatattattgttaactatagtcatcttgtagtggtatagaatactagaacttattcctcatgtctagctgtaattctgtattctttcacaaatctcttcctatccctgctttccccaaccattcccagtctctagatcagtattttttttgttttgctttgttttgtgttttttggtttgtttgtttttaagatggagtttcgctcttgttgcccaggctggagtgcatggcgtgatctcggctcactgcaacctccgcctcttcgtttcaagcaattctcctacctcaacctcccgagtagttaggattacaggcatgcgccaccacgcccagctaattttgtatttttagtagagatggggtttctccacattgatcacgctggtctcgaactcccgacctcaggtgatctgcctacctcggcctcccaaagtgctgggattacaggtgtgagccaccgcccctggccaggatcagtgtttttaaaagcaatttatttttaaaaaaggtctaaggtctaccagtccttgggctacatgcctatttcatgttggctggggccttgctctggcataagtattgactttccttcagtatccagggtgaaggaatgttgacactctggtgatagtggctgagggaaaggagagttctggaagcttttgtatcaacataaatccctcagcccgtagtaatgcatgccatattctgttacaactcataggccacaacaagtcacatgccacacataaccacaaagaagtcagaaggcaatctagctatgtttctggaaggaggggaccaccacaaacattcggcaagcaccaataatgattatccatatactacctgcaaatctaaaaccccaatttaggttccattgctaccaatcttacttagtctacatgctgacttaactccatattttaagtattgactttttaaagaattgcatccagcatttggccttattctttaagcagagttatcttttatgtgttattgatgtgtttttcttttaaggtgttttgtcttaagtcaaaacaaactctagtgaatatgtcattagttactaagcctaataattataacattgattcaacaggattaaaatttatgcatgagattctgctatcaggtttttcagggagatgttctgtgactccaagacttacagtttctgtgttttgcatgtcattttacaaatataccagagaatagactgtgagtcatagaattctaacatcatagggttgacagggaagtgttaaaaaatatatcatctatttcttatattttgacaagattgtacacaaggcattatatatcaagccattgaggatgggagggcagacagagaaaattatttcccaaaattgtttcattcaattcatcatagagcaaggttgtcccatataactgctgtagggaatgtgggtagggtttgtcttgtgaaaaataaacttatttttggccttctttttgcttaaatttcagtagcatgttttctctttacaacaattttcaaatgaatctacttggaagtttcgtatttatctcattagcaaaattagtattgtgtaagttcataaatattctgaataataataaaaatgaaaataaaacaatgtggtatagggagaagaaagctggatcacattactgtgatccctgaagtgccttaatgtcttcaaagcctcagtttccttctccgtacaatggaggaaacaaaataaaccttttgcaaattaataatatgaacttggaactacacaaaggtcttatttgcagaacagtcttagaataactacataaatagaagcatggtaagtgtaactgtacataaacaagcacacaattttaaatggaaattaaattttattattcagaccacattgattttatctgatcaatctactctcacatatttgagttacaaggtctgagggtgaatggtattgtgtgatgaattccaacaagtctgggctttacttaatcaaattttacagcattggaccaaacagtaaatgctggtgaagttgattcctttgtctctccttaactttgagacacttaatcaaataaaatcataaaatttaaaagctagaagtgactttgaattcatatcctctaatcctttcactcacattttttaaaactgggctgttatcagttaggaattttattcaactgctagtgaaagatttttgaaagttaatgctgtatacaaattataaatatatacctccaatgtttttgcaagtttcttggccttccctacgtaattggctacatggatggcaaggtttgcacagcgtcttatttttagaataataagagtgacattcaacaaagaaagctgatttaaaaaagaaagaaaagaatgataaaaggcaaaagggtaagtggctgataagtttgtctcgtcttaaaaagagccagggttttttgcttgtaacttattgcccagcattttttttttgaggtttcaatattttattcaagtttctgtaagtgatgttaattacagcatttgaaggggaggatataattccacacaaaatggaagactttaaaatgtacccattaaactgctaaaaaacaaattgagtgatgagaatacaaaagaagtccaatttagattctgagtgttgtcaccatgtgattacaatcacgcagactcttccaagcttatagctggagctcctggaagctatttcttactctggtgcaaggacaaaaaaacacaatacaggaaggaataagtcctgaattattggcttcatcacatccaccttctccaccccaaaatggcacggaagaaacagtgaccacaccctgcagaccatttggtgtaaaagaggtgacgacgatgaactgcggtgggaacaggtcatgaagatctgtataaaaaagtctcattcagatgagtttgtaacactgtcaagcagtgagcctctcatcagttagggttaggaaaccaaggttcgattctcaggaaatcacagtttcattaatttactcaatatgaatttacaaagtgcctacatattaccagctaccacttgaaggcatttctagataaaaaagaaacttggcatctcacaggggctaccgagttccccccaagtctactactgaaaggatcttttttggaaatgggtttcttctgtacctctgaaagggtaacatcttaaagcagaatcatctttaaccttgaggtctaacatatttagcaatacttgcatcccagtcatacaatattaaaaggtacactaaattctgaaggtagctatgctgcaaaatagtttaaattaaacaattgtatggtattcattcatgcttgaaatttcagtcctagaccaagcttgtggccaccagccttgacgttcttgccatccaggagagctgacagtgtcagtttgatacctggctgcagggtctgagtgtatcctaaacctatcaggctggagttgttcactttagtggagaagcaggcatgagggtcagtctgatacttggctgctgttccgaagcgcgtgttactgtttcctgctgtccagacgagattgacagcggtctccaacttcttgttcaccttctggtaaatggagccgccaaactctgtcccgtcattcacagtagtgtgaagctggaattcatcagtcctgtagccaactgcaaagttgctctgggtcactcaggaaggactttgcagtctcaaaacgcatctggtacccagccagccagccctgtaacccggcactagagcaccccggatggaaggcccagcagtgtggaaatccacgtcacagcccaggttaatgtgctcccacttgcaccctgtcttgattttagcattttttttttcccagtgttaggtgacgaggatgaatgcaaggtcagcctcaggccacgtgcaagctgaccgtccacgctcatctcggtgcctagtgtattgtcggggttccatttctccgtagacctcgagccatagtcagtccatcggtacctggtttccagactgcccgtcactttggtggtctcagtgttggctgagcctgagcttgtaaactccgatccatcctcagatttcgttttcaaatcaagctttattaagccaatccatagcccttggtgaagacatccctagcagatttgccaagatcggcatacgtgggtggcacagccgtcttctgctcaaaggtggcggcgggctctgcgggggctgctggttgctgctggggggctgctgggggggctgctggggggctactagggggctgctaggggtgctgctggggggctgctaggggggctgctgggggggctgctggggggctgctggggggctgctaggggcgctgctggggggctgctaggggggctgctgggggggctgctggggggctgctggggggctgctagggggctgctggggggctgctgggggggctgctggggggctgctggggggctgctaggggcgctgctggggggctgctaggggggctgcggcgccaaggcagggagttgcccaacattttaatataaggctccacattgcgaagaaggtggggtgatttattttattttatgttatttatttattttattttatttcattttattttaattttattatttttttgagacagggtcttgctctgtcgcccaggctggagtatagtggcatagtctcggctcactgcaacctccgcctcccgagttcaagcgattatcgtgtctcagtctcctgagtagctagaatcacaggcacctgctatttttgtatttttagtagagatggggtttcgccatgttggcccggctggtcttgaactgctgacctcgggcgatccgcccacctcagtctcccaaagtactgggattacaggcgtgagccaccacgcccagctagtaatgtagttttatgactgatcaccttatgtactcttccaattctcaacttctattaataaaaaataaaagaatatagataatgcattagaaacatctgctgcagggaactgttttaccattacagataacgttatgaatacaagtatttctgttatttatatttgccattatgtctgttctggaatattatcaaaccagaattataactagcaagagactatataaattaaaatcacacattttaaagtaaaactgaagttggttcaaactaggactccaccacttgagcaaactacttagcacaaattacttaaacctcgatgttctcatctataaaataaggggtttacaaggtcaactactaaattagataatacatgtaaagtgaaatgcctaaatacaatgcctaggatacagtaattgccctgtaagttgtaagtgctaccatgaaccagccaatgatctctactacatactatgattgagaaattaaagatggttgaaattttatataaatcgatgtcaaggtaatattatttatgaagttattgtacttcaggtcatcatgattgctttagtgcatttgagactcttttcttagatgacaatggttctaatccatcttctatcaaagtctctatttctccatttaaatctggcagatccgtcttctagagacatgaccaagtcaatgattttgattagtctgtgctccttacccaatattacaatacctggaaagtaattatgtttctatttttcattttaatctgctcttaccatattgacaatatgggcaatggctaagtccattatgagtttaattgctttatgtgccaggtgttcggaagttcattctttgaatctaatgaaagtaaaagataaagtcacagaactctggttcattttatgcatacattattctaactttggataaagaattaatcattcttttacatcctgtattgtttaatgtctcccttgcccagaaataaggatttttatcacagtgacttcagtcactgatgaggcatacatacagaaatctcctgttaagtaagattagaatttgtctttgggcctttttaaagtttctgcaaactgataacccaattgctcatgctgattgacagaacaacattgaatatctaagtagtctaggcctttgtctggtcattagaatttgtccttttgaggaccattggctggaaactttatactacaattgagtgtgctatgagtaagacagcttcaattgaagcctctgaagaggaaaggaaaataacaaagaagacgcttttgtatctttttccattatcaataacgtcaatatagaacatgccttttttcatatgaaacttcaatatgaacttattcaaatgacactctggctatgtcataatgtctgcattctccaggtatatatgaaacagattttaatggatgttgggtggcttccattcaccctttcatatttgaaaatgcacttagaaactctgttgagaaagttgcttatgctattggtcctccttttctgttgttgttcagtctgcccccaagtggtagagagcctaaaaacccaaaaagataacaacgtggtcaatccatgacttatcagctgcaattgtatgcctgattgatttttgttgctatacaacagctgaacaattcgaaatttatcacatggaatatgaattcacctgttcaaatcatggtagtataataattcttgaaattgcagctgcatattttaattcattacaccaagtaaataaacttcaagacattcagccaccattcatgaaatagatttctaaaggcttatgtggggatcattttctttctcttaccctctaccctcttgttttaaaactcctctccccaccatggccttatactggaagacatttttactcttgatttctagcaattgctggctggtattgttgagttttaatatttcagtgtgattcagagctctgaccattttcaagttcttaggagccctctcttgtctcatttttaaacatggcctttggggaatgacagtgattgtgacagatggtaaaggaataagattgcactttggcgctgcttctgtctttgcctcttgatcttttcccactttctcaaggcaaattatagatttccttttgcctctagagggacgcaaattgcagttgccagttatatggttctttgtttctctttctagctcttaaaaaaaaaaagaagggctcttatttaattaaacattgtcattacatttattgttgatgaaaggtactgatttgtatgttggccaaatatctgaccagacaagggagaggacttgttgaactacaggcaaaaaaagaaaaagaaaaaagaaaaaaaacttttgttgcgtttgaaggtagcttccctctagtggcaaaaactggtacttcacttgtagactacaagcgatttaaaaaaatatattttttgttatctctttttaaaacattatctgatatgtgtaatgtacatatcacacattttaatgaatgtggcttgcaactaaaatcgagtttcctaaaaagtttagaaatcttttcagttaccaaattcataatcttaggtatgcaaagtaggcaaggtactttactgtccattttgttcttcagtaatcccacacatacaacacacaattccagatgaaaggattctagttgactaagaagatagttaataaaggggttttagatttttttcataatttattgggtcggagttaactcaagcggttacctcctcatgccggactttctatctgtccataatttatcaaaggagtgtgaaggaattataaagtatcgcataaatttgggtggtgggcatattgctgtacttctctgtgtattagaaatattttaggctgggcacagtggctcatgcctttaaacccagcactttaagaggtcaaggtgggaggattacttgagcctgggagttcaagatccgcctgggcaacacagggagaccccatctccacaaaatattaagaaattagccgagcatgatggcacacacctgtggttccagctgcttgggcggttgagataggaagatcacttgagcccaggagttcgaagctgcagtgagctgtgattatgccacttcactctccagcctgagtgacagagagagagaccctgtctcaaaagaagaaaaaaagaaaaaagaaaagtttgatactggaaaaattttagagagaggcgatagaatcactagatagttaaaatttaagtattagaatttaaagggcactagagattagttgagtgttacagttttaacttgaacttattcgttcacattcatgtaaccactacaaaaggatttaagcaatgccaagaatgagctataatttagacaatgtgcaggaaatacaaggacaactaagacgggcaagcggcaagtgaaccgagaactgtgcaaagagatgagtactaatggaaatatgtacaacaaactaagagagtacaccaaggacaaagtggccctttgtttgagacggatgaaaggacagttaagtacagaagataagtgtaaatgatcaagagtttgggcacagtgcacgggtattttccatgcacatagcaccatgggaagtggttctgagcaatcaggagataacagggcttcaagtatggaaggcttaaatggagagagctgagggagacttgttgttaataactttgctagagcaagtcctaagcaggcactgttttataccataataaataatcaaatgagagaatatgaggtttggttccccaggctccacacgtgactatgaataatcttataaataatagacttattcacaaaacacaagatagtctagaataaccgaatgaaatgatgtttttgtgcttctttgacttcctaccaaacatagtgttccttggaaggaattatgtttgacactgtattgtatgactggaaaaaaatctataatgaagaggtgctcacatatgaagtagcactgagaaagttcgcttcaacagaggtctggtgatgggagaattaagcataatcaaaagttctagttgcattctgaagtcaatttcaagttgtcagtcctaattgggagtggggtttgtctaacataatgcttaagacattttttggtggcaaaatttctcaatttaaaggaacatgatacaagctcagaaaaaatgcagcaaattgatgactaagacctaggtaatctgtaagtaaggaaatgggatgtcaggagagaaattgacatttgtttagataatatccacacttggttggatggactatattttatagatattttcattcttgaatattttagtttctaagatctttattatgaaacaagaacataggtctaatatatatgttatatgtttatttatatataatatattatattatacatatgtattataatatattatgtaatatattatattatacatatgtattataatatattatgtaatatattatattatacatatgtattataatatattatgtaatatattatattatacatatattatgtattataatatattatatattatggataatataatatattatattatattatggataatataatatattatattatattatggataatataatatattatattatattatggataatataatatattatattatattatggataatataatatattatattatattatggataatataatatattatgtatgttaatactatgtaacatatatattacaattataaaaaaagtgtatgtaattacttgtatcaaatagtgttttatctgactccctccatgtccataaacatatttcccacactgactatcacccatgttccctcctacctttacatactcaaggatttccaactgcccaggactatgaccttcatgtcccaagcacattaaccctcctttggcaatactcacctgctgttgacttttcatacttgctctcctgagttgagacttaattgtatctctcaagaccctgatatcaggtataagatgagatcaagtttataatctaagaagctcctccatgctaatagaataacacatttgcattttgacctgttctttcttccaaaattaatcaagaaaaagagcttttctgtagaacatgggctatttgagaaaatgtgtatcaaatgagtttgtcatcatttaatcacaccaagtgcatgcctttggactctatttgtgtatagagctaaaccaatatttgataaatgtttgcaatactgataacaaatttcttagataaatgggcaatgttattcttgtcttttaaagatgaaactcctgaaaatgattacaaagcccattgcttcatcacacacagacacatccacacaaacacaccatacacacacacacaattttcaagctttgaaaggctcatgtgtaagacaaagggtattttcagtaggcttggaaatcacttggcatttttgagatttgccaaacagcttgagatatttaaaaatatttttgttcaaccaaattccaaacatgtttttctgagtactttttttaggtcaatttttataaccatgtgtaatttcaagaaaatttaacccatatgtttgtttctgttagtgtatattcagattgatttataacacagatgtaagtatttctcttaacactggtatatgaagagggtgagagggtctcccaatttgctgcttgggacagtccacagtgagactttagattaatggtcacagactataacccagttctaatctcaacacagtctccatgataaaagtcacaggggactggctataagtgtcagcaaaagatcagatccagttactgcagtatgttgatgaatatgtgtgttcctagcatggactcaaaagatggaactctgactgatgactgtacagcactgtgagaatgaagcccttaagtgctactaaaaggtctttaccaactgtgatgaaaaactgcatctgtgagtaatgctacttactggcaaaataggactgtgacctgccaacatattccattattttttgtggcatcgagtataaaagtagacccgttgtccagttgtagggaaagtagaaacacaagtcaaaatactaccatacttcataggccgggcgccgtggctcacgcctgtaatcccagcactttgggaggccgaggcgggcggatcacgaggtcaggagatcgagactatcctggctaacacggtgaaaccccatctctactaaaaatacaaaaaaattagccgggtgcagtggtgagcgcctgtagtcccccagctactcgggaggctgaggcaggagaatggcgtgaacctgggaggcggagcttgcagtgagccgagatcgcgccactgcactccagcctaggcgacagagagagactccgtctcaaaaagaaaaaaaaaaaaaaaaagctaccatactttacagggatagcaaaaatgaatttttaaactagcgcgtgtttcctgtaattcttaaaattaaacagaaatagaaaaactctaacaagaacctcagattcagccaatgtgccaccttagaagtgatattctctccatagccaagatgctgtaggtaggaatgaataataacaggatgtcagagtaagtgccaagtggaaggaaattaaagtatagttatgatgtaagggggcagacataggtaattttaaaaacaacaatattttagaaataagaaatgattcataagtattgcttgtgaatgcaaaccaaaagtcagataccacatgcataatgaagtgtgactctatccaaatacttacaacattttcagggaaaaaaatatattctctgatcctgaatgttgtgcctacagaggaaagaaaatgaacctgtttactagagggagaaatctcagtgactgaagaagtcaaacaactttttgaactctgagagccaccttagctgttctgcttcagggttttgggcaacataacatctttatgaatgttaccttatagaacgttagttataccagagcagacgcaactggggatttgacaactctgccacactttgactggactgacatttccttagcagtaacaagctgctgctgtctggtgccatgggggccctgggcttgatttagtagcactgacattgactgcttgttatttcatatcttagagctgtcaggaggcaactgatgtcagcataaaattatttgatagctctgcatcttgggcaaaatgtgaatctattgatgttataaaatggccatcaaattcttggaattagggggtggagataatggagaaagaaaactcacctggtttattgttaagtaatcttttgtttaaaatttggttcacataaatatgaactgtaactatctattaggcacatactggttgtactcattaaactacatgctcatccaattctaacagtttcagaggataaatagtattattttgatcctcatttgacagtacagattatactcctggaagatggaaaagctgggacgcaaatgcaaacaatctggttccaagatccgtgctttcaccttgagttacatggtttttcccatggaattgaagatcctagattcatagaattctttccttgagctgccattgatttttttctttagttttaattttagaaaacatttgctcattttattgagggaaaatagcaattagcaccttgtgtgatctgataaatactcactgaatgaaaaatggaactttttatcatcctcatagcttttctggagtaaccgtgtatccaatggaatgattccagtcgtaaatggagttggtcaaagactaattctctcattacaatacttactttaacacagtatttgagaacactttgaaaatgtgaggagtagtgagtaaatgtggggaattttgtgattaataatctcagtagtaaagactattagaagctcagaagctctcacaaaatatgcaagaaatacttatcaaatttatgaattgtatctcagtttaccactctgttgatcaaatcacttatttttaaacatagtgatcttcaaatatagccatttctaaggaatgcatttgcttctttctgaaaatcacctgacaaccccaaatcatttccatttatattttgtatatccattgatcttgttttgtgttgtttaaaagtataatcttttatgttttttgattaacttgaacaatgacagatcacaatttaatttctagaatgtgtctttgtatgtgaatgcgtttctttttttcaaacaaatcacaaaggtctgggggaattgtgattctctaattcgagctcagtatataccagttgaaagcatttagttgtgattaaaacagattgaaggagataatccctctgagaaagcagcttcaaatagcttagcagcgcttcttcagggataagaactaacacaacacaagctaattcctccaaagtctccctggtggagctgtggacgtacctttcatttgttgtttttcttccttactgcgttctatttgaattcctcttaaatatgaattctgctttaataacactttactcattttgttttccaagaaccaacatttaaccttttgtgttaactgatacagggagatacacttcatataatattaataaatgaagagtgtgcaggcagttctcaatttacaattgaatgatattataaaagttcataggtaagtcatagacaatttagaactcgggatagaatttatcatagaaatgttgttctatataaaatttggtttcttggttaacccttcaaagcctattgaactctcaatgtagccgaatataccttatgtaactagtacaagttctgcatagcggcagttctatgagaatacttctaaccaatgttctggattcaatatcgggaagaaaaaacgccttttccttgggagtgccttcaaatttatttcgttcacagtgtatgtcatttcgagggtcggagaaactgacaggtctgtatcttctgggagtagtgtgctggagatgggagaaagagaaagaactagataaataacaaattgtagggtgagattttcttcattttcctattcgcttggatatgctgtaactccattttacaatttaagaccatgcccttgaaaaccggacccattattggagaagggatgagtaaagtgcatatatggaccccaactattaaaggctaagaaaagaaaaatggaagcaaatgcccaatgacaataggcaaagaagttatgactccttcagccaagcccaactgaagatagaagtggtacagatctcatgttcctggatattagacacatatggagcaatgaaatttcaaaaactatgttgacccttaactatctgtattaaaaaacattgaagatttaatggccaggtgtcgtggctcatgcctgtaatcccagcactttgggaggccgaggtgggtcgatcacctgaggtcaggagtttgagactagcctggacaacaatggcgaaaccccgtctctactaaaaatacaaaaaatagccaggcatggtgatatgcacctgtaattccagctacttgggaggctgaggcatgagaatcgcttgaacctgggagacggagacagaggcagaggttgcagtgagtggagatcgcaccactgccttccagcctgggtgacagtgtgagaccgtatctcaaaaaaaaaaaaaaaaaagaaaagaaaaaaaaaggaacattagaaatgttcctgtttactcacccgcttttccttccccacttcccccacacccctctgcccccatcacttcctcttccctcccaaaattgctttaaggattttcctttctgctgcgcccatgatgcagtgatggtgagccacacagtacattactgtaagtccctgttgagttgaggaattaaccaaatgctaccacagagtttattaataaagtttaggccaaattgtgaacggaattatattttaagacacagaacacagtttgctatgtaaagttttgtaagctggagcaacaatgcagaaactaatattctgtgaagagttcctagcaagccagaattaattgactaccagcgtctaaccaaacctaaagttctaatctagcttttatatacagatcacctgccagcacttcatcattttgtatatgctgtttgctatgctattatttggtgattgatctgctgtttaacttatagtaatgatgatggcctggcgttaacaataatggcatatgttaaaaatgtaagagagcatctcagcaataaaagagatagatatagttcagaaccttttcacattgcattgcccctgttaatgtttcacaacactttatactctgaaaaaataaaaataaaaaaaggaagtggcataaaaatagcatgtaaagtgttattcccacatgctgttcttggtctttggcatgcctgttatccccacattctccaaaaatgacaagaatgcatcccatctgatacatcctgtgaaaaatttaagagcatatttgaaaacacaaaatactgttttcataaactgctgaaatctgtgatagtttggcagtaatcacaggaacaatgctggaacacaacttttaattttttcttttccttgcgttctcttgtcaaactcagtgaacttccctgttctgtattgctttctgatgtgttgatccaagtctccctaaaacccacatgctaattcctgaacagagtttaacacttgacttttccccattaattaatagtccagtgttgatatcgatgtagtctttcttttgtggataaaaagaagcaatctgaagctaatttagcattgggaaaagtagtaacacagcttttaagaaaaagaggaatgaagcaatgggcaaaaccagctgtaagatcttctagacggatacgtgtggctacagttctatcaaggcaagaattggcagaactttggaaacttctgtttctatttttattcttttatactccttcagaatttaagagtcactccttgtctccatgacaaaacataacaaatgctgtttgttctagtgtttaggctaatgacataacgtgttaacccttggttacacagaataaccttcacattaagagtaatcctgcaccatttatgaaacataagcatcacacctggcagctttttgtcaataagcatatttaaaagaaattccaaaacaaagagttcagtgtagtgacagtgatactatagtgacttcttcagccatgttttgctggataattaattctccttaattctgattctctcctgccctgtgcctcacattgggtctatacttcccacagtgcttaggagatgtgcattcatccaatttgtacagtcagtctaaggattcaggcagactacataattcgttagaatacactgactgtgttgaccagattataacctgtctctgcttttggtgttatgtgagggcggcacaatgacagaaacaatggtagctaatacctatgtatgcttactgtatttggcacagattatctcatttagttctcacagtcccaagcttggagttataaaggaagaattcttggagatgatggaagctcaataaagccaaaaaacatgaacttcaccattagacagactcaaactaagttagtaatatttctacttttcctttttttcttttttaatataaattaaaccatttactcctctcctctaccctaaagtccaaatgtaatatatattaagggatatgatttgtcctgatttggtgtccatacaaattctctgtgtcagagaataacctagaacttggtatgctttatgattaataatctttcaatatgttgttaaagattttatttatacttgtggctgggcacagtagctcatgcctgtaatcccagcactttgggaggctgaagcaggtggatcacttgaggccaggaatttgagaccagtctggccaacatggcaaaaccttgtttctactaaaaatacaaaaattagtctggtgtggtggcacatgccggtaatcttagctactcaggaggctgacgcaggaggattgcttgaatctgggaggtggaggttgctttcagctaagatcacaccactgcactccagcctgggcaacagagtgatttatttaatctttattttctccaaaaagaaaataaagattatacttatacttgagtagcagtcagttataaatgagctgagagggtgaagtaaagaagcctgtatagacaaatgaacagagacagacttttgtgatgcgtctttaagggattattagaagatcattttggagtggacaactcaagaaagaaaactttggtgggaggttttacaaggtcttcaaggcaggcaaagaaatgtgggttttgatctgaccacattatatgcactttgcttatttatcgttgaggtatattactgaacactgtcttatcctatttcagtaataatctttgtttatttggtaaagtattatttttttaagggttagcaattctaagttccaccatgaagcagtcaagtgaaattgtttctcagtatttgattgacttgattcatccattttcaaagaaaaggtaaatcatatagtattctgtatgatgtagactgtgtcactcagagtgaaaaagttacctttgtcttctaccatttgagaatgtgctgttgaatttgcgaagaaaagagccctgaggcattaatcatacacattctccaatctagatttcaaaatgttcagtagatgtttagggtatgacagaagaatattaagcccgttaatacggtaattacagtgtttcttgcttccttgtaccctgaactgattaatacataaacaggactcaaaatataaactttatgtttagtgaaagtgccaatatctatgtctgaattcatcaatgccatcttaggaaccaggcaatatctgttcactgcctagtgccttagggagactgtttaatgaggagatgtgaagccttttacagtttattgttgatgacattttgaggacacttgcagtggggtagactgaaaaacaataaagctgggtattttcttggatatggtttatgtgccccagagtgttgtatcagattttatcagtaatcaaatttctacttgatagcaaaaacaaaaacaaaacctttttagaaacttaatttcatatattgaaggcaaagaaaaaaatacttgcaaatctgatatctgaattttcttaagattcaaagaatttcaatttttctacttattcagttgaattaaaggttactaccactgtttttacaagcttgaaaggcctatttatttacttatttatttatttatttatatattttgagatggagtctccctctgtcacctaggctggagtgcagtggcgcgatatgtcggctcactgcaacctccatcatccaggttcaagcgattctcctgcctcagcctcccgagtagctgggattacaggcacgtgccaccacgcccagctaatttttgtatttttagtagagacggggtttcaccatgttggtcaggctggtctcaaactcctgacctcaggtgacccacctgcctcggcctcccaaagtgctgggattacaggcgtgagccaacgcccccggcctgaaatgcctattttttaggttagatatggtagtgttataactgttgatatcctttgtagtctgtacttaaaaactctgaaatggcttgaggcagttccacagcaaaaattccatatgaatgtctattcagataacgattcttatattgtgtactatattaatatacgtaatgtatttttatgtctattgcctaatactttcaaaatgaaaagaaatggaacaatatatttttctcttgcctttgttttcattggaaccttttgtgaccaccttgtacttattaacatctgagactatggcacaacgctgtggtgaaatgtgagccatcagtccaggtgggctggtgttcgtgtgtcttcatgatcgggtctggtcctcagctctgtaggtacattttacagaggtagtattatggggtgtgtggttaaaagctctggaaatgcactttgtagacttgaatccgaccccatcaatttcttagtgtgtatagttatgtaactcatagttatgtatgtaatctcagtatgttgcataacttagtgtgacgcagttatataagttatgcacataacatagcataaataactacataacatacatacttgatataacatacataactgttatgtacataatgtatatttagtacataaaagttacataatagacatatttgtgtaattaggcattaattccaaaagatgtagtacatgtttgtacctgcttgggttatcattataataaaaacagataatgtttgtaaatactttagctctaatgtataacacaaaattaatagccagtattagttgctgctgttaatattaatgttagtactgtgtaatcatctgaaaagtgcttgctcaataccaggttaaaaacagagagcgctagagcgacttattacaaatttacccaggtaatagaaaacccggatgcgcttcctcactctaagcagaaaatgtgtctgtgatgatttgcccttctggaaccatttccagttggtattaagtgaaatctactaaattttgtatcctgggtttctcttctctatactttgtgcagatacctctgtctccctaaaaagaattatttgaccagatacaatgcatatgattatggttattctagcttaagccagtttattataatagatttagttgaagcttggttatattctggcgtcagtagttttattaaccatgaagaggttatagctttagatttgttgattcaaccatgcattcttaagatgatgtcgcagacaccttaattaaacctgggtgttcctaaatttcctcagacattactttcaccatatttctaacattacacttagaagggaagctttctgcttctatgtagtcgaaatggtaaagaatcctagattttcgttttattagattgattagaacagaatgcaagtatagaagcttttaagtgaaaagatctatgtgaataaaaatatatgcctatatttttgttacaaaccagtgatttaaattttaatgcatatgtttatgtagagaagtatgtttgctattataataaacaataaaaagccattgctcatgtgactcatgaaagcaaacctggcaatgactttttctcatatgtctgcagcctaccatcacatatgcctaaatttttacgaatgtgtgtccagtatattgttataaccatctgcaatcaaatgtgttatgcaaaacaaatacttaattggtataactaattctttgattcaataatgaagatcatcacattatgttatttagagtaattacttatagcttaggttgggatggacacttttcaggaagaaaatgtatactttgtttctcttttttctgaaatagggatggaaagggtattaactagcattaaaaagggcgaagcaacaagcttccctgattggagtgtaggtcccaagcattttactgataaattcattcagattgagtaagctctttaagctctttctttctttcttttttaagttaaagtcatactctaacacctattctcctgcccacaactatacctttgagtaaatgttcttaaaactaacaggtacttctctcctaatgcctaaatgaactcaaccaccatggagaagtgatagttttgattggtagatacaaagtgatcatttcagcattgtattaagctgtacgtggattaggtagtagccaaagaaacagggtggccagagattttgagggaacaaaggcagaacagaaagtgagaagaggccaaaacaatacatcagtcgtgtaaatctgccttgggcactgctgacctatataaagctgaatatcatcttcagtgacatcttcggtgtacctgtcctggattgcctgtgcttggcttcgggcactaattttctttcctcatacaatccaatccattaaacgtctgctatagtttttctggcctgaagagaaattttgtttgtttgcttgtttgtttcggcctagttccaggcccaggataagatgaagcaaacactgctttcattcattcatacatcacatatatgcttctcttcaaccttctcttccttgctctctgacatacacaggtacttctaaagctctgggatatcccttaccatatagcaaacttcctggcaggagcagaggcaatagctctctagtagtgcttggggtagtgacagatactttcaagactgacagaaaaaagaaaacacaagctctttttcaggaactgtatatatatatatagtgggtcttagtgagatacaaatctgccactaaggtaccacttattaggccttataattgagatttacttgtggacctgaaaactctgcacagtccataagagaatttcctgtattccctgcatagtaggagcaagacgattatctattgtaaggttatctatattattccatttgacatttttaagtctattgaagtaagtgagaaatgtggacctttgcaaagatactgattgcccaaactaaaagaagttaaaacttgaagtggtaatttagtgttctcttcaaaggttgtttaagtacacacattattaatatacacttagtttatgcttttgacatagcagatcagactttacacctggaaaaattgtaaagacaaaggttaagtttgggcatggtggctcacccctgtaatcccggcacttagggagattctttgaggacaggagtccgagaccagcctgatcaacatggtgaaaccttgtctctactaaaaatacagaaattagccgggcacgctgatgcatacttgtaatcccagctactccggaggctgaggcacgagaatcgcttgaacccgggaggtggaggttgcagtgaaccaatatcacatcaccgcactccagcctgggtgacagagggaaactccgtctcaaaacacgaacaaacaaaaaaagcagagatcaaaaaatatctgtatgttcatctatagccatagctgtacctatgttctttaacttaattatacaacaaacatgatagtatttagtttgccaaaatgtaaatattttccacttctattcactcacctaggctggcttctttacaatagaccccaagcccattcataattgacctatcccctacttgggtctgcatatgatcataaataacagctctcgctacgagtcattattaaacaggaagcattccaagtgttaggttattctctgattcggagtagccatcaagaaaaaggaagaaacatagaaaataatttatagtgatttatggaatggcaactgagcctaactgtatgttagataaggcaactttgattttaaagagctgacactacgatagaagagagagatatccaccaaagataagcaatgcaaccttgttaactgctaactgagtcagttaatgatgtcctaatggtttgatggggagaaaaacctcagaaattaaatgttgaaattgtcataatggaggtatatgcaaggtactgtaagaacaaaagagaagccttatgaacagccttttaaaagtagaatggactataaagttccagtaactctgtctgagaaagtcaagaatggcctcatagtgctggctttggagataggataatcaatgggcagaaatatgcctggtgaagaaaaaaggagataaaccaagggttctacttgcacaaatgcagtttttggagggcccctttggactttgtaggtgaataaagagccaggcttttgggtgcatggtgtacagagtatcacatcatggaaggtgagactgaatagtcagacagaaggcagagtgaaaaggacctctcaggttcagcaaaagattgtaacatttatccaacaagcaacacgaagtcaagaggggcctgtttgtctactagccttctttgtacctccctctccttccctttggaacttccttatttcatttttctgttcatcttccttttttctcctcctccttctgctcctcctcttcttccttttaacccatctctttctcctcttcctctttctttttttttttcttttgcttataaatgaaggatgatcctttcaatagtagtgtggtggatggactaggattgggaaagatgattagtgtattgaataattagaaattttagtaatacattatgagggaactaatgagggccttccataagaaagtagctgataaaagcagatacaaccttgtatggcaaagacaggcaaaatctctggttccctgcctaagcctggtgtaccacaccaacgcctgacaccaaacaggcagactgtgaagttttattatttgcaaacaaacacttgtgaataatgcgtagcttctattttgtgatgctgaatgaattggtgatgcctttcccaaggccaaaaacaaagcttgtgtaaaatagtagtgaggaaaaaaggaagacaagttccacttttgttttgctaaattcggtatatgtctccaggataaaataatgtctgtattcaacaaatatctggaaataaatacgagttctagaataagggaaagaaggaaaaaccatctacaagagatgaagtttcattgcaatttttataggacagatgatgtaaagggttggttttctgttaggaagaaattaattgttcactttctgaatgaacatcggcaatttctagctgttagaaagtgaagtcatatttctaaagaggcactgtcacagagatacatttggaagccttcaaatatctttttgttcttttaaaattagcattttggcttttccattcataaggcagccagtgatcagaaagtaatttctttcttctttggaaagaaaacctttgccctaagaaaaatggcatctcttcctcaagattagcccccaaaatattaaacttggggtaaagcagccaattctgttcatggttatgaccaaaaaagaaaatggagagtttattttcttaaaggctgctcaagttcaaaaatttgtgtttgatccctcaaaattcatttcatgttgaatatgttacctgaacttaagttgagtttacaatatttttcaaaaaatactataacaacaaaacatttattttgatataaaattatgtttcttatattgttactttattttatttgaacctaatagttaactcgcaaattgcatatcttgctcaaaaataagctatttctttaggcctacataaaacattaaatgagaacacgacaaaactaactgattctgggattacataaacatcccctaatcttaatattaaattcatttcttttaggaatacattgcaaaaattagggaagaaaggttttgaattactttccagtatgaaatagtaaggtcttttaaatgtatggataatcagtaaaatcattttattagtcatgtttctgcttccttggcagaaaacattccagcttgactccacaaaccagcataaccaagtttgttatagtaaataattaatctgtacgtattggttgatgtttcatttcagcatccttgaaacattccatggaactttcatatttccaataaacaacttcaatcagtaataatatgcttgggtaaaacaaagaaaatgtggttatttctttccaattataaagctaagttttagaaaacagacatcagagaaggggtaccacagatctatttttaatattcaatacaagttagagctcatattttattttggtccaggattaagaaaaaaatttgtttggagatagtattttacttcagcatttccacattgagtcttttctatttctcattgtttgtgatgcttttaaatcaagggcactttgttttttagctcacatctgctccccccttgttctggtcagactttcaacacgtagttgctctgagattgttcaggagatctcagacaggatcaccacgaccttacctgagagtggtcaaaaaaggagcagatgcgtgttgtgaagattaagcttatgtttatctgacaaatgaccttaaagataaaacgcagaaagcaaaactcacaaatgtggttgatgcagagcaacgagacaatgttgtggcaattatttttaaataacttattaaactttataaaatgaaaagatttttttaatggcaaacataggtctttaaggaaccacagagtgcagttattgaattaaaatattgacgtgaacatatttttcaaatatgcttcaaatggtaagtatctgccatcacaaatattcaatgtttttaaaaatgctaatatatttaggtataggtcaagaaaattactaggattaggtatttgctactagcaaagcaatgccatttttcctagctattgctttttctattgagtaaattattgaaataattgtttgagtttatattttactcatagttgaggctagaatagtaacgccagtgtattgatagagttgatttgtttttgaattatagatctgataatagaaacagccctagaggtgagtccctgatgacatctcaaaatggttgtttaattttccatattagaggagtattatgatagaacaacaaacagagctgctttcagacaagaaacatttcatttaaattattttctttttagttaatttctaatatatttctaatatacttaccttattttacaggagatgcggacattaagaaagcttttctttattttttgccaaatgataaaaaaattaacactctttttttaatcatagatatatatattccgtatggttgaagtagacacattgaggattagagttagaagttatttgcacttagccaggcaaatattgactgtaattaaatgagcaaagataatttgaatgtacagataatttcaaccaaagaagatgccaaactggtcaggtgataaagaaaagtgtggtgagcttgaaagttccaaatatttttcaccatcttcttcatataagaacacattttcagacttgaagttcagctttctcaaaaatatttgaaatactgttgatgtgctgaacaggaaatttcgatgcaacttgcatctgtggacaacatcagtgtccctaaaaatgcaagaaatgatcttggtcagtatagccttaaataatccatttaatgaaagaaaagttgttttgtttggttttctcaatctttgggtagccttttaaaatcatatcattttcagatctccaaaaagccattattatcatgtccctttcatagaactaaaacatacatctacagggaatgatgaccttctcatgaattagtggctttaggcattataatatatattttaaaaaaaaagagttggagtggctagcaaaaaacatgcagacatttcataggatttttttcccctttccacttcaatgcatttatttgaaaactgcttatttgcctgaatttgccctgctggcaaaatttttctaccagatagctactttttattgttgatgcacatcatgaatagcagctttatttgatggcaaatgagatgccccaagttgcaagctttccataaacatatctgaattgttcaatttccttctcattgtataatttccaccctggccctttgcctgctgatattccgataaagatttcattcaagtaattttcaaaactgtcctatgttctttgctatcataagtggtaagattgctcaattcgtattagctataacacaagtgctgcacaggttttttatcagatatttctaaaatcatttctttgtcatgaatggtaacgagaataataaaataatgcctccagttgggtttgcaaacactggtggtttactagcaatagaattagtagtaatatgaacgtgaaaagtcacttttctaaagaacatatcttaatgaattattttgtttctttttctttcatgtctcctaacatggatttgaaaattatgattgctgaatgattccaaatgacttgggcctttgtttctcaaataggtaagtgattcttgttctttggtgttcttaggagtccgtggttgtattttaaaataaatattcattgccagtttgcactgttgaattttctggcaaaatagggtaaaaattgaacataagacaaatcatcattttcagaaatataattcagatctttttcattagttggcacaggaaacagactaacaagaagacccagtttgagttgtacgtattcataggagccatatgttcaaaatcatttaagtcctttttgctggctagcttttgtattttaaagcagcttggtcatattttgcccatgaagttctaggtcacactagactagttactaatcataatactgtatgaattacccaggtataagaaagcatttcatatggcagccagtaatggcttgatacagaataattagctaacaattttcctgatctcaaagatactaggctgaaaaaaagtttagctttaggttctgtagtatcgtcacttgtagagctgggatcaacaagctagtctatgggccaaatctgaccaactatgagttaagaatattctttacatttttaatggctgacaaaaaatcaaaagaaaaataatatttcataatgtgtgaaaataatgtgaaattcaaattttggtgttcaaaagtattgttggaacgtagccatgcttatcactttacatattctctattgctgttttcataccacaattctatggcccatgaatcctaaaacatttacattctggcccttaacagaacaagtttgccgattccattgtttgagtactagcatataagaggttaattccccgaacctcttactttggagattctattagagcagaggtgaaatcattatatatctgaccttttcttagtcacaagggaatccaccatatctaaaatgaccaggtcagaacaaatggaagagcaaatcttgactgtagatttaagttttcctgaaatagtcttttacatagttatatttctcatacattttaagccctacaacattcaacccattaagtctaatgtattttactgccagcaagtctttgagcttgcccacagatattcagagtcccatagttgatgggaactggggaagtggcattttgtggctagtgaagcagcaacatgttgtataatgaaaagaaatatcctcaaacttttcaatagttctcaaggctctgtttcaccaaagagaatactaacattctatagagactgcctgttctgaattacatttgacagtgttggaaaagtgtaatactcatcactgtaatccagcttagcatctaaaacaacacaagtaagtacagttgtgctttgtggaatagattttgcagaatttttcagaggccatgtggaacatgagtggttatatgcatattctaattaaaaaaaaaactttaaaaataattataaatatattgtagttcttttcatgttggcatttatcagaaatagatgcatttgtagtttgagaaagaaagaaataaaagagaacaaagaaagcatattcttggaatattgcaagagagagcaatgtagaaattgctggatattaagaatatgcattaacttctaggtttaggccactgggaaataaagcttccgtgcgtgtatttgatgtataatgacaggcacaaagaaaaaggcaaacatactatagatattctagtatggtacaattatacagtatgtgttctaacccttttcatgaaaatttgacattactgcacctcagatagaagcagcaggaatcaccagggaaagaacagctggatgctttattaggttttatgttgtacataaggagaccatgttttccattgtcagtgtgtaaaagaaaatgaaagctctgggcatcattaaagtctcgaaagcgtaagatgtgtcagctccattctctcaacacctggattgaaagtgcagtgtggggtcaccgtaaaacaaaaacagaccgtcttctctggttggaattgcaagagttgatttttagaaataaaataattcataattgttgtagagagaattcttcctttataactagagagttgcatgtatgaacataaacttatatgtctacctgaagacattttctataaactgcgtctgaatatctttttcctgcaccttaaggggtgctaggaggcttcttggagtcagagagctagaagactccccatttgctgccactgtggtattgtccttttgatgaacatttctccctggcttttcatttgcctccttttgtggaaccatttttgttggcatcccccacccaacacacacattatattctcattgtgtcccttgttgcaagtacctttatgttggagaccgttttaccttatacctttatgtaatccacaaagcttagcactgtgttcctcttattgtggtttaaagtgctgtattagttggctcaggctagtgtaacagaataccacaggctggatggcgtaagccatggaaatctatttcctcaccgtcctggaggccgcaagcctgagattgaggtacaggcacggtcaggttctggtagggtctgtcttcctggcttgcagatagctccttttctctctgtcttcacatgacaaaggggataggtagatggagagagagagagagagagagagagagagaactttcttataagaccacaatcttattggataaggatgctgctcttatgacctcatttagccttaattattgcctaaagatcctatacagtcacattgggggttagggctttaacatataaattttgagagaatatagttcagtccagagcaagtacctttgacacaaattgagttacataagcagaagagaggactgaatttttctcttcatgaaaatttaagagctctttgcctataggctttggccacttctgttttctccaagagttgctcatattaaatctagtaaataataaaaatgcgtttcaaatattaaaagatgttctatgttctggcgctaatctctactcttaattatcttaaaaaacgtacaagaaatttactattgattttattaatcgctcatgaacccacttatttacgtatttaacattgataggttgcccaaccatatgcagggggatacagactaaggggcttaggatctaaagaatgtcctgacaacattgtaccctttaggaactcctagctggcaagaaagacagtctcagagcaatgtgtcaagtgcttaatataatttgctcttgacatacaaatgaagcagtgcccacaatctttagtaaattagagacttctcaataatgatagcatctgatcatgagattgagtttgacagttgaagaaataaagggagtaaacaaacaccaggcaaaaagaatggcaagtacaaaccaaacacatgggtgaatgagagagctttactgcagtctgcaaaccatttatgctgaacaaaatgaagaaaatacaatgctcttaaattttgtttgtttgtttgttgagctcctactatgtgtcaggttccaggttatatgagtcagcatagaatggaaaacaacaataagctccctgttcttgagccaattttcaaaggtgaggagataattaataaatgattagtaaataagtgatcaagaactgtaaatgcaaagaagaatataaacatgaccttgatatagcaggatgggctaccgtgagcctccttttatggtcagagaggtcctcctgagaagatggtgagaaggagatgtttgatgtaaaattggaatgacaaaaaagagtcagccatgtgaagatccaggtatacagaacagcttctttcatatatcaaaaatatttttttcttaaaatatatgacatattaaccttactttaaaatatgcaagaggaaaagtgggaggatgcaatggactgaacatttgtgtcccacaaaattcatgtgttgaaatcctaatccccaaggtgatggtgttaggaggtagagcctttggcaagtgattaggccatgagggcagagccctcatgaatgggattagtgtccttataaaagaggcccaagaaagctctctagtcccttctaccaggtgaggacacagcagaaacatgccatctgtgggccagacagtgggctcttgccatactccaaatttgccagtgacttgatttggatttcccagccaccagaaggtataagagatgaatttctgttgtttataatctacccagtatagggtgtttttttgttatagcagcccaaatggactgaaacagaagataaaaaatagtaagatcagcagtggtagagcagtaagacattgaatggttgttaaagataggtgatgagtacttaggaatctgtgagaattttctctcattttatgtacctttgaaaataataatattaaaagtttttttggtctcaaatgttttctccatgaacatactgtttcttcttgatatattccttatttattacactaatataaagaacattatgataaataattcttgaagggaattgcattccttatctacttcagcatgacaaattaccccaaagcttagaggctcaaaacaacaataagcatgtattagcccttacagtttatgtgggtcaataatttgtggttttagcttgggaaacacccttaaaaaaaaccgtaaaaactcttatgagatttgagttaagatgtcagccaaaactacagttatcgaaactggcttgactaggtgaaggatttgcatcaaaggtggttgactcagaattgactagttgatgatgttggttggtggcaggaggccttagctcctccctgctgggtgtccccacagggttgcttgtatgtccttaaaatatggtgtctggctttttctgaagcaatccaagagaaggtagaaacatggcagacttggaaatcacacacccttaccacacatgattgtattggtcatagatgtcagccccattcaaggtgagaggggtctacatgaggacatgaataccaggagatggagataattggtggacatattgaaggctagctgccacagggagaaacagtatatttggtattaaacaaataatcttgacatcatgctcactgaattgatgccccctccccaaaataaatccctcattaatttgttgttttcaactcataactcacacaactatctttaaacctctgtatctatatttagtttgtagggtacacacttatataatgatgtctttcttctgattaggcacttaaattagctgtatttaatggaataatgatattaaataactttgtaaatcaaaaggtgaaaatatatgcctagaataaattatcaagactttgtccagtataatgagtggtgattattttccagtatactcttcaatttattactgtaataatcttttaaacccattaacagtcaatttgctctgtgatattaaaatgttagccacattatttgcctgttaatgtaggttaaatgttaattatgctgttgtatggcggctaagatggtacatccagaaattacacataatattggttggttctttggccgtcatacactaatgtgcttcattattattgtgctaattttagtaattttagtacaaactacataatactctgtgttactaaaacagaactacccatgatatattgcttgcaaccaaacattaggcaattttggccccatcatttaggagtagtttacatgactaaacaagtaatgattctgtaactctcaaacttgcatttagtgtatttagaatgaattgcttagtatattttaaatatttgtagatcaaaatgtaatcccttttaaaacaaatgtaagtcatgctttttaagctaaatgtacatttaaacttcattagtgtagtgattataaatacagctatgattattcctccagttgtactaataatagaatggcatatcaaccttctccctgggtccagttttattactcctcattctactcttacaactattttaaaataatacttagcagtattttgagaaatagggtttgttttagtaaactatcactgtgtaacttgctgtcacaaacttagtggcttaaaaccacactcatttattattttacatttctgtaggtaagaagtttaggctcagctacctttctgcagtaggttcacattcccggaatcaaggtgttggcctttctagaaattctacggatgaatctgctttttagctcatccaggttgttgcaggaattcagtgttctacagttgcaggactgagattcccatcttcttggtagctgtgggctggggttagttctcaccttctagtggctgcctgcattcctcatcggatacccacttcctccattttcaaagccggcaaaacgatcaagtccttttcaatcttcgaatctctcttaatccctttctcctttgtcctttctcccttctggcagagaagtttctctcttcttaagggcccatgttattagattgggcctacctgtataattcaaggaaatcttcttattttaaggtcagctggtaagtaaccttaattccaactgcagagtcccttcacagtagtacctgagggagtaaatgtgggaaagaaatctcccagcgatatctttggaattctgctttccacagtgttgttgtttgattagaaatttagagtaatgtaacctgagagagcccactcaggagaagttccatttaagtttagttctcagtgacacaaggaatcatggaaagatctggagaaaaccagaaaaagaccatgctaattgcaagtacaccataaagctgtaaggttcatatttgatttattcaaaggttcataaagcaaaatagataccactactaaccaaaacaatacgaattaaatacctcgcgttccagacctgaaatattataatatatataaataaataagcagacatcataatttgcgcttccatgttcttaaaacatttttgtagcaattttccctctttccttccctcttaccgtataattcccatcagcataggactataatgtttatttctgccagaaaaaaatagaagaatctatagtgtgtcatatctccccttatctctccctatctatattttctgctcataatttgtatttttttcttaagccacgtctaaaattcagctccttttcccccaaatattctatgcaaactgcccttacgacccacggtgactttcacattactaattatgatggccttgttagagtattgatctaaatagaccccaaattaggatttgacacagatggtcacactgtcatcattgatatactttcttcactaggcttccagaacaatcagccttgcattgtttttctcctgtctgcctggaagctccttctctcatgtatgtgttaatttcaccttcttgcccaaatccttttctttagagtgctccagctcagggtttttagacctcattttctatcttaaagtactttctaggtgatctcatcatttctcatggatttcactaccgtctctagctttactcctaagagttctacttttcttcctaaaaactgctccacccacacttttctgctcaactaagcccaggatttttgattttatacacctttttttcctctaatccctttcctgtggtgagaaaagcttttaccagacaggggtcctgatccagatcccaagagagggttcttggatcttgagcaagaacgaattcagggagagtccatacagtgaagtgaaaacaagtttattaagaaagtaaaggcttttaaagaacggctactccacagacagggcagccccaaggtcagctggttgcccatttttatggttatttcttgattatatgctaaacaaggggtggattattcatcctcccctttttagaccatgtagggtaacttcctgatgttgccacagcatctgtaaactttcatggcgctggtgcgagtataacagtgagaaccaccagaggtcactctcatcaccatcttggttttgatgggttgggactgccttctttaccacaagctgttttatcagcaaggtccttctgaccttgggtcgacctcctatctcatcctgtgacttagaatgactaactgtatgggaatacagcccggtaagtttcagccttattttgcccagctcctattcaagatggagttgctcttgttcacacgcctctgacaaagctatttgttctattttcagaatatgtccagattgcgttcatttcctttgccactgcctaaagtcaagcaagcactatctgtcacctgaattatggcaaacccctcctaacaagtctccctaatcctgcccttgccttcaggtatcagtgcccaccacagctctgacctctctcctgttagtctctccccagggctaagtcctcattatcttccttgctttttcttacagatgcatcacctgttggctctgcttcattatcttttccaacagatattcatttgtctggctctctcactttcttcacttcttctcccgaaaagcttcttctcggagaggcctttctttacattgcaatccccgcctgcacctgaggttttgtattcctgtttcctgccttgcttcttcttctcacttacctaacatcagcctagcctctaaattctgtgtgagaaggtatttttgtctgcttttttctcactgccagtgctagatgagagccttgaatataataggtggtcaataaataatactgagaaaaaaagaataaaacatgaaagtacattgatagatggtatgttttggtgctggctataacattttgaggtagatagtacaggtattattttctttattttccaaatgaaggcaattatacatcttgcccagggtcacaaaactagttaagtatcaaagattaaaccaaaactcaattctcttgactcctaacccggtttccattccactacaataggtgctaaaaatacaatgttgtctgttcttgggagctacagtacagcatccctcaagaacctggaaataaagaaataagattgccttctgagagtcacactatgaaatcgacgtgtaatgagtcacttaccttaaagagctagaaatgcttttaagccaaagggaccattactgattaaatggtttaacatttccaaagaaagaacattttaataagaaaaggcagacatagaggcacttcaagaggatactccaaagcgaaagttgggcacgtgaatcctaggggctggagtctaagccagtgaattatgagaattccagaacttcctgggttcacagatacatcagactctgttagttaatgacaataaacattggattcatctgaccaactcactttttttcagagaggcctttctttgtcaccccactttatattgcaatcgtgatcacaaaacagccttatgattaataattaattttccatgcagctctgcctgtctatagaagaaaaatcccttctaatatgtacttccagcagtctggtcccgatgttagttatttcttattgaaagttagttgaccttctgattgcagtatggcttttgtaaagcttacttttggaagaaaagacatcctgatttcactgacacctgtacgtccctgcgattggtacattaaaaaaaaatatatatatgtacacacacacattcatatatatataatatatatatatacatatgccgtgtgcagtggctcatgcctgtaatctcagcactttgggagactgaggcaggaggatcgcttgagcccaggagttcaagaccagcctgggcaacatagctattaacccaggtaattttgggaggctgaggtgggaggattgcttgagcccaggaggttgaggctgcagtgagccgtgatagtgtctctgcactccagcttgggtgacaatgtgggaccctgtcttgaagtaaatatacactgaattgtgattttatgtatcaatctcccttacttggttaattgaatgtgagtctcttctgcacctccctcacttccactgaatatggagatgctcttaacatttcagtgtgaaacaaaatcaaccactccagaacttcctagtatcattctgtactcgaagtgctgcacaaaagcaggctctgaaggaggctcctaaattagagacgaaggacagacttttttttcttgtatagagtcttaacagaaggtgtcaggtgaaattcagcattttagggaatagtgggtcaaggataattctgggttttcatagaaggaaggaatcctcttgcagagtagctgccattgttttggcaacttagatttttatcaagaggcaatgggaggggcacttgtcgttaaggtcacttgcaagaggaagcccagaggaacagctacacggaactggacacaagagaggcccagaagaggagtctcagtctttggttgtctctcaacagaagcaaattaggtttctaaatcagccagccagagaactaaacacacacttggtggctttctgatttatcaagcacagctggtcacaaattatttttaatgcttgcatgtatgcatttctatatgtgtcaataagttatgctttggtggtttctcccttttaaagtcttgaataatagttaacaaagcactcagggaaaatattttatttctagcaagaaagcttccttccttcctatttgtttgttttactcctgacttgtctttttaaattatttcaccttggaagataaatcttagggaagtttattgtgacaacctcaaaattctgttgtactatagtcagatctcgaataaataattaattttagggaaaaaaaagagcgacataaacatatcaaaacatactggcattgtgatggcataagaacacctgaatttaagtctgagagttaacaattcctctttaacatcaagatatcactcagttaccacagaaatgaaaaatgagccattgaaggtgaatagacaatgagtggcatgacttttatgttgggcaggaaacaaattatgatggcaggtgaagatattgatcatgagaatgagaaagggtagctccaagcccaggaactgggatcggcaaaaatgaaggaaaaaactgagataaagggttccttggttgagaatcgtaaggtgcctcactacagtcaccaggtatattttcccttaacaaagtggcagagtcatctacgttgaaatacaaggaggtacctccttagacatcaagaaggtctcatttatcagcaagtagaatggaggatcattgtcataattaaccaggttctctaatcagcctaaagctgttgagagtgaattaggaagcacttgttatattaacattctaagtggaaagagcacaacaatataatctggggtctccaacaataagagtcgcaggtttttttgtccttgcgataggacaaaaaaccaaacacctcatgttctcactcataggtgagaagtgaacaatgagaacacatggacacaggaaggggaacatcatactctggggactgttgtggagtgggggcaggggggagggtgagcattaggagatatacctaatgctaaatgacgagttaatgggtgcagcacatcaacatggaacatgcatacatatgtaacaaacctgcacattgtgcacatgtaccctagaacttaaagtataataataataaaattaaaaaaaaaaagagtcgcaggtatcagcattttactctagcattctagaggaccttattttaaactcggtgcaaaccactacagaaacacataatgaatgatttatgctctctctttttttttctgaaaaaaaaataaaaataaaaaaaggcctaggatttgaacatgtaggcaggagtgactatagaagtgttgtcaaaactcttgactccaggagtaatgacaagggcttctttacaattcgtgcatcattctatttcgtggaagatattctcatgcaggtggtctgacatcctgtgtctatacacagcagcatcagcccagagagagacatcagtttttacacaaaacagcgatatttttttttcccagagtctaaagtcaatgacatcctgatgggagaattgcaaggctacgacatgcttttcttgttcatttggtaagccatgaagaaattagaacatgattttttttttccaatagaagaaaactatgacacagaatgaatagtctcaaaaaagttcaaaacttttgttttgtaaaaaatggtcatattattgtcttcatcttagttttttgccttcaccttatttttcggagtgttcaaccttagcaacatcaaagtcatcaactgaaaagtcaccagtgggaatgaagtctttctattgagttgatcttctgttagttcactgtagaccccagatgtgggaagttacttctctctgtgacaagacggctagagagagcattcaggaaaatgcagatggcgagtatttcttgatttaaacagctcatttcacatggtccatcacataatccttttaaataaagtagtttgtctcaatagacttattaatcttattggtcatgtgctacctgtgtttgattgaatctcagtgtttacaacttatccacagaattatttttagaattgttcttttaaattctatgatgaaggaataaattcttaatggcttaaactttttcatagtttaaaaatttatttttaaaaatgttactcttacaaccaaccccctttatgaacctggtgctcaaatgaatattgtaactttgtagtctctctaagaagttttcaaagctgtacattgaaccagatgatatatttctgcgatgtgggccacccaaacatttggggtgctgtcaatagtgtaaaagatttgagcaattactgctacttctaaaaaggtgaattatatcaccgttccttgttttagataaagcatagttggaatttcttgacatgattgaggaccaaggagagctttggtcaaatctattttatttgaatcaagatagggagttctgaaacaaaaatgttcaaaggataaacgtacttggtatctaattagtcagtatgcctcaaaatagttcttgcatacctagggaacctttttttttgagatggagtctctctctgttgcccaggttggagcacagtggcatgaccttggctcactgcaacctccgcctcctgggttcaggcaattctcctgcctcagcctcccgagtagctgggactataggcatgcaccaccatgcccggctaatttttgtacttttagtagagatggggtttcaccatgttggccaggctggtctcaaactcctggcctcaagtgatctgcctgccttggcctcccaaagtgctgggattataggtgtgagccacagcacctggccgggaacctttagaaaaaaaattagtaattattaatactgctcagaacatgcaatggaaaatattgatgtagatcttctgaaatctcttcttggattaaactctaagaatagaaaatgtgtaaatgaattacattaattaccgcttcttcccaccactgctccttcaactccataccctgaattgtttttactgaattgcactttgaaattatgcccttgggccacattgaggatctttagaaaaaaacagccctgagaaactcattactttatttactgtaagatgttgtttgaggatgttgttctctgccttgccatttggacaccttttgagaacccccagaagagatagatctcaaagggcaataccaggaatagtcttctatttcctgaacaagtagttgttggtctcatggacactgacaattacaatttttttttcttttccagtttacactggagtccagataatacagatcaacctagagcacatctctacccttagtacagaatattgcagaattttttctcctggtctcactgcagtttcatttcattgttcctttgttaattttcctttgccttgatgcacttgttgacttaattttatttcgcggcatgaatttgcatcatgaatttgcatctaaagtctggaaaaagagtgtaaacaaccaaattgcctttataatgtgagtgagaccaaggcacctctgggaaaccaaaggcctagtcttagatgaagaatttggggaaagattgtcaactgaaatgtccatattttcatgaagtctctcagtgtggaagttcagtagaattaaggtgttatctgaatcagaatccctggaaacaacacctgagcataggtatttttttgaattataacatgtaaaattaaaagatggcatttctggcatggaaaagagcaagttcaaatgacctgaaaagggaaaaagcttggcatggtttggaaagagtgaaaagtcacacatggctgggacagaacgagtgaaagggaaaggtttgggagataaagttgagaagtagacaggccagatgtcaggcagagccttacaaaccataataagacgttgcatcccatttcaaacacgctagaaataccgaaggtttctttgttaagtcaagtttgttgaagtagaattgatatacagtaaaatttacttttttagcataaagttctgtgggttttgataagcacatggagtcaggtaagcatctctacaaccaaaacacaaaacatttctctcactccaaagagttctatcacatacctttatgatcaacccttcctcccatccccataccctaggagctctatcacatacctttatgatcaacccttcctcccatccccttaccccaggagctctatcacatacctttatgatcaacccttcttcccatctgcataccctaggagtttggctctgctttctcttgtatagttttgccttttccagaatatcttataaattagatcatacaatctgtagccctctgagtctggcttcttgcacttagcaaaatgcatttgctattcattcatgctagtgtgtgtacaccaagagttttgagtgggggaatgatacaaactgctttgagttttatagaaataactcctttgctgtggtaattgtgggagtggggttgtgaagaggtgattgtagcaggtgaaattaagggagaggataggtcacagcaggaaggtgctgagatgcggattcaggaaatatggtgaaggcttatctatcatgagtgctagtgatgcagatatgagtaggacagataattttctacttaggaaaaataatttcaaaacatttaatactaaaaaacaatgaaagtactaaaaggattcataggaaagtttaatataattttagattgaagaaaaacttattcatcaaaacaaaacataacaaaacgtggagaaaaattacaatatgaaaaagttaaatttgcataaggtgaaggacaccataatcaaaactgtaaaagtagtgtcagccagggagaaacattaatagcatatataaccaagtattgatgtacacactgtataatgagcagctatcaatctctgagacagataatccaaaaaaaaaaaaatgggtaaagtggagaagacaattaactgaagaaatatagatgtccaatatacatataaaaatatgcttattctcgttactttttgattcagcaattccacatctggcaatccattctatggtaatacttatgtatgtgggcatagattgttttgcatcaatagggaaataaatatgtaaatgttggtttattggcataataaaatattatgcaaccattaagaagaatgagctagatctgtattaaaagaatgagctagatctcagttaaaagagtgagctagatcatggaaagttctatgttaaatgaaaaagttacaaaacaatttgttcagcatgattctactgatagctaaataaaaagaaaagcacattagtgactatgtgtgcatgagagagagagagggagaatgaaagagagagacagaaagaaagaagggaaggagagacagagagagagtaagagagactaaattcagagaaaaacaactgtatgcacatcaaatggccaacaggttaatagcagttcatattcacagaggatcttagaattgggttgggtatgtagacgaaaagaaatacatttttcttacccatccctgggttcatgactgaggcctctataacaaaaggcagattaatagaaaaacttgcaaattgatttagcataagttttacatgatatgagaacttttgaaatgaaaacgcaatttatatattgttttggggaaatacccattagtaaacggttaaaatatgcaaggaatgataccatacagtctcaggaaagtggttaattcagggggagatggcaaagttgggcttcgtttctataatttttgactattaaaaaatataaagtatatatgacacgatatttaatgtttggtgatctagatgattgaaatatgtggacatattattttctgtttcctgatggtttgaagtttttgttattaaaaatacagagaatattttgcttagatgatgactaaagaagacattatggagtaacatgaggaaatatattaaatattgcctaaaataggggaaggaagaagtgtttagtttggaacagggtgctaccgttgtgacctttcttggattattataatacaaacagtaacttgcatctgttgagaagttattgtgtaccagatactttgcaagggcctttcgtgtattttatcatttaatcctcacaacagctgttaggtgatgctatggcttgagtgtgtcacccaaagttcatgtgatggaaacttaatccccaatgcaacagtgttgagaggtaggacctttatgagatgcttctcatttctctagcaaaagactctgccctctgaatggattaatacagttattgcaggagtgggttccttatctcatgggagttaagttcctgatgaaaggatgagttcggctggcccctttccctctctccctctgtcctgagtattctctctccctgtcatgccttccaccgtgttatgatgcagcaagaaggtccacaacagacgcagcccttctatcctggactttccagctaccagaagtgtaagaaataaatttctgatttttatacattacccagtctcaggtattctatcatagcaacacaaagcagactaagacagcctgtatcatagatgtagaaaatggacatagattggttttgaatcttattcatggtcacccagcagttaagtgacagaatcaagattttaaccaaagccttctgactcccttaaaagcttgtaactccaaacttccatgttctgtaataaatagcatttttctgttgagaaaggaaatgtggaagagactggtcctagccttaaatcagttgggttattaggaaataaagtagggaaatggaaagtaaagtttaagggatagaagaaaaaaggtttgggctaaaaactacctttccctatggaaataaaatgactagagaattaaaccttgaaagatccataaggattggtgtaaaattcttgtcttttcacttttgaactggtagttcaagcataagaaagaaacagtgtcttctcaggaagatcctgtttaaaatgtgttcctcgttggaaatgctaaagggtacacaggtttattggtttgcaagggctgttgtaaccaaatgctacaacctgggtatttggttacaaccaacacagagtttttgttgcaaactgtcataaattgtcagaataattctggagtctagaagtttgaaatcaaaatgtcagcagggccatgttctcttggagactctaggtagactctttccatgccttttcctagcttctggtggtggctgtcaatccttgtccctcaacttgccggggttagaactccagttccttcctctgttctctcattctttctttgtttctttccattgactttttataacaacactgcttagattagattgagtgcaccttactccgatgtgacatcatcataactaattttatctgcgacaaacttatttccaaataaagtcacattctgagctactgagaattaggacttcaacatgtctttctgtgggacacaattcaacccataacaacaggaaaaacacaataaggcaatcattataagttttatgtttcattcttgaacttggtagatattgagcatttaaaataaattaaaatatgttaaatgtataaataactatgagtatatatccacgtgcatctacgcaggccatgttttatttctaaatagtacatcatttaagtgtttagcaatttgtattatgtactgagattttatatctagataacaatgtatttagaaagagatttttaaatatcaccccaataaagaaaccagtggaagaaaactgtattaagtttcctccaattccttatttagaagagcatatagtattcaagtcaaataagttgttgaataaatgaccttttggtaaggtaaattattatagtaggtctgcaagatgagcacagtcattgtaggaaaatctgttgctgagtatgctttgtgttctttttcatttagttgttctgtttggttttgctttattttcttctctgactgaaagccttaacagaaacaaaagtgtttctctcatgtgaaatgattagctctctttctcaccctgacttcctgtcccgacttgaatagaaagcaatgcatgagtatctaaataggaatcaaatgttctttgacaaagatgcaaaagaaacaagaaaacaactggattttattcgtttctcagggacacgttcactgaactgcaaaagccaaaacacctgggaaaatctgcctaggcaggcagggctgtgaccagtaatggaaaatgcatctctgtgtgggcttagagggctgggaactatcatagactgtggctggagtgtgatcaagtaagattcaaaagagagagattatttcagaaccatatagcataaaactgaaacgcagagaacagataaatgtatgtgtctgtccttttaggcagaaagcatccgttttgaaaaaacatttacctgtgctgatttgaagatttcaatatgtgcctttccagagtacttgcaatcatcattgtgtagtgagccttcaaaaatgaaggcttgctgaagaacaccattacctgtgagtctgagtgtgttgtgggttgggtcatccaccagagcagatagggtagagagggcatctgtagaccactaagtaaaagaaaacatctgaaataccaccttctttattcagccctttggtttgtttgtttgaaatgaggtctcgccctttcactcaggttggagtgcagtggcttgataacagctcagtgcagcctcaaactcctgggctcaagtgatcctctcacctcagcctcccaagtagctgggactgcagacacatgccaccacactcaccaaatatttttatcgtttattttctgtagagactgggtttgactctcttgcccagagtgatgttgaactcctgggctcaagtgatctaccaaagtgatccagcctttcagtgccaggatttcaggcatgagccactgtgcccaacctcagccctctaatcaaagaaatagtaagctgcatagatgccaagtgtagaagttgaagtactaaatctctgctgtgttccagcattgctagggatgaaatcccctaagtttatttagcacttaaaataatactctctagtatccaagggcctgaccacttctttatcagtcaccacatgcaggaagcagtgtcagggccggcggggagtgcttaaatattctatttgcaaatgctctaagttgcaacagttagaatgtaatgcaaccccccccccaaatttagaagcccaggagggatttattctacccataagtagcaatgaatttgacacttgaagaaagttattgtgtataaatcaaaaattcagtgattataaattttgaatttttgtttgagatgaagggtggagaggaaaggtgggagtaggtaaaaataaatccatcgaggtaattgaagtcaatgaactttgtcagtcagtatctattatcataaaatgctataactgtcaccttgggcttatacagataatgaggactatctgtgttttaccaataaatttctttgtgttggtttagcacaagccttatacaagcactgaaaatgctaggagtaattttttttcttttccagttgacttttttttttttaacaaaactgtaacatgtggtttgcaattagctttaatttcaaactaaacatattttaagaagccaagtagtttttatgcatacaaagtttcaggattcctctcctctctgactttttaagcaaattgctgtgtctgggccccatctccacattttcacaacttaattcttagcactttcatctgaccacattctatattttgggaagcatccaaaggttttcttagggacttgaggtgggtgctaaaatatttttgtttgcattttttttttctggctacattagtttcttgttggtagtgagtgatttttcttaatttggtgattttcttatattaagattatgactttttaaattgcataggcaaaaattattagtttaaaattccagatctcttcatttctatcaggcatatctattggtaattttatcaatgtttatgctcatgcctagttagtacttcaattagcaaattaattgtacttttcataaaatacctttttaaagtaaggttgccagattaaatgcagtttgcccagttaaatttgaagttcagataaacaacaaatagttttgttccagttaaatttgaatttcagataagagcaaatcgttttgttttgttttcagacatactttttcacatagtaagtacctatacaaaaaagtatttgttattcatctgaaatccaaatttcactatttttttctttgttatttatttgtatatttattttatttttgtctggaaatcctactataaagaaagaagtataggaaaatttattggttaaaaacatgttatatatcaagctatctgtcttagttggttcaggttgctataagaaagaccttaggctgagtaatttagacagaatctatttctcacagttctgggtgctgggacctccaagatcaaggtgccagcagattcagtgtctggtgagggtctctccttcaaagttggcaccttctatatttcctcacatagtggaaaggagggtcaagctgccctgggcctcttttataaggacacccattccatttatgaggatggagctcttatgacgtaaacacccttggccccgacctcttagtactatagcagtggggattaagtttccaactggaattttggagggacatgaacattcagactgtagtattatctctaaaaatgtgtgtaattgactcagttacatttcaatgattagagagggaagggtaaatccaaatttaagatcttgttaactttgattcattaattcattttacaaatgttcaccgaatgcctaaaatgtcaggtcctaagggatgagcaaaacaaacttaattcttgccttaatgatatttataacttaacggagaagaacattaaccaaataatctcacaaatacatggtaaactgtaataaatacaataatggggaaggatgacattcatacatataggggaatgtgttggaaagggaaagtcaggcaagatttccctgaagaagtgaaatttgaattgttaaagaaaacaatcagtcaatgatacttgttaaagcacagtgaggctgactttagtcaggtctattgcaatagacatagggaccatgaaaatgggattttgcaatgggggagagaaattgaacgaaactccaaatatagcatgcacaagtgggaatttatagccaagaagtagagtgggggtcagtggatggaaaattgctaagaggaagcatctggagtaagaaagattcaaactaaaccaaccaaacatgaatcttgctgaagacagaacagagtgattaggtatcatctgggggatggtggaggatgaagaacctgctcatatattgagagtgatcaggtatctgtggtggaggattcttgctaaactgacttagcagggttcttgctaaaactggattttacaaggaagcacacaggagagcttaggagaaggaggctgactgaattttggttaagcaaaggataattgtcagaactaaaactaaagccccagtgggactaaattaggcaaagaagagtgtatcagtctgttctcacactgctaattaagacatacccaagactgggtaatttataaaggaaagaggattaattgactcccagttcacatggctagggaggcctcacaatcatggtggaaggcaaataaggagcaaagtcacatcttacatggtggcaggcaaggcggtgcgttgagaggaactcctttttataaaaccatcagatcttgtgagacttattcattatcaggagaacagcacaggaaaaagatgcccccaagattcaattacctcccaccgggtccctcccacaacatgtgggaattgcaggagctacaattcaagatgagatttgggtggggacacagtcaaaccatatcaaacaggtagaggaaaggaagtgaatttatacatagatgaggcatcaagaacaaaagaattgaaagtatgtgtcaggttgaacccagtgagcatagaaagtgttactaaaaattctgcaaaggaagtctaaccagatcaagcatgactcagcaagctatttcaattttgatactaaaactcaatggaaagatctaccaaggttttaaaagactagtaagatttgcatttgaaaagatgaatctagctgctcaaaagcaagaagattattgttgaaggcaccatttataaaccatttcctggtggcctgtatattcttgtagcaaaaagaaaatgatagctcaatgtatatcagatattggcaaactttttccataaggggtcagatagtaaatgtttcaggatttgcaggccatacgatctctgttgcaagttaataacagaaaggtataacaaattaatcaaagatttatgtgacccaagagccttcaaaaatgaagacccaaagatgtagggaaagctatctgtttttctgctaagtttagcgtagaatggacagccgtctagaaatgcgactggacaaaaggatatgatttgctgacaatagactgagagtgtggcaaaccgagccaggctgtccagacacttcttggtctctctgtgtaacatttcttcctccctggtatagggcacagccccactggaatgagggtcttcaaggaagaagggagaagggagagagtaacctttcagaagttttatgacttgctgtgggaagagagggattcaagtgtctatgacctgccttggagaagacgaattttatttcctatgaactcactatgggggagaaaggggagcagaagacagggggctgggagaagggcagacagaggctttgctttgagggcttctaatttcctttagttcaaagtccttgggatgccaaagcattatattttggagtattctcttctaagccacaacaaactaaaaaaatgaaaatcattttatcttaatacaaggtatatgaggcaattgaagccagcaggggctgacatcttctataatgcttaattgctaaagtctttccagtgcttctccattctgggtagatcttaaattatcttcacttttcttccctgctatatgtcttattttctgatatatttgtttatctactggtgattatcagctctgctccctatcaccacttgttgaactatattctccatgatttttaatattatctagtgtggtgcctcccaggcaatgttcatgacctcacaaatgggtcacttgttagccttggggcaccagggcagagtttgatgaggctttggatgggctggccacagtgatcatatatagctaaaagtggcctctttcattattcttgacagtatgagtgtattactattttctctctatgccttgacttggaaaaatttggaaaaccctgatcaactgtaacggaaagagtcagtaacaggcatatcagaggttctctggttaaggaagtagatattgaaaagagaaccattttggggtcagaacactggttctcatataccagctgatataaccttgggcaaatagtttctctaagctcaactgactaatttgtaaaaagagaataatagtagttgaacataagaagtaactgttatgctttttttgagagtatttaattagataatacttttaacttctagcatggtgttgagaggaaaactttctctgtcccaacttaggtgtgtgtgatgggagaggagaatgtgaatcaattgacaacagatagattaataggagaaaagttttaattcatatgcatgcaggaggcaggagcagtgagtaaccttgctgaatagccaaggataagcagtatacctagttaatgtcaggagttcgagaccagcctggccaacatggtgaaaacctgtctccactaaaaatacaaaaattagcaaggcatggtggtgcatgcctgtaatcctagctactcaggaggctgaggcaggagaattgcttgaacccaggaggaggaggttgcagtgagctgagattgcaccactgcactccagcctgctgggtgacagagtgagactccatctcaggaaaaaaaaaaaaaaaaagaaagaaaaagaagaggttctaagacttcagtgggaaagtatggaaggttctactgttttttgtttgtttgttttcatcctgatgctaatggagttttcttcttgactgaaagctccactgaaggagggtttatggcagctgaatttgtacatccttgtgttaaggatctgtcttctctcaagcaggaaacaccctcagaggggagttactgacagctatttttttgggaggctctgcttgaatttagataagaattttttttcttgttgctgcagttagttcagatgttttcagtttaaagtaacatttacaccagtctggtagattattggtcccttcagaagcgatagtatacccttgtctaagtcactgttctattcctacaactagactcaaaagaattgtcttaccttagaaagattcatcactttgtgtaacactcactttgtgtaccaccagttaagttcagcagaagacttaggtgtagaaaggtatttcagatttcttggcaaaccgttcacatagctggtaacaaagtgcatcatgaattgtgaatcactttcacatttttgtgctgataagaggacctctcatggtatagcccagagtaaactaacatgcatgacgtgatttattctaaccaacccgatgaaatgcagatgtgaatggaagctctaggcaaaatattacatggtgtatttcactgaagaggagaaaaatgtattgactagcaaaattttaaatatctgaaacccaaggtggtggtaaggactagaaaaattattttgattgcagaaaaatgtttttttctccatttctttttaaagaaaaattcagcatcaaaagcagatatcgcaggaatcagtcctaatgattatattctcctattgttataacaactgaaatgagaacacaacctaaatgaatttttctgttgagtttgtaaaaagaagtacatgttacattaaattcactcatccatgcatggatctttagaaagaaatagtttgaaaaaatttcaagtcttttagagaatgtgactaatctggtctgggtatttctggtcagggtgcatcttctctgctacagacaattcttgtgtctactcaaaatccatgtgttgaaacctattcctcaatttgatagtattaggaggtgggactttcgggaaatgattataagagtgaggctctcatgaagggaattagtgcccttagaaaggagggcccagagagattctctgtgccatcagccatatgaggactctgagaagacggcctgtaggaaccagaaagcaggccctctccagacaccaaatctgcctgcacattgatcttggatttgctagcctctcaaattgtgaaaaataaatttctagggttcataagtgtctcagtctgtttatgttgctataaaggtatgcctgaggctgagtaatttataaataaaaaaatttgatttggctcatagttctgaaggctgtacaagaagcatgatgccaacatttgcctctgataagggcatcagtctgcttccacttatggcagaaggcaatggggaaccagtgtagaggtcacatggccagagaggaagtgagagtgagagagagaaagagacagagagagagatacagagagatacagagagagaaagagaggagggaggtgccaggctctttttaactactagttctttcaggaattaatagtgagaactctcacagcacccccccgacactcacagtcccctggaattaatctgtgcatgaagggaccacctccattaggccccacttcaaacactggggatcagatttcaacaggaaatttgaagaggataaacattcaaattgtagcaatacattgcactgtaagttgtattgtgttatgacagctcaaacagatttagacactcactttgaaaccctttgcctgaaccttttgtgtcataatcctgctgctactgttgatgttgtacacataccactcattggaactgcaagaccaccaggttaccgtatgatcatatttttatgtgaatatatatattaaaaacctttaagccagagatatgcacataactcttattgaaattatgattaagcaaagtgaaaaggtgatagtcctaagtatcctttttctaaggaaatgattagagtattgctttacagctgttgactttgcaagtgtccttggagtacggcattccttccactctccccttcccaacccccgacccagtagttaatggtgggcttctagtacacacgctgagaatcatctcccactttggaaatgatgataactcagaatggatcataaccggactcgcgatagttttcatagacaggtaataaaaagaagacattcaacatgaaaaattaaaggtgttacgaagatgccaagagatatattcttcattttattgtagaattatcagaaggagatgaagagttccaacctttaagagcaggcaacagtaattttccgtggttctgtgggacaccttatgcttagcaatgaaagtgtgtaataaactctctggatgaaatattaccgctagcttccagaactttattctgtttatcctctccatgggattctgctataatgttaactcttagaatgctaagatttgccaatgtctgacacttccagttcatcagttgtggttctttatgtgaatatttgactagagagcttcagaatgttataacattctttaatggaaagggaaaattagttttcggatgtgagtttcgttttatggaaaactaaattttcttccatctaagaattttaacttatgaaattataggagacaagaagtatgttttttataaatagtggagtgtttctagtgtcatctgccttgtctgaattttcacatcaagtaaacattttcttagagcatttatgaatcatgaaacagtgtttgtctattaaacagattctggtcataagtttttcaagggcttaatttataattctctccagcaccttgattctttatgctttgtctgtattaaatttccatcatctttttccttttttcttattgaaattatttgggggtcaaatacattcatttttttgttattttaataaagaaaaccgaagctatgcatccaagagcacataagaaatttattattcatgaatatacatttatatgtgcaaatgtatgtataatagacttaatacgtgcttgtatcattgaaaaactttgttactaacaggctttgggaatcatgtctgtgacatgaagttgaaacaagacaaaaaaacttgagcaccaaatttgctcattggtggtttagcaactgtgtagaatttcaaggattatgtcctcattagctgatactgctctagatgtactatatttaatgttatacttttctgaatatactaatgttcaaaaaagaatacaattaaaatattagttaatatgcccacttcaggtgcaaacacattttacatgtgtctccgcacaattccttgtttatgtgtgcattttaatggtttatttagatcttatgttctgtatcttttgtgatattctcagtacatttagctacttaaatttgaaatgtgaaaattattctttccttcctaaattgatctctaatatgatagaaaatttttagtgcttactataaacgtcaaagttgggtatttatcttttatttgacaaaattcatatatatgaatacatgcatagtataacctttagtcagtgaacacccataaagtcaccttacttgagttaattaattcgaaaattatgcattcactacttacgggggtgttaaaattttatcttgcggtggggttgcaaactctcactgcaaatcccttaaacattggcaaattacagtttcacatataagagatagaactagtatcctgttcattcaagaaaagccagttagagcaatgttgtctaaggtggcctcttgatcgtggccaaagctgtcctgggactagagtgaagcaggtgaagtgcccggggtgtgcttcacactcttcagtctcccaagtgcccatcctgttcttgaacaaccctgaaagttgttcaagtgaggtgccttgggggcaaaatttaatgaagtcctcactctcaggatcatgcatctgtcccctgaattttgtacttgctacacaattgtctaggtcctggactgtagcaggtttcacaaaaatgtgtacagggtgcccctcctgtgtcactgagctgcagccagaggcagtgtatgcatgcagaaatgaatgacagtctcttggaaaccaagcgataatcttgtataatgttgagtgatgctagcaggtatgtggatgtaggccataactgagcacttctgaggcaagttgcatacttacctgaaagtgcggacccttttttggtagctgcatttttgtaattattggatcccatagaaccatgctcacttgtgagaaataaggggataatttgtgctcccaattaaagttttttggactcttgatgttgattccctgcaagaggatactggaacttgcattggagaggctgagttagggttttatggatagacttaagccaaaggcaatatgaaattgtccaaatggtgtagggttctctttgtcccaagagttatattcttgcaaggagttattcactggcctatgtgtgaatgaaaatatggccatctatagttaatgtattgggctttagtgttaggagacagtgatatttgaaaagtcatccacacatagtgaaaccattaataatcaagatctaatgaataaactcagccatctgcagagcctcctaaaacactgtgtttaaatacattgtagatgcaacaagagtgatgcaagtcagatttagaagaccaggctgttttccagaaagctgtaatgctctgaaatgtattgtaatgtttctgaaataatggttggattgttataacaaaagtgtgatggtttgaaaaaggcacaaaaaggggaacgaaaatttaaaattgctagtgcatatccaggaactggtatgggttgtggttcttgatctagataagtgctttgctctccttagatagttctagcctttgtatatcaaaggtaatagtcatactacattgcttgaaacggaattcacattttgatacatctcaccttacattggagtctccttagtagcgtaaatgaacctgatcatctctcagtatattgatgaatacaattcctgtacatgctaaaatgagggctccgattttgacttggtgttgaagtcccttcttagttgccactctctctcattctttttctggtgctgcagctttttgctgcctccttcttccctgggcttgtggcagcaggtcgagtgtattgggttatccagtgggctgattccaatttagatcctgtggaagactgtgctttagaggagggatcagcaaaccacggccacatgccaggtctggcccactgccattttttggtatgactcgtgagctaagaatggtttttccggttttaaataactgaataaaactttaaagaagaataatattgtaggacacatgaaaacttgatgaaaggcaagtgtcagtgtccacaaagttttatcagaacacagccacactcacttattttttgtactaccacagtggaggtgagcagagacagagttgataacaagagaccgcattacccacaaatcgtaaaatatttactctctagacttttacagatctctgccctagatagtccagggaaatgagctgaaagtttccataaaagctctgacgtctttgcagttgtcgtatagttcggtcttcaaggggtggaaagttgtgttgtggaagtgcatcctggaaaaagagcggatatgagaaggaaagcaaagggaatgaaggtggtgatattatttttttctggtttatattgacaatcttgaaactgaatcaagaatcaaacttctaaattcagattcatttaacaattcttaaaaatgctttatgttccagggatcaaggttggtgatttatgagaaaacaagaacactagcccattcacaaaagtcatctcaaaacataattatgcacttttctgaatgattgcttaactgtttcaattagtatgtctcctctacaagtagtgctctttatagggtaaatttaaaatctctacattcaaagtctttatcctctttctatgtttcttctctcttctccgttctcctgcctcccttctccctttacatctctatctacactaggtgtgaaacactggacaagttacttaagttctcatttactctcattataaatgagaacttacatactagggccttacttacatacaagggctattttagaaacgttaaataagaggatctgtagtactcagcatacacataagtaacacaggcaaattttgattcttataatgtgagttttcttatgaaactaagaagaaagtgattcagaagtgctacattaataagaaaaaatagaagttcaaaatacatttactgttctatagctacataacactttattcttgtgaaagtttaagaatgacctgctaagtatttcagttatcaaacctaatatatgctgggccatttgggtcatgatttttatccgggaccaggcatgtgttaccgttaaacactttcattcatcatttactagctaacagctaaacaaaactagttgtgtaatgcgaaatcactaaattgctgcagtagtcacttgtaatgaataacagaatattacactgccaataattacaggtgattaatattttctggtcagtttccattccaggatttgagttatgtggataactggaacattccaccttttatgagtgacaaaatcttaatccacatcaagagttctgtattgtcctgtgaatatctaaagctaaagaaagaatttagagactgtaaactacattgaaggagattttaaaaagggggagaaagggaaagagaaggaaggagggagagagtgaagatgtgagagagtaaaggcaggggaaaggagggagggagcaagaaaagaaaaaggaaaagcattattaaaaagtgtccggtttaggcatagtcaattcttatatcaggaagaggatattaaacggaaaagagatgcataaatcaatatcgtctctattttgagggctattaaaataatccttaagtttctttccatttctgactttgatgctaagattgctctccaaatattatatttttcattatattctatgccatttatagtttgtaggagagaaggaaataaatgatgaggtcccatactaaagctgaaaatttttaatctctcagacaacagataatcatgtcaccgtgcataaaacataaccatcagtagtaaatgtataaaactgagttgcttaaagtcatagaataattgcttctaccaactttgtaagaaagagtatactatttttgcataaaatgtaaattaaagttgaaatattatctgtgttgaatggaagtatacaattctttctcggtacagggaatcagtagagccttacaggaggatcttccatgttgcttttagtttgggtgaaaactgttatcactggatttgcattaaatgaagttccttcctcttaagataggatgattggcagggattaaggctttattactacaagatttctaagccaagcttctctttttcatgaataatacctacccccttatttattcatggtatttttgacagctgacagttcaggaagtatatgtgcttctgtattaactattaaagctctctgtttacatatgggtggagatggctggtacatttccacttactccaccaggtatgttaaaatcataagtgaggaaaaaattatataataaaataaattttataataaaataattaaaattattataaaataattaaaatataatattttaaaattattataaaagttataaaattattataaaaattattataaaattattattaaaattatataaaatattatattttaaaattattatataataaaataattaaaatattacaataaaataaagcaagacatgtggaagtattagagggaaatatccagagattatcaagccatatttagttgcaccttttctcgtggtattccatttcagtgattttaaaaaatatatcaatgatgagtcaactagatacaaatgttattacttctggaattcactttggccttgttgaactgaaatagttctatgtaaatgtatatctgtctgtctatctaatttgcttagttttacttctataatacaagatttgacctttatttttccatttattaatatcatatttccatggtaggtcttcctagagtataaagaaatcaagtttctcaaaaataatagtgttaatatcaaaattgcgagtgagtacaaagagcatcatgccaagtgaatggcttatctccagaaaagctgcgtcctggtgaaaaggggaactgagcaaaatgcacattttgattgtgtgtatcagataaattatagctgccagcaatcctctctatagggagaaaattcacaggatgggtttatccaaaggaaggaaaaagggtcatctcccctaccttgctcttgtctgagcctgcagttgctgttttcattcactcccacaggggtgattatagagcagcctcaacaccaaagcaggcaaaaaaaaaaaaaaaaaatgttggcggggcgcgatggctcgtgcctgtaatcctagcactttgggagggagaggcggggaggatcacctgaggtcaggagttcaagaccagcctggacatggtgaaaccccatcactactaaaaataaaaaaattggccaggtgtggtggcgggtgcctgtaatcccagctactggggatgctgaggcaggagaattgctggaacctgggaggcggagcttgcagtgagctgagatcgcaccactgcactccagcccaggccgacaacagcgagactccatcaaaaaaaaaaaaaaaaaaaaaaaaaaaaaaaaaagctggactaaagaaaaaaacaaactacaacctgaatacagtctttaaaattattaggccagtcttagtttttttggtgttttcaacaaaaatatcctgaaccattaaatctgggtttgagtcaagaatgaaataataagttgaagtgactagactaagttcagtgaaggaaaggaattgagagatttttcttaggaaatagataactgttgacaagtaaatagttattaaaaatatatgtcactgcagtgtcagccacttatttatttttaattaaggatctgttgacctttttggccttaaataattgtgttaaatagaaaatattgccatttaaacttctgtgtagattactgttaactataatttaggaatatgcttccttaaagtttttgtaagtttattttctggatcatttctcaatgacttgattcttaatttggtctaagtgctattttctgatgcttttatagagtttaccatgttggtttaaaatatactttgctgccagtttactaagagagtagctgagatgtactgactgaattactcttagttgcttgtatcctaattatagaattctttactaatccaaaagtaattcagcaaaaatacttgactcagtaaattcttattttaatccttgtattttactataaaaagatattttaaaatatttctttgagacagacttttctttcagtacaataagatatatgaatggtgctgggcatgctggctcatacctgtaatcccggcgctttggaaggctgaagtgagaggattgcttgaggccaggagtttgaggtcagcctgggcaacatagcaagaccctgtctctacaaaaagtttttgaaaaatgagccaggtatggttgcaactgcctgtagccctagcaattcaggaagccaaggtgggaggatcatttgaggccaggagttcaaggttccagtgagctatgattgtgctactgtaccccagcctgggaaacagagcaagaccttgtctctaacaaagatatatgaatggaattaaaatgttttcttggagcctcttgtcattgatttagaaagtctatttaacctctgttcggttcccaatgacaatagaatgtctttcttttctcatttattttttctgtcgtatcatgcagctctcacagaaataaagacagaacattaaacaggtgtaccttttaaattctaagattgtaattttattattgaatagaacttcacttttagtgctttccaaatgatggtgcctatttgatttcctttaaattcttctctttacacatgacgatttcacttgtgttgactagtaatctttggtttaacccttccgcactttttgttaagtctaaagtttaaccctttagactttctttactatgaaactatctaaactagaaacatactagggttcaagttaagataatgaagagtcatctggtattaatgggaaacaggagtatgtaaaacccgaggttctcaactgttttcttcctttcattctaggacaaacattgatgtgtgagatatccccatgcatttgagaacctttgcatagactgtactgcagccctacccctttcccacaactgttcactgctcacactttctcacccttcagcacacacatagaaaaaatagtactgaagtgctcagtagtagttaagagtgaaattaccgatgatttcagtactgcattttagccagaaaagtctaaggtaggcctaggaagccaattcagaccaagagatccctttctcaagtaggtcatgtttgtgccttgagtttctatggctctttggcatccattgtgagcgagatggacacagtccaggaaatatccctaaggaatagctactggtagcagatcccattatcaatacagttgtactataaaaggcaaaggcaaatgaacattacaataggcatttaactttcttttttttttttttttttttgacagagtctcattctgtcacccaggctggagtgcaccagtacaatctctgctcactgcaacctccgcctcccaggttcaagcgattctcctgcctcagcctcctgagtagcaggtattacaggcctgcaccagtacacctggctaattttttttgtatttttagtagagacagggtttcaccatgttagacaatctggtctcgaactcctgacctcaagtgatccacccacctcagcctcccaaagtgctgtgattacagacgtgagccaccgcacccagcttaactttcattttttaaaaatttatgtcaacaagctaaaattcctcttgattttgcattacagttaaaatatcacaaggtatcattgaagaagtttaggtgctcagttcctaaaggcccttataaagtcactttcctagaagccgttcccttttctccctaggttggttgcatatccttcttgtatatgcttagaaagtccagcatttaacatgcctagatcttgctgaatgttaattacctgcatattttaagcatcttttacccctgcatcctccattagaccgcaagtccattgacagtatgtactcaacactagcagagggctgggctcaagttctgaaacatgtgtgactttggatatcataatatccaatgaccacccacttgccatttctaccctttctattattcaattggtataattctgactagcagaagtattttaattcaaataccatcattttctgaaaataatcatgctacatctatgacaaagtgtcacctaaaattatttcctcattctcattaagtagaaattcctaggccaggtttatttatttgtaaatctcataagtttggatttaacagttcttgtttattaaaatcaattatgtggtgatttgtgagtttgaccaaaagctgatttccctactttattttagaaatttatatcttcagtctatactgtttttatatttggatataaaataaatttacattattcaaaaacataaaattcaaaagtataaaggaataaaattcaaaattcaaatataaatgaataagcaataaaaattatcttgttcccctagcccatccattgctctttccaatggcaactgatgttgtagtttcttggttattcctcctaaaatattttgtgaaatacaccaacaaattcatatactgtgtaaaaggtacattagtttattccctttgaaaaacaaatattgatatactatacaattttttgtccttgaaatttttatataacatattacagtgatcttaatccatacaagagaacatcctcattcactttataactagataagcattctattacatcttgtatacaagttgagttttgttcgttgtgtttcatttatgggatacaaatccagcaggaatttacacacaagtcaataatgtccccaagaccatatgaaagatatgagacctcgatccttggcaggactgactgtccattgtaccatgttgttaaagtgactgaaggttattgacttactgcaataggagttagatatctgatttagttgagtatatccatttcaaaaggaaaacccaggacttttggtgtttaatcattttgtgaaccttaccttaaccctttcccattagattggacataaacaatgcttaatatcagtgactaatggtattagttcttcagcctggcggccaaacagagcagttcagaactaatcagcaagatacaatcagatagatgccagaggtgagggataatttttattttctctgttctgactctctggagtttcctctttgcagtaatttaggtcatgtctatatttactggatgaaagatttatctgttgaattctttaaatggtggcaccaactaaatctagttctttgcaacagactttagaaagattaatatgttctatgctttctaaaaaaggtagtatagataagacttgtccctttttatttgaagttagaatgaaagtaacatttttgaaaattaccattgtcttattgaaactcaataggtaagtatcgttctccctaacttgaaggttcagctaatattttgttgagaacttgcactttgccaggtactattttaagagccctacctgtattaactctttgagttcctataaggtaggtgatgatgttatccccattttatagaatgggggaactgagaagcagagaacttaaggacttgctcaagaaaacagcagaactaagatattgtaaagccagaattagaagcaaataaataacaacaaacaggacatttggctccagtgtcattactttctatggctaaatttatgcgacttctcagaggaaactctagttccagaagctcaaagtcatgtacctgcaaagtggtaaagccaggatttgaacccaaatctgacatcaaactctgtagttttattcactgtataaatagagagatatgattaaatatatgtattgatatataaatataggtaaatatatttgaaataggctatgtgattttgaagtgggtgaattttctcttgtgccgtctctgaaccggtgttagatttcttgaactgttttatgattccatgctatggttaactatgcaattacttctgcatagatgcccgaaaaaatctttacttaagatccattcaattcgtgtttcttcggtaaagtcttccctggccatgctttccccaacccggcatgcgtaacaagtcaagattatcagtcactccttgatgtcacttctgtgtcttcttttttttttttttggagatggagtttcgctcttgttgcccaggctggagtgcaatggcgtgatctcggctcgctgcaacctctgcctcccaggttcaagcgattctcctgtctcagcctctcgagtagctgggattacaggcacatgccaccacgcccagctaagttttgtatttttagtagagacgggttttcaccatgttggtcaggtttgtctcgaactcctgacctagtgatccacctgcctcggcctccccaagtgctgggattacaggcgtgagccacaacgcccagcaacttctgtatctttttacataacttagttaaggtacttaccaatacatgcatgccttttgttaatctgcaatacctttatataaaatatggtgacttaattttgtatccaaagtatgttacatgctatctgactcctggtatgcactcaattaaaaaatgtaggaagtctctgtgaatgtattctggttcgagggttgcctgattaaaaaaaaaaattaaaagtcaatgactctgacaccatcctacatttgtctaacttaatacgtcagtagctgtaatgaattagagctctataacttgaagaaatgtgatattgtttgataaagtaaatatagaataaaatctttgtacgtcgtttgttcagatgaacattttaaaaataataaatgacgtttatcctttgtccccatgtgtgaatcaagtctgtgatatctctaaactctggtactctgaaatatctcttcctgacctgctacttcacttcaatacactccttcactcccgcagagcttgctcttagcttcagcaggatctcttcctgttccatccagatgccctttcctagccttggtgctcccactcatcttctaaatgacagccagctcagactccattcacctttctagttcccccgagagagtctcaatcccatgtcaactcagttgttagctttcaccctgcacctctcagctcactgcatacaggcggagcatctgtctttttatccccagggagaagcaaaggtatttggattgccctaaaacactcagggaggacttaacggatagtcacttctaaagcactctttctgttccaaccctttcactgtgtgcctctgtgcagtagagaagtgagtctactaatattaatgtgtgaaacaaggaacacttatcaaagtagctgccatcagtgagccacctgaagtggaattttatttgtcttgtactcagcaccaaagcagaatatcttgctttttttggaagaaatcaaaataacacagattttactttggaagatgaaacacactagcatgtctcatctgttccttcttgatgatctgtcctcctggaagtatgacagtgttgacgtagatgtactgagttcatggaacacaagcctattatcgttcctctctgtcatatggaaagaggagaactgagagattgagaaaaaagttaaaacacagaggacccaagtgtaacgtcatgttaaaacatttttgaaattatgcaaagagaaataactatcaaaggagaagaatgaaaatcaatgagtaacaattaaaagacgggattttttttagaattcaaaaattaatagaattggtagtgctttattttcttatacaacatttatttagtgatatctaaacgttctttggctaaagtgcaccttctttttttctccctcttccctccctccctctctccctccttccctccctccctccttccctcccttccttccttccttccctccttccttccatcatcacaggtgtgagtgttacagagattatctcaatggttaatctgtataaagatgaatatttcctttatttctctccgctgattagcgctgtctcaaatggcaaatgttttaaaccctgatcttttgatgcacttcctgcagcctcaccccacccccaaactcaaagagagtaaaatcacagtgttcctttctctttctccccgtgaaactggcaaatccccaccactacccttgctaccccacccatcaccattcatttctaaagcagacatttagaataatcaggacagcattttggcagggcgcagtggctcacgcctgtaatcccagcactttgggaggcctaggcggggggatcacgaggtcaggagatcaagaccatcctggctaacacggtgaaaccccgtctctactaaaaatacaaaaaattagctggacgtggtggcacctgcctgttgtcccagctactccggaggctgaggcaggagaattgcttgaacccgggaggcggaggttgcaatgagccgagatcacgccactgcaccccagcctgggtgacagagggagactccatctaaaacaaacaaacaaacaaacaaagacaggattcttacacttcctgtttccatagaatctatagaaggtctaaagtacctaggatgccgtattagtccacaaagccatgatcagatttccagtctcttgagcctagcttagatcttcagaggcacaatgcaagacggtttttaacagagaaaatgtgcatgaaggaccttttaaattatagcttctaaactttcagcatcccttcaatgatttcatactctgactatttttgcatcttcctgacatttgcagttcccttgaggcatatattacagtacacacactacccatggttagataatcacaagtttagatatttgtgaatgtttcagctgtgaagaagaaaaatgacttcaggcaagggtacttgtgaacatcatcattgaaaatctcagaaaattccatttgcatatatccacatatgtgagcacttggttgattctcctcctttacttttgctactattttgttttgctttaggtcttcctttcttttcatttatttttaaaccagagtacatttatcctggacattttctgatgtttatggggggtgaggggctatgtgaaacttgatgccaattgacatgaaatctatttttctgaagagaaatttgaggtatctaggagaatgcattttcaatcccttctcaccattaacgtgtattaaatgcccaagctaagtttgtccttgatgtttgcagagaacctaaaatctctggagaaatcagatattttagggtcataccaacaaaggaacacatgaaaatgaaggttactcagaaacaagctttttaaagctgaggcataaatggcagagctgcccattgagtaaaatgttctgcaccgtaagagtgaaccggaaatggatagaaaaataaattaacatttaaaattatactttgtgtttaagaattgagaaaatttgataggccctgtaaaaaacaccattagaatgagaacattctaaattacatcgttgaaatagtagaaaacacatgtccttttttttttttttttaaaaagtctttttttaggtgttttaagtaattctctttttctttttcttcttcttttttgtaatttcaatagcttttggggtacaagttgtttttggttaaatggttgaattgtgtagcggcgaatcctgagattttagagcacctgtcatctgagtagtgtacgttgaacccagtatgtagtttttctccttcacccccttcccaacctctttcttctgagtctccaaaatccattttaccactccactctgtctgcctttgcatccccatagcttacctcccacttacaagtgagaacatacagtgtttggtttttcatttctgagttacttcacttcaaagaatggcttccgcctccatccatttgctgcaaaagacgctactttgttctttcttatggctgagtagtattccatggtgcatatataccacattttctttatccactcattagtcaataggcatttaggttgcttccatatctttggatttgtaaattgtgctgcaataaacatatgtgtgcaggtgtcaaaaaagatctatttgtaatgtttcattcctagttgccaacatgccaacaaaatacttttttttaatgacagagaacttaaaattgatgttgaatttctgtttttcttttgttactttttacaagtatctgcaagtttcttgctgctaggaagcataaaatagaaactatttgcatatgcatttaaaataacttctgacttatatcttattttcattaataaacttcagctacttcactggaaataattttattaccaccttgtatatagttgataagaaatgagactctagaacctcattagcatgtttccttagacacataatttaacctcaattttctcatctgtaaaatgaaaataataattgtgctttaactcaaaagccaaagtttagacacatactgcactgtaataggcatgatgttcaataatgaaatagctattattattattttgctatagagaaagatatataagtaacattaaaatttggaaacaagttttccatattttcctattaattaaaatatttatttttctcttttattgttttatatattttatgcttttatggtcattgcaggaatggaagtttaaggctcaaacttgcaataagtagagccagttttaattatttatgctgctgatactcaaagtttagttgaaattttaactagtttttggtttgtttaaactaattcaaagtttagttgaaatttaactattttttggtttgtttaagtccctaaaggtagatatattgattttaacctaaaagctgttaacttaggattctacactttgccatggaggaaaagaggttgactaagtgcctcctttgagaaacttaagatttaattaacatttttcctttccctctgcttcatccatacttcctttcaacaaaagagatttttcatcctttatgtactttctaatattccatagaggtttatcactttagttttcataaacttgcaaagatgatctcaaataaacggcttcaaaaataggacattaactgtatgtgtttaaggagggaagagattgtagttagaatacttaactaaatgagttctatcaaacattggagaagtactttagaaagagtttactaattgacaaatgtaaaatatgccgccctgaaaattttcagatgtagtatggtgtaaaatatgttcacaaataaacctaaaaagcatggtgagttttttcatatatactctttaaacatttggtcatgacaaatctatgtgatgtttgggtggagactagtgctcaattatttcccagaatgctaaaatctaaatgtatgccaaccgaaagtctttaaatcagatgtttattacttaaaactgaaataggttaacctttcctagatgctctgattaagcttagtcctcaatgactgatgtacactggcttacactaaagttattaacctaagaatcttcccagcaagtccatctctttcttgatattatgatctgtgaagtttgaacaaatgttgtttttcttcaatgttatttatctttaaaaaaagtccaggagtagaaagtattcctgatactcgataaaccagtcctctctgaacaaggaaataaatacctctctccaacttttagaaacaattgaatgacagccttctagtctcctattactgagaagattatgtgtggctttaagacacaaattgtaccttattagtctatatggccctctacccagtactttgcctgaaatataagtgatactcaatgaacgtcattttaacaaataagataataaattaatgagcagatatagacctttttaaaactcatatgacattttgcctgctccttatagagtcacaaagtatatataaataagatgtaattagaatttgtgttaatgagaatttaaaatattgtgatatagaaaatggctgtagactttatttacagacaagatactataaatttcccttcccccattgttacctctaaaaatttccatgatttcaaagctgttgagttcattgaactgttaattcttcctcggaggcagtgcaatctctgcaaaacaaaaacactctggctctgtggtttacaataaacttcaaatatgaagggttttttgtttgtttgttttgtttttgtttctgtttttgttttagacggagtctctctgttgcccaggctggagtgcagtggcatgatcttggctcactgcaacctccgcctccggagttcaaataattgtcctgcctcagcctcctgagtagctgggattactggtgcgcacaaccacacctggctaattgtttatatttttggtagagaggaggtttcattatgttggccaggctggtctcaaactcctgacttcttgatccgcccacctcggcttcccaaagtgctgggattacaggcgtgagccaccgcacctggcccaaatatggagtttatttgcttgttttaaaatatttattagagaataatgtgagtaattttagtcagtaatgtgcagttattttaaaattcaaaattattatcatttaaaatcttttcaatatcccattgtaatggtacccaagcgacatttttgtgtggtagtgtatagatctagaacatttatctgaagataaataactttgaaacagagtttaacaatgattcaaagcttgggaaaagcctaaacattcatcctgatatatccgaggaagtccttcctctagaaatcttttacacctattcctatggaaaacttagcttgaattatacaagtttttcattctgtgaggtctttgggatgaattcctcaagtgaaatgagacacctccattgataaccctctcagttacatgaagttcctgccgcacagtaagacattgtatgttttcctgccttaagtaaagacactttgttgcagaatttaggtaacttactcaaaaccctcagacacgtgagtgacagagcctagaacacagttatcctaacactcgatccaggaatgtttctatcacatcacttctaatcctaaatctaaaagtgaaatctaacaatagcaaccaccacaagaaagagaaataaaaacatgaaatattgtcatgtaagtcaatttgtaatgatatttatgttttactattctaataataactaatgcatattgagtatttcctaatgaaggtaaaatgcaggtaatatgcttaacagtacatccactgcgtactgtgctaagtattttacctgcattttattactttatctttatgggaaccatcagaagtgcatattaatattatctcattttacaagtgataaaaataggactttaaaaagttcaataactttcctagctattagatgtcctgactagatctgacttcagagcttgttcttataacccatctatgattccaatttacagtatcttcaggactaaagtaaattgttaatgtttaacactttaaaaaaagataccagtggaacacttgattttctaaagcacacagagaattttcttttagcacgttaggtatagaatgtaatacatttaactgtaattcagactgtgaaaattaaattatagaaaccttgtagcagcatttctttgagtgttacatcaggtacatttcagttaatatttgaggattacaagatattttattaaaatatgtttttctaactgttaaaactcagagttaattattttttcagccaggtaatttttttttttttttttgaaatagagcctcgctccgtcacccaggctgaagtgcaatggtgtgatcttgtctcactgcaacctctgcctcccaggttaaagtgattctcgtgcctcggcctccggagtagctgggattacaggcgcccaccaccacactaggctaatttttgtatttttggtagagacaaggtttcaccaggttggccaggctggtctctaacttctgacctcagatgacccacctgccttggcctcccaaagtgctgggattataggcatgaaccactgcgcccagccgataatttttttataaattagttctgcttgatcaaacaggaaaagcttgaaggtcagagtttgaagtatttctgacttatttatgaaaatgagagaaaaagaatgctcttgtcttgatgaaagccttattaagccgctcacattcccaaatttgggatgttagagtgaaatcttcagcctcggccccattcatgaaaaatcttggaagcaagtagtgatttctcaaactgtgatgccacccatttttacaccaaatatcagtgtttctgggactatcatgcccctggtgggtgtgtgatttagaatgctaatgagcgttggcagaccaccgtagctcctgctgtaatcctcacactttgggaagctgaggcaggaggattgcctcaggccaggagttcaagaacaacctggccaacatagggaaaccccgtctctcaaaaaaaaaaaaaaaatgaaaaaaagaaagaaagagaagaaaaaaagaacatctaatgaaatcctaggagaaacctaggtcgaatcaagcaccatgttgggtccagttggtcttaggtcgcttgacctacaccctggattttcagggtcttatcagtccctagcttctgcagctatttgaagtttccttttgatagtcatgtgaaactgctgcctgaaattttctgatctcctgcgatcaccctgtattatttctgtctcaaaaggaaaataaagcttgagaccccaattcactctaccaaaagaaaaaaaaaaaagctgaaagctgagtcgtacaagaatccgcctttccttttgttcctaagcagatagctacaggcagaaggttaaatatccccacaggtagctactctatgttcatcttatcttatgtaaagtgtcagtttactgagctccagaaaaatacataattgactattgccctagctgctccttttgttctgcaccttgtagattcagtaatgtggccataccattcttcattcacctccatcctgcttttccccttcaaatatcgaagccgtctaaatcatccttagagaaaggctcagacttctcttttaggcattgtccttaaccttggcaaaataaacttccaaattgatcaagaaaaaagaaaaaaaaatgagtttcgcttgtcccaccatttacccctgccgagtggtcagatatttgtagcaaatttagttatactctcttaatatctataagcaatccaaactccattctcatagattcacacatacacacacacacacacacacacacacacacaagcagtttttttgtaaaggtactattttgttaaaatgtgaaaggatgcagggttatcttttcaatgtatattcaacaaatgaaaagatttttggcaccaggcatggtggctcacacctatagtcccaattactcaggaggctggggctggacaatcacttaagcccaaggagatggaagctacagtaagccctagtcatatcattgcattctagcctaggcaacagagtgaaaccttgtctctaaaaacaaacaaacaaacaaatgaaaaactatgttgggatcttcccttttgttcttctcgctccttctcttctttccccacctctttatttctctactttcttcttttttaaagtttgtttttggcatttctcaaattattttaaaaattaaaggcatccttattgtaattttctaatgtttttaatttttattctgtgttgtatatatttaaggtgatacaacatgatatttttatgacttctctcacaattaatatcaagttccagtttgtggtgtgaaggaatgatgtgtttcaagtattttatcatggatcttcaatttgtggccttttactaccatagtaaattgactgtaaattagaaaggaaccttaatacaccaataaaatctataaaaaatttgtctgaaagagccatgtctctaaagacaatttttaaatagagacaagatgtagcattttaatacatagaatgtaaagtaaattcagagtttacgtcagaggggtttttctgatttatttatttatctattttgttgttgttgttgagacagagtttcactcttgttgcccaggctggagtgcaatagcacaatcttggctcacctcaaccttcacttactgggttcaagcgattctcctgcctcagcctcccgagtagctgggattacagccgcccgccaccatgcctggttaattttgtgtttttagtagagacagggttttaccatgttggtcatgctggtcttgaactccggacctcaggtgatccaaccaccttggcctcccaaagtgctgggattacacgtgtgagccaccacgccaggccttatttatttttttaacccactttcttcctccatagatgtatggtgatgatagagtgcccacttgctgactgtgcctatgtgtatttaaataatttaaaatttaaaaaaaaatccagttcctcatttgtactagccacattttaactgttcagtagccccatgcgggcttgtggctactttattaggcaccacagacataaaagatttccatgatcatgcagtgttctattggacagtgccacacaacatactttggtatttaaccaggaaagtcagcagtattgcagaactgtgtgggttcaagccaatgttgtttaagggtcaacagtatttatattttatatttatatatttcttacatttatatttactttatcttctttcctttttttcttcttcttccctttttccttcctcccttctttccttcatgtcttttcttcatgtctttctcccttttttatttttaatttctttgtaatttctctttttgaccgagttcattaacttttttttaaaaaaaagaactatttcagcaagaccatgacattggctcacccactttgtattcatttaggagtgtgtctgttttctcacccccacctggtatggttgctaaatccagatgaggataaagagcacagatgttctcctccactgtgtggaagcctaggctacactcttgccttatacttgatcatgtcaaacgcattcactagaaagggatacaaagaagattctaagattgtgattttacctataagtgtatttaaacagcagcaacctatgtccagaagagaggaaacagattttccaaatatcagtcttgggcctgggtcattatggggaagtgggatcaatgagatgaaggtggtaagatccatgtccttaaggccagtccttccgccccttcttccaccttaaccacgcagcttagattgcaacccagattcctattttactcgacctgtaggtaacctgtaaattggttactctcctcctggaaaatctaaagttgttatatgagaaaaagttccagtcaagtactctggtgtttttcttgatgtatggcatcttacacagtttggctgtgtccccaaccaaatctcatcttgaactgtagcttccacaattcccacgtgtcatgggaggcacctagcagaaggtaattgaatcacggggatgggtctttcccatgttgctcttgtgatagtgaataagtctgatgagatctgatgggtttatagagggaagtttccctacataatctctctcgcctgccaccatataaggtatcccttgctcttctgccataactgtgaggactccccagccatatggagctatgagtccattaaacctctttcctttctaaattacccagtctctggtaagtctttattagcagcgtgataacagataataaagcaactatgatcaaaatgtaatatgaaaaaaatgaacattatatttttaaatagcatgtgtgccacttacattttaaaaacattcagtgatcgagattatccattattcctgtaaaccctgcactcattatacacagtgtctgaagtgttaatagttcttattggaatcattgccctgctgagttcccaacatcccaacaattcagcacatctcaccagtctctttctctctttcagcttgcaggtaagcgaatgaaagttttccctcccttccctatgccttctggatgtgtttcagtccctttgaatttcagacctgccttcattttagacactcttctgagtgctgaatgccacagtttgaagttcactgcatccccctcaaaaggcattaattccactcccaggttctttctctctgttggacaccaagggtctatgattttggaggagaatattttattatattaatgtatttacaatgccaagtattgtacaagtttagaaaggaagaagaagacaaaacactttcctaaaaaattgcttataacctgcagtattcaaagtcaagttttcattagaaacctttgaaatttgcattatagtataatttataaacatcaaaacaaaaagcttttttaagaaatttttttgagacagggtctcactctgtagcccaggctggagtacagtgacacaatcacggctcactgcagcctcaacctccccacctcaagctgtcgtcccaactcaacccccaagtagcttggactacaggtgcacacctgtagtccacctgtagtccagcaagggacgtcttacatggcaacaggcaagagagagcttgtgtaggggaactctcctttataaaaccatcagacatggttttatagcatggcaaagacctgcccccatgattcaattaactcccactgagtctctctcttatgacacatggaaattatgggagctacaattcaaaataagatttgggtggggacacagccaaaccgtgtaagatgccatacctcatgaaaaacaccagataatttttttgttggaattttagtagagacgaggcctcattatgttgcccaggctggtcttgaactcctgatctcacatgatcctcccagctcggcctttccaaagtgctggcattataagcatgagccaccattcctggccgaaagcattctttttttgtaaagtgatgtactttagatggtttggatcctctcttttactgtcatctattttccacatgctttctaatcccttgagacttaatatttaaaaatcctaattttagccaggccatgcataacagatctgtggaagaaactgcattgtgaaataagacctgtcaaagcaacaatatttaagggcagctttgatgtcaaattgaaggctggcattttagtttggaagtatattcatctattctttgacttcataaattatatttagactactagtggctacaataatgaaattactgtggattgtaaacatgaggtattgctactgtggtctaccatgtatccttaatcgactcagtttttaaattgctaaaattcaacctatttgactctgtcagaagagctttaatgttcttcatttgtgcaaactttgtttctgtcacccttgacaaatcctaatagggattaatttagttacgggtgacaggataagctgcaacggcaaccctgcattctgccatggatccaaactagttgtgagctctgtttttcttgctgcaggcagaaagtttgctgaatctacaatggacaccacaatgcctgactctcgtttccatctcttacttgttcttgtttaacataacctcgttcttgtgtggcccaatttaaaattatatattgtggaggtatttgcaattgcagtaataaatatgtgttctacacttttttaatcacttgccagtctgcattagccttttaattattaataaagtgaaatccattgatttcctccagttgttcgaacatgagtctgacctaatcctgcctcaggcttgaggggttctgagatgaacagcaaatccttgagctaaacattaattttgtgggatttaaacatagtactatttttttattcctaacagaagctatttctttgtcttttttcttctgaatttgcagaagtattatgaactttggtctgttccgtgttatacatacgaaacaaatcttgaacaaaacaagtttgtgatgccactaaaatttgacctttcttattattttgtgctgatattagaagttttatcattgatgctcataaaattgtaggttcagaagactgtaatcacattttaaatttaagttgagcaccagtcattactacatcatttttgtctttctgtgttaggaagagctctgttttcctggttatattttaaaccatatttaagaataaatttgcatttattgaaaattttcttaatgaaatctcattttctattttctttgtttattgatataatatcaattaacatatttttattctgtctgcctatagaaattgaataatgtatcaatttctcttctcaatgtccttttacctgcaaaggtgtggtaagcaggatgaaaggttgcttttgaacagaaatttatatttggtctgatttacctattttcttttggaaaaacacagtttagagctttagcagctggtgaacagcattaactaaaacttccggaagacaaagcatcataagtataaatggtctatctcattgtatatgctaaaatgttgtttttcaaggacagaagaaaagttacctatgataacagtaccacaaaatgactagcacagagtaagttacttatatatgtgaatgaattaactattatattttatatatagttaatagtatagtataattataatatatagtaatatataatatatttatactgaacatcaaacaatgtttaattataacaactactttgcaaagacaacttcacatagttcaggatattcatatttatataaagtttattaaagttattacattctgcacaggctgatccccaagtcatatattattagtcaacagtcattatttgctattcatatactagctgttgaatatttaactcaatcaatgtggttgtttcttacaatgaaatctggagttcttttcttacttaaaaaagattgcagaatattatatatatggtaatttattaaaatataaactagactttatcaaacttagagttaattgtaatatttacaattggaagctgagaaatggaagattacaagtgcttatttgaccaaacagtggcaacagattttgtttttatgtgtgcggcctctccttatagagtgaaccctcataactgcttctaatcccaaatctcagggaatttgtttccaacaccataacagtctttcaaaagcaacggtgattatagtaacttcaaagcggcaagcatctgtactttaagaagggccagtggaagctagcatccatcttccataaaaaagcaatcgtgcttttccctgctgccacttagaagagcttccttggggaccttgttagatgctttcatgtgaagaccatttgacccatttctgattagtgtgcaggttttcatggcagtggcttctgggagggagatgccgttggctggtcgcctccctattcttgaagtgaaaagaaaactctcagtggaatatattaaggataataaagggaagaaaaaattccagttaaaagactggtgaagtattgaactactattaaaaaaaactaatgaaaacgtatttctatactgactgttaagaagaaagcagagccagtatcacagttccttgttttgtgctcagatgagttttgcgtcttcatttctctttcttgcaatatttcagaaatatgtagtttgagaatgcaaagaataaatgactttagctcatttcacctttattttgtcagttttcttttacctgaatcatcatgtctacatttaaaataacagtaaacaagtctttataagtaacaggaaagataaccaagaatgcctgcattgttaatgctgtaataattgtcatcatagcttttttagcctcatttaccttacctatcttcactccaccaaattcactgtttcatatgatattcatatcagcaatactgttggtatcaagatatcgacaagcttctaaccgtactacattattttttaactttaatgccaattcttcactaataactattattcaatatagaattattttaagatcctgcttgcctaaataggcccagtatttctccatttctcatattaacagagtgtttacattcacagactcaaactatgaaggaaatgattccttagtagtttctcttgctatttgaattttatttgtatagatgcataacggaagagttcagagcgtaatgcagtatttgctattttctaccctccctcctccatataggattgccacagtctaatttcctattatgatagattgattttaatgtagtagattgcaaacactgtgttcaagcattcttatttttaatttctcctgcttcatccctttaaaaaccacagctgttactaggataacaaaaataatgttgaataactgcttacttttccgctttcccggaggggtgggggaacagcaggtagcatagcctcatccccaaacagatgttactttattaaaaattgagtgttttggagggagtagaaggagatttatgctttaggagagcagtgaaattagaaggagtcagaatatgatatggaccaattcagcttttaaattcaagctttgcttgtattttattgatagcattttaattgaattgtattttagatgtgtttggattaatcgaatgcccaaggtccagcctgatattaagtaattgctatcataattagtcaactcaacaagtttttctagactcttcatataaaattgcactggataagttctgtagtagatctaaatgtaatcgtgtatgatacaattcttcttttatgagagtttaactgataataacactttactaaattatttattaccagaatttttaagggaatttaatatgcgatgcatgatacattgctctttatttaaatgtatttcactatacatttgttggattacattttgcatagcgtcttgtatacttctttaaggcatgaatgagccatagctttgaaagtccttttgttttgttagagaattcagacctgcccccctttttttttaacttaattgtggaagcattctgaaatttcaactgctaggaaatcgttctgcaataacttaatctttttgatatccaaataaccaataaaattatatattttcaaatgagtttttaaaattatatccaagaaacttaaaaaaaaaaagaaaagcactagccattctcacttgcatccatccatccctgagttaaaattctgaggattattatctcacctcctatttggacctgctttctaggttactatttgtttctatatacaagattaagataaattatggtaatatgcatatttccaatgccattgaaacaaaggatttataatttgtagaaaaactagaaaaatcagtcaaaatttcaaaactaggcagtctgtaatacacttcaaataaatttatttctttctgtatttttcagttgtttctctttgaaataatcaaattattaaaagcattctaatcaccttgcaatcacaatgtagagacaaaagagtgaatacgtgaaacactgatcttcacaattattgtgaacttaagctgtcgtactcttgtagttactgtgaccatcagcaactgaggacaattatgcagaatcattaaattttagttatagtacttaattaaacacttgcaattttttgaaggtgttggtatctattaagttttttgtttctacaatgctaaatatcttctagacataatcatcatattagaccctgtcatggttagattgctgttattaaatgtctcagtcatgaaagtctgtcaactgccaatgaggatggagagttcaaatcttgcaattagtcagtcagcaaaagtacattcagttgtttttcttaatcttgtcagtgtcattttatatcattaggtaaaccaagaaaaggaaggcacttatgtgggcaatttattccgtgatactatgaacctataagtagaacaattattgtttttcatttgtgaggttaatagaaacttcatcctttgaggtccatagtaaaagcgaatgcattcagaaaactatgacacgtttagattaaatataaatatatgttaaaattttcagattacaaatacttaaaggatatttaaaggtgtcacatctgaatttcaggaaactgtgtgagtattacacatatcattagattatccagtttttccaagcaaatattcagtgttattgtagaaataagtcaagtttctggggaaaaaattgctctctcacccaaaagaaagtccgtctgttcatattcgggaactgtaggtaactaaaagtcttagtcagtgagactgatcatggcttgttcatttgttgcaccctaccaaaaaagagattctgtgaaatcaaactacatcaaaactttcacagtggaaactcctttatggtttctagaattctcattgtaaaccccttaaaccagccatacctgacagcaataatcagagatatttgtttctatagtgaagtagaaatgcatcctctagaacaatcccgtcttcatgagtcccatcataacatgtgctcttacctagaaggctctgtctctcttctggttggcagcccaggttggagatgaagccttgtaagtgtgaatgcgattagttactttcattaaaagatcctcagtaagaaacctcttgatgccctcctgtgtatttactagcatcatcacttggcaaaaatgtatatctttcttttggcaaatgtgtgtgtgtatgctatcttcctgtaaataagtgcctataaatgttcaatagtattcataaaatgttcattgcaacaaattggtgtataaattgcatttatctttttaatagttttctgaagaatttccatttacttagtgcaaactatataatttttgttttgtaaaatttctgaaatgttcttcctagctttgtactgagttctcaatttgtctgcaaaaccgtttatttactaaatattagtaattgatgctacttaaagaaaaattaggagcaacaaagaaaaagaagagacataaaaataaagataatttttaaaccactattaatcctagtacttaaatgaaatgtctttaacatttagatgtattgttttctgaacatgaggaataatataacacagagaacattataggtcttttagaatgtatgtattatattttatatatgaatgaaatacactaatattcactacaataatgagataactaggatcattttaaagccaattatatgagcttctgggtttaattgagctttagacatctaagtcttttgtaaactcttttgatgcaggaaaaccaaaagagaggatttcagggaacatgcgggagggagtgagttagtttggaatgttagcttggtggagagaagggagtgttagaactgatgaagcaggttgtgggaagccaagatgccaagctgaggagtttcttctttattttattaactttgccagtgatattgttttgttcttgaaacaatcagagagatacaatcagagagaaacagggagactgaatgtagtagaattctcattgtatattttgtgccatgtaaaattacttacatggaaaaaaatcatttcctttggtaaagggctttctcttgctcaggtttactgataacctggatttttactaggcctcttttttctttgtattttaatttattttttttagagacagtctcactctcccgccctggctggagtgtaatggcatgatcatggctcactgcaacctggatttcctgggctcaagtgatccttccatctcatcctccctagttgctgggactgcaggcatacatcacctcccccagctaatttttgtattttttttggtagagagcggggtttcaccatgttgtccaggctggtgttgaactcttgagccaaaatatccacctgcctcagcctcccaaagtgctgggactacaggcatgagctaccatgcctgaccattactagctatctttttaacttatttaaagtcaagtcttgtaaaatagcctggagttaatagaagttatttttttttccttctaaaagtgatacagtcaaggtcctgtttcagaaattagcaaaattggttattgtcttttagcagttggttccttatacaagcctttgagaattcctttgaaaagataaatcaaattgccaagtttgattttttaaaaatatattttccttctttcagttctcattagatatagatttcaagaaaatacttggggcagtaaatgattctagaaaggcacttaaaacagttaactactaaaatagcctatttacatgctttgagtgaatgataaagagaattaagtttatttttgtcacattaattcccttcatatctagagctctccagaaaagctctgcagataggatgcccaatgcacatattccttggtgacaagtagtcaggataagttttatggaagtttcctaggaatctttttttctttttacaatacttggcttagtaaatcaatatttttgtttgggtttctgtttaaatcacaattcagtacagcttcagccactgaatcaagatgtgaaatccatgtactgtggcacacatttcaaattgtgtgttttaaagcctcaatctaagcaaattctaaattcctatgttttttgaggatggaatggtaccttaatgaccataacatgtggttagaccatatatctagaagtaaattgatttaattggtcatgataaggacttatatagtacttaatggtaatagatatagagttcgtgcagtctccttagggttagaattcacatggtgcctgtgtatggatccagatctatgcataactagctagccaggaagcaagctatctctatcttttaaaaacatttacacctatctaaagtagaaacttgtattatctttggaaaactgaggccccagaaaccctaagtaacctgcctaactcacacagctctaggagtcatggtgattccactgaaacccatcagcttgacactatgatgcaggttgaaatctgcagtgcgttgccttgggctaggttaatctgcccagagaggtattttgctgtgagtggattgtataggaaaagggtttgtgtggccagacagcagagaggaaatggatgaggaggcagagaaaatgatgaagctagtaatgaaagcattgacattgattaaattccacttcttagaattgtcactgattaaccatgtagcttagcattttatttaaaaattttccttatttctggcccaggatgccatgagtccaaggatttaggctttaaaaatgatagggttagctcaaaaggaaatggataggttgtgaattatctgacttggtgaattctaatcagacaaacagagctattaaaatgtttcaataacttttagggcattttcaaaaattagtagttaatatttctgaatggtactgctttcttttctgtaggctttatcaactattgatcatgtgaaatcaaccgtggattcttctggagtcttttggggggccttttaaagtaaatcagacattggaacacatagttctaagaaggagccagtacgttcactttagacattagaaattatccaacacattcggttcgtttaagtgtataaccgtacaagtaattgttttaacatatttaatttccatatttgttttaattaagaaattgtgttcaactttttcttctgagtcacacttctttgattgtttttatgattgccttgtaatcgttcaagaatcccttttatattggttagtatggggctaattatgcattcgcgagtgagctaaatgcagatgtagttaattctcacatctactccatgaggtaggtattaagatcttcacttcagagacgaggaaaactgagatagagcctggttaagtgagttgttaaaattctatacctagtgagtggcaaagtttaattacaattcaatgtttttctactacaaaattgatcttgttaatcctattccttattctgttcgaagtcagttttaacattatgcatacaatttttgtgttcttttctacctttcctgggagggttcttgcaagaataaaaacatagggttgtgtggcatttccggattgtttccacgattcttggttatttcctccatagaagccatgaacatagaggatacaaaagcattgtagaaagaagtaaatctgtcaagaaatgtcatgcctttgtttagattacttcctcatcagtccttgcagtttattgaaaaatcctgctctgggtggattgactatgagcttacattttattttatttctgctggtcatgtactactgcagagttgtttgtatttaaaaaaaaaaaaactcaaagaggggatttcaatccttaaaaggcaagaggattttgtttatctttctagaattcatgcagtgttgaatccaagtctcttctttacagctatattttaaactttttcaaggcagggacagtgtatttttatgtgaattttcatatacgctagatgcaactcagaattttatgaaatgcttcttgaattagattttgcactgtacattttgaagactatcctacctctttaaacagggagatacagaagtaaacctattgggctggtaaaaagggtatgcacttgaaaacttggtggcctttagaaagcattgagatattggactgagcacatcaagggacatattctgtgaaatcgttacagtagccagctagtcagatatgagcagagcaggagagtaccctccccacaacacacacaccaggaatgtcaggcagccatcaggcgatggtcaggcatttgttaccggcttctttaaaataataattggttatatacccaataatgggattgctgggtcaaatggtatttatggttctagatccttgaggaatcaccacactgtcatccacaatggttgaactaatttacactcctaccaaaagtgtaaaagcattcctgtttctccacaatcctctccagcatctgtatatacccaaaggattagaaaccattctactataaagaaacatgcacacatatgtttattgcagcactattcacaatagtaaagacttgcaaccaacccaaatgcccatcaatgatagactggataaagaaaatgttgcatatatacaccatgaaatactatgcaaccatataaaaggatgagttcatgtcctttgcagggatatggatgaacctggaaaccattattctcagcaaactaacacaggaaaagaaaaccagaaatcaaacaccacatgttctcactcttaagtggggattgaataatgataacacatggacacagggaggggaacatcacacaccggggcctgtctggagtggggtctaggggagggatagcattaggagaaatacctaatgtaggtgataggttgatgggtgcaacaaaccacaatggcacgtgtatacctatgtaacaaaactgcatattctgcacgtgtgtcccagaacttaaagtataataaaaaaaattaaaaataaaataaaataataattggttgcagcccatgtcagggaaaggcaatctcccagtaaacagaaacacctgaaaccggtgatcagaaacttctgaatatctcaggagttgggtgaatgggctcaactatgtgcactaaaaggcaaaatggcagagtttaactggtatatgaccttctatggacatttgactgttaacggaagaatgcctcaagtgagcgtgtgtacaactccagtaaacacagtgcacacgctcccctcccaagtgctagcaggccactgtgcatgagggcagcccaccatagggaagaatcaggagagaagggatgcaaggcctcagaagtacgccggcacacgaaatcctgagttaaaaggtcaaaccacgcacttgatctcccaagtcgcccacttggccctcttacaagtgtactttactttctttcattcctgctctaaaggtttctaataaacttttactcctactctaaagcttccctgagactctccttctgccttatgcccctcagttgaattcctatttctgaggaggcaagaattgaggttgctacagacccgtacagatacattccaccaccaggaacagaattagtaagcaatgatagaccaaacatttttcaattaattaattagttaattataactgacaaaattatgtatttgtggtgtaccacatgttttaaaatatatatacatgtggaatggctaaaccaagctagttaacatgtgcattgtctcacatatttatcatttctttatggtgagaacacttaaaatctactttcagcgatgttcaagtgtacaatacattaactatggtcactatactgtacaacccatctattgaacttattcttctatctagctaaaattttgaaacctctgaccaacatttccccaatttctctcacaccccagcttctgttaaccaccattctactctctgcatctatgacttccactgtttagagtccatgtgtaagtgagatcacacagcatttgtctttctgagtctggcttctttcacttaacctaatggtctccagattcatccatgctgccatgaatgacaggatgcccttgttttttaaagtctgaatagttatttcagtgtgtgtgtgtgtgtgtgtgtgtgtgtgtgtgtgtgtgtgtgtatttttttttttatccattcatttattaacatttaggttgattctttatcttggttattgtgaataatgctgcaatgaacattagagtgcagatatctctttggtatagtgattttgtgattttgtttccttttaaatatatacccagtcatgggattgttggatcatatggaacatttctatgtaccaaacatttcaatggagtaataaatcaagatgaaaaaagtggagtttgaatcagaccaatggagagagttttttttttaagttggcactctgttctcaagcctgaattgcttggaataggtcacttttccaaattggcactaggctcgaaaatggttggttttcaagttggcatttgctgaaataaaacactagcaccagcatccagttaaaggtacacaaataccatagttattttttattatgaggaaagaattggggaataataattcctcataacactgaggctgcaaaaatgttatatgacagtctctatatataataactcatggattcttggtttttaaataagcatagggcatggggaaattattaaaatagagcaaagccttatggaatataatatctcatgtgtaagtttatgtacacagcccctctatataaacattaagtgtgtgtgtatttgtaggatgtaaggaggcaaaatcatctcttagttgtgtttatatgaaacagataatttcatgattacattttttcttctgtgtcacttgcagtatgtcttctaacagttgttggacaactagctcagacattttaagagcctacagatgtcattattaaacttagtaatcagtctagaaataaacacacaaataacaaaggatcataaaggtcagcagtatggcaaggcataaacatggaattctagaacttgtttttattatgaaaagatgtattttgcagttcaaagcatgtcattctttgcatatgttcaactgaaatatgaaagaaggaaaattccctccaaatgactaaggtaacgttttacaggggacatatggatattcttagaatttaatgggggataggggaacttacctggaatcaattataggaaatttggcaaaatggaagtaaaatattcatttgctttgcttgttataattacgtttgttataagctttttaaaaatccaaaagaataaaatgaaagtaatttcaatcaatgggaattaattgtgttcaaataatagcatgacaaaagagacattggaactgattttgaataatagatttcaatatgtgctgagtaaagctctagggctgatgtcttctcttgtctgaaattttctaatactctccccaactgatgttgtttctcccatgtcttgtgttccttgaacatgcacttccctgaaagcaaaaatcacagaattgtttgtttacctacctatcccacgagactatgagtttcttggaagcagtgatctctcttacaaaacacttttggatcttcagttatttttaacacatcatgaacttcctatttcatgtatagtattgctagctcagggctgagagagcacaataaaggatgaataagaacttacaactaaatggacaaataaataaatgagtgaatatgatagtgtatgaatgttgcactgatatttacttattttgatttgatacatttcattgtaaacagtaaaaatgtagagaatattcttctctgtaaaaataaaatagtattttagagctttctttgtaaaatatatgtaatttatttaaacattacagatgtatttgattcaccaaaaaattaaaaatatcatagtaccattcatatctatcttcatattctaattatgattaagttttaaatagcagttatgtctttaaagtgaatgtgtgttatgttctgccctaaatataacttaacattgcaggtagaactctagtgtttgaaaatgtttagaagtcagaattgcaattactgagtgtgggataaatattagctataaatataattatgtataaatataatgaatataaatattagttataaaaagtataagcctcttccaactcttaatgtttataagtctactaaaaaattaaagatttctaatagtttaggagttgggagggaaaaaggaaaaaccacaaacaatgatgttggaatgcaagaaatataatttgatagtgcagaggtgagcaaaaaggtctgttgggccaaattcagcaaaattcaatgcagaaaatatttactatctgacccattgaagaaaatgtttgctgatccctgtatgtcatgaaaagataaacgtgaatttgatttgaatggcaaaaagtagaggtatgaagtaaaatgcatatagtccaaaatgtatatagtctccacagagccataaagatactccctgagactgcacaatttataaagaaaggaggtttaattgactcacagttctgcatggctgtggaggcctcaggaaacttacagtcatggcagaaggtgaagggaaagcaaggcacagccttacatggctgcaggcaagagaggaagcgaaggggaagagcttcttcaaaagcactttaaaagcatcagctctcctgagaactcactcactcactgtcatgagacgagcatgggggaaaccacccccataatccggtcacctcccagcatgtcccttccttgatatatgggattataattcgagatgagatttgggtggggacacagagtcaaaccatatcatagggatttctccagaatatttgtgttgtgatgctatcttacgtacttatttttaccttttaaataaaaattggagtgaaaatggcagagtcagaaattaatggatcaattatttttttgtttgtatcaaagtttgagataataaagataaatattttatcaacatggccttattaatactgtatattcaatgcaaaaggagtgctgactggaaaacaatttcaattagtaatacttattaattggatgctaagcctaattctgtccttgttttattttttttcccaagatattaaaatatatttacctataagttgaaaagtaaaaatatgactgcaggtggctcattttgttttcacatattttgaaagttctaggctatggtgcccctttttgtccccacttcatgctttcccatttctcggagacaagtcacaatttctaactatttttgctctttgaattattttatgcttctttgtagcaatgtgaggcttggaagaaaatgtacagtacatgactttctcaaagtttacattttaaatttaacacattggaccttgcatttcgagttcaggttgcactaatgagatttctttatgagcaaagacaggagaaatgtttaacgtttttaatagctgtaactctttttatatatagatatagggtcttgctatgtttcccaggctggtcttaaactcctgggctcaagcaaacctgctgccttggcctcccaaagtgctggaattacaagagtgaaccacccaggcaataattcttttttatgtttgtggatatatatctatcctaagtgacaaaggaatggacagtattcacattgcctcatgctttcaaagaatatatggtgcagggacatctagaaaatgggcttttggtggattaaaagaaagtcatgagtgggttggccaaatgatttctaaaaaaaaatcaactctagagtagttttctctaagccttttagaatcgtttctttagatatttatatgatcttataaacaaatatcataaaattatggttccaatttactgacacattgccttgctggaaatgtggtttcatgccaagaacaaatatgaaaaatgtagcaaagctaattacagtacaacatgtgtccatcatttgatcttttggaggagttaagggaaattcaaaagaaaaattatcatgtgcaaataaagagagcttagctatcttgcctactggcctaaggtttctccatcactcctgcagcgtttactttatgtatcaggagttaattaaggtgaaacatgaggtaattagggctaatcctcccagcctcctgctggcttgttgcctcccaggctattgcctaaaccaaactatgttcgcagttttaaaaaataatgctcgtgtttattttagacattactcttaacttttaaagttgccttattcattttaaataggactttccatggaaaaagtataaagaatgatcaaactttagttttgatttaaaaagtaaaacaagactcattaatatataggtggtcattgacagaattgtaagtttacacttgttcactttacgtgttactaacagatttaataaaatttgcattagtataaatctttagctttgattatgctggaaaggtgcatgcacttcccaagaaaataatatttcttatacagatttctcaatatattatgcatttggatgtgtatcagggtaattggagggaggatcagagaacaaaaacaaaaaaaaaaataaacaaacaaaaaaaccttccatgaactgcatttaggtattttatctttgaggaacattctaacttttagatttcactaaatagatctggtaagtagtgactgatttattctccttaaaataaatacatcgcttgtgtcaaatatttttaattccacactaaattgtttgtgcgtgtgtatgtgtcgtttatattttcactttttcaatgaaagtaaagaataaaaaggttttctatccttgttgtttctctaagttgaaataaaagcatgtgcttttttattaccctagtcttataatttaccaatcataatagaatctgtactcttgccaaagacatttcattaggatgtgaagactttagaattgacaccccctcacatattaattaaaaagcaaattgcaggtaagcagtcatgacatttataaaagggggaacttacatgggtaaaatctcttttgttgttttttataatatactatcaggactgggactaataattctattataaatttgatttggggagatgtttgttttcccaattgctatcaaaatttgacttttatttagcctacattgacttcttctgttccatctttttatttatttgtctgttttattatttttttagagacagggtttcactctgtggcacagtctggattgcagtggcttgatgatagctggctgcagcctcccttaatctcctgggatcaagggatcttcctgcctcagcctcttgcatagctggggctacaggcattcaccactgtggctggctaattttttaagttttaaaattttttatagaggtaggtccttgctttgttgcccaggctagtctcaaactcatggcttcaagtgatcctcttgcctcgtcctcccaaagtgctgaaattacaggtgtgagccatcatacctggaatccatcttttatatgtactcttaaaagaattgtttatgctagcatcttgaaatacatacatatatatatgtatatatatatatatatatagtcttttactgaggttaaaatcatttttttgcagagtaaaccagtaaagattgcagaacaattatattgcaacaagttgctaattcatagtttctgcttgagactctaaagcagttaatatttacattgttagatgtgtggccaaatcatgaacttttatttagtaggcgatttcataacctccaaatgtctgaatcttactctttttgtattgtattgaggaaaaaaatgatcattttgattctataggctttaaaattaaatcaaactctaggtagcattgtttgggttatttagtgaatttaatgttgattctttaaaaatagaagtggggcttttctcctgcaaaattgccaagagagcatttgcaccatggcatttaagaatatatcagttgagattttctattgatcccagctggggggatgagtgccccgagagaatacatgcgccggctttatgagggtccctgtcatcaaggatttagctgtttcatttacagattcctgtaaatgttcaccagatccatgaccagtaattttcactggagaaggactggaccgtgggtaagcaaatgactctttgtcattaatggtttcaagtagcattaaaaatgttctggcagctcagttgattttgatgaagctatgaagcccaactgcaatgtgtatctagctcatatttccaattataagaccaaggaaagaatcaaagtgaataatatgtaacgtacacacatacacacacaccctaattttgattacatagcttttcctgtatagagatttaacttgaagtctacagatgttcacatttagcacagcacaataaaaatacaagtaaaacagaaactactttttatgtaattaaatttatatctgctaatgttcacttccttaattgggttatctcctaagtgatcagtaaattgcatgcaataactaatttacatgcctccttagacactgtagctgcctgatgatttgaaaagtataagtacccacaagtgtaccaaaattcattttgaattaacagtgaataaagaaatcttcaaaaattcttgagacatgacagataaatgagttaacacatctctctgtggaatctgtttctatgtatcaaaactttttagttcatgttactgtttaaatgacctcccattaatgtaagcctgtcatttataaaaatattattattattgtttctaaatttcacttagagatgccttagaaaaatctatagctaattttcttcgcctgtattgcttctagtatgggctgactcacagagatgctgcattacacacaacaaagtgttccataatttgcaatatcctctcctcctccttccccttctccctcttctttcctcctcctcctcttcctcctcttcctcctcctcctcttcctcctcctcttcttcctcctcttcttcctcctcttcttcctcctcctcttcctcctcctcctcttcctcctcctcctcttcctccttcttctcctcctcttcctcctgctcctctttctcctcctcttcttcctcctcctcttcctcctcctcctcttcctcctcctcttcctcctcctcctcctcttcctcctcctcctcttcctcctccttttcctcctcctcttcctcctcctcctcttcctcttcctcctcctcctccccctccctctcctcctccttcttctccttcttcttcttgtcactctgtcatcccaggctggagtgcagtggtgtgatcatagctagctgcagtcttaaactcctgggctcaagggatcctcctgcctcaacctcccgagtagctgggaccataggtatgcatcaccactcccagctgtttttaaaaatgttttgcagagatgaggtcttgctattttgcccagctgttctcaaattcctgggctcagaccatcctcctcccacctcagcttccccaaaatgctgatattacaggcatgagctaccacaaacagcttgtaatctgtaatctcttataagcacagagcagaaataaaaatggcatcatttttaggttctcctaactcttcttgcccattcttcactgtctgcccaggaacaaagtcctgctcttgagtccacaattatccaagtaattctaaaggtcttctcatacatgcctggtgagggcataaattaatgaaacctttattgaggacaacttagcaatatttattaaaattaaaaatgcttgaagccttcaacccagcaattccactgctgtaaatctatatttcagataaatttgtgtatgtgaaaaatggcattatatgtgtcaacttttgcattatggcattgttttaaatcgtgaaagatttcaacctaagaaggatgaagtcagcaggggacttgctaagtaagttatggtgcagcttgttttgagccataataaaagaatgaggaagtccttcacaccttgctacggtaaagttaccaacacactttattaagcaagaagaataaaggtggtaaattgaacttctccattttaaataatttgtgtaaaaatggagaaatgaatatatacacatgtatatgtatatttatgcatattagcttatatgtgtgtaaactctatctggaaggacggacataaaagaaattaatcatactggctgtttatggggaggagaactggacaaagctaaaggagacaggtatgagcatggcatttttctttaaccactttaaataatgtttttatatcgttaagacattaaaaatattctcatcctttattgtttccttcccaacctgacatcccatgttcaaatgttcaaattacatttttcctcttcccctcttttaaatttccattttagtgctgtcaattttagttggctattagaaaaacaacccaaattcatattaatgtgtaggtgactcatagcctcagaccttccaggcgtgttttctatttagaagaggagagttattaacttgcatggaattctaactcgttaaataccaggcggttctaaaagtaccccaggcagtgcttgcacgatcatttgattaaagtgaggacagcaagccaaagacatctgtaggttctttaatccacatccctgacaaaaggacaaagcagtcactgccactcacaccaagattctacccagaggtggatgcccagagggcttccaaggaagttgcatgctggaaaactccaagtacagatgggacagagctgctgagctctaagccagtatatctaagtgtggttatcacacatgtggcaaaagacatataacacatggcatatgcttcatgatggaatgtttgttaaaaagaaagactctagagcccctctgtcctcaagatctactgaaggcactgtataaaagagccctagtttgagcactgctgtctgtcatgaattcgcttcatctgctacttttctgatttcagtaactggggacagtgggatctcaatcagaaaggatttgctcctggaacacccaaggcttgggcaatctctgagcagccaagcccagtgttctctgagttcaaagatctgaaagtctttgcaaagaccttagagacccatcctgccaagactgatcccaaaaatgctttcctaatccatttcctgaggctctctgctcactagggcccaaccccacacttcctgttttatagggatagttagcctctgccctggggcactgggctggtccatgtgttcctttcctaccctagctaatgtcttttgacatttggggatgcgtcagtgctgcagattctttaaactctattcatttattttaaaaaaatacttaataagggctgggcacagtggctcatgcctgtaatcccagcgctttgggagcctgaggcaggagggtagcttgggtccagccagcctgggcaatatagcacaacccccatctctacaacacaaataaaaataataaaaatatctagtgagtacaggctttgggaccagtactcttttgggccctggggattctgaaaggaacaaaagagaccaaaatcagtccttttgggaagtagatatataatagacaataaacaaggcaaataaagaaaacataattgttttaggatgaaactctaaggtttgggggtaaaaaagaaaaaaaaagtatgtaggaatggggagtggggacagaaaatgttctagaaagaggaaagaggaagtgcaaaggcttaaatttacgaaaagcgaggagttccatgtgagtggaacagcctgggtgggataaatcctgcaaatttgaatgaggtgaactgagagccatgagcaggggccaggtcatggagtctctttgggaactttggctttgatgctaagcgagacaggaatccattgaaaggtttgcgttttgttttgttttgaagaagaatcaacatgatctgacttactgaaatgatcttgatgttcagttgagaatttcccacatggtgacaaggcctgaaatacagagctccgttacagtaacgtaggtgagagttaaccaggtggaatcagcggagaggttaagaagtaattagaatatggtgtattttcaaatcaaaaccgtgaggattccatcactctatgtgaggatataaaggaagaacgagagtcaaggacgactccactttgttggcctaactggaagaacagaattgccacttactaagatggaaagactggagagagatgcaaatgttaatggacaagtaaaatgtggcaggtcaatctgacaactaaaaatggagctgtaatgtaggcagttggatgcatgagtccaaggaagagatatggcttcaacatataaatttagaatctttgtgtacatgtagtaatttaagtcatgatatttgataagtctacagatggagtctgtggaggcataagagatcccaagactgagctttggatcagttcatttttaaagattaagaagatggagaggacccagcagaggagactgagaaaaaaagaaaaaaagaaaaaccgtagctagtaggcagaaaaccaaatgagtgtcttattctgttggccaaatgaactaaatatttaaagatagaatgctcaactgtgtcagatgctacttaaggtcacagaagacaagtaacaagaactgaccgttggaaacagcaatgtggagattatgggccacctttataaaagcaattttcctggagtggtacaaggaaagtctctattgcaggaggttcaacagagaatgagagaagagactgtggagatagcaggtaatgataccacactagtgtcctgcagtacggggaagaaggaaaatgaggaatatatggagagaaatgtggatataacaggttttgtttttaaaacaggataaggaaaagcgtgtccatatgcttgtgggaatcatctagttaagttagaaaaattaatgatacagcagagagggggaaaattgctgaagcaaagtacttgagcagacaaaacaagacgggagctaggcacaagtgtagaagtgactgtaatgtaggcacatagacagattatcattattatgagagaagggagataatgggtgaaggaggtagataagcccagatatttggtctttgtagtgtgcagtccatgatgcattcattatttcacattaatgtttggaaaataagtgggaaccctggcatacattgtttggtaaagaaacaatgaattatgctgaaagagaacagatttccagacagtgttgttggagtctttatccattgcatatggctcctgttagagtcaatttatataaatagagaattccttttccagtcttgtttaatttaagcaatgaagtattgagtgctcctgaagattattaagactccacccctgccttcaggaagctgcccatctggtggaatgagccctaagatattttgaggactgctcactccacccatgatcccacaacaggaaagaatatttaacattagggacatccaggaatattcaggacatatgtttgccattactgtaattagtgtcagttgtttgtaagtgcagaaatagggaaataaacagtgttacaggagaacagaagagcaaatgctcaactttgtctgggaggtgtagagaagcaatgttaaggcattgaaacttactgaaatagaagaagagacaggagttaagcctggacaggtagattagggtcatattgaatgaataattgttctaaggggtatgaatatttttctataaacatcaatggtgacgttaagtatgtctgtgttttggagagaaatgtagtagctgtatggagcagaggctggccataattgaaggttgaaaaccattgtgtgtcctctgcaatagtccaggctaaatataataaggaagtgacaatgacacagggcgctttcagctccacttcaccagccagaaatctctgtggccagctgtgcccctgcccaggcttcactcggctctgggctcgccactgggctcattccacccacttggcccagtgggctgcactcagcttgcactaccaacccagggtagggcacaggtctttgcactcagtggctgagctgggtgtgggcagtttttgctttgggcaccagcatctagataaggggaacccagtggcatcggaaaactcagagatgccggtaaccacagagacctaggggttttatggctctttcccagggagtccccaggtttgagcccccaagaaatgttacatcatttctgctgcccgcagtgcagcaaacaggagggcatattacagcttattcatgttacagcttgttcgttcctgcagcccatagctcagcaaatgggggcatgttgtgcccagaggctttttctccacattgcttggtgaatgagagggagggttacagtgttacagctctttttgtacctactgtttggtgggttccgtgttcttgtcccacaaccaagaaggatgagattgcacagacattggagagtggacaaggcagggaagaattttattgagtgagagtaaagttcttgacaataagaggggagcccaagttggtggccctttgtgtgagggggagggcccgaaagtgggtatcccaatgtgtgcctgagtctggggtttttatgggctcagaatgagagagtgcatgctgattggtccatggtgggcctggagaatgcaccatttaattggctaaaggccttaaggaagttcttactctggtagtggactcccctcagaactggaagttcagttttcaggctttaagctgtctttggcttgaggttggatttcaccagagacctgtccctttctgcccagaaatttatctgccgtggcctggagcagtggctcatgcctgtaatcccagcactttaggagactgaagcgggtggatcacagggtcatgagtttgagaacagcatggccaagatggtgaaacaccatcactactaaaaatacaaaaatcagccaggtgcagtggcaggtgcctgtaatcccagctactcaggaggctgaggcaggagaatcacttgaaaccaggaggcagaggttgcagtgagccaagatcatgccactgcactctagcatgggtgacagagcaagattccatctcaaaaaaaaaaaaaaaaaaaaagaaaggaaatttatctgcctcctgctgctatcaacaagggcaataaatgttgaaaggagggagtacatctcattaagtttttaagcagggctttgacacgtatttagaaaataagagaaaaaataactgactatgaggttgctgtttggggtaaaagttacattttgatttcatttgtcaagatgtagattgccgaggatgagacagatttggtcagaaggtgagcaagcataatgagttcattatgtacatgttgaatattaggtaattttaagctactctaaagtctaggatttgtttctttgacatgtttcctgtcttttaatgaacgttgaatctataatcagaactcaacaaaagaaaactcaggaaaactagcaatatttaggtgcaatttcatgtgagggacattgactgctaaaggacaaattcattacatccctagcaaaatcaagggtttccattattttaatgcagggtagcagggtaaccactttttttttttttttttggcttaaaataatttttgtaagttacaagatgggccagacatactttactttcttttcttgttatatattcacaggcaatcaatcctttgataaagaaaaaataaaagtttagaaggatggttaggaggatgtgattaagtaatacagcataaagaaaaggattaatttacttgaagatacccttttctttcatatatgcccagtggaaaatgataatagttttaagatttccaagaacttcaataaaatatatgtaataaatgcatcaagcttcttattgcattgtctcagtcattaattatacaccaaaaccatttaatgtcagaatagaatgcttacttgaccaatccacaaaaactccattgatttgtaccactttagtctatggattcaatatactgtaaaaactttaaaaatcagtaaacttattttttaacaaactaaagaacactatgaaatgctatgatgttttctcattacactgtcatagtgttcttgtactcagcaatgttatcaatgacatagattatcatatgaatgtattatcatctttattgtgagattatgtatatttaatgcaatgcttttttctggaaagttaaacctaaatttaatatataattatggccaatatattaattcctttaaggtatttaaaattttctcatgttacatattttttaaagtttccttttttaagttcttatatttttattaggtgaatgactttattattgactaaagtctctgacagcagataaaaggaggaataaatgaatgaatatacaaactgaacaattaaataagccttgttgctacctcaagtgatttcttaaaaaaatcttgctttcagcaatgttagtagcccactgaaagtaacatccttatattttttttacctacagaaaagtatgtgaaaaagtcacagcagcctttttggtgcttcttgtttttcttcaaattgatatcaactgtgtttagcatggataggtactttgcttgagcaaaagttttcttagtatttctaaattagcttctcctcattttttggaggatattcttatcatcatattgactctgcaacatattagatgcatccattttccaaatcgtgtacatttttattgcggttataaatggtaatcttttaaattgtaaggtttttaaattaatcatggctcaatttaccaaagacattataaaatggactaaatttgctggatcttataatttatgatttgttcttttactttcatttatattttctcattttctttctttttcccttggagattcactatctcaaatattgtgtaacaccaaatctctttaagagccacaaagaaaagtattgtgattcatacattcatatgacagatcgcttacccaaatctccattttactaggagttatgagatgtagaaagtaaaggcctaacctgccttttccaagaactagtaatatgatggagagagacatttaaagtacagtacaagagagaatacagtatttgttgctgtagaatttttaaaaactataaactatgggagcacctagaaaaaattgttaaggagtgttaaaagcctcgttgaagttggcacttctctcacactgcagattatgaaggaagacctattcatatgggcaaaagggatggttgcaatcaggagaaaggaataatggtttgtttcctagagctaccattaaaaattagcataaattgggtggcttaaaacaaatgtattccttcttcattcaagaggccagaagtcagaaatcaaggtttggttctttctggagactctgagggagtaactgtcccaggcctactcttgaaaaataatagtttctcactattgtttcaatttattttagaagcagagagacagattctataaaggcccaaggcaacataaactcctatgtctggtttaagtaatgtcctatcatagaaaacgttaaatcatactttgtcagctcacagagatacattgacctatctaatagaataataataaatgttattagcaataaccgtcatgtattgaacatagttaagcgtttcacatgtatatctcatttaatcatcaccttaatggtagtactagcatgctctaggtagagataagaaaactgaggcctaaagagagttatctataaacatttgcttgtgataagcagaataataataaaacaaattgaacatgaggacatatattactatgaaaactgaaaaaagaaggagaggtggcacatgagcataaatatgaaatgatagtgcaatgacagaggaaatggaactctgtgtggtgtgatcaacttaattttcagcactttctgcttctgccttctgcagcaaaactcattacacaatataaaaatattatgtgctacttactatgagagtaaatattaaggctatagtacacattgctttgaaaccttgcatttgaggattgaaagctttatctcacaaagtagaagttaatataaactgccattataagtaaatggatatttgttaaaaagcaaacaaactgaagaacttctcaaaaatgaatttatttctaagctagaaaagcctaatatttttgaggtgcttcacaaggctgatatttttcaagtatgaccaccatagtgtattcctgaaaataggtgtcataggaataggtaaaagtgaagattactctgctcaacaccatgccttctgaatcgaagtttcaggaaacaaactgaggcaatttgcattataaatgaacatccagggtaattgtttaataccaaatacctgagaaccattggtgtaggtttaatgtgagtattcataacattccccccaacattaaaaaaaaattctttaatttttaactttaagaaatgacttcagtaagatggaagagatggtcataaaatgaaagggtgttctcagtctacagtggttccatgaattttcatttcaaaggagttgtattaagtaaatatttaaggtaactattttacagatgacttttttttttttaaatcaaataaatatgtttggaaaagccatgacctatttgtaaattcttttctaaaaagcctgaatgtgtgtatgcatatggtatatatggtcgtgtatcataaaataaaatgaaataaaataaggtagatattgggctttctcttgctggtcagaaaaaagccttcccatttcaagggactggctctaccaatcaggccaaatttcctgggcacacatccttctgggagtggttgctctctttactttccatttagcagctgtacagttgggaaatgttcaacagaatgaaagccacctgctcctctaatgatttcagccaaacagacaggattgaaggtttaccaaatgtgttgtctgtcactctgactctgctcaaaaaagtaaatcaaactggtcagatattcatatagaaaatgtgtcattagttaactcctggagtgcctgaagctcctttcaggctaccagactctgctgatttggagatgcctttttaaaatgaagaatggaagtgatttgaagagacaaatttggaaaatgaggcattctagaatgtttcccttatcaaatgctatatcattgcactctataaaatgagtagatttatgcacatttttccccacattgacagtttgattttagtatgtgattatatgttcccaatccgactaattaaatgtcaaattcccataagtttccaactcaccccttcttccagctcagtctctctgtattccctgaaaattgtctacaagaaagtatagtatggaagggaaaaccatcatagtctttcctatcacactggaaaaatcacattagaagtggaaattggcctccaccttctctggcagtttgggcacgctctttaatccttctgtgccttaggtttttaatctgtaaagtagaattattttatacattagatgtgtctggaaatgtcacaggacatttgttttcctgaataaatgttcagtattatgtggttttttaaatgttattttgagatacttttgttttatatggttatcccattaatatttacatcacgacaaatatccagagaagtttcattttatgtattttgttttactacaatctgatcgtgtataacattttttttctatggccatcttcaaccttatgttgtcaatattggttaacagagggtgatgcagcttcagtataaatttgtttgtgtaagtatttctgtaatctcaagggattaatgcttcataagaattagctcatataacgccatagaaataagtagagaaaaagcccacaaacttttgttgaataatttcaggaaaattctttatgggtgcacttttttgttggatcacagagctttagtcatcgaaagcattgaactagtgagcatcctcagcatcctcagtgagcataatagtgttaaaaactccataaacatgttaattgaagtagattttgaaaaagggaaaatgataagcagatagatatagaaaaataaaaatgggtaaataacatttatcagtaatccattggttatctttttttcaaaaggcatggtagaaattttattataatgaacaaataaattatatcagcctgaaataattttaagtttaaaaaacaagatctgctgtctaaaaatgttatttccttttacacattaaaatgttattaatttagactcctctaatttagagttcctcaaaatttattcaaatgaattagaaataatatcatgaaaaattagattcatgtgctgatttgtattcttgcatttaatgggcactttgctttatactcttctggcaattttgaatgctgaggcagcacactagaaaacgccaacatcggcagattagtgcaaaagtcaagaagccatttacctaattgctgtgtcagtctaactgcacaagcatcccactcggttttatggaactgtacctgaaggcgaaatcaagttggtgtagaataagacaggggattagcggttccttttgacattttatgcctttcatttccctcctgtgctcactgtatcttctggtgtccagggaatcttgcttagaaatggacatgaaggctaagcaggcatttatagctaatatgtacttttctactcctccatatcattatttcatggttatctttgcatcccagacggctcctggtacaaattgttgcacaaggtgggccttcaagacaccatttttaaaaacgtctttgccacgtcctcctgagatatgactctggaatcaatctgttcctaaactagtgtttcataaattagagtcagctcaatgatatcgaaccacagattcattcaaatagaactgcatttcaggcatggatttacaaatgattatcttaatattttcttgcaaaacatagctaatgtgttctttacatttatttgacctcccctggttggattgttctgtctttattgcttcagcatgcaacattgcctggacactcacagtgatttgcacctattttttatggatgtgtcagcctatgattatataattatatgactttttataaaagcgtagaaggcatagaaaataatgtgccctcattttatgaatactcaagtaccctttaaataaaacactttactcacttttagagatgatatgccactggaaagcaatcatttggtcttttatgtaaattactatttttcattgtttaccaattcccttatggcccatatgtagtgtaactatattttctatggcagtcagagttatacaatctagaagttaagtgattaataaagcagatttcctgggatcagatgcagtataatgctgtgctaatataaataactattttttccccacattactcattggaccaaaagcatcaaaatatattttatgtaaatgaggaccctacacttttcaccagcttatgaagcaacatttctttaatcttaccgtttagtttctaatatgcttttcagataaatttctttaaaagactagatgaattactatgtcatattaattgcatatttgttgtgtagttggtatgttcaattcagtgacattattttataagaagtagacctttcctgccatgagctttcaaagtagttgcagaatttcccatgaatgtgaaatacagaatgacaaatactgtaagtaaacatttaaaataaacaattattaaggttatactaggttgaaatgtatgaaattgccagttttcaactgttttgaccaaatataacctcatacaattgtattataattttacataatattttattcttcctcaattctgtgcctttgttcttcctggtttttctacttagaatgtccctccccacttttttctgacaggaacacttacttttcatctgtatggtctcacctggaacactatatgtgcccagcatttttgctgatattcacaagaagacttaagcactaccactactgattatacagattttacatttaaaataattcaatgtgtggacattttatcatatgtgatttcataaacccctaactccaccctggtgcttcctaaaacataattctcccagggtaacgttatgacttactgtgtccttcaggctagatgtcataatgtatttgtatctatagagcttattaacatgattggcatataacagtaggtaaattcagtgctgactgaatgaatatgttattctattaataattcagtaactttttttctttgaactgggaaaaatcttggagagtttctacttctttccccttattttataaatgagaatactgatgctcagaaaaataccttgatattgctctttaagagtggagttaaagctgatacagcacgagcaaaatactaaaaatcatctaaaattatatatgtgacaatttgcacagatattaaaccagagaaatagtaactctgggataactctagacaatgacaatcagagaaggtgttgtagaagaactgggatttaaaatgaattttaaaggacgggtagaatttggacaggcagaggaaatgggagaatgtgagtaggatggtatgagtaaagcattgacagaggaagacctaaaatgtgcttagaagagtgagcaaacagaatgttaatcaatgattgttctgatgtctttacaaagtatatgcttttacccaggggatatatacttgttggctttcttattttgatataagatacaatatatgtgaaattctggagactattcctttgagattgaaaagcgagtgatactttgtcaaagtgttctgtattacaagttagaataggattgaaaattaaatataatccaaaccttgaaacttggcttaaacataaatatatttctaatttactgaagcaactaggcttccacaatttgtaatgtaaaggttcttttcttttttttgttggttttatccccatgaaattgtttccatcaatttgagaaaatactgaggtttcttagtttggttcttttttgtatatgaacactgcgtgcccgtgtatgcgtgtgaagtcacaaagagaagggttggaggggagagttggaggaaacaaacatccccttgtcaatgtagtttagggttttcagctccttccatgaacctttgcacagtatgacatctacaggttatagatggttttctttctgtatttggtgttggctctaaaatcctccttagaaaaggcaacacaagtatcccttcccgattaatgtgaattggaacaaaaggtataaataccatagataaagagagatacatatatatgacgtagtatttgagtgagataaactcttacccatggctaatatttgagtgaaaggcaaattggtaaatattttctctattgaattatttttaaatcacttgagaatcatctgttgagttctcactacgtgcccagcagtgtgctagttgtcagggatgcaatggcaagaaaaaaaaaaaaaaaagacttgaatggtctttgctcttatggagctttgaactagtaaggagatatataataattacagaacaaatatacacattgcaaattgctggaagtatgttaagaaaagcaaacagatgatgtggtaaaaagcagtttggtctgttagaatttgagtaaaattaaaagaaaaaacatagcttgagatggtgtcctcttttggaggtggccaaagatgttctttctaagggggtgatacataaacttagagccaaggtgaaagatgaagtcacccatactccataaaagacagggacaaagtgctaagcagggaggtggaactgtatatgcagtggtactgcagtgagaggaactgggaaggagtgagggtgaagactgggtatgaggaggatggggtgatcaggaatagtcaggtcatgcaaagatgtgcagaccatgctaacgacttcaatatgactctttttttttttttttgatggagtctctctgtgtcgcccaggctggaatgcagtggcatgatctcggctcactgcatcctccactcctgggttcacgccattctcctgcctcagcttctcgagtagctggaattacaggcattcgacactacacccagctaatttttgtattttagtagagacagggtttcaccatgttggcaaggctgatctcgaactcctgatctcaaataatctgcctgcctcagcctcccaaagtgctgggattacaggaatgagccacagcgcccagccccttaatatgattcgtggtgtgactagaaaccatgaaagaatttaaagccaaggagtgcatgacccagttcatattttctaaagattcctgggattactgtattgaggttggattgggagggagcaagaacgaagcaggaatgtcacgttaaaggtcgttcagctgtccagacaagaaataatggtggatttggctagggtgatggcagtggaaatggagcaaagtgagcatattctagaaatacttgggacattgagctgtaaggactccaagtgccggcttcatgatgtgtgggaaagactgatcaaggagaatcgatgggtttctaacttgaacaacaggatggataaaggaaccatgaacagagatggggcccactgtggcgggcaggttttgggggtgaagaagatgagttccactttgtattctgaattggagatacctgattgtcgtgaaggttaagatgcttcagagtgttcagaaatcaggcgtgagattaaggtaacagataaggatttgaataatgggaatatatagataattgaaggtatagaaattctttttcttgatcataaagggggaaaccctatttgaatgtggtgtgtataatgtaaatacctacacacacatacatatgtgtgtgtctgtgtgtgtgtgtgtgtgtgtgtgtgcataaaacctaaggagtaaaaagaatagctgatatcatttggtcaggaaggaaggaaggaaggaaggaaggaaggaaggaaggaaggaaggaaggaaggaaagtttttcttgattgaagaaacccatgttcaattcaaccttacacattgaaatcatttactaatttgctttcatttactaatttgctttaattttcccccacaaagctgtatatgaatgtaaaaagaaaatgattaaaaatacaaataagattaactcagcttccaaagttcatatagggtaagaatttgcattgaaaatctgatgaaagtgtttgaactctatgttctctcccaagagtcatactccttttaaaatttgctaacagcgaacttcatattttaatttaacattgagctgaagcctctaaaagtgacatttctacatggaaggtgtgccagattcctggagagggcatatggaatgtgcggaatatgagcaacctgtttgtaggcatctggaggcactggaaaagggatgaggttaacctgaaaaccactggattcaggattagagtagcctctcttgccgctgatcctgaagttgtatcttatggaagcattgtcagaccacagaacgcttgctactgaaaacacagggctgaattaataattgctaatctatattttatttatgatgtgctagtcagtgttgtaagcacttgatgtattatttcatttaattattacaattcccttaaaatgggtgcaattgctatctctattttataactgaagaaattgaagtgagcttaaataatttgtagaagttcacgtatctcataagtggtacacctaggatttgaactcctgttcgcacaaagcatgtatcgtaattgttatttgttgtttgggatgagtgggttgaggggacaagaaatttcaatcccaaaggaaagaaatgctgtctttcctggatgttagttgatttcctggagtgaatggccttctggctcccactggccagggaaaaagaaagaaaataacagcaagtcgttaattcataaaacaattttcccaagtgcaaggcttgcagtttctgcacctgctacgttgctgactcatctcacctgaatcatttagtcagcttcattgtgtttgctaagactgctaattatcctactggaataatttaaactatcaataaagaatgcaataaatcattaaagatatggttaatagggagagataattttgactattcagcttgcattgatccttgatataaaaagattaattttatattccgtttttaaccttacaggcaaccattagccatttcttttcacagagttgagctgagctggtttttcattaaaaatgtggcatttatcttattgaattctagctgtgatatctcattccaggaacaaaaatatattctgacttaccaagaaagcacaacaagacaaatgttacatttttaataaaagtcattgtaaacaaatttttgaaatttttatgctttttaatctacccaagtatacatcctccttattcctattaatttagaaaattgatatcttttccccttaaaactataggaattatgtgattttattcgttactgaaattaatgaggatacagtgtcaaaattatttggcctgtaatacataaaatgtaatattttgtgtttgaggcattcacagcaaaacttaggtaatatttttttttttttttttttttttttttgagacggagtctcgctctgtcacccaggccggactgcggactgcagtggcgcaatctcggctcacttgcaagctccacttcccgggttcacgccattctcctgcctcagcctcccgagtagctgggactacaggcacccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggtaatattttattgttaatgttccttggatgcttgtagaatggtgctcatttttaatagcttttaattaatttttatgtttttgctattgcttggcaaagttgtataataagaaatacttgtattagtagtcatgttgatctattgcatgccaagattatattggataatgtatgtatccatgaaatcaaaaagtttcagtgttaactttttcaaaataacagtataagaaaaatgcattttctgtcaaaactcatagagtttgagtttttaaaaagtttattgaagagaaagtcagaaccatactatagaattttgatttattttttattagaaccaaaggaatagttagtgctactctaaagttagatcagctaaacaattactgtatatacactagttttatttccataatctgataactttagaaacatgacaaaaaagagcaaacttcagagtcgtatcctattgtgacacaaatcagctatttatatccaaagtgtgcattcaaaagtattcctggttactcttgaatgtggacttgtggaagctcacaaattcaatctctgcattacattttatttctccatttactgatcctggtaataggccaggagctacattttattaccatcccataagtgcacccgacttgctttaccagactatgacacatatttttaagccattattatagcccccactggtacccaactggtcagaaaacacagattcaaactcaagacaagtaaaatgatatttctccccttcctcagacttgattggaaattcttcctttatgcaatcaactaatcatcaaaatcctattttgctggtctctgaggggaatctcaggcagtatagagagcaaaggactttgcagttttgttatgtccatggatctttgggttgtaagtaatagaaaacagttcaaaattgctcatgtaaaaagcagggttttttttttttttttaaatgcactcagtatttcatgatgttcaaatactgaaaaggaaattcatgagaatcagacctagaaagttgaaaaacacggttgtgatcttccctgtgatcacaatctgtgatcacaacaacacaatctgtgatctgctgtgatcacagattgtgatcagtctgcacccctttctctctgcatgttgatacttgtggtttgaaatggccccacacaaatcacaccttacggtctcttagctgcggtgctcactaatgactgtatctcaagagagagaatctggatcaacatggtagagcctaagagtgggagcccctggcccactctgctgtgaccatgaggttagatcaggtgaggcttctgtgcaatggacagtgatcgatatgtttcatataatcctatccctagaaacatggcacaggcactgaatgatagctagaaacccaagcctggagtgattaccagcttgcaatccattctgtggagaagggaggacttctactgatttttggaggatgagggcaattctgacagggagtggtatgagtaaaggctaaagattggatcctttctaaatggtgactagaagggtgaggggagctaaaggtctacatgaagaagttgtggaagcttggaaaggaaggctttgtagaaagccttagataataaaatttttactttggcatcctttgaagttttgttgttgatatggcttttgtgtgtgtttgtgtgttttagcaaggagtggccattggtcagaggtgtgctggtgaatgtttaacaaccagctctccaaaataaaaatgtgtatgtacatattaatgtattaaaaattttattgataggatatggacacacaatttacaaataataaaatatgtggctaagtctgaatgtttgttttccctcaaaattcttatattggaatcctaaaccacaaaaggatgatactagattatgaagtggggctttttagatggttagtgaccttataaaggaggccccagagagctgccttgctccttccactacaggagggcaccatctcaggggaaccatgccctcaccagacactgctgccaactcaaccttggacttcctaacctccagaactctaagaaataaatttctgttattaataaattgcccagtgtaaggtattttagttatagcaaccagagcaaactaagatatgtgtaacaccctttgttgtacatttcatatggctagttgatgatctcaagattctgtcagtgatttttgctaaacttttgtgcctgtatctcatctgcatctgcagtctagccatggtttcccaaatcaagttgcatcccaatctgcttattcttttcccagtaagtttattgtcattaaattttatatgtgatctgctgtaactatttctcatcctgatattaattacattctttaaactggaaacttttcagcgttagaatcaattagaaatgtatatagtgcaacaacagactcacaaagtaactgagcatttagcaattggctcctgagtttcagccggagctggtttcagtgagtaactcttaatgtctgagaggtgatgataccctcaattacaatgttacaatcctcaaaacaatcaatgggatttgattagatatgggagtatggtgaagacaaagaagatttcaggaatgtgtcctttgataaaggggttatgatcatccacaatggagaaataatataggaatccattcattcaacaaatatttatgaagaagcaaatactaatgaggaaaagctaaacattttatatgctctacaggatagttttctaattaattgttcaagtcaaccacagttcaaaaatagatataaataattattgatttctattaaattaagcctctcttttcagcttttagtgatgaccctacttgcacattatgcctgaaatgacatagtcgctggaccctgagccctcccaaagcagaatctgtcttactttcgtcctgtgttcccagcatccagctcaatgtttggcttatactattcaataaatgtgggttgagttaaggaacaaagaatctatacttggctccctaaaagagctagtcagtgatgaaaaggggcagactggttgacttcaaccactttctagagaaagtgttgacagtgttaaatctagggaggctattttttattcttttcaaatcccaggaaagtctatcagtctataaggaagtctacaagaaagattcaataacgtaagtatgttgcttgacactgatgtttctctgtcttcagggtgaaaattctaggaatcattgtttacagggacatccttgaattccaaatcctggaattaagctaaagatttgtgacttaggttggatattgatgtaactctaaatatttagcaaaaccaggctgagcaattttctctgcagcatataatgaatgtgcatactctatgcctctagcttttttagcaatttggaataaaatctttgggatttgttctgacacttttgccttgttaataaacatagtaagaataaggacaaagagaggattataaaagtcatttgtatggtcaagctaaaacagtggcatttacagaagtttataggaaatgtaaggaatgacattttatatacgggcttatttttcctttaatcctatattaataaagtgaattctgtatgggtaatacaggataccctctgtgagttgactgtgtttacaaaattcatttctaaactattgttcgcaatggggcatatagcggtgcatggaagcaatattaaatatagtttttagttacctccacaccagtctacaaaatctgatttagcaaagcatctgaagtctctgaagggactaacgatattatagaccagggtgtggggaagctattgtccctgggccaactctggttcaccccctgatttaataagtaatgtttttattggtgcacagctgtgcttatttattagcatattgtctatggctgctttggggccacaatgacaagactgagtagttgccacaaagaccttttggtccacaaacccaacttttcagtgggagtgtttgcctatcactgaatggtctttaatgaccacaaggaagggtgacctgtgaagtttattcagttttgactgtagagatcaatcaggaattcatgctaccctagtcgacccgtatgctggtttattgtgtctcacagcaccctcttgtattttcccgtccctccagacagtggtacaacttcatgtggcaggaattaattctcaaggtctgaagagaggactctcacaggacatagtctaagagacataaaagaatgggattggattgtttcttttggtgtctcaagttcaccgcagaggtgaggacatggctttatttggcgacaatgccttattgtcggatgacaattgtcggactagtgatgaagtcaattgcttgcttcctttcttcttgctacactgtccccataactagtctctctgcatctcagcccctgatcaggatgggtcttgcgatgagacaccttgcagacatgagttgatttttcaaaggtttagtcttggtcaggagccaatagagcaagataaacagaaataaagacagtgaggcaaggtgagcaggggttcccagactcctcctgcatttcagataatttattagctaggagagttaaccataaagtagctgtttcccatccgtcctaaactgttctgtattgtgttctattattctatgttatgctgtcagtatcactcctagatgacatctatataatgtttattagggaccatgcagggtgctagatgccctgcacgctaaggattttccttcttctctggcaacttgtatatatatatatatatatatatatatatatatttctccttcatctaatctttaaacaactgagtttctctagacttacttgtgagttctcttaatctcttattctatattttctccctagacaatcacatgaacatcacagcttcaagtgccttccctaaacagataactctcaaatgtataactctgtcctggacctaatttctgagcttcagatcaggatacccaactacctacttggaaacatttcctcttggctcactcatggtctttctatctgactcttcagtcagagactgtctcagtaaatacatccaccatccatgaaacttctaaacccagtaattcttgtgtcagttttgtcccttccctttcccttatcccctggatcaaatcacccagtctagtatgtattttcctctaaatataattgggaatccatctacttctttttattcatactgccatcactctcgtcaaagcagccgcatttctccctcggagtaggaaacagcttgttagctagtgcacctaaagctactcttcgcaccaatcatgttgctcttctatttgaaacttttccctgacctccttttactttttggaaaaagtccaatagcattaatgctacctacaagaccctgcattatctcttcacagctctcttcttggcctttttctacttcctcctgtgtgttctccttcttgcctttgaatacattgcttccttatccttagcctagataacccctgaatatctttctcagcagaacttacctcatatccttaatatgatttttttaagaatgatcagactaggtgaggacccccaaatttcccatttgcaactgtattcacaactgtaattaagtaaacaagtatgtaattgtgtaaaatgtgtcagcctcaccagaatggaatctctagaaagacaagagctgtatagttctgtttaggactgtgtttccatctcctaacacaactttatcattactgaaagaattaatgtgccgactgaatgaatgaatgagctcatttaacacttgcatacttgttagatatttattgttgtcaccatttatgagaactaggtagaactaagtttccaatctaggctatcagaccctcagaccatgtactgcgatacactgcaaagaaggtttagtgcttatttgctctcctggttccccattaccatgcataatgaaaagttgatgagttccagctactggatcctaggtaaggaagagcaaatcaatatgtaacagtgtttttggtgttaagggtcaaattgaataaattgtgtaccatattacccttacatttagaaaatggcttcactggatacccttttattttaagatcacttattgtatttttattttaatgcactcgcatataaaatgaagaaacagccagataatgagtacttgatccccaaatcatgaaatcaattttaatatgcttagaagatttaatattttcttagggcaatgagattgatgaagtcctgttaatgaatatattgatgtaattgaaggaaaatgggctcaacagtcttttgccatcagtgagatgaaccctatcacacaaactaagaagtaggtaaaaaagaaggcattaaagacattgcataagcataaaagttcattctaaacattttttattaataaaataaatttgttgatatagataacataaggctaattttctcttgaaatttacataacactaatataattattttaagtatcttatactgactccatgaatctgtttattttctttccatatcagagattgtagacgaaaaaagaaaaaacacctcctttttgcagtacattgatggaaagtattttatttcatatcatattttattaagaaactgatctattatgaaaaacactttttaagccaaataagtactaagaaatgtgaaaagtagcattgttttaaaaaatttaaatttcttttaaaaacattcattttctggaagaagttttgaatacaggtttaacaatttcaaattttttttccatctaaattctacctttcaaactgtattcccatgttaactagcctgaagacagatactaattgtaccccaatttgtaatgcatcagtttagcactattgatccgctaaaaaatgaaagcaaactaagcaagagccagtctcaataccaaaggaatgatatattgattccatctgacaatgctttgtctacagatcaatgtgtatgtgcagcatagaccagttaaaaatgaaacagggtggacaaaggtcgtgaaagaaacagggtatccaagattattggagatcatgaaatgaacatatcttaaagtatatctgatagttgttcacttataaaggaattctgtaggtttactgtgcaaaaaaatcataatgtaaatgttttatgatgacaatgccatatcttggtcctgggagtctctgaagaaattgagactcacttcttaatcaagaatgactttgtcttgattaagaatgactttgtcattcttgattaagaagtgagtcttagagaaaaaaaaagacatgatatggattcagtcctgctatgcttggtcataaagagatgactgtgtatgatatataatacatctgattcttaggttctctaatgcatgttttatattcctgcagttttttttacatttcagattttgaaaatcagatatattgggctgatgagagattgagagatggaagaaatgttttctggcataatcacaaagtagtaattaatcagactgtgagatttcctccctgtcgaataaaatttaatatactgtagtgaaatatatgcatatacaatacattatctgtttgttctcttcatcactgtattaaagaatcacaaatatgttctagaaccagaggtgggtaatgttgatagtatagctatggaaaaatagcctaccacaaatttctttttttcttttttattcctctacacattttattttcttgggcttgttacattttaagagcaaaagtaggtgtcagcctgtatcaacattgctactttaagaataaaaatactctgttttatgaattgttcaagttagcatgtctgtggggatttttgaagattcgaatatggtcagatgtgaccttctgagttgatgtaaaaagaacatagaaactaatttatgtgtagagatactggatttcagaataataataataatatttggaaatcacatattagaaagtcagaactagttccaaaaatgtatatttgggatttccttatctagatgctatttatgtttttaaaaccaatttgaagtctattcaaataggaataaggaaagaaactattatagcctgtatgcagaggaaatatctgtcaacccaaaagtttagcagctatgcaataaaccataatgtgtattcaggctttgcttatgcaacttattttattattaagaagtgtgaatattctgtaatagcaatctttggacaattgtatacacatgattttctacttttgcatttcttctgattcaattctgcattaaaatatgacaaatggaattcatgcaagaaaatgtgtttctgaataccttgcatagtccacatcttctgttattcataatccctgacaaaggatgacagatttttgcttttaaccactaaagtggaaccaccctgtggcaatagcataaagccagttcaccattcacttggcctgccagcatgaaaattctttgaatatttgagaaatttttaattttcaaatttgtgatttctaaaagtttgtttatgatatgaggatatagttcttacactattttaaataagctcaaaatgttactgtattatattgtctttcatcttataaaccttgtgctcaagtactgaaatttaatgtgtctagggttacctatttaggattttaaattatgttctaagatttaaactgtggatttaaatagaaatagtgattattattacattatagataatacatagtattaattaacaatttatttttatgatagcaaactttactgcctattaaagcatctaattttagtttatttttcttatagttatattaaaaaacatttgcatagaactgtaacatgtttaacctttctaagtaaaatgggactagaaaagctcctttattacattattcatcgtaagcttacagataagtgagagaatttgacattgttttcacaatctagcctataaaatggcttaggtttttgaattgatgattacctacttactcaaaactctttttttaaaatcaaaagaagccttccatcaaaaatgtccccaataaaatatgacagccttctgtgaatacaccctgtcctctgaccagtcaattccttaatatccagatgcaagaacttatatcagtcggtatgccacacactacagtgtgcaaagctaggataataaataaagtgtagcagtatgtttattaaaaatctatgccttaaagcaatttaaaacatttttaataacgataataactataataccatatacatgattaataggaggtttttactgtcttataataatactttccccttctctttggcatatgcttagtttcagatacaaacttttcaacctacacagccttgattggattggaaaatgtgcttgcacgctctctctctgtctctctcggcctctagatagatagataggtagatagatgatagatagatacatagatagatagattgattgatagattgatagatagatagatgacagagttgacctctgagagggatgagcaaatggcaacagcaacaagacatccaaagaggactagcaattgtccaaatgactacccacttagactgatttctgagcatttcaagcctgaaactgagttttaccaggaaataaatctgtatatattttatatatatatggaaagagagtgagcatacccaacctacgagagagagcaggtttgccagaacacttcagactgtttagggtgaaaagtgagtatctgaaaaagagtgtgtattgaagagaaggggatacacacacacacacacacacacacacacgcatatatgtgtatatatattgtgtatattacatattagattatattaatatcaatagttatgtttattacatgtaaatcaagcatattatatatgtgcttactagtcatttaaattgtaaccatttaaaaatgtaaatagcattcttggctcaccagctctacaaaaacaggcaacaggcagatttgacccacagggtgttgcttccagatccctgtgctaaactgtacttttaaagtatatgcagaagaagaaagctttcttttgtggatgatgtgttactaaataactatcatataatactaaataactcatattggctttgtaagaaaaagtgaagtagtttttttgagttagttttacatacagagctattaaatctgtagtgttctatgtggtcaaagtcatttaaactaaaagaaatctcactagttcaagggaaagtcaaaataataaccatgatgggggagaacaaaaattgcaaaatacaaaaggacaatatatattgtccttttgcattcaaaccatttttaaattcttacaattatcatcagctttagcagctaattttctaaatgttaattaaatagactagaacattctatttactattatccattgtcccttaaattaatagcaaaaagtgagtaatatcttgtaagttattaagaagcaattagtatcttaatacagaacctggactaatcacttcattgaaacagtcatctgctttatcaactttgctcaggatttgaacatgatgatcaaggaaatatatttaaaaaggaggactatgtcatttctaaaatgaagatatctgatgatttttccattgcagtgtatctgtattttatgaagctacatggctttgtggcctcttatgatatgaattagaaattatgatatacaaattagttctgaaaaagatggactgcatttttctcttctcttattctctggcatttgctgaaataaatacttacgttgttcagggcagaacagaccaagatccaccaaaagaataccttattaagtatgaagggttccttgtattaatgcatttcaagagaagacgcatgctaaccattagtattaaggagtacaaggcaacctactaaggcaagaatgtcaatcaactttgacagtcccatgtccttcaacatttcctgttttttcctaccctccccaattttcctctcattttccttgcttcctttctcctgtgttcttcttttctagataaacattttatctgaacattttacattctaacgtgttttagctctcttccagacacctcatacatatcatacctcatctcttaagtggtttttaattaagttaaacacattttggcctgttacttgtccaggaggcagtccaaaaatatttattgaatgaatgatgtagcaacataatatgcaaacaaaaaatagtttttacgtaatatgtagttttaaatacagaagatagttattatatatatgctcagtgtgagaaacaggatataaatgtagctaaaacacagaagttgttttcatttatgtcagtctaccatgtgcttagagtaacaataaaagatggtttagtaagatgaccattactattcccatttttactttgtctttacatatgacacatttttacactgttttggtcaataaaaagcctagctttccatattgattgctatcacgtacttattgaatccaggctttgtccctctaattactttcttatgctattttacatccttgtttttagtattgagtggcaaaactcattattaacttgagagtcttttgatctaaataaaagttaaatcaccagtatcacataccggcttttttccaaataaatgtaaagattttgcatttatggtagttaaaaagttaaaatgtacttttataatgagctgtgcatatggctttagtagttaaaatatgcactgagtaaatatcttagcccatatatatgggtcatgacatgatagatggaattattctattagaaataatatgaagaataaaaatgtaagttcactgtgtttatagtaaacatttgataggttttcatgttctttttgaacaaaatgttttgaaattattctcaattgcaagacctatgtgaaagctcaattttattcctctttattcattcttactgggaaagaaggaaagtctcagccgagtgtaaaatctttgaaattgttcaatttttgctacattctttttccatttacaccattgagaattgacctggttgtggaagctcagtctccaggaatatttgagggttgcgggtggtgaggacgggaggagaggatatgtcactatgcacccagatttagaaaactccccattctctgcgttcttttctcccatgcctccccattttctcttttcttgccctaattctgtttacaattcccatattctattctttctgtcgaagatttcctgctgattgtggaaagacaatgtccaagggaagactgacatacaaatgagtagagtgtagttctacacgtcattttctccctctggacctttcctctttcactggggcttgtccccttgtgccattcgttgcccaactggctttacaacagggcagccccttttcatttttgcttagttttatcatggtgtgccttaatttaatccaagaaacatgtttgaagattgctgtgtaaagcattggatgtttccaaaacagagacgggaatgtatatgtgctgatactagatcagggtgggttgaaatattattgtttcatttaaaatgtaagtgtgcaactgtatatatgtatatctatacacacacatatacctatgctgtatattaaaatattcataaaataatacacaagaaaaatgataacagtgtcatgtaaaaaaacccaacgctttaactttgttataaaacgttacttaaaaatccttttgcaaggattgaaaatacgagatatgaaggacatatgtcttcatgtctaaatttaaacatacaaaattataaaatgagctgtactgcataagaaatcagtgttctgaaggacagctgggacagaggcctttgggatcagactgaagaaaaatgatcacacagagtaacagttagaagataaatgtctttagtcaaggttttcaaagtgacattttacctctcctagaaaaaaacctgctagtttctaaactttaaaattccattttggtgaattagcttaaaatattagaagaatgtgactgtcagcgattctcttcagaaaatcaaagaaaacacaaatttacaatggtcattttttgctgatgcttatcaacgttttgattatggaggaatgaaagttttaaaacattttacatttaagataattttttatcttaaatgtgttaggtttacccacaacacattttagacttgcttcctaagtattagttaaaatggaacaataatatcagatttacggccgggcgcggtggctcacgcctataatcccagcactttgggaggcctaggcaggcggatcacgaggtcaggaaatcgagaccatcctggctaacacggtgaagccccatctctactaaaaatacagaaaattagctgggcgtcatggcgggcgcctgtagtcccagctactcgggaggctgaggcaggagaatggcgtgaacccgggaggcagagtttgcagtgagctgagatcgcgccactgaactccagcctgggcgacagagcgagactccggctcaaaaaagaaaaaaaaaaaaattacattcatgagtcatgtgtttgttgcatgatgctattttcattcaaagagagagtatggtcattctgtaaaactatcctgttgtgtaggaaataggactgtaattttcaaacttttttcacccaatgaaaaccttttcttcatggcagagctgtatcatataaaacataattaaatagtatttaaagagatactatgaatgtaaatgtctaaggataagcatttaaaacttatacatatcaaaacagtctccaatacatggcacaatatcatggtgctgtgacgtgttgtatcagttagtagcagtgaaatgactatagcgtgatgatgtgcacttaccccacatatgaccctaagtattgagtaccagggttcacatgtgtagcattctcatttgtaccatgttccaaatgagccggggcaaatttgaaacgctaaatcagaatcttctcttccaagatctattgtgatgtagtgtgtgactttcccatataaagtttctgaaatggttttgcaagccttacagtgctatacagatattagtaataataaacacctgaattttacatcagtgctcagaaagagtggactccaacctctgcatgaagtcagttagattgcttgcacatatggtggttctcatatgatgggattggaatataatgtgtctgagtgcattgttagtttttgttataaaaatagttgaaaaccaaatttaaatgaaattcaaatcaaatattgttgccattcttagagactttagcgaaatactaggatttcattggatacaatggaaagaacaatgaatgtaaaatcaaagtcttattataattttgcttataaataattgcttttaataatacttgtatagccctgaactgtttatagaaccattttacacattatgctcaataatcttcaaataattctcatacaatgaggataggatggttattattatcttttttttttcagaagaggaaatagactgagaaaaaaataaattcagcttaacatggatttttttctcacttaaaatcttaaatttccagtgtggcaacatcatttacatatagtgctcaataaaatagtctaagtgccactcattgcccaatttaagtagtgcagttctagtatattttataactactcagctattgttagtagtaccatgaaacagtatgtcaaaataatattgaagaataaatgtatgtgcttttggagttcttgttttagaggtagacaattctactaaaattgcattttataaaataatagaagaaattgagaaaaatactataattttttttccctttaacatttttacctatatattaacataaataatttctaatttaacatcttaatcatttctcatatgagtaaaaagacattaaatcctctaacttcatttggagagttcttgtctcttccccatgcaagttgtagctatgtagccagcaggcagacatagcattaagacagccaacttggacgaaaggagacataaagggaatgtcagagttacccagcccagagcccctccctcctaccaaatctgaactttttttcttgattctcatgtcattctttccaacttctcaatcttctaaaacaatctgcataaagcatcttaggcttcacactttacaaattaagcagataatgtctctaattagccttacttcttctcttcctgattacctccccatttgtttcttattatctttgtccatgccttcatttttgatcttagatcttcttttctatttattcaacatttccctctaagattccatatgaagtaaattcaagaatactatggaatagcattttaatattaagattttctcttactaaacatgtatttgcataaataaatgtaggttcacgtctttatgtattttattagaaagaataacctcctatttaatacagaggatgaagctttaagggaatataaactttttatcgtgcctgatatatttgagtatataattatatgcttactctgattaggtagatatgtgtgtataaaaccttcaaattttaatggaaacattaacttttgtatacattaacttgtgtctctgaatacattaacttatgtctccatgtaaacagcctcaataactctgttcaatgacataccagtttctgtctgttggtgttttttagtttgccctttgacagataattttttctaagttcagttaattgaaactaatattttgccaccatgaaaagttttaaagaggaaaaagaggttaaaatacacattggaattattgatttagcagcattgacatctctacataaagcacattgctgcttgatactgaaggctctcagtggatgacgtataaaatcctatgtgggaaaaaaggcagaaaataccgaaaagaacacatctgtttatcccaggctttgggagtttggaaagacctttatttaagctatataatgtatagaaaagggcagggatttcatatttgaatagttagtgtctccagttaggagttgtcagcagacatgcagaattgtcacctatgtttggaatgtgcggaggcatccttaccaattgctatgacaaggtctggatgggatacgtgtctacaatgcattccagttccagtacccaagctgatttggtgttctcattcttgaaatggcgtatggctctttttcggcaaataaaatcagcaagtgattgatgtgccacatccgtttggtgacgtcaactgccatgttgctgatacattttttgtcttctgcagatagagcctttttagggacttagatagttcagtgtcttaagaagatgaagacaggagagcagaaagatgggcacctggcccacagcatcattagccactctacgctactagtggaaagatacatttaaaaattaatgcttttttaatttaaggaaaaatatgaaattaaaattaagactatctcaggacttcttaaaaccagtcaaatgagtgtaacattcaataattgtcacttacctcaaaatcaataggatatatattaaacagaaagcttatttggtgtaatatgggtatgtcactcctcataaaatacttccctacttccctctcccagtgattatatatacttatttatactctcatccttaaatatccatacaaaaataattatatatcgcaactaatagtgactttcgaccaaacttctaataggaaaaataaaaaagttgactcttgaaattataaataatattgtaaaacaaggttagagatttcaaggttttccacaaagtaaagaaaataagtgaacaatttaaatatagatatagccttaacttgataactatggaagctagaattttcatgatagtttcctgataaaaatatgcatgtatttttgtctaattaattgtagtagcatataaaggtaccagttgcttttaaacaattaaaaggtttttttttgtttttttttttttttttgctaattttagtatagcaaggatagctttctgtaatataaaccacaggaattccattttgaaactgtgtctagtatactgtacaggtgaaataattactaggatgacacgtagtaattgggtctgtaactccaattaccctgaggcattgactcatttagacttatgcctttattcttcgggtttgtgagataagcttttctgtagaaataaattcagagtatctttcctagaattccaggagtctacaactctcctctccagaggaccagcaagaaatcattgaattatttgctaattgtgagcaaaatttgtattgatttttctctgtctctctagtcgatgttaatagcatcatacttcaggttactaaatacttttcagcaccatctaattgtcaaagattcacttactaagacaaaattgtagacatcaaagctatacacacacacacacataaacacaaagaaaatgatgacacaggcagtttatatgctctttcttacttctctttctcatatgataatgttttgcaatatgtatttcataatttgaaaccaataacaatttgaaaggatattaagactactataccactcagctccatgcttgatttaactgctgggcaagtattaatttctcattgcacccaagtgcagctaacagaaaaaaagtacatcaaaataagtatatatccatattgttttcatcatgttgtcatatcccttaaggatataagcagcatatcttttgttttcctattaaaatcactttatatctgtaaaaatagacactgtatttttcttatagtgcttaaacactgtatatggtttctactacaatgaaactattcccacatattataatttctacaatatattagcagagtttttaaaattaaatatgaatgtccgttctccacaccaatacacaaaactattgctcaataaatttgactaaatttagtgaaatatagtggtggaaagaacagaaaaaaaatcctttgggtgctcacagtagaattttacatgggaaaagctatttctctcatggcccctaaatagttgttaaaatcaatgtacctcatctttgacatctgtttgagcagaatgaatccatcttaaattcccaaatcactttcactgtgaaagaatgcagtaaatgaagcaaaatagtttggggaaatgagaaaatgtaaacaggccaatcagatgctgtttaatttcctggatagccagaagttttctcaaggaaaaatgagatcagagtttgataaaaggaaaacctacttataacccattgctagctgagggaagttttctcaagtatattgagattttaattgatactacaccttgaaatgtttcatagcaacagccaatgctaataagttacttagcactattgcttgatagtccataaatatctgttctgtatacacaggaacagtcatcactaatattttggatacaacttactatagtaagaaacatagtattctgaatgtcaagtgttggaatattcaatactttggccttttttgctgtttattaatattgatgaggttcttcttcagtaatgctgttggattattaattcctgttaaattctgagaacactaaattaaaatagactgttaaaaatttaactttttatatactaaggcttaatgtaataggcttttggttagtactactctgccataagatgctaatgtgcttgagtaatatctctggaaataggttcacaagacggaccaccaaaattatagaataaatttgacatcacactttgcttgagacggaattcattttttatatttatataagttctgcaggagcatcagcgatagtatccttttgaactaattagtgtcttcttttaaattcagagtaggaaatctcatctgctggttcccaaatcaacgttgactaattaaaaagttctagtgcacaacacaatcaagatagaaagaatccatatatgttaaaccttcatgtttggttgtcttgttttaattatagtttgtttctatccttgaaagattgtaagagatggtgaaaagtggtgcaatattgagctactcaaggtcatatgtgtgagaaaaactgttgaatataaactcttgctcattgtacataaagattataaagtgtcgcagtaaatttttcaagctatggtaggcagagcatttataaagatgagtgacaataatttcttctgtccctatacctacagtttttgcgatgtgacattgctcattttcctactgagaggaggagcccttttctttattgcttgaatccgggctggtcttgtgacttgctttgagaaaaataatgcagtggcattgatgggctgagctaacacctcatggggccttgctgattccacatttgacttccaggatcactgatgtccccatgtgaagtagtctggcctatgacttttgaagttgaaattactatgaggggagagtagcccagctgcccagctatatagctgccccagtgaccacaaacagcaccaactacctacaaatgtaaacaaggccacctttggccattcagcttcagtaaagatcccttgatgactgtagatgaatcagtgtccccaggtaagatcaagagaagaaccattcggcaaagtcggccctaatctctgacacacacaagtgtgagccaatgaaataatttttgtaagcccttaagctggctttgttaagccactgagttttgaggttagcaaggcagctagagttaactaatggatacaccttttattatgcgtaaggacaggtattagtctgcgtacatttcactgcctggcacagagtatatattaaggaaaaattattgaatcgaaatgaagtaagtagaaaactttatttcaagagactggcagcttctcgggggaactgggcaaaggaaccacatcccttattgaacttttgcctgtaagagtcacctccagtctcttgctgagctctgggcttgagaccaacattaagcttttcctcaaaaaatcacatataagagccaagttaaaaacatttatgcacaactctatgtgaaaaaaaatcacatgagaaagtgtgaataaatttattatctatttcatttggtgtgattgtgttggtttatttgaagtagaaaattacagatatttataggtatgtaaaaattgtttataaaagttttagctctttaagttttgtagaactactttgaaaagaaaggtaaacatttctaagcatactgagtattcaattagatatgctaattgcttacatgaaaaggtgtaaaaatcataaaacatggaattagtttgttctttaaaattaacattattaaatattctattctataatgcaatattaattaaaattttccaaagaaaacttgagcttgaagttcatagaatgaaataagcactttagtgactaaagcaaatggtcattcgggtcatgaaaacaagatagtaatgagaagaatgaaaaggtctgtatttttaatttccatttttaaatttttaaatatgcgtatggggtaagtgaattttaggttgttaaatatgcagtcagattggcaaatatatatttagggatgagaagggataataaatgtgctgtaagtccatacatcttgaacaaaatatgcgttcattttaatcacagagaggacacttttggttgagtttcattcaaaaaagggaagaaagaaatctgcatctttcattaaaatctccatctagctgtgtttccattagagttcactgaaaaatgactcataaaaccaacaattttatgcatcaggtgacaggttttgacagaaacagcactgcagtttttgcgatatgctacattttgaatgcttaagctgtgtgattaggtgtgctttatatgacttccacgtgcttagctagcaaaatctgagtttatttatataaaattattcaagtgaaaaaaatagtgtctctcacagtgagcaaagtcagatctcaaaaggggccataagggattggctagcattttatcaccaagtgagtccagctctgttaaaaacaagccacagaccttcttgcgatgcacaatgggctttttatttttaactgaccacagagtaaaaataataaatctgccatctgcctgtcaatagaaaataaaataattttccatttcagctctagcaaaataaaaatctgtgtctcctgtaaacacagaaaaaaaaaaatttgtaaagtaataacatgtgtgccagaagcttttgtttgtccatatgagaaatagctcgttgctaatttttagatactctctagacagttttctctgggcatattttagaataattgcatatttgagtcagctggttttatttaaaattgagaatccagttgttagaatattcaaacttactttttttactttgatgttaaatgagacactacactacttgttcttaacatgacatgttgatcacgcagcttcaactaatgttttctagtaagggaagtgaaaagaatgcatattttagagaaaaagggccctggatttccatctctaagcttaatgacctttggaatatcactttctgaaactcagaaatgtacatctagagataataatcccttgaaaagtgaactagagataataatcccttgataagtgatgtgagttttacagattattggccaatgtggtgcctgctgtataatagatacccaagaatggtaattattactattagtactggtatatttaataaatttctatttgtcttacttggatcccatcaattaatatgaaaaagttttaaatattatttgtggatacttatacgtgagatttctactttgtcaatatcaaaatggcagaataagtacagcaagcctaaaggctttagtttttagaaagactaacgattttcttgtgttattcataagtcgaggcaagttaaaggtaaagatagtggaaggaaaatgtctttgttaggtattgtatatgcagaatcgtactttgagataattgacggtattcaagctggataattagagaacgaaattttggcctttattaattaaaattcggagtatagtgaaatttatgaaagaattgcacatttcattgaaggcatatttgaaattctacaaagtcaaaaagcatgttccaaacaccctagttttcttgtacattttgttatattcatccgtcagtttcagcagctatattcattaagctttcctgataccacttttcaaaagtctaaatgcatttgagaatggccttaattctcaaagggaatcagaacatacgctatgtaagtggattcctacaaatttttatttcccagttacatcaaaattttcttcaatagcttaaaatccagtgtaagcaagtttcactaagcagcatttataatttccaattctttctatttaatttgtttgaattttaaagtttgaaaaatgatccctatccatataaaaaccacatttttaatttatttatgctgaaaggatcctccaaacttaaaagaaataaaattcctcctcccattctaaaattattatgattttatagtatttttctttgaattcatatgcttttcactatttagatcactacctttggcttaatgtcctcatgagaagaaagtaatgctattttaacgaaggtccatagggtacaggtatgttttggctccacattgcatcccaatgctagctagctcagtgcttgcccaaagtgcagttttatttaatatatattaagtgaataaatgagaagataattgcaagatctcactctttgactattccaccattaccagccaaaatgtgcaaagtctagttcatttcctctttatctctcccctctcctgccctttgattctcccttctactctttcttttttttgtgtgtgattcttttcaatcattctgactctaaaaagcaaatcctttttttttaatttttttattatactttaagttctcgggtacatgtgcacaatgtgctggtctgttaggtgtgtatacatgtgccatgttggtgtgctgcacccattaactcgtcatttacattaggtatatctcctaatgctatccctcccccaaccatcccacaacaggccccagtgtgtgatgttccccttcctgtgtccaagtgttttcattgttcaattcctacctatgagtgagaacatgcggtgtttggttttttgtccttgggatagtttactgagagtgatggtttccagcttctttcttcccttcattcttcttcctagcttccatctttccccctagacaaaaatgaatatctcattgaattatattttaaacaaggaataattttgaaagttgattcataggcaaaataatgtaaaaatgatccttgaaagtccttcaaatcatttgcaaagtatcatactcattcatcgtgagcagaagagtgagatgttcacatttcatgtgggaaacaggactgcaaagatttccaaactttatttcataggaatattgtttggaattgactgaattgtggaaatattatctttttctcccgctctctccttctgagcatatatatagttaaaatcagataaactaaccatgtttgtgtcaacctttatagtgaatacgaaaagcatgcttataagtgcagcagacactcattccaatcccccaggtacccctttgctatcactggaagtggacaccaattatacattcgatattctcattcacaaaatggcaatataataatacgtaattttgcggttcttttaaggttaaaaaagaaaatgcctacaaagtctttaaacagtactcagtttacagcaagtgctcaataaatagtagctgttcttattactagatccagcttacaagtgacaagattagcattaaatggattcatttcttgaatgtgatattttgtgtcctaaaaccaaaacatgttttttttaaataaaaagcagaatttaattatagaaatcaatgggaaaattaatcccagttgcagaaacaggtttgaatatcaaaagcacacatacaagccaatgtgaattgaattgtaatgttttttgcagttttcacttttcctgttgatccttaaaatgggtatttctcagggttcttgtcaggaattcatccatctcctcaagtagtgtcttctaatctcatgtcttcagctactacatggctgacatttccccaaagtatgtctatggcctaggtatcacacttccgtatagccaagtctactcaacattgccatttaaaaatcttaccaacatcttattctattttcttatttatctaaaccattttactgccttctctattaaactactatgaaattttggaagaaatactcataaaacaaaataaaaataggatatcttctccatcaattgtcttctgtgtcatttttcattcaacatttattgagcaactttctcatcactgcagttggctttgaggcacagagttaaagagaacatggtatctctccaaatgcccatctacttggattgattcctattagtcacaattttaaagcctttttttttttcacttcaatctcaatggctagtcatatccactaactggaatttaatttcacattcacttactattcctgcttgtttccattattgttttatttatgttataggatataagggttaaaaggaattgtagataatctactctgatttcctcaatttacagatgctaatggagcttcatataacttgagactttttcctttgtcaagcagctataataaatcctctgttagaatctgtttgataggaaaaaagtatgtaaaatttagttaatattcctgattatctctgagaagtattaaatgttttctcttgtttagtcctagtttttgttagattcttagattcttgaagacagaaactctaccttattactgttattttccaggttatgtttgagtgcatggcttggagtagtaatttagcaattatgggattaatttttatcaattgactgccaaaatcaaaaccaaataacatattgacctttttataatatgagcttccaggaagaacagtgaagaaagatcattagaagattgaaacatttctgatgtgttttaagtgtcttgcaaatacatgtttttttgctcccccgttcaatcagcacatctattttcaatcctcatttcccgttaatgattggaccagacaccctcattagacattttaaaaaatagaacttgtatgtagccttcttcaagattagcatcttcctcaaagtcttcttactctgggcttttttttttttttaatacttgccggtttatggtacaaatatttgctagcttatttctcttctttttaaatcttgtctgggacactgatattttaatggttactgttgtttaccaatataaacaagattgtgtttgagaaaaagataagcgttcaatttggttattgggtttttgcattttctggtgtcctgccttggtaaatttgcagagtcttcagttggcctcgtcaatttctacacatttccactgtcgtagtcatataggtcatgcccttatgctaaatccctgactcatttgcaatcaaaactctcttgattgcaccctaggtgttatattaagacaccctttcatttagtcattcttatacatttgaggcagaaagttggaaatatttgtattaatctcctgcagaatgatgtttatgctgtgacatcactctaactctctactggcatcatttgtacagaaaattatttttaatccatagtgcatctgacttataatacttcacagtttggcattttgaaaggtgtttcctttgaatatttttttcacatctagttcataagaagccatcatgcactcttaaaaatttctaggatgatgattatttttcattctaaccaattttacttaattgtgtcttctctttttcaatttatttatgttatttgtttatatccattcatttgtggtagaggttgacataatgctaagatcatttgttaggataccatatgaattatcatagtttgaagatcatggttgagttagctttttcttatagtgaacacattcctacagccaggctgagactgtaatttagtctaccatctcctgggtgtataaaagtggcttaaactaggagatggcgagaaaaaatggattagtagtttgttgttgctgatataaagtagatgttaatagtcactagcttgtaatttcaaaaggtaaaattattatgggagaacaaatagaacaatgaaactctaatgctgaccccaaaacagtacatttaactggctttacaataaatagaattactagtataaatagcaaatcttgcatgttgtttgattaatgagagaacattttttcatacctttgagaaggaaatactgaatcattgacggaaacttgaaaaaagtgtttcagcagttacaatcatttacgaaaaacttttaagttacgctaatgaaaagaatgtatggaaacaaatatggaaaaattatgacactaaaaatataatcgctgacatgtgaatatacttaattagggcaaaacagaagtccgaaattaaggaaaagcaaaaatcgttatactctttttctttttgagtcttgctctgtcactaggctggaatgcagtggcacagtctcagctcaccgcaacatccaactccctggttcaagctattcacccaccacaccctcctgagtagctgggattacaggcacacaccaccacgcccagctaatttttgtatttttagtagagatggggtttcaccatgttggccaggatggtctcgatctcctgacctcgtgatccgcccgcctcgggctcccaaactgctgggattacaggcgtgagccaccgcgcccggccttatactcttttttttttttttagatgtttgaggcaatgactaatatgcatttttattcattcattaataaatatcaaatgccatcatcctatatatcatctcatttgcaaagcaattttcacatgtgtttctctttatagtaatgtcctttgaggattgatggcaactaaggagctttgccagttaaatattcctaaatgtggaaggaatctgcaaagtaaatgcaaatgtttatttccctttctcttattaaaaatgaattatcaaggcccagcatgtcttcttgtagtagagtgatagaggaattattcagaaagtattgtcagtgctcatatgtaaccttgaattcttagcatcctatttaatactgtagtatgaaaatatgccataatatcatagcacattctatagaaaaccacacataaatagaactagtaaaaagcaataatgttgaaagctatattattttgtacttacaaagtgaacttttttataagttgaaacaacaagccaataaaattagccatcgaagatcccaaactaagtgtgaacaggagttgctgtctgtaattatttatgttttgttggagatataagaaatctcaaagcttggccctgcttcaaaggaaagaatattggttaggtaggaaagaggtagggggtagtcttggaactgttaaggaaacatttatgtgaaaaaacacttaatgatgttttaataaaagctaaaggatatacagtgtgctggattttgtgtgcaaaactttcattttgttccagttaaatactgagttctaatgtacagaagtgagaaattcagtggcgaatccaaaaagaaaagaaaagaaaacaaacagacttctcttcattctgaagtgccaaggcagccatccaagtggtagaagatcttaggtgccatatgtgctgttcttcctatggggatgacattttaaacttaactgaaatgactgggcttatttgaattctgctggattcttttcacttcatctcaacatgggatggctcttctcagtagaatatattcttagaagaatccacacttactgaaaaaggaggcatatcatggccagtgtcctttcatgtcatgcagttcccatcatggaacacaactcagggtcacagtgtagatatggcaatgtgaggcatatttggagggtctgcatctgagcaccaatttccctctctccccatttacacatcttctttctgtctcaagggtaccaaaggattatttgttgcttttcagataaaccttgctatttgcttccacactgaatagagattacagtcccctccagccctttaaaagtccagcacaccaagctttgccatatgtgagcaatctacaggcactattagccccgcttgagtagctcttgataacattctctaggaagtcaattaaagatgtcaggaggtgggctggactgcttttcttttactaacaggcattcagagagtggaagatggaactgtcagaaacaggtgattttgggttgtcaagaaactaaggctcctgatttgttttgtcttttcccctcattatttcaactttttttctttctgtgagctcttttagtttttaaccagcaatagctatataatagggaggacaaagcacctagtgtaataaatgacaataacatttgcttagtgtaagtttaaaatataaagagagataaagtcttagaaatttgagcgtagcgaaaatttctattaaggagttactttttgtgttaaaatgcctatatataaatacaagttaaatggttattcactaagaattggtcataaaacttgatcggtattatattagagtgattctctgcccttgcttcccatacaacagggatcactttcttttgctacaaatctcgacccttttattttatgtgctttcactgagaaagactatccaaagaagtaaatgactagattttattctaaattaatatgaagcaaagtgtcacaactatttatctaagctaatgaatttaagtgtttaaaccagattattctgtcctcctaagtattattttgttcggtcaaaatagtatttgttaaatattatattaatttaatatttgttaaattaaagtaataatagagaaatagacattttattgtttgagctacaacctagttatatgtttatatactaatcaggacaattatcactgtgggcaaataaatactttataagagactatatataactttaaatatctctatttgattatgcaaaaccatgataatgaatgaaccttgctctttgccaggtatgtgctaaatgccaaaaaactatttcacttaatcctcatcgccgccttagataagaggcgccattatccccatttcacagatgaagaaacaaaaaattagagagggtaaataacttgctccaaatggcatagctgttaagcaacaataccaggactcaaacaaaaggctttcaatcaccaaaacatgtgggcataacctccagagggcaaagaatagctgaagacgcaagattctgtttgtacttgcaattgcagaaaatataacctataagaattatgtgactctgagaagttaactgtctccaagatggtaacatacagttttgaatgttttaataacggtgaatgaggagacagaaaagattgaggctggctagaaggtttgggtttgttggaagaagaagctggcttaaatttttcttaaaaagtgaagaccagtcctgagggtttccgcatacctattaggaaaaggtgccatagttggttatacagaagaagaatgtaacactgatcagcaattcactcaccatcagcttttgttctccagtttttgtttttcttttttttttttatgaaaaaaaggcaattgtacagaatcaagctcatattagggatttattcaaagaagcaagtgtcatcatgaattttgaattaaaaatagatttagcttaatgttcaaaatcaccatctcacagcatggcataataactgattataatgaagaccttagttacaaagctaaattatttttagtatactttgattattaggttaaggaattgtaaaatatgcctgttatatcttatttcatcacaatatttttaaagtataagatctagaataaaaaattgtctattttcaaatcctggccacttttattaactagatgaacttgacatcttggaacttctgtcttttcatttataaacctgcccacctcacagggtcattgtgagtattcaattgaccttatagacaagaaatcttgaccatttagtagacactgttttattccaccccactagacaactgcaatattttaaaataaacattcagaacatgatctttaaaaggttatggatgtgataagaagtgatacaagctactggcttttttctgatcatttgaatacatgaaatttagaagttagtttttacctttgaaaataagaaactactagcatttcaagatcattccacagtgataccttcaatgcatattacattccttactaaagcaagagataagcaactacccatatattgagtaaactcaacaattagaccaatataaggaactttctactaaagttgcatatgtaataattaactatatccggtttagtaatgacaagaattgaaattcgttattcatctgtttattcaatgaacatttattgcgcacctactgtgtgctaaggataccattctagactctggaaatacaacagcaagcaaaatgaacttggttcctgcctttgtggagctagcttacattttattaaaagcagatagataacgaacacaaacaagaatacttttacacagtaatatgtgatattcaggggagaaaacagaggaatatgatatgtgtgatcttgctgcttctttagtttgggtagtcctaacaggggaaactgaagaagtgataagtaaactgagatttgactaaaagaacaggagaggtgtaggaagtcatggggagaataacaattcacaggccaactaaataatgtagaaacaagacccaaggaagtaactggccttgctagaagaagaaaaaggccagcatggttgggaaggaagggagcagaaggggtagatactacgagatgagaggtcatatctcttgaaccttgtaggccaggataaggattttcacttttttctaaatgtgatgggggtggtggagtgggtgggggggtccttcggagaattttatgtaaaaagatgttaacatttatttttataattttgaagaggttcctctgtctgctgcaggaagaattgactgtagtgtggacaggagtaagagtaagattgttgagttggctgctgtgtactctgagagatgttggtgactcagacaaaatgacaggggcggaagtcaggaaaatcgggtggattctgaataagtttcacagtcattggagcttacgaatggtcaggatggtgtgagtgtgttcatgggtgacagaaatggaggagtaataataattccttgagcgattcatagaagatgataccatgtacaaagacagggaagattgcggaaataaagacttgtatggcgaaaaccatgaattccattttggtaatgttgagttactcttagacattcaagacactgtcaagcaggcaggtggacacaagactgaagttccagagtagctcaggctggaggcatgcattttgggatcatcagcatggaggcagaaccagcaggggttcactcagaagaatgtgtggctggaacactccgttttaagtactgacgattttttaagggcaggaagcttttggcaaagtagatggatgagtaatggctagttggaaggaaattaagaaaagtattccagaagacaaggtaaaaaacacacatttaaattagatgcattttaatgcaatgctttcgtggtaatgatttcattatgtaggaattcaggggagaataaaaaaaaactgtaggaattttccacatattaactcttagcaaatatatatctagcacttattatagataaggtgcaatgggagagaaacatggagttattatatctgcattggagataatagctgatagctaatttcccatatttttttccatggccatctgattcttcagtcttataaggtactgatgtattatgaaatgaaggaaattaatcactatattttattgagccatccgctgttgtatggaagtcttattcgaccaaatattttaaatattgaaaaggaaataatggctatattagtatacttttgtaccattttaaatgattttcaattactaataaacaccatctttcatatgactattttttataattgaaaaaaacaacaacaactgggactctgtggtaaaaaataatatgtttttagaacctgcaatttaattattgggctgcttaatatttgagatctattgaaaatatagagtgaactttttattatgcaaatttattcagttctaaaaataactaaatgataataaaacattcttttttctttacatcatattacagtaatgaagctgttacctctcagtatgcattttaatgaattttaactaacattttaatgagccaacattattatagatccaaggattagacaaaattgaatttactggtattgagaaaagttcaccaagagttatattgtttaaagatggaatataatacattttatgataaaccatcaagtatcctgtatgaaaaattgtgctaatggttgaataacattatatttatgctatacatagatatattcttcatcacactttaaaaacattaatgatatttttgtttttgtatattcaatccatatgaaatataaaagacatagcatatcaaagaaaataatattttataatattagatttttaaaaaaaattttctttaaggaaatctctatgaagtatcattataagtttttattttttaaaggaggaatcatttataattttcttgatgtactttttttttttttgagacagagtctctctctgttgccaggctggagtgcagtggcactatcttggctcactgcaatcctctcctcctgggttcaagccattctcctgccgcagcctcccatatctgggattacaggcccgtgccaccacacccagctaatttttgtatttttagtagagacggggtttcaccatgttggccaggatggtgtctatcttctgacctcaggtgatccacctgcctcggcctctcaaagtgctgggattacaggcgtgagccaccacgcctggcctgatttacttacatgaaatagatttatacactcacaacttataatttgagagagaaaaataactttttataaaattgataattttgggtaataattgatattttaggttctatagaagatgtattaataactgtaagccgctctcaactaaaacacagttagtaatacttgctccttcctttagaacctcctcactcaatattctgttgaggcactgaaaggacctaagtctcaaatcaaaaggttgtcatcgaattcgtctttatgtctcttgtgcctagctcgcaataggccttcagttaatgttaaatgaaaagaaatgtccttctcaatagcaaagtttgtgaatttttagtctatctttgaaaaaaactcattagttgaattgtacactttgatcaggctcaagttaaggccatgcttactagcatcctacagatattttattgacatttacatttcaaagcacctaattgtggaaaattgccatttgtgtcactgaatgactcttgtaagaaaccatgtttctatactctcttcgcaactctttgtgttgaatccagttgggaaagacagtataatttgaaaacactccgtcaatatactttttctttatacattgaatttatacattggtaaacatacgtattaataagtagttaatacatttacagggttttaaagaagtataaagtagatgcagggaagtcttcctcccttattctttactttccagtattttttttttcctgcaagtgcatttgttattattagtttcttgtgtgttctttcagagattgttttatgtgcatgcaagcacattccagcatgtttcttttccttttctaattaattaaagcatacaatgcatattccaaacccagctctgaaactcgctcctccaaaaagccttccttatgaaaacaaagtttcctccattttaccttacggcattttaagtatacttgtccccaataattcatactttcatctttcagtttgtggtttttgagttaggtatggtaactttcctaaatctctttagcaccatgaggggaccatctttcattgaaatatcttgtactcctaaagtgtgctatatagagactggaacaacatgtgcagtacatacttgaatttaaaaagtgggtgattgagaaataaaactcttctgttacctcacagaggtagtctcaacaactagagctggttgaaaagtgaaaaacaaatatctaagtttgttatcaattaaacagagcaaaattaaaggtcatattaaaatcaacttttaaaatgaactaggtaaaactcactgggcaaaatttatacttttagattgggaagaaccatggatattagtactgtataacataaaatagtacctctaaatgtgtttgtttttagaattatattatatataaatccctactcgcttattcatagcgatgatcgcttttagcaattgcatagtaattgattgaccccaagacattaaggcctgaaaaattttatatatgggacagggttattgaagattattattattattgttattattattattagttttcttgagacagagtatcactctgttgcccagactggagtgcagtggtgcaatcatgtttcactgcagccttgaccacctgggctcaagcaatcctcccacctcagcctccaaagtagctgtgactacaggcgcacaccattacgcctggctaatttttgtatttttggtggggatggggtttcaccatgttgcccaaaatggtctcgaactcctgagctcaagggatcccccgacctcgtggcctgtcaaagtgctgggattataggcgtcagccaccatgcctgtcctcttgaagatcattaactatttgatagtcaaaggaattaaaaattgacagccattaaactcattgaagatcagatgcagaagtaaaattcaaagtctttcttgtttactatactacttctaattcctaataacagtgattcttttatgaactacttcctttacttttcactgtactttacaaagatcatttgttcaggcttcataacaaaccaaagacaaaggctttttttaaaccttcattttacagatgaaaaagctgaagctaaaatggctgaaggacctgtaataatttaataataaaagtagataatcatctggataataaaagtagcagaacagagacaaccgaggccatctgactaagcccattatctttaccacagtgctgtgttgccttcctgccaaatagtagtagctccataaacacttgttaaatgggagttccaagtccctaagaggaactggcatatggtggaggggatttcgagtgcattccagaaatagagaacaaactgtgtttaggccctaaaaaaagaaaagagcgtgttacatttcaggacctgaagaaaggcctgaggaaatgtgggttgaatattatgattgaagtgacaaagaagaggctgtagagacaattttagaggctagactacttagagttacagggggaggaaggggactattcagcctgaatttcctggaactgtcctgcaataattattaatagtacttccttaggatttcaaaagtgttagtttggaaggtaaaatagaaagttatccaattcttaggtaatgttgaagatttttttttaatttcagaatgaatgaatgcatttcctcctttgctacttgggatattagaaggaaaatgaaaagtctgttagtccatacttcatatccagcacttttatcaactgagagcaacttcagtgattggttctccagtgatatattgaagacatttgtcataaggccctagccctctaaagcaaaggtctttcctttaactaaatatggggaaaatatgtcaagggcagtattaaacatgtgcattagaaattactgaatctgtatataacatttgagtatttagtatccactaatttatttcaaaaattatcccatttgccaacttcagattttttggttgttgttgctgacactttagacaacttgccctacattcacaacagccgtaatttgttcatcaagagtaccgagaaaacaaggttctaattttactatttgtagacagtttttagagggagtaaggttaatatggtgcatgaaaaaagccaaaaagagattaaggcagtttgtgaattttagtaatatggcataatgaagtgcctcgatcatgtcaaaataatggaggtttcgtagactttctggtaaatcttatttatcaagtttggtaccatcccagggagagaaactcaaaccatctcatgcagctaagtaagtagtaactacaatgtagagatttgcttcctctctgcacagaaaggaaatggctatgattattttttatctccaagcattctgagaatgaaagtgtagtaagtcctcaggctaggagaaacagggtagcccagggaatagatatatagctagagactcagaaggcagtactatttgttttcttactgctgagcacatactctatggatggtcaaggtgactccagtgtgtatcagaggaaaagaaggattttattaaaactctactgaagaaggcttctttccagtttcagctaagatgtgaaggtttgattaaagcatccatgagttttaaaatatttacatacttttgggtaaaacacacatataattaattctcttcatgagaactcagtattacttataccttaaaaagatactcagtatctgttgtttgatatcagtttgtctttaggaatgtaagaaactgtgcttttcataagtaaacaaacatcttcaagcacattgttctccaatcactgtcaatggtgtaatatgagttttctgagataatttaaatttggtatttaggatatttgcatgtataaaaagtacttggatatgctccttgcttcctcttctcctgctgaactgtcagaagatggtgatgcttttgaagatttatggtagatgggtaatgagattgctgaatgttaactactgcatttggaattcatttagtagcaaaagaaaagaaggttactgggattgggatagagtagaaaagtgatagagctatttttaatcagtgaatttaaaaatcaatatgatacgttctgaattaggatacatttcaagtctcttgtcatgtagtaatcaagtagaacatttcttgaagaatataggatgtcaaattggatctaattcagcaaaattcatgatagtgtagtgcccatattttgtgatgtggacatatcaaattttaatattggaagactaaggctaaaaaatccacaagcatgtggaatatgtttttaaaattcaaaattcgaatataatctattcagttaggctttggtttatgttctggtgcaaaagaggaacataaaccgtgtactctcaaactgctcatttttgagtttatggatgatgatgtgattcatgtgaaccccctatctaggacctccaatggttatggttacaaaatgtgttgttaaaatagctaaaatgatggaaatggtgaaattagcagaatcaagttgtgagcccatagatataattatatttctactctattcggagatttgttgagtttcgggtagaggggaaagaaaagataaagcaacaatagtgttaaagtaactggcaaagaaggttgaccttgaccttcttttcctttcaaccctcatttcatcagcaggggtgagattactttgagaccctgccaataggtaataaataacacataaattccaggacacccttgcactgtagggtgccctaatgtgtaataatccttagactattgagtttataactcatgacatctggcagttacttggcattgtaattcatgttgatcatgcacatcagaatacacaacagtagagaaatatcggagcaataacacgttgataccaggagaggctagaatgacaagagatgctgctgaaactgtgtacctctgtgaactgtgcagtggaatgctgtaaaagctaatatcttcagataaggactaataaggtgggaggagagaggcgatctgttgggatccagaataatgcagcacattaatatgtacttgataacactctttatttcctttattcaaatggacaactatagctataagtcagtaatgaatcctgaaatttggatttaaatatatacttagatatattttaatttaaaagtgcatgtaaacaaatgtattgaattcaaattttgtataaatatatgtaaaagagatttaataatttaatttttgttttctttggtctaatggtaagggctaaatgaggaaggaatgcagagagttagagaaaaatgagaagcagtagggaaaccaggcaggcattctacaaagcacctgtaacacacctacctggtacctagcagcctaactactttgtctgaagacccgaggcccatgggacatgaaccagactgaaaagctagaagcagacagatggttatttgtaatcatcctgtaaatgtaaattctttaaaactggtgggcttgctggctttatcatctatctgtctgtatctatctatctatctatctatctatctatctatctatctatcatctatctatctatttatatatctatacccaaacccagatctaagaaaagtaggaggcagtattataaccttaaaacaatctggtgtttccccttgttaccatcttaaaaagcactaatataaaaaaaaaaaagccagcctgtgtagttcttaattttaagttgactgtattatatcttctaatgcccaaagttataagcattgctttgagcaagccaagacagttttgtccgaactgggcaggtgctgaaagacagttgcctgtggaggagaacagaatgtgttgggagcatggtgagatgggtttttgttctgcagctgagcaagacattgccttgaacatgtttaggttaatactagcatttctagaaaccatcctcctcacatgctatgtttggacacaatctctaacttgatctggtttctttgagctttctgtgatttcggagacagcaatgccacgtgaacaattctgtgggcgatagctctttaagggagaaagaaaaggaactgattaaacattaatcagcttcaatccacagcttcctcataagctaatggataggctatgcagatccctgtcaaatatcacatgctaggctttgccaaaaataggacttccaagtgttgaaggcatgccaactgctggctctttaactgcaaaccaaagcaaatgattgccagagacaggcctagagtctgccgtggtcagatgtcaccagtttgcagtgccacatgtgatccaagagtttatgaatgatctcaacacttggtccccaaggagaacatatgcattacagaggttatggatacaaattacagagagcgcgatgtttccatgcaatttctaagaatccttcagcaagttttaaacataagtggaaaacattaaggaagacttggcactcttagcaggacttcaaattatattgtgggtgaggacagaacacggctaaaaaaaggattcaagaataaagacttggctaagaaactcgaagctggccattcctcctgtgtgaattatgtttgtgtttgtgtgttttattccctgcagaatactagacttcacaaaatgctatgacttgaaaatgaacaagtcacagggcattcttgtttattcaacatgctccaattcctaccgctggtttatctggatcatttgctcagtgaatgtgcctgtgcacagaatctcattggaggtgggggtgagagcttctcattttggagttgtcagcatgctacagggtgccagagtgtcagcttgcacagcggcccccggatgtctccccactgagttctttctttcccattccccttctgtgcagaagaaaccacttatgacttatgcccacatgttcagatgttattgtctatttaactggtggctagcctgcccatcctgaccatattttgttcaattgtaccaaatgtaataaagtagtttcttgtgaatgacaatctttatcagttgtttagtcattaaaacttcagaaaaatacagaattattatgcgatgtcagtggggagcttctggttgaaaaaggaaacttacactggcttaaatataaaaggaaacatacctagaaagtccagagttagcatagttttcagaattaatttgtccagccatgtccttaagagcccagatttttttacactttgtacatagctccagtttcatcctgaggatcggtctccccctggggtcaaagcgtggctgccacctatagccatgtagtccaggaagagatagggtgcttttttcatgtgcagagtagaagttctgagctgcatgctggttggggttacactcagtcattccctatggtaactggtggtggtggtggtggcagtggtgttggtagggctaggggaataatctgtggtagttttatgagtgaccatcattgttttttctcttagtccattggaataatttaatatgatatacctataatttgtgctaccagtttttttggctgacataaatctgttctattccttgagtcgttgatttctgaccttcttgaactgtctggcttttattttacagatatatgagtatgtagataggcaagccaagaggattctatttcttaaatccaaacaattcaaattgttcttcataaatgacattttaaaatcaaattcaaacactgtggtctattttatatcataaaaaaggggtgcagcacacatcttgaaggagagcacatcaattcaatcaaccaatcgacattatttggttaacttttctgatacccttcaactagagagctctttggagggttacccagtccagttaagtagataaggaaagacttcagatgagtgagtccaaagttgacactgaatgaacagtatgtacttcagaaaggcacaggcaaaagtaagagaacaaagggacagctaggagttacttgcaggcagaaagaccatcatatgccaacttacaatgataattaggtgttccttcatatccctagggcatggaggttacagaaatgtccctgatgagcctggagatatatgcagggacctggttccaaacaacatttgaaatcatattaaggagagaattttatcttaagagccattaaaaagtgttaaaaagggaattgacatgatcacatttgcattttagctaactcataatagctacaatggaaagtttaaaggagaaattagagaaaaaggtcaaataggatattcttacagtaattcaaggaagatataaggacattctgaactagggcagtggagagaggatgaatagacccagatgatattgcaaatcagtgcagcataatgactgtgtataaattctagtgtcagacacactgggttgaaaccctgtgcttacctaacacaatagatgaggctccaatgacctattctatatccatgacgctatctttggcacatagtatgtactcactaaattttagctattatcatagaacaagttattttaaaaatagattaaaagtgtcattatatgtgcctgttaattaatttttaaaagcaagtctaaaaaattcttactgaaaatcagcacataattacatatattatatatatggataagtaaaggctcctgagtatgcttctatttatcataatttactgaaactgtattcataaactaaaatgtatgtcatataaggaactgcttcgggctagaggtcggtcttctactgagaagtttggatgtcattgtgccacataactccagcagttctgatacatacacagagagaaaacctgccggcaggaaagacttgtgttcagtgttgtttgggtctcctgcggttttcaactgctgttggccgtacctttcattacaattatttcttagattatctttctcgtaatgtttagttggttgtggatggtattctttattcaatgatgtgtgccaattcttttatcagtaacattttaggctttacccttctaataactttagttgggatcatgtgcacattgtggtttagaaatgtatctttcagaagtccattagttatacagtctcacttcattgtcattgctaatttgttttaataaactaagatggaaatgactaagtagtgatttgcctagactgaggttaaaaaaaaattctaagaactattgatttaagacaaaacagagagggtttggggtgggaaaggatatgggattataaggaagcaggagccaaagatataagctctaaaatcacagctggacataaaactttttaaaggcactctgttagttacctattgcttcataacaaattactacaaaattcagtggtgacttgagtcctcaagggtttttggactgagggccttggtttcttgccagctgttggctggaagctgacttcagatccttgccaaatgggcttctccattctgcaacatggcaccgtgcatgatcagagaaagtatatgaaaagagagtaagagaggagttcagactttccctctaaagattcaataacttagtctgctgaaatacactgacaatagacatattaacaggagaaaaaggctacatatttactatgcacacatgtgcatagaagccacacaaaatatgagactgaaagaaaggtcaaatacttgaagcttaattattctcctcatagaggagaggaaagtgggagacacaggcaattttagaagaataagtgatttttttgaggagatgaatgggcctgaagaacaaagggtggcctgggacaacatttccctgggctctgggtgcggtgtcaactctggtctttcctcctgcaggatgcgccaatttcccctggttaatgagatatctgagaaaggaattaattgaataccttctggaggacagcatctttaggtagacaggggatctttagagaaagctctttcttccatttgctactcactgggtgctcttagtttaaagtctgaagtggcgtattttggggtatcattttctaagccacaatgagagagagagagagagggcaaaaacatgaaggtcacaatcttttataaactgatcttggaagtggcatcctaccactttgtaacattctgttcatcgaaggtaaatcgccaggtctagttcatgctcaaggggaggggatatacaaagggaataaataacagaagggagtgaccattggagaacagaacaagggtctatcacaggcactgtcatgtcattcttgttaatctatttcttaaccagttcataggagagtgtttgtcacattacagcattcaatacatacttgcagaattttaatttgtcaaaaatctctatgtcgtaaggtagtaatttagaatgttccaattttccaaaataatttcctaagtcatggtgcatcccaatgtaaaaaaacatgcaaatataattcaggttatattatgactagctaagtgaactatttatatgtgttttccagctcacatatggaagtgaatattcgggttctagccaattacatatcccccccacctcaccccatggagatttgaaaccctgtattctaacttagatctgaaagcaagttctatattagaatgtacctaccatatcccttttctttttaaatgaagttttaaaaattctatttttatttgacaagcaatcgtatatattatatatttactgggtacaatgtacacctgttagaaaagctgttatctgaaagatgaaagataaatattggtaagggtgttgagagaagggaacccttgtatattttgttggggctcagaaactgataccctgaaatatgtcactgaagcagtgtccttcgtctggggtaatacccaaggttcgttgcctcgtgccaaggaaatcaaggacatggacacacaaggactgagtttaagaacagaggtttaataggcaaaggagaaaccctcccttgtgcagagggaggggttccgagcgtatctcccagggtgcgacgagatgcggttggttttatagatgagcttgaggatgcggtgtctgattcccacagggtttagaggattggttggggcaggtgtgtcatttacacagagcgtgaagaagttggccaccccatcccaaccttttattatgcggatgagttctgtacctggtcggcacgatgttgcctgcttttttactgcacctgtggcggaagaaaaaaataataataagaagaagaagaagatggagcctccgtgttgaatagacttggcttccaggtatccctttctatcggcacagctgcggcattcacccgtgcaagcttccggcttgcttctctatgtctgcagttcgattttacaaactgctctttttttttttttttttttttttttttttttttttttgagacaaagtctcgctctgtcgcccaggctggagtgcatgaactcgactcactgcaagctccgcctcccgggttcctgccattctcctgcctcagcctcccgagtagctgggactacaggcacccgccactgcgccaggctaattttttttggtatttttagtacagacggggtttcaccgtgttagccagaatggtctcggtctcctgacctcgtgatccacccacctcggcctcccaaagtggtgggattacaggcgtgagccaccgcgcctggctgcaggctgctctttgttagaaattatttggggctgttttttgttaaaagggaagcctcgctgaggacttgtttaccctcactatctgcctaaataatttctagctcctatagcagcacttggacatgctgaactgaagaggaagcctcaagatctctctgaccttccttcctccaaacccccatctctcaatcctctgtgtctcttgaagcacaggatgaagttgttctccaaagtttcttacctgcctaaagtccggacctaccaaagaagaaaaccattacctctggccccttccctgaattttcatgagctcaaatgatatcgcagaaaggaagactgaagttggacaacaaacctgggcaaactttcgtcaaaaaccatcgtccccttgtgagccgaaaagacttagtcccaggctattgtatgttctttaaggttattgaatccgcctaaaaattatctatacttccccatctccctttcccctaagaaacggagtatataagcattggtataccatagcggtgttaggcaattactctgtgattctcctcagggtacgctaataaatttgtgtaccttttctccaattaatctgctttttgtgagtcgatttttcagtgaaacatcagaggcaaaggggacgctttcccttggcccctacaacttggtagaaatgtaaattaatacagccattatggaaacagtatatcctttttctttaaaacacaactgctgctaccctgtcatcgaatttatttctcttcatcatatttaaagactttttggagagttaggtaacacacactgtggtatgtgctcttcttttgacatacgtgtcaagtcacacttgaaaatatagttttcagttctttctagggtagaggatttagggggaatacacacacacacacacacacacacacacacacactcaatttagaatttaaaattgctttgctattttctacatttaccagaccattttagttctcttaatccgacacatgggaatacttcaccatggctaacactttcttgtttttatcggctacgataaagagcacagggcaaaatccaaggcagaaatgaataattagcacaaaaatgggaactgatagatattattttattttacttttcttacatttatgaatgtaaatacagaccccagaaacatataaacaaatatcagaatatacatatcttccttcaaaatttgagaagagtaaaaatgattttactcctttttctaaaaataagttctaggctgcctatggtggaacctgctgaaaagcatgtttttcaactgagagagagagagagaagaaacatattataatatcctgaagacttagggttaaataaatgatatcactaaacacaaatggatttactgagtactatacaaaccccaaagagcacattacaagttgaagagggtacagtatcaattatatcattatctcaccctactctctgggtgaatagtctgaaagcctaaaattacagttgatgttagatttcttggcttcatttgcaaattggagtcattttccccctttttgttgaatgccataagcacatgttttattgttgaagagtaccagtccttatagtttgttatgatgtttttcttctttttgtcctacatgtcaaaggacctttaaaaaaaaatggattgtggaaaattggtgtaacgttgtatttctgaatgatttgcaatggtattaggtactacttgtgcttaggctttttggcataccattttttaggagagcagatctggagaaggcccttcaactggccagctgtgccattttggaacagattgagggcctgcaaaaacaccatttgttgccagtaccggatattgtaggggtgctcatcaccctgttaccatatttttgcacttcttaacattgcataaataggcagctgttctgtatttagaatataaatgagtcaccagcttgctctccctggaggatttacctgcaagagggaaccacggtgttaaccccttctcatcagttgcatgaatgtcacatttaaatgcacactttcctcagcccactcagaagcaaatcctcatgcatataaatcacacctttcttgccagttagacaagggggccaaaaatatgcagttcacagagctaaaatggaacacatttctttagcagtgaaatcagtaaattaatcagcttataaactgagagtgagcaatttgtgctgaattatttcttactgctccttcaataagagacaaggtgctctaatctcataaagggccatgacttcattaagatggaaaaccatgttaaagggtgtgttgcaaaatacgagaaaagaaaaaccctgaagtcactgagttgactctctggagctcttttaaggacagggttttttatttatttggggaatgacaattaacctacagacttggcacaacaaagaagcagagtgctgaagtgggtctcattataggacacggaaggcagttggtttgacctaatccccagtcgcggcacatgatttacataacaggctaccacaagctgcctaatgttgatttcaaacagcttgatgtgtgcatgtgtctgtgggtatgtgtgtgtgtgtgtgtgtgtgtgtgtgtgtgtgtgtgtaggttcattttacctcaaggtactttggaaccaaacatgtcggtgttggaatgtccaagaacagaaatagtaaagccagtcaggaaaagcagaggcagttgcagtatatggtacatttgctgatctcaactacttttttgaatgtttaccctaaaattaatgtagctctgatttaccacctaaatgcagtccgatagggctgagccatctctccaggcttttcatcttgtcaggagcagagaagcacaagtagatagataggtgacatttggagaggcaggcatgccagattttcggtggttacagcgaaggtccaacctgctgttctccttaatgaaaggagggaaatttcagacaggcaaaactgctataagggatatctctgccctgaatgtcacactgcccagatgtcactcggcaggtggagttgcagaatgaaaatgtagccctgcgtatgtgggtgctagtgtgctgcaagggtgaactatgaatctgtcttctgaagtgtaatgaaaacagtgtggatcttgtctatgtttgtgtcatgagaaaggactttgtcaaagaattctcaccccactttccctcacagatcattaggcttgcaggctcacaaaccacatgcatatatatatgcgtgcacacacacacacacatatatgagtttctatatagaaaatagaattatactaatgaagggttctgcaccttgcttttttaattaatcgcagaactgtacatgaatatttctcatttttttgactgatttcatttttaaagttgaatttttgaccaaaggtgcatgataatttagtcagccattctcctgttgatgatcatttatgttggctccagaatattttaaggtggatgtagctatgttctcagtaaaaatccaggcaatttttactagaacaaggtaaacaagacttgaagttaccttgtacaacaaaaagcctaagttactgtcgttgagttttcttttcctgtaattatttttcctcagtgttacgagatgacttccgacaaaaccccacagatgttgtagtggcagctggagagcctgcaatcctggagtgccagcctccccggggacacccagaacccaccatctactggaaaaaagacaaagttcgaattgatgacaaggaagaaagaataagtgtgagttaaattaaaatcatggcccagagagattgaattttcagtctcaaaatacaaaatagatgtattttattctttaacattattaatacaattgtatttgaatgttaattacaatttatactgccttgaaaagatttaaaaacatttggatgagactacaagagacaaaaattatgtaaatcaagtgtacatgaaatattaataattgcaccaatctgagttatatctttacactgcaatattgatattttagctctttttttttttttttttttttttgagacagagtcttgctctgtcacccaggctggagtgcgatcctgctcaccgcaacctctgcctcccggtttcaagtgattcttctgccttagcttcccaagtagctgggactacaggtgtgcgccaccacgcccagctattttttgtattttttgtagagatggggtttcaccatgttggccaggatggtctccatctcttgacctcgtgatccacccacctcagccccccaaagtgcttggattacaggcgtgagccaccacacccagctgatgttttagctcttttataaaatctccagaagcttctgttgatcatgcagtacctgagtgttaaagtataaatgatagccataaaccacattaactacatctaattttgcaccattttcaaaaattataagagaaattaatttaaggtgatgaatatctcaaatgctttttccagtttttccaattgaataatatttataacagtaaaattttatacatgaattgatttaaaaggaaattgaatagatgtaaaataaaatggaaatcaaaacagctgactgattctgcatgtagaaaaataactgttttcaaaggaaatttataatcagattcatcagttgattaaaattcaaaatgaaacacacagaaacaggcaaatggcatgtaatcattttatttcttcagaggatccacgcaacatttgtatgtgaagtttttaagtgagaaccaacccacagaaatagtatgtaattgcttaactttctgatattattcagtagtataatttttatattcaatacaactgagagtgaatacatttaagataatttctcatttgactgaataaatgtgccattttaataaaaaaactataaagtattggtatctattatcttaaaaatatgtttattacaaatgaggatttttcctctgtgcacagtgagattacaacataaaacagaactagataggctgtggaagggatgacaatgtatattcatgcgtttctggtatagaggcaaagatattttttcccttcaccctctaaaggtttaagtcttttagtctgctgaaataaactggcaatagacagtttaatggaaggaagagcatacaaatgtatttatatgtaagtgcaagggaatcacacaaagtataaaactcaaagaaaggctagatggttgaagcttaattaccctcttcataggatagagggaagtgggaatagtaggtgattttagaggaagattaaatgattttcagagaagataagtgggcccaacaaatagacaaagttcctctggcctctgggagaggtggtgacaagttctgggaaggtgaggggcagaactgcactgcaagcaaaggttgtcttattatgtagataaagtctcagataacaaccccaagaagaatagttgaacagtctgtccagtaggcatggtaatgacctttagtttcttctttggtgattaatctttgcaggttactgagatttcagacaggggatttaaggcaattgtgtttcttttggaagaacttttctcagtcagataaggaaacttcagagagcttccctctctgttcttggggcaagtggaggggagaaacaaaggaatgtcagagagacattgatgttaaggaagtttctaatgacttacaatttcctttagttcaaagtgctcagaaagccaaagcaccacattttgggatatcgttttctgagccccaacaccagtctcactattaacactgtgagatctacattaccaaagagagttttgttctcagtggtcttgcttgggtaccaaatttatgaaaatgtactcctgatgatggagtaaaatcattgtttatggattggtagtttatgtttatagcatttagctcttgcctatttaaaggtgtgctggcagctgaataatccaggatgaccttacccacaagtctggcaattggttgactctcagctgggtatcttcgttcccctccttatgatctctaattttccagcaggctagttcagtcggttcccatgttggtctcagttccaactcagcaagagaaggcaagacacaatgtacaagaacctttcttccagtgaagtatttgctgtagttccattggtcaaatcaagtcatattacctagctctcagcttcaaggggaaggagaaatggccttcacagccatttttataagctctcattttattctaccagacagaattgagaacaggttaatggtctttttcacctatgtaaaaaaaagttgaaaattcctttctagaacatgacaagttgtaaatcttgaaacatctctgataagagccaacgtacatgagttgtgtttgcctgtgaaattaaaaaataatggagaaaaccaacatgttcttatcttgtatttcttcaagaacactcaatcattgtaaagctaatattgaattaaatgagtaccaaaaaaaaaaaactggaaaagaaactatgagttatagatttactgaaagcctaactctgctttaatgtcctccttagcaaatacatattttaatattattgcatttgtttttatcagccaataaatgcttctcatttaagaaatcttgaaggggaacctattagatgctaatggtttatactaatacatattaccattttataaactgtgtttgtttttatccaacctgccattttctccaagaattatctcttaaatacaattaagatgaaacaaagatgattaatattaacagttgaaatgtgaattctagggaggcaaagatttttaccgtttgatttaccactgtctcttaagtgtccagaatatgcctagtaagtatggatatatatactttctgaatccctctgattcagcaggattttattagattatttaaaatgaatatctagtatttctttctgatgacaaatgacaatagcaatttattcaaatgaatttcagtgtgaagactaactactgggatttagggaggtcagtcacaagactcaaaatgcgatcaggaaagagaggacagctgccttaaaaaatattttctatgaagaaagtatggaaacttacattgagggtgaatttaagaaaagaaaacatacctgcaaatgccaaaataatgggagagttttttcctttgggaaacaaatatgctcaaatactcaaaactatttattaatgacctttattttctattctgttcctttttcttcccttctcttttctttttgtttgattttaacagatccgtggtggaaaactgatgatctccaataccaggaaaagtgatgcagggatgtatacttgtgttggtaccaatatggtgggagaaagggacagtgacccagcagagctgactgtctttggtaaaactttcttctaaattataaatttttatttttatcaatttttctttgcttttaagtattactaacattaaaaactgggccatataaggacagttactcatgactcatggtaagcagtgacaaattagaattatcttgttttctgtctttctaatgaaagcttcgatgtaaagaaaaaattatttgaaactttaattaacttacattgttcatgtatttgtaagattttgcagttcatcaaaatgtaacgttctttctcaaagtctatttgagatattacatctatctaaagtttatcactcattcaactctcatgcatttatcaggtagctattatgtgcaagatacagggtaaggatttttaaaagttagagagtatagtataaaaaaacttgttttccagttcttagaaattcaaactgaagtatttataatttcaactcttgataaatatactatgtatgcacacatataaattcaaaatcagaaaatggacccctaaaatgagatattttgttatgatattcatgttccttcaactttaagaaccaaggctctccttagctggttaaatgcaattaataggttaaaaactgactagaaccatatcatataaatggtggataaagtattggaaaggagaaaactggggacaaataaagatggccgaggaaacaaatgtaaggaaaatactgcagggcagctgtggaaggttgaaagagagagaaaatgacaaaaaattggaaaaaatagatatgctaaagatactcaaaaatgaaacactcttttagaatacattctatttaaattctatttaaatctctgtatagacatacacatttatagacccacacatgcacacacatacatgtacacatatgtatgtatgtgtatgtacatgtgtatatatacaatcttcattaaacattttactatagcagatattatgtgattttttaggagcaaaaatatcattgtgattttcaaattatttttcagtagcggtaaaataatcctctacttctgtgcatgatttaaaatccctatttctggtcatttcttcaggacacacccaagtgtggcaccaaagccctgcataggtccccagagaaacgtattttgctggcttgggagacgccatcccaaggtgtaatgggagtgccactatagaagagctgtattatgacttccactatatttcaagagttaagattgtgctttgtgcatgtgtaccagaatgcaggcctctcctttcaatcattctgagcaccaggtaatctctggtaacactccctgtggctactaagcagcttgaagtcccaaatgacaaagctaggagaaatcccataatttgttaaaggaattgaatagaaaaaatagaattgttcaaagtatgcatgtaaatttctatcctgcagagctcagacaagtgtcagtttgcccctacatttcatgcagtcctctataagagtctcaagatgtgctccactctgtaatgaataaaacacagttttgcctggtaagaaatgatattagtggtcactgaacgttagcattgaaagcccacaagtatagctcttctatttaaagaaacactcattgctatttttctgtaactaccacaaactctggaatagaaagaaaaaaaaaagctatattactgcagtatagactgccttcagaaggaaattgaaagggtttaatgtcattacagaagcaattagacttaccactaatgagacatccttatgaaatatttactctactttccctaaagaaatgatgagaactactggggattcctaaacatgtcaagagttatgtgggaacttctaaattattttgaaaatagctattatccaaatagattgaatttgtctagaggcagttcccctggcagaattgatttaggaaacggagaatgtttattagatggtgtaagctagtcagaactgacctgaggggttataagtacaagattaagttgaaggaaaaactagctttccattattggtaagaaaacaacatccaaatccaaaagaaaaacaaaaaaaacaaagtgatggtccaaatcaaggatgtgacaagtattgcccgagaaaccccttctgtatcttggctccctattcttagagaacataaaagaaaaaaaaacagtgtactattaatagggaggtcttctttattttatgctggtgctcctacatctaatacacattttccaatacaactctttatattttagcattgttacatattatcatttttgaccaaatatttatataagtaaaactgattgtacttcatactctacctccctcaattttattttcatggagcagcaatttcacttttaaaggtctagctactataaccactctgtagctacagaaggtttttaaaggtcctttgcagttcaatctttatcttaagatatgttttacagaacaagttacattttgttgttcaaaaaaataagtatatatattattattataaatatgatgtaaatatattatattttattgatacctattattattataaatataataaaaatatatataataaagttacatttaattgttcaagaaatataagtcacttgtaaatgtcaagaaaaacaatgaaaggaataaagggttttttccagtataatagctgtctactttccgagacatattgctaggaaaaagaattttctgaattcttcaagtattttgattctagtgggcttgtactttgaagttgtatagtttaaaatttcagcattatatattttaaatgtgccatttgatcatatcaaagatatgatcggtgtaacctaactttaaaaagttactgtgccatactccatgaatcacatattgtggttgatcttctaatagtttttggtcatgaaataacatcctaattaactgggcattatcaaatctaaaaattagaagtaggtatcatagtctacagtagcactgaaatctgtggcccaatctatacaccttcctgaagtatagtccctagaagtttacatatgttaagctctgaagatcctggatggcagagaaagtagagttgaagtaaataatacaatttctaattatgagtagatttcagaaaactgctgtccaaaatttgggttttaaaaatgacatgtggatttcaaaaatgatttttaagtgtttatgaatgcaatacacgaaaacttattttatgtgtaacatttgtaaaatataataagtattacaaaacttagaatgaaatacaggaatctcttgccccaacacaaacacacacacacacacacacacacacacacacacatatatttctcatcattttacgttctgttttatctaattattctgggatttgtttccatatttctgaatatgtgcttaatctgctatttattgatgtatcaatttcatacattatttgacttcctattatagaagatgatgatttggcccacttatagctccttccccaccttctcacctccacttttccttctttttctctttttagtctatgaactttcaaaacattggttatattaatattcagaatttgagttattatagtcatgtcaatattattgactgtgagttgaatgttatagtattatgaccatatttcttttctggtactatttttgttcttctttgaattaataataaacccattttcccatttacttatgctttctatacctgtcatgaattcttgaaatctctaacagaaactataaaatcttctataatcatttttttagactttagctattaagtccccttcactacagtcttccctgaggctgcctgatctgacttggttagacattccttaggtcaacaccgtaaacctaattctgcttttgtcttccttgtctggaatgctggatctgctgttttctgcatcctatgtttgtttctttcttggttaacccctcttttcagaaggggttctcaacttctttctgcttggctgaagcttggagcacattctcaaccaaaatgccttcattctctccagaccttagagttctagtttagaattatactttagttagggaatttgactgaaataatatttttgctcagagtattacagttgtgactctaacatcatttagcatctcatgatgctcttgagaagtctactgtgattctgattcctgtatcctgtatctttgtatgtgatcagttttctttttctttttcttttcttcccaaatgtttggtggtctctttaccccagttttctgaaatggttcaatacattaccttagtttgacactcttctcttttctgtgctgtaagttgatgagcagtctcaatctgaaaactctcaaacaaaacaattcaatgaaatgtttaatttttttaaatttttctttgtcaaacatgttttcatcaattagattttaaacctccttggtttttcttttctctaattcctccttacttatagcatcctgttcttgtttcatgggtattatgacttctcttgtagcagagagtgttgtttttgtaatttgaattttgttttatttttttaccagcttttattaagccccaggtccatgtgcaggatgtgtaggtttgttacctaggtaaacttgtgccatggtggtttgctgcacagattaacctatcacctaggtattaggtcccacatccattagctattctttctgatgctctccctcaccatgcccttttgacaggctccagtgtgtgttgttcccctgatgtgttcatatgttaccattgttcagctcccacttataagtaagaacacgcagtgtttggttttctgtttctgcagtagtttgctaaggataatggcttccagctccatctgtgtccctgcaaaggacatgatctgattcctttttatgactgcatagtattccatggtgtatttgtaccacattttctttattcagtccatgatgggcatttgggttgattccatgtctttgctattgtgaatagtgctacaatgaacatacgtgtgcatatctatctataatagaatgatttatattcctttgggtatctaccccgtaatagtaatggtatttctggttctagatccttgaggaatcaccacactgtcttccacaacagttgaactaatttacattcccaccaactgtgtaaaagcattcctatttctctgcgacctcaccagcatctgttgttacttgactttttaataattgccattctgactggcatgagatggtatctcactgtggttttgatttgcatttctctaataatcagtgatgttgaactttttttcatatgtttgttagccacaggaatgtcttcttttgagaagtgtctgttcaggctctttgcccactttttaatggggttgtttgttttttcttgtaaatttgtttaagttccttgtacatctggatattagacctttgtcagatgcttagattgcaaatattttctcccgttgtgtaggttgtccgttcactctgatagtttcttttgctgtatcacagaattttaataacacttttttttaagtaaaattatcttgtgatgcttctctgcctttatttcctcttagtttctcttccccaccatcccccaccaccatggctccataccacattgttctttgtcttttcgctggaagcttttttcaaatggcacatgatctattgttgttaattcatatttagttgttattctccaaaaagattactggaaactctgtgccaactgattattttcacagtacgatgttcagattgagaactaaccattttggggaagatgaggacagagattggggttgatgatactggttttcagtctttgaatgagagataatagttgataccatgagagtagttgaggtattcagagataacgctatgagagaagatccttaggacccacaccttaagaagtatctgtattttattagtagcatgtggtataagaacatgaggtgttattaagattgttgtcggcaatataatcctttcttgagtatatttattgagcatctgctatgtcccatgccctgtttaagtgcttaaatactaatggtggaatgaataggcagagcccctgctctcacctggactcttatatcatgttatcagcaataacatgaaattttgcctctaatatgtggtgagagaggcattattttcctctgagaacatttatttatatttgtctttacttcataggatgaattttctcaggcaaggaaagttctagccaaaaagaaactaatgcagtcaggatttatttaatcacattcagacagcctgatcattatcattcagtctttttctggaagggcatgacaattcacattcaatgactatcaaacccatccttacctcatacatgcccagttaaataaaaggagacctaccagggccatctgacttccaatttaattgacactacagggtggcaggtctttctgggtgagctgaagtcaagataaggtttacaagcagtggttaactctaatgtccttttattacatagctttggtcttacaggacttaaagaactctacctatgtaattattgccataacactaattttataatgttaagcgaagtttatttttaaaattttatggtcatttgagaaatagctgttaccacacagtgattgacaattttaaagccattttcaatgactgaatacagttaaaaagagaaatttgtttgctgggcacttaattttttcatgtaactaagtaacttaagagatactatgcaaccacatttcagatttatggtattttgtgttaaattgtatatttgctttctgaatatttttgacataactacaagagacttggcatttgattttattatagctgtatataaagttggatttttccaaaacgccattttggaactaaattgacagggctgactacttgagagccatactttacagaaacacactggcaaacaacactactgtcccaagagagattaaccttgtaagcaagttatgcaggtgattcaaatcctgttaatctcacataaaaaaatgttaattgcattggcaaagacattgcctctgatcactctgcagttatataattagagatcagcccattcagagaggctctgatctaattgataagcagtcagcaaacgacccttgagatttcttccccgtttttcaatatgtggtcagacataaggtattaacatgaaaaaatcagtgaccttgttttgacatgttttaaaattaagtttgcttgttattcaatagtttaagattttcatgcatacttattttaattgtacagagctctaattgtccaaactctatggagcattaatagatattgagtgtgatcacttatcaatgtattggatggttttattatcaacttactttctaatccacctagcttttcatttttttggagatgattttgagtcaaaaggggagactcaagttacttccttataatttttaaaatttgtgtctgaaaggggcttggctttgtgtttggcttattgtaacggttgccactgcagatccaacgcatttgaaatacatttttggcctgtacaacttctttagtcttcatatttatgtttctgattctcagattttctggaaataaagttggttaagaaaagtggaaaatagttcttacaaaaaatttcttccatttaaataaatgttaggcaaacctacagtttttaacataatgttttctgtgggtaattatgaaaattgcaaagcagaaggtcagtttagtataattaacagaaaacaattggaataatgaataacacagtttagagataattgttagaaagggtgctatggaaattctcagaataatactttaaaatatgtgaccaagctccagtatctcaggaatttcccatgtcacatgttggacagcacatcctaatacccaggtataaaacccatgttgatgtgtcatgtatgtgcaggcgactttcatctcatttattctttgcctttgttttgctttgatttgtttttctatccattgaattacatttttcaccatgagccaatgtcagacttccaaaaattgtataccacatatgctcctgtggttatccagttgctaagcaactggactctgcttgagggtagcagggtagagagaaggttcattgtgaagtcctgcacccctgctgagttcatttgaacagcagcagggatcctgtatcttgattcttcttgaaattataaatcaagtgcctccacgtgtctccatataaaacaatgaggcttagaacaagtaccatgactaaaaaacccttagggatcctaatggtatccccttgaggaagggacagcttagttttgagacatctctgatgtaacgtttgccatttggattaattatatgttgtgattttgtgactgttagcatgttaaggaaagcatacacaaactttgcctgaaaatataagtattttaatggaactggtctcacatattgtttttcaatttattttatacccagcataatgtcatgaaaacttttcatgttagataggtagatagttttaatattgcaatgacttaacagtttttcaatgtataagtttgctgcaatgtatcctaaaatctcacattttccaatattgtcagttttgctgcaattatcctatggacttcttagttttgttgcagttatcaattatcgaagccactgttctgcattgttatattttgcagagtgtctgcaagtaatggtggctttggttcttcttcagggctcatatttcctttttcttactgatttttaatgtcggcatgcccgtcttgttccggacttcaatgggcatgacttttgtattttactttttttttttttttttttgggacggagtctcgctctgtctcccaggctggagtgcaggggcccaatctcggctcactgcaagctccgcctcccgggttcacaccattctcctgcctcagcctcccgagtagctgggactacaggtgcccgccaccgccccagctaatttttagtagagacggggtttcaccgtgttagccaggatggtctcgatttcctgacctcgtgatctgcccacctcggcctccgaaagtgctgggattacaggcgtgagccaccacgcccggcctgtattttacttttaagagaattttggcatttaatttcttgcaaaatatcttcatcacgtttaaaaagtctgtttgattccttctttatttagatgatttgtaatttgatagctatatctacagatttgatcatatttatcttcatttctcttcctattatataagtaacctcctttatctcattgaaaatttatttggcttcaagtaatataaatctgccgaacaatggcttaggcataagaggttcatttttctcattcttaccatttctatgatgaaaggagcttacacacacaaactcacacacacatgcccacactcacacacaatccatgttttacctgccagtctgtttcaatttgctaaatgaaaagttgagacatttccttgagtttccttttcaccctatgcgtctgactgatcacccagttttgatctctcttgtctgtccccttttcgacatcctatgaaccattgtgtcagtttaagctgaaataatttcttacaagaacgctttgacctaattcacgactttatgtttctcttctaatttatctttcacagacataccaacacgacctttttcatatgcttattcaacaagttgcttacttgcttaaagtccttcaatagctctctatcaacctcagggcagagctcacagtccttgagtggtgaacagggccttcatggtcttatcactcactctctgtctagctttgtctctcaccactttccccaatgtaactaacctgctcactattcaccagcttgaccacttagtgaaagcctctaggagtgggtgcattaacatgtgctgaatgagtcagtggatgagagaaagacttctctagcttgttcatcccagtgtcaggatgtagtatgctactcccactaaaatcaaagggaacaggaaaggtctcctcttgatgaatcatttttcaatctggagtaatatcaatagtgtctcaaacctctttaacattgggttaatgtagtttttggatgaatagctgcgcctgatagcacagaagaagtcgatcccgcttcctatgtgaatgatttattttttactattagcatttgggaccctcataaggatatattaatcctattgcctatttaactaccagaaatgatagctcaataccaactatgccagccccaaaatagctgttttgggcacatagtgtacagagttgaaaaaagtaacactaaattattttatccgacatgttgtctacagggcacaatttgctgctaatttattcagggcgtctaaaatctttagatgcaaccgtgtttttctttagtttttatggatcgtttgtcaattctgcatttacaaaatttttcatgatgaaattctatttgtcttgttttattgcttgggatttttgagtcccagagtacggatactctagcatatgcagaaaattttgatccctactgtcaaattctctggagatatacaatagtcttccttctaaatgccaatggtagttggttttattgcaataaaatatttatcttgcaacttacacatttgttttataaatatggatcttgatttagtcaataaaatcaaatactcttatttatactcttaacatctattatttgaagtaatttattttctttgaaggtttcctgccgaatacattttagtttttgtgccactgtatacaaaattttaaattagaaggtttgaaactcaagttctaagtggctaaatatgtccagatggccagaaaaattgtgtcagcttcctacagatctcatctttcttttccttggcttagttctctttctacctcagtaagtagcaatattgaatttgtttgtgatttgcagatatgggctaataaaatttaaatgacaatttttccagtctcagaccattatccaaaagggaagaaactggacaaggaatgccaatgtctggtgatacataaaactactttttgatttgtatcctcagaggctaagaatcttatggataggaaaagatttttatggatacagacttatttttctctagccttatgtagaagagtgctagaatacaatttaacagtgccaaatacagattaataaaagaagaaaggatgaaaacagtaaaacagattactgaagaaataaaaaacataaaattaagtaaaaaaaaatgggtagatatctcaaacacttaagagaagaccattggagaaaacctcaaaaaattgataaataaatagtttgcaacaattaataatgacagtctttgtatttaagaaaaaaaatcaggtagacatctttccatacatgaagttaaaataatcatgggaatattgagtccttatcaaatcatagcttaagtgggaaaatctaggtaatacatatgtgtgaaagtacacattttttggttttctctagcattcttgaggaatattaatatttgttttttaaatgtttttatccctttcaacttttagttttcccactttgaaccctgataatagattattgtaatcatttttaatctctctttttcctgtagaattcagtgttctgattttttatgataggatccacctgatttagctcagggattcactgaaaaatcaatttaatatttttttccaaaggttgtatggtcttatgtgcaaactgtagctattcctttgttccaaaatatcttattttattgaatgacattggattcacaaggccttattaaaacacagctgaggtacagagttaggtacctgtgtaccaaaagtaaattaggtttcctttgcttttttcataatgtacttaaagcatgcataatagtttatctcattttaccattgtttcattttttttttcaagaacgacccacatttctcaggaggccaattaaccaggtggtactggaggaagaagctgtagaatttcgttgtcaagtccaaggagatcctcaaccaactgtgaggtggaaaaaggatgatgcagacttgccaagaggaaggtaagaccaacatatggatggaagattgttagataaccaatgaataattagaaaataaaaggacagctacaatgccaccaccaaacactcctatgtcttggggtactttcactcatgtgatttttacatatgcaagccacatatttactgtttgtatgttaaagtcctccaggctttcaatgtcactctttcaatgagtatctacattaatgcttgattcttcattccacctcttatccccagataccaaggattcctgggtgccttctttcccctggaccctttgaggtataccattctgttcctgcagaatgccccctgcaggcctccatcaatgactgcccgttcccatgcttcatcccctctggataccctttgtcacctctgtggcccaaagcataactaacaaaagactattgcatgtggctgactgtaagtcctggagtaaaggaaaggtcagcataacactgaaatggtagcaagtagttggcatcatttttcacataggggatttccaacacagagaccttctgtcactttcttttttccatctcttcatggagaccttctcttccatctccttcttattgttcttatcacaaaacccccaaacccaatctctcaaactctaacctgtattcaaaaatgcttttcatcatatataaaaataattttgacttgttgttatagaaatttccttaaggccttgccatttagaatgaaataagtaattcaagtgttttttgttgttgttgttttaacacaagtaattttatctttaagatttgttatgccttcctgctagttctacctgctgatattataaccatcatgcattctccaattactgcctgcataaaattgtacaggctgtgtttttctaatttttcttttttttaaaaaaaattttttggctgggcacgatggctgactcctgtaatcccaacactttgggaggccgaggcaggtggatcatttcatgtcaggagttcaagaccagcctgacaaacagggtgaaaccctgtctctactaaaaatacaaaaagttagctgagtgtggtggcacatacctgtaatcccagctactcgggaggctgagtctggagaattgcttgaacccgggaggcagtggttgcagtgagtcaagatcgtgccactgtactccagcctgggcgacagagtgagactgtctgaaaaagaaaaaacaaaaaacaaacaaacaaaacaacaaaacaacttcgtttctttcaactgactgatattaaccatgcttcctccgaagctgtataccttttatgtgctttcactgctatcagtaatttcctaaatgtaaacattcatttcaaaatctcaattttataaatccctagatatgattggatactttacttcaaaaggcatgtcactcatggattgaataaactggattcaaatgcatcaaccatttataatagttactgagaggttctttacaatctacaggaataaaacaagtgaaaacattaattcagttagtttttcagcctatgtagtggggaaagtcatcattgtgtttgtttcatcattttaatgccagacatctgtctttaaaggaatggtattagtagaagaggtttgtaaatgtgaggcttttcatgccctctcattggagaagcaggttagaaaacaaggagagtttacactattgaattgttactgtccatcctctatatatagtcagcaactttcttcaaatttgagagcatgtagtgaataattttaaaatattaatgtaaggtgaagagattaattctatagtaaaatttatcctagtgtaaacacaggtttattttaaataactgggagtatatgcccttgtgcattgaaactttaaaaacctttaattttagaataattttgatttataggaaagttacaaaagttagtaacagagagttcccatttacactacacccagttttccttattgttaatatcttacatgacaataaaacatttgttacaactaatgagcaaagcttgataggtaataattaagtaaagtgtatacattatttggctctcccaggttttcatcattgtcctctttctactccaagtccagttcaggtaattattgggttgggtatcatagacttctgcatttgttctcatatctctccagtctcctccgtcctgttacaggtccttagtttttctagttttgtgaccttaacaaccttgaagggaagtgctggccaggtatgctatcgaatgtgccccaaacttggattagccggattagactgcgtttataggtttttaaaaagaataccttagaaatgacatgctcttcttagcacattgtatcagggggcacattatatccatataacagcactggccaccctgttaattttcaaacactgagcacgagctagttgacaaaagtattaaaaatagagaattgtaagtgtgcattgcattttaacatgtctatgttcctgaattaagataaaataaaaatgaattgagcctagtttgattatttccagcttaatgtaggtgttaggtcataaacctgacaacttaagctgctacactgttctctaaatcttgccaaattcatttgcttcaaagtacaaatgatacatataaatcaaacaacagcattaaagctacactatcagaaggtatgatatcaaggccactaaacaacaaggttgaaagcatgagaaatcttattttcactaacttcctttaaaacattttcatagctttggcctctttattctttttaccagcatattatggtagtactttgtgtaaccagttaaatattttaaaaatattagacaaatggaagtgctgtgtaagctttaaattgtttttgttagaaaggcttaaagcaaggataagtgcaatgtagaaactgaggtcagtatttcatcatgaaagaagcatgtactttttcttgaattcccagtctttaagtgatgtttcagaggagtttattcattcctcgatttgtatgtattagcataagcctcacttatgcataatgagagagaaagacacctctttccttggtgaggaataacagtaataacttttagccaaccgtagactaaatcaacaacattgattctattacattatttaggtctcagactagggagatggccattgttcttgtataagcaattggtgtggtgcatgacatttctttggcttaacatttaatgaaatttgaataaggtttgtgtagtggttcatgcttaacacatttatacgaaagctttgtagggcagctgcatagcctgtaattactatgtaagtaatatgtgactatttttcttttggagacaagaaaagcttttcaattcaagtttaaatttatgaaatgctgtgagagctattaaaaccttcaacacagaagaagatatctgtgccaacctttcagtaaccagagatgagttaagggagtattttttccccttgccttgaaaatattttttaagtagtactgatatgcctctttcttttatttagtcttaaactcctgacctttctcagtaactacctttaatgaaattacaacagactcttagtgagttgtattaaaacattttctgaaaagatgaatgtttcagtttggtaggaagcatagcaagtctaacaataacccttatgctcaactagggaaaattatttatgtggacattttccatgcgaccaagggacaaaatggaaaggagtctacattatacatattagtgccaaactgttaattccttgcagagacttctgaagatattaccgtttcacaattgagtatttcaggaagcatactgattctgtgccaagtaccaatactgttttctagaagatttcaatacatatgtgttagggacaaaaatttcataacactaacgtgagaataaagtgagtaggaggaacaagcaagtgaaaggcattttatagtttataatgattatgatttttgaagcacatttttaaagcataatttaaatagaagaagatgcacttttgggtttacctacatttagtgagtgcctactacatttgtaatgctcattgcaagtttgaaaaagtaagtcgttttaaacaaggtaagttaactgttatcagttctttagtttttgttttatattagtgagattgggtgacgtgggaaagtatttacattccaaatacagtaaagaagtaaattggaacagctctagttattttcttgggtactgtctgtcttttgcaggcaaatatccaacattttgcttattagtactgtcttgatagagtgccttcaatacatcttttcacaaagtgttttatgtgatagaagttgtcagtatttataataaatgaggtgagtttccatcttatgccatgttccctcataacataggtttattgtatattttcgttatataaatatatttatgtgctaaagctctgtaaaaaagtatcacatgaagaaacattaacataacacaagtaacatgccataaagaaacagtataatacatttgtaaccaaagatataaaaataaattgaaatatgacaacactacaatattctgttcaatttaatattaatgagaattttaaaaaaaatccctctcagaacttgggtaagagttagtgtgattaatctaattgtgaattcttatctgtgcatgtcagcagagtttgtatttcatttcattattagcagtctttaaagaactgtaaacaggagatttaatatctctcatcaatcatataactttcagcatattaccattacctcctttatcttttttatttcatttttattttctaaactaactctaaagtgacactaagttcctcaataagaacttctctcttccacagccgagaaaggaatgttcataatagcttgtcagaagaaaaaggaaataaaatatgccatttacatttttacgtatgcctgcaaattctaaatgcagttgatggcttgcacatagtggatataattaatgaatatttcataaaatagaaaagggagtagagaataagagtttcaagatatatggagcaaaattctatcaattttccttaacccactgacaaaatttccttttctaaagtgcaagtctattttaagagagaattttcagagtttttagttccatgaaatgtgagatttgcataagcacatgattctttaagaaaagaaactgaatggaactacttataattcctttttttttttttggatggcatttttatacaaagtggctctttcttcttagccctgcaaaatgtgtttagattaattgtttggaagctctattgtttagagcatgtgcttctgggacacagagatgctgaacaggtgctcagctacccttaggaggcaatgggccttcttcacatacagtgtatgcatcaaggacatgggataatttgagctcctgataaataaccacactgattaggttggctggtaaagactgggcaagtgaaatggtcttagcaaaagaaggaaaatctaagaacaggagaaaagcaatgaagcaatgtgtacaaaatattgtaaatgacatctaaaaaatggactggttcctaaaagtcacaaatttaaagaaaaagtgtaaatgaaaaatctttattttttatgctatacagatgtcttatccatgtctgtctaaaaacaattggaaacttcatgagcaatgactgtgggaccttttaatacaaattacaataacatacaaatatttaggccattgccaaggggttttagactttaggccttgttctgctactgtttgatcatttagtttatttacactgccgttttctggaaatgatagttgacaaatttctctactgcaaactaggaatgtgatcttgaagaagctatttaaactctatgttttacatcctgaaaatatggcccagcaatgtggtaggactggtgattaacctatatttttactgatcttatagggtgaagaattatgccatccattctaactcaaagggctattaaaatgatataaccatttcaaagcactgtaaacattgtacaatggatgcacatacatggtgcctcagttttacaaatccacctgattggtggcatttattaataatgcagttaactacagggaaaaaaattaatgctaaaaaaatataaaatatataatttgtatataatgacacattttcctatctttggccatatgatttccatagaaacatatacaatattatttttaaataagtatcacttacgctttttttttttttttttgacggagtcttactctgtcacccatgctggagtgcagtggcacgatcccgcctcactgcaccctccacctcccgggttcaagtgattctcctgccccagcctcctgagtagctgggactataggcgcccaccaccacgcccagctaatttttgtatttttggtagaaacgggatttcaccatgttggccaggctcgtctggaacttctgacctcatgatccacccgcctcagcctcccaaactgctgggattacaggtgtgagccaccgtgtctggcctgcttttaaattatatagattcatttataaatgtttctagtgactttgccaagtctgaaagttgcctgcattttctacctttagtaagctatacattctcctggtattgtgtgccacctccagtgcaatcagtcacctgggttgagaccttcacatttcacacatactgttttgtttgtctgtgagtaataagcataaaaccattattataaaaagatgtgtaatgttaaaagcaagtatttagggaggacttaccatgtgccttacaatgcaataaatgctttttacatatgttaattccattatttttaaagcatagtattacagcataatattactcctacttgagggttacagaaacagaagcttaaacaagttaggtttttaaggccacatattaataagcattagggccagaactgaacttagaatctgtctagcatgaaatctctattttaaatgagagggcatgataattatatgattattaattatttaaggatttgagtcacctatgaattttatattttagatagaaacttagataattggttagaaatactatattatgaataactaaataaacatagtatacagcaatagagttaaggtaatttttagaccaacttcgtaagccacacataaaatgtcttgacattataaaaatttaaacttagaacagttcaagtttaccttcttggaaactgaagatatagattttgtttttacaaacaggattaattgacaactttcagagggatgacagaattgtagttttcctgtgttttcatcaaataggtgctaatagttgctgttaacacaaaactaattgccacctacggtggggagtgcaagttgcctagtcctgtgaccacattggcccatctgttaagaatctcagcttaggaacaatgctggaactggcatccaatttgggttctggccagtggtcaactaacaagctggaacacacatggaatatgaaatgccttgaagtcagagatgctctgctgtctgttaactgacagctcttgtgtgtgtgggcagagccaagaccaggtgccagtatgcagagcaaaaggatctgtctgtgtgccacctgtcattgccatgtgcgtaatgtccaaacaggagccacagtaggtgtgtttcttccatcaaagtgtggttgttagagcattcagttaggctgaggtagcgactagggcaacattttaccttaaaccaaactataggacaagccagaggcttaccagaaggtagctctcatatcccgccatatcacacaagtggatggagatttaccactggagacactctcccctgtacctaggttcttacattaactctaagcaaaaggtaaaaaaaaaaagttgtttaattaattatattaacacaaatacttgtgtgcacaagacaatttgtggttagaatcatgcaaataagttttaatcaccccaggggttattctaaaaatatatttctaactgatttttgttattattcttaataagttgaactgtaacataaggctgaaaggtataatagaatttaagagatcaatgttcttatcccagctctgccataattcatcatgttattttaagcaattcatgtaacatgtctgagtaccagagtccacatctgcaaactatgttggattgaatggtttcggtgctgtcctcaaattctgaaaaattgtataattctatgtcaatctctcgaaacaattagagaatcacggcaatattttttttcaatagaagaaaaaaagaaaccagaaaattgaaatagatggacataaagaagaaaattaatattacctgtgtatctattatccagtgacaactacattttatgtatagaaggcatcttgtaaacttatttatattttagacatatttttcattcaaaattgttcttgaccctgaatgcttacttaggcttttattgttaaaaagccggtactgattcaaaatagctgtttctgactgcattttcctttcccataaatataatattaataaatgatatttacacagtgcttactgtataccagaaataatctaagcattttacaatagtgctattttatttttagaaaatgctatgatgtaaacattattatacctataatataaatatcaaaactgatatgcagagagggtaaatatgccaacatcactgactatgggacctaggatgtctggcttcaaagtccacacttttggctactacatagtggtgctgagtgggaagaacttttcttcattttttatttgggattgaagataaggaaaagacagcctagcatatgcttgcctagaagtagaatttttatcatatagtcacagaatacatctatatagaaagcacatgttaaagttttgaaaatttttattataaggacacttatttcccataatatatgtttattatgtcaaataaagaagtttatgtcttttcctttaaaatcattattttatactacttattgacacaaaatttaaaacaaatctattttttctcatggaatgttttaacttgtattcttttcttctcaacactatattgggtaagaaaaaataatttcactggaaacatattagaagttaaagaagtgcttgctgaaagagtcaaatggtgtgagtagggtgtgattggccctctccatctatgggtgccacatctgtggatttaaccaattctgataaaaaacattaaaaagcaacaataaaaataatagaaataaaaatacagtattacaatgatttacgtagcatttagattagatatgataatctacgatgatttaaagttgcaggaggatgtacataggttatatgcaaatactacattattttatataaaggatttggacgtcctcagcttttggtattttcagggttgtggggatggcagtcctggaactaagccccagtggatactgagggaggactatgtatacatctagaatgatgaactcttctagggtattgatagtttaattcatctttcacattcactgtctaacaaagttctcagaccaaatttaagtgtactaaaatatggtaagtatagtcaataataacaattctatattttaaaataatttaaataatggaactggattgtttgtaacttgaaggataaattcttgaggggatggatagataccccattctctacgatgtgcttatttcccactgcatgcctgtatcaaaacatctcacgtaccctactatgtacccacaaaaaattttaaatataaattaaaaaaataataataatataaatggccaggcgcggtggctcacgcctgtaatcccagcactttgggaagccgaggcgggcagatcacgaggtcaggagatcgagaccatcctgactaacacggtgaaaccccgtctctactaaaaatacaaaaaattagccaggcgtggtggcggcgcctgtagtcccagttactcgggaggctgaggcaggagaatggcgtcaacccgggaggcagagcttgcagtgagccaagatcgcgccactgcactccagcctgggccacagagagagagtccgtctctaaataaataaataaataaataaataaataaataaataaaataataataaggctatttggaggaaaaaagtttcttcaaaaataaatcaataggtactaagagtatgatttttgctaatttcctgataatgtttgaatatcaatagttccatggatggttatgagttaacaggtaggactgagttctaggctatatattttctacccaataaatatttttttcatttttttaaaactatgtaatggtccctcaggaaaagttgtaatttgatactattattttaattaactggtatgaattaaaagagaagggataaaaaagaataatttctgagatccagtactacaattacatgaacaaggaacatatctttgttagtgtatgaaggagatataattgccaaatataaggaatgggaggacaaatagtttcaaagtatttcagggtataccctgatccccttcagtgaagtcatttttggggggatctctgttttagttgttacatagtataactcactggcgcttcattttaaaaggccatatttggaggtgggaggttagccctagggctcagtgagtccttgccgagaaattagaagtccctctgagaagtgattcatcatatagacctatgggataacatcataataagatctcagtataaaaattctgccagttattcttatgagcatgatgttaaaattacaaaaggtattgtaataccattcaactcattcatcagtatagacatttgaaacctttataaagatgatctggttgggtatgctatatcattgcaattctttaaataaatggcagttgttataaaaatatgtcctatttctgacacatggtactcaccagttaagacattcagtgcagtgcttctcaaaaaaaaaaaaatgttcaattaaacccataaacattctaacccactaactgacattttctaacagtttgtccaaatatttaccaccacaaataacagaaacaaaaaagtaaaagagacctgttatctttatttgagagagtatttaaaagtgagaaagaaaatgcttttgtcttcattatgaacataatttatagtaagacatatatatagttgattttctcaaacgtaaaccccaaatcgccagactagtcaaatattatatatcaagaattatttcaaaaataatcccattcattgaatattctgtgttgatatttcaaggaataaaaaaagatgagattgttctcaaggattttagtaggtagtgtgagatatgcataacattattaaataaggtgaactatatacaaactatgatatttgaggctctttatggcttcagaaaataaaagatagtctattcctatatgaaactagagataggtctgaaagggaaaattgaattttcataagtggaatagcaatggctatttcaaaagaacgaagcaggatgaaaaagctttggaaagcgtgggccaacaattagtgattcggtttgcctggaacatggaggagtggcacttaaggccacaaaggttagttgtggttctattatgaaaccctttaatttcaagtgaagtgtttatatggaatacaccataaaatggggattaattgaagcacattgaatagaaatgcatctttgtgtccacctttagaaaactgattctttcatgtagagtagcttggaacagagaaagtttggaagtaggcacacctggtaggaagctgaaatatagtttagggaatacattgagtgtattgtgtgagttacacaaatatggacattaatacaagtggtcatacaagaaaacctttttttttttcaattggcaaataattgtatgtcagagttattggaaaaagagaaattaaaaattaatgctgagatttgtaacttgggtgcctggtcaaaaggtggtgtgttcaataaatagagaagtcaaaaggtattattcagtctcatcatttttaatcatgtaatagtattttctatcactgaatccaaggtagaattgattgtgagatttagtagtattttttctctgagttaaggagaggaaaaatgaccaaatcaactatgatatgccatctatgataagatgattcctaattctggaggtgttaaaatataaaaatgtgcatcttaaaatatattaaatatgggagtaatagctaatatttacaagtgctttccttagaaataactcatttaatcttctcaattttcttatgaaacaggaactcttatcattgttatttgataaatgaagaatctgaggggcaaatataaatgagagagatttgaatccaaatccaaatccaaagcccactttcttgactactatatacagtaatttatttctagtaaaacatatttaaaaataatggcataaactaattttattttaagggctcactggctttctgcttagtggctacacaatatttttaattaatgcttccagcagccttaaagtttgagtcccttctttaaacagaggagaaaactgaaggttagagacagtgaaaaacatgctcaaggtcacaggaaacatggtaacaaaactggattcaaacctcaggtctctctaatattaaaagcttgtgctcatggcttatgttggacccaggacgcccttcattccatgtgttagtcaatggctggtgacattttgttttgtatatttctatataactttctaacttgaacaaactcatacagagtccaaagttcagtaaacagaaaataaagtgattcttctgctcaaaatatactgcgtggtgtcccagtgtctccattgtgcacacttggaacaactttctaagagaaagtagtgctcagatcatcattattataattatttctttatctccccaactccctttgccttatttatgtttaatcctaacaatcctaaatatccagtcctatgactgtcacatggtgctcacgagttagtcctttagtgcagtgattctcacgaggggcaaatttgcttcccccatttcctgatatacatttggcaatgtctggagacatttttgattgccacatttgggagattgggtgctactggcatctagtgggtagacaccaagaatgcggctaaacgtcttactatgcacaggacaactcccacagtaaagaataaataatctgacccaaaatggcgatagtgttgaggttaagaaatgctgatttcatggaaaaaatcaatctgggcattgctcaagtagttattttatgtaatttttattttttgtttttaatgttagggcaaaaataatagaatataattcactgaaatacacttcgaagataataatctttttttgttgcctgagatatgatggttatacaaaatgagataaatgaataatatcataatttggtttgatataggcatgtcatcatttaacacaagaagaggacctgttggttttctaatgatttgagatgaatgtatatttttgcaccttttctagaatatataaggcagataatttttcttcatattccttgcacatcagatagttgctgaattggcgaaactagtaaagaatatcctaattagagaagtgtctgaacctcattttcaaatagacctacaaacccacaagttatgtgaaacatttaatgatcagaagtgttcctatgaggttgtatggaattcatgaattattccataaacacatttcaagaggaagtttctcttggcaaaagaaaaaagaagaaagccttttgaatcttccacagcatctcggactgaacatccctctgataatgtagtcacttccccagctagttctcagtttgaacactgatgaaggagacttcttagcatttttccaacaaagacagcaaggtcgccaaatagatggcacattcggaaatacattttaccaattttaccgtgaattggctgtctcttatcacagcatttcttcttgcacacagaagactgcaagaatgggctctgcctatctaaaaacttccagtctgagctgtgagctctgtggattcttgtggatgtgatccctaaagtcctgtcctgaaaggacttaaagttgggttaatttctacccaaacgcacaactatgagctatatctacttttccaaatctaataatgcaatttctagtcctattgtaaaaccagttttgaaagtatttaatccagtaaaacaattatttctaaatgaaaggataacttaacttgcttccacaactttatttgttccagtaggaacaaatgttcttcttagttgttcttcttagttgtaatatatttgtatttttaacagtaaatttccaagttctacttattcaagaacttattgaaaataatacctgcaatatttttaaagtatttaaaagtaataaattcaggaagatgcaccagattttatttaaataatctatgaaaagttactggaaaaattgccaaaagagtgttgcatattaaggacaataatgaaaataatgaaatactcctttctgatcatgataaaccaaagaaaccctttctctataatctaatctctataatgctttggatttgatcttatatgaatgtagaaagaagaagtacatgatttcacaaagcacatatgtatcttgttctcagaactgcagggagcttcaataattgttctgattttcactaaattgaaagttccagccacctctatatgtctttctcaaaatgttgcaaagatatctttatatttgaatctctaatctttaaatatgtatttatatagtatatatatttttaaaatatatagtaaaatcttgaacgttttatatattacaaaaatttatataaaacatatattattataaaatgttgtaagctatatagtgaaagcattatatataaatgtatatattaaaggtttagagatttctatatatatgtgatagtataagataaatatatacatattaaatatataaatatatttaaatctctaaatgtttaggagttctcaatttagtgaaaactagaatgactgtagttgatattaaagttctctgcatttttgggaacaataatgtcattgttagtgataggtcagtgcactatctgcagctattcatagtgtaatgacaaacaataatgaccaccatgtcagtgatttaaaatattctaagtaaattctaaagttgtggcaagttctttgatgttaatatttgatataaatgaagggtttatcaataatggaatctgtttataatttttatcatatgctttttaacttaaacttaatttttatcttaaaatttttttaaaaaacaacatttagaccttgctctttttttaccgctgaagatcaaacttcggtttcttcatctaggcaacaggggtgcatgtgtgaggggagaaaatgtatttttttctcaactctcataagtttgtagttgggatagactgcttcaacaaaacacagattaacaagaggaagagcaaacaggtttattaatgagtgtagtgtatgtcaaaatgagagaggggtaactcaaagcagtggtttacaagtctggtttacatattatcttcaacaaagaacatcaattttagaaaagtgacaagacaaagtagtcgtaggcttcaaagacaggagaataggaaagagtcgtttgctcctccggtgccatctctgagctgatgaaggttgcaagggagaaattacagcctgtcttcaggtgggaaggtaggaaggagggtagaaaggccttttgtatttgtaaatttctgtcctgacttcagcaaacacaaaggaaaagcagcaagttcccctgcatcttgtcttccccagcttaacaatcccgcatacattagggtatggtttccttcataaggttttcaggttaaacaatagaacaaagacaggtgtgagcaaggatattctatttaacttatatctacctcgaactagaggttaggggtggctcctgggtcctgtgaaaaactgtgttaattgtgttaatattcagaattgggagggattggacatagagagaatatttgaagtggaaaatgatgaatagaagatataacttgaacaaacttagagttcaaagttcagtaaacagaaaataaagtgattcttctgctcaaaatatactgtgtgatgtccccagtgtctccattgtgcacacttggcattttgtcatgagcaatatttgatgccgatgagagactataaccttccccttcctgcacgtgtacagccttcgtttattccctcatcaacaaatttgtcacggctgcctactaggttcaagtaactgtactaagttctgaggatacagctgttaataaaagtgacagggtcatgcttttatggagattgaaatctagaggtataagtagatattaaattaatcccgtgtcagcataagcagaagtagttgggctaaagggagagagaggtgggaggtatggggagtgggccagatgtgaaggctcagcatatgcagggatgcaagagacagcccgagaattctggggtatagttgagtgctcgagtataggaggggactggtgaagtggccagagaccaatgaggatgtcacatatagactgagttcagaagtttgaattattccctgagccctccagagagccagtcaagagtgaattggagtttttattaatctactgtatatatttaaagaagacagtaaactgttatattaacataaaattggggttttgccaggcaaatggaacattaaagctatggaacaagataactgaagatatagacaagcaacttatggaccacgacatctaagcagggtagagaaaataaagaagatacaaagggttgatagacatggaggaagaggttcagtctgtgaactgaataagtgaggaagacacaaccaagattatggcaggatccgacatttgaacctcagatttcaaaggcagagccatttcaaaagccagagaggtcagtggccaaagagagatggagacaataatatcactggaggaggttataagaatgaagtgagttcagctatggaaaatgttaggtgacatttattgaggatttactatgtgccttgtgcaaatctcaaaatgtattgagtcattaagttcttataacagccctgtgagatagggcctgttaattatcattttaaggaagaagaaattctaaatatttcatttgaaaactggatgacatgatactcaatgaagctgaattttgttttggtttgctgtattttatatgcacggcagaaaataaatatctcattcaagtaatatttattgagtaattgctctatgtcagacacggagtaattgcttggaatggttggaggcgtggtcttcattttccttcttcctccgcctttactccagagggcaaaccctcagtaaagacccagatttgcattaaggcatgaagaagaaatatctgagaaagacagataagaaggacacttcacaaatcaggaaacaggtagtttagcaagcacagtgaaaaatcctcatggagatgaccacaaaaattttgtgaggggttattttagaggagatgaaactcatttcagaggaaatgaaatacaagagaatgagatgacaggagaagatggaaacttgggcgatgaacaaaaacaacgagctgggaactttacagctggccacaaatttgccaagaaaattaatccctggagcctcccatgtctaccatgggaatgtaagatgggagagacgggcactcagaagacagccacaggctacactggttaaaacttgaaaggagttctggtttagggtgagcaggatgctttgatgtctgaaagagcccagctgaagtttggtttcattgcccacactccagagagaggctctagctccaaggtggtcagtacccaaattccttggcatcggttcaagtcctagtcttttgggcctagttaccttatgagctgaaatctgcacttcattaaatcaactattgtcctgttgcggtgaacatcttttttgtttgtatgtcttcgcttagttttttagctggaaaatgccttgctctctcagctgtgctaaaggaagattagcataggggtttgcgtttttcagtcaggccgaagagagagccagtggtcactggaggatgaaggtaagcaatggtagaatatgggaagtcaagagaggctaaaatattgtttggtttggctaattaagacaagataaggatgccatcatatttcaagtttcattttggttttctgtagaggctttcagaacagaacagcaagtacacttgaatgataaccttgcttcttactatttccctgcaagtgtaacctcccaggattttttctttctttcattttacaatgaatgctgtgaaaatttttattttcttaaaagggtatccgtctctcatacttctctaaggtgccctgcccagaagttgcttgcaacctcatccctaagagaactggcaaatattcacctcacccaaactgtgaacattagcctgcattataattatagataaaaagaaaagtgtgacctgtggttgtctaaagattaaaaacatagactcagtctgtaccaacaaaataatggcttattgtgttcgttttggggtcttagacctcaaaggtgatttaagtaagagcttgcctttagaatacaccttaaatattgaagattaagaaagcatcatatggaattagattgccgagaagtgcttatgtgattcttaataggagtttcaagtgttgcctgtgcaaagatattacttgaaaaattgtgaatggagagagcattttagaaaaattgagcaacttttcctattttcagctctcaaaattgaaagaggtaaaagatttaagtttctgcaggaaagtttatatttcatagaagcgtgccttgaataaatttgtgagttactaaaatgcatgttttaatgtaattgaataacactgtcactaagttctagatggatgtatctccatgtccataacatggtacagtggaactgattagttagtttgtatgtataaaaaatcagtacagggttccataagatgaataagtgattttctcctaaaaattcttctgttgaaagtaagacattacactatgtgacattttcatagaaagctccatagtgaaattttcttgaattatggaactatggaatgcctataattatagacctttactttctgaaagagtctgaaaggtataggttgaccttcggctatttgaattgagtggaagtgtttcaaaaattgaaaacaaacctttcaagtctccttaaagggaaagaaacatttactcatatagacattaaatgtttcctggttcaattcatagtttttactattggccaacttaacgattaatacagcagatgcataataaaattttaagtgctaattcaaaacacttgttctagaattggagccagaaatcttataataagaagtagtaggtgatttcaaaaactaaacatgttgagaaaatacatttccttccaagaaaaacaaaggtgcttttgagatgagaatggccagtcaggaagttttatagagtccttacataattcaaacaaggtgatgagatacacaggcttgaactgagcatgataaaattccagttggtaataaaaattttaatttatatttcttaattttttcctcctcctaaattctgtgttcattgtggaaggcttgggagtccctaaattgtctgaattatattcttaaaagctagaaaatcatgagaagttcctacccttgaggcttaatgtgcatcaggaattgcaaagtatgagtaatgaatgaaatgtggttataaaattttgccagttttcaattcctgtttgatattttaaaaataaatttagccatataggaaatctttccactaggtaggaaagcaggtatgtttatgaggaaaaaataacatagattcttttatttaaatttggaaatgattttagagtgtagtactttttttcttaaaacatacttaatatttctcttttgaagtgcttttaagattattcatcaaatataagatcacacacaaacagaatgttgcatgcaaactgtgggttttaagtattaaaataaatttactttgttttgtttgttattcagctgaacagatggtaatgattttgacacaattcagttttcgttttctttttttcttccttgagaaaaaaaccctgcaaaaacacagagcttcttttccactttgtcacagctggttaccaatcaatctcaattcacggtacagtgatgatagcacacgttgtccaggggccaaatctgattgggttgcatttttcagcagtgtttcatatcagaaaaaataaggtatctctatggtggggactgtcggcacacgattgtacaactctcattaatcaaacttggcaacaatgactgcatttatttaagtcaaagactagcagatttcaaaatgaaaatcaccaaatttctgtttgaatttcctcatcagtaatgttttttcatctgtttctttttttcttggttttaattacagccaatgataccttctacattgacactgatcattacatatgatcaacctcctgtgttgatcatatataatataatattataccatgttacaaagtagctgtttcataccaaaataaactccacttattgaaaatttattctagacttcttaaagaatgctaaatgcaattaaaagcaaaatataaatacctttgattgtttaataggagaataattttaaaggaaatatacatcaggaaaaacatttatgaacctcccagggttacatttggtgttagaggaatattgagaaaaaatattgataaagttagtttctggaggttttgaaactgaacacaaagtcggcagtacataaatacctacttgcccaatgcaaatgcacacagagcaataaacacacacatccaatagaaaatgcatgctgctgtttgttagaaaaataaatgtacttataaagagttccagtcacttcataacttgagagaacaatgtcagcattttctgtaaaattgtgtttggaaacagacattttctctaagttatttactgctgtgcaattatatgtaaagccctgttgtacactataaagatgtctttaaatgtaaggaaatattatttataacttattgtatcactctgtcaatatttgctttgaagggagaaatgcatattttcccaattttccaatgtaatggttacaatgacattaatattaaacatggaccaatgtatcttgaaagaaatctaagaaataaggccacatctgttagacctgggaaaatacttgaaacctattagttttagggagcaaattattgtcttagggaaaccatgacccatgagggaaagcagagactggtagtagatagtcacaagagttttttccccaactataactgcctccatatgtggttttgggaaagaaactttgtcatgttttgcttcagattgcctacatgtgaaattagtaatgagccaactatttacattctagattttgaagttacttagacataatttctttaaaaatagtctttatatttcttaagcttttgcagataggagttaatctgatcacaattacaggcctatcctttctctgacctgagacacttaaggtaaatattcataaaggtatcataatttgattgagtcttccgggatttttgcaggtgcttagcgactgccatagtgggtcggtgatgttgggaggaacagtagtgtctgcatggtgtacaattgtattaggtttgttgagtcagcagagtgaggaagccgaaagagcttgtactttggagtaagacatcttgatttgaaaattcaaatctgtatgttaaaaatgtccacgttttaaattatgtcaattgtttaaataattttaaaatattactaggccaacacgcacacacacaactacaaatttatacaatctaagataaacttcagtacccagaccatgagacctgaattctagtaacaacagccattaaaagcttaactgtgatgttaaccatttattctttgaacccattaggaaaaaattctgagaagcagctactcttttggtagtatatcccctgcttactttaatttccttatatggattcatacatcaggatttttaaaaattgaatgcctatattgtcccttggtaaaaagctgggtaaaaatctttgtaatatagttgatgaaaattgcgccagaagacttagattccaatacggtctaaacctttgctaccgatgaattccagggcactggataacaaagaactatttttctaatattaaaattaggacattagactaggctcaataattttgaaattctttactatgtctcagaatatatgatctgttggtgtcttgaaataaccaattttcatgtattttcttattattgcataataaaagagtatttttatctattatcatagaggtactttatttaggctccatatgttctcttttaatatgaataatattggattagctgaatattttcatgttcactcattcatatcttcatggttttctagactttaatgaagttctttgaaattgttatttttacacatgctataattcctttgttaagaaacgaggaataaaattgaaaataatatcccaatttgtgctatgccagattttataaacatctaagaacagctatatggtttgctttcaggttgaattttgtatatgtacattttctaatttttaaaatgggggaaataatagcttcccactttacctaccagaattgttaaaagtataaatgaaagagtatatttgagaatactaggcaaatatatttttattgtcatattttattttcataagacatgtgacttgaaagctccctgccaaaataatgagcttatatatttgaaagcatggaacaaaacacaaagcttacattgttttctctcagtcttcacatttgttttatacattctgctaaaattatttcatttattttggcggagagagagaaattatttatttgttcatgttactaatttacagagggtaatttattaatgataatatgtaaaccatatgtgtagattgccactcaaattgccaagttatctccatatagctagtagcattaacgaattaaatattccaagttcttacattttcagtatcatatcaatatgaatttaagttacatttcagagctaattgctggtatataaacacaacattactatgcttcttgatacaatatcttgttatatttcaaattagttaatctctcagtactgcatataattgttgcactggtaaccatgctataaagaagtagaggagaatttcaagcatttgctgatgcatcatgatattttcaataagcattcattgaacgcctccaatatctcaggcactgtttggttagacttgggctatacagtttaaagcaagagagaaccagtcctcattcccatggaacatacatgctcttggaaataaagaagacaagaaataaggaaacaaaagatgtggtaaagatatgtgctttgaagaaaataaaacgtattaaaaagtgacaaaagaaagatgaaagcaaagactaaaaagaaagtaattttttaaaagtaactggattggtggatagcaactagaattcttaggcaggaaagacatgtataagggaatgatatttgggtcatcctgaaattcaaaaagggtcagccatggaaaacacaagggaagaacattccaagaatttgcaaaagtactacaaagacacagaactggcttcttacattgaacaagtagaagagaagccatgtgactggaaaatagtgaacatgaagtttgagagggaggcaaggaccagattatctaaaactttaaacaccgtaaataaataggttttattctgagtgaccaaatgagaagccattggatagtttcgaagagttcagtgacataatcagatttatgtttatcaatcagtaaatctgtactgaagctcttaattccctttgaaacccttacataaaataactgctgttacagtcgtcccttctgatttgcagttttgtactttctctttgtggcttcagttacccttggtcaactgtggttcaaaaatattaaatgaaaatgtccagaaataaacaattcatcagatgtaaatggcacagcattctgagtaacatgatgaaagctttcactggccagcttcattccaccaagacacgaatcacacctttgtccagcatatccacgctatgcacactaccttccagtgagtcacttagtagaacttctcggttatcagattgactgtctcgtgtagtgtatttgtagttcagtgccatctgtggcttcaggcatctactaagagtcttggaacattttccctctgaataaaggggattattgtacagtatatggttgctgttattaggaatagttgacctgaagatgagataattcataagaaacccaaaattgaaaaagctgtcttgtaggagagagagtatacttttctgtttggcacaaggagtagtactatcagtagtaactttgggaagaaaagttatcatatgttatcatatatagaagatcttctaatagagatgttcaaagatagaatagaccccttgtcacaggagcaagtgggaggactgattggttgcatgctgcagacaggattcaagtgttgatggacagttgcagaaggtgaacttttaaagatttcatttagcctaacgagtcaatcactttatatatattcaaagtattctgatataaatacatcacataaactgctgataatacttgcagactttcctcaggcaaagattcagcgagaaatgagaatttaaaagattgtgagcatttcaataactaagtactcaaagtctgtttgtttttaaattacaacatcccaatgtgatgggacataacaagacatgtattgtagcatttacttctagttggagaaagacaaggcatggccctgggaaatgtgtgttagctggagagagccaaggaggtagctctgatctaccctaatgtggagacatcatttcactaggctctgaatcctatcaagttgtgtatccccaaattttggtgcaatgcgtagatatgtcatcagcatttcttgaataaaataatgaaatgtttattataatcttttccaacttcagtgatcctcaaggagaaattaaaagatgacaatgataatgagcatctactaattcctaggaactatgctgggcactgttataggctagaccgttaaaaattattacccaaaacttctttttactccaaagcatacctatctcattgggaatggatttagttactttccgtacttacatgttttctaacaaacctggcccatgtcaccagactattggccttggccatagttttacaatctgtatctgaaaacctgttctataggtagaaaaaaaatagatttgctgttttattttaatggcacagtctctttgaaaggtagtctcttttattaattgttaagattaattcattttattcttcccaagtaatatttaattttaacttttcacaaggaaggtaatatgcaatcatagaatgcacaattacttttatccctgatcaacgtaccattaattaaaaaacaaacaaacaaaatcttattcctattcttgtttccaccttcctttaaaatgataaaaaaatctcaggaagtcagatttcagacttagtttgggttcaaatattatgtatttagtaatttttaaataaaaacttttaattttttttaaatttcaacctttattttagatttggaggtacatgtaaaggtttgtgacatgggtatatagtgtgacagtgaggtttggggtacaaattgtgccatcacccagaaagtgagcatactacccaacagatagtttttcagcccttaaccccctccttctctctttcctctagtagtccacagtgtctattgtttccatctttacatccatgtgtacccaattttcaccttccacttataagtgagaacatgatttccttcttttttatggctgtgtagtattccatggtatatatgcatcacattttctttattcaatccactgttgatgggcacctaggttgattccatgtctttgctattatgaatagtgctgcaataaatatataaatgcttgtggggttttttggtaaaacgatttattttcttttgggtatatacacggtaattggattgctgggtcaaatggtagttctgttttaagttctttgagaaatctccaaactgctttccccaatgtctgaactaatttatgttctcaccagcagtgtgtaagcattctcttttttccacagcatcatcagcgtgtgttattttttgactttttaatagtaaccattctgactggtgtgagatggtatctcattgtggttttgatttgcagttctctgatgatttgaataaacaggtttttttcttttaactaaagcaggagatcacttttacattttatttagcttccgtgttgtcttctgtgtaatgaatgtctctaatgtgaagtaaaattttgtcatatgctataactaaatatttgctgaatatgaaattatttttgtccaaattatgtacttatgtgtcttactgttttaagttagcatttaaaaattaaactattttcttgcagagaagaagtacacatagaatgagaaaagtgacacattcagagtcagggttttaattctggtttttctatttattgataacatgactttgaacaggtcattttatttgcctaagtgtcagttttctcatctataaaataacaatttctaattccaaataaggttttgcagatactatgaacaatgtgtgcaataattttttttaactggaggtaacatacaatttttttctcaatgaccaatcgaaataatatacaatataggtatcttttattaacttggaatcatggcttcacatatatattgatccagaaaagactttttagaccattaactttatctcccctcttgtagctcttgaaaaaactcagctatagggcaatgtagagacttctgaaagtcagacaacaagaataaatagctaaacagtggtcaagaattcaatgtttttagatgaattggaaatggctgcaaaatacagtatttaaatgtttctatcttacagctaagcatgtcatgcagttcataggctaactgtagaaaagattatttttattagacatcaaatacatcaccagtaacttttctgaggccattatcaaaataattgtttttctcacatttttactggcaaagttaaacagaaagtgtttatctgcatgcattttagcctagtacttgctctaaactatactcaggtaaagtaatttgaaatattgaagccattcacagttggcctttatatcagtaggaaacaagatatgtatcatgtattcaccactagtgtttcttgagctcctagtagtggaataataatagctaacatgtatcgtgctttttgtgtgcctgttttaagtactttatatgtcatttaaagctcacactcactccacgaaatagatgttatctttagcacttattttgctaattaggagatagagacccagaaaatttaagtatattgccaactcttacaagcacattaagaggccaagtccatgaatacaactctggccattttgctcctgagcctgtgctcttaaccacttgattttgctactggatgttaaaaactctatgtttgggagtgtggatattgcagtgagtgaagcagacaagatgtctgccttcatcaaaatagataacaatacaaaatgtaactaagtgcagaattattgctgtagcaataagttttcaaaaaggcagtaattcgatttttatagtatggtaatggatggcttcacaatgaaagtagtggataaaaaagtagtggataagttttttccctaaccacttatgacatatttaataagcagaattttaaggcaaaacttgcagacagaaaagtaaccatgataattaaaggatggaagagtaagggtagttaagtttagttggcatgattggtaaatagacaatgctttttctcatgtcaaggtctataaattaggactgtattagttcatgccttagcctctaataaaattaagctgggttattcttctagctaaatctagaagtagaagacatctggttatggcagttttaaatgcaagcctaaaatgtttgtatttgtcctgaaaacaataggaagtcacagctagttttgagcagacacaaccaattaaaatgatatttggaaacatggatctaactgtggtatgtatgaggaagagaagcaaggtggccaatcagaaactattgcaaaatgtgtgtttgaaataaaaaccacaggtaaatatcaggaggaaagatcacatgtgaaaaaaatgatagctggattatttagtttgtgtaattataatttcttagaattaaataagaacatattctcatgcaagtactcccaaattttttggtgttataatgttttctgacccacttttttagtctgtttcattaatgaaatggaggtaaaaccataaatgcacgtgaacgagctgaggatgtgcatttccaaaaatcactccaaggcatgttgatgtttcaggagttaatattccttatttaaaaattgattacatacccttaattcttttaactaatgcccattttgtcaatttgccaacaaataagagaaaaattttgttctttaatatatttcggctctctaatagccaaggtgcctaaaaataaatcatagtattgaacacaatgtgactaacaaactaatgaaatataactcaccaagaaactgagatgtatactgttttctttagcagtcaagagctacaaaataaaggtcaaagtgctaattatgcctttgatagttgcgaagtggaaagaattctatacatatgtgaagtataggtaactgacaaacagctaaagatcagatatgaaattgaatttattagcaatatctttaatctaagtaattgcactttgtggctgatttgtgtgtgtgtgtatttgtgtttaggtaaaatacagtataaaaagaaaaatgaagatgaatacttaatgttattatccgtatagctactactatttaataaaaccagttcattttctacacaggtatgacatcaaagacgattacacactaagaattaaaaagaccatgagtacagatgaaggcacctatatgtgtattgctgagaatcgggttggaaaaatggaagcctctgctacactcaccgtccgaggtaagagatttaagatgtcaaagataattgaaccaggagactaatatttggttaaattggtaagtgaacttacgatcaaaataatgaattatgctgttttgttgtactaaaatgcctagattttgtgtcctctctatcattagttgaaataaaattactttcaatatttggttcccaatgatgataatttaaaaagattaattcttatttaataaattgcttatatggtttaacgttaatagtttatatggcttaaaagtaaatcttaaaaatagaaaagatctatactactctttcatttccattgctttcaactacttactgcttttaaatgtcatcagtttcaaaagtactctcatgctttctgtttactagtttgtcactttatactagtagcatactgttttgaagtcctttttaatgtcagcattcaaaacagcaatctgaaaaaactagcaatgcttccaaaggtgaaaatgaatacagaggagctctccagccttgagataatctgatttagagactgatttgtgaagttcattggccttaaataattgaaatagtcagtgctgctcttgtaataactttcactttctgggtgtcatgcacttcctcagtcatggaataatgttcatttatagactccctggaattgcttataagtgaaagaaagcattacttaacttcacagtgcactagaataaattaactgtcttttcagtgggacttgttgatcacgtgagggaaattacatagttcaaggtaccaagtagtaccaagtagacactcacactaattcttgaaacagacattagccatggcatcatctacactcctagaaaatcaaacaaagataggcaagcacatcctttctcccactgctaactgtgcctccttctctcatccttcgtgataaagagattggctgcatgttttcatccaagtctcagttacatcttaccccatttagtcatacctctgacccttgtgcagctttgctcccaaagagattcagaaggttaggaaaaaggttcggagaagtttgaagttgcaggaaaggtgtgagggattctcaggttagtccttcgcgtggtaagaaaaaggatttttaccaggtttatgatttgggcttcaaatcatacaaaactcaactacctccaggttattattaggagacaggcattttgggtacctggaaaaatattggtgcttttcatactactcaatatttcaccaaatccattttttcttctgtagatattctagtgtgaatttagatacaaaacatatttagacaaaattgacagctagttgcataaaaacattttcattcttcattagttaacaggtcataaaggactatgatcatatatgaattgaatatatatatatatatggattatgtaggatgaaaatctgataacctttgtaagccaatgaacacactttatttaacccacactctacatggataacttcatacatttgtcatatgtttgctaggcagctttttgcaaaaacaattcactagaccaaattatccccgaagttttctttttctttttttctaaagtaaatggaaaataataataaacaaccaaccaataaatgctccatccgaaaaatatttgctgactaaacaaatggtgagaaaacgtgaggagttgtttgtttgtagaagcagcagggtttcttttatacttgaatgcttggatgagtgagacttgaagtggtctgtttgctttaagacctttcccagctaattgttttcataatttgctgaaagtttcaggcttaacatttcatttaacaaagcatgctcctcatgcggggatgtttgaagctaacttacaaaactaatagagagcattgtttgttttcaatagttttttttttcttaaatcagcaaaccttaaatagcctctcccctaatctgtatactgtagatggattagagtgtttattctttgtggtatgaatttatcacctctctaagactgaaacctcaaaaactgggtttaaaaaaatctccttaatgcaatataatgtagagtaaaatactgtttaaaaacatttattttttaccattaggaaaagcatttgggttttctcatgctaagagattaacaggaaaaaaaagacaacactgttatctacgacttatttttttttctttgctaatttttctatgcacataaatgaaatgtgcagcctttctttggatcgttttattagaacagggtcaactgacccaagaggccatgcccattttcatccatttaatgcagagacacagttgtgtttaatttgctgattttgaaaacatccacctgctgtttttttttttttttttcaagatgaaatgttgctaatgtaacaaggacaaaaaaatgtattgtgatgtttctgctaaaattttatcataacattcacattagccaattggggaaaaggtaagagagtttattgtcaaaatttgaaacagatctactcagttatttcccatttcaaaaatatgctttaaaaaaaaaaactataaattgaggctgaacatcaagaagctccctttgctgacttggcaaatgtaaaattaggaagaaataaagccagtcaacaacaaacctcctagcattttcattctaatcaattaatttattattaataaaactttttaaatggcttaaaaatgacaacacaaactgcgtatttgtaagcacattttacccatttttaattttttaatttgctttgcataaagatctcattggaaaaatcatattgtttctagagcattaaagccttaattttttggaattattctataataaaataaaatagaaatacattttatttgtttaaaacatgatttctcaccacagtttcttttttttttttcttttgtcaatatcctacactcaaaacgcctttttgtttctgaaggaaacattatgttttaaattcacttgagatggcaagctgaaaagtagcaaattcaaagatgaaaaacaaagttctttttctactggacattttgcaaaattaagagaaactccatctgttagaataagccacaacttcacattattagtctgttatctctttttgatagtcaatcttgtattctgcccctcactcccctgcaaaaagaaagaaatcgtggtacattgggtaactcactcctcttttcctctggctatagcaaacacaccctatatgttaggccacattagggttccactaaaccaggcttttcgtaccactgctacaattgccttattgcctatggtctgaagcttccctgttttaattgtgaataatattataagaccatggctctcatagagatggattgcacaaagctagtattacgatgtatctgttaagtgaatatgtgtaaatatgttttcaatggctgttcctatcttgcccgaagagccatcatcaacacgaaactattggtatgttccagagtcacattacatatgcactagagctgtatctactaaggtatgggcgaaacactgttgaagaaattctatttttaatgtcagatttcatgaaatttcatatactactaagcatattgtttcttcatttggataatgggatcacatgtttcacaatatttgtctattgcttttgtataaaatggtttaccgtctaaattgatagcgtgttattcatttttaaaaaaggattatgaagcccatgtgtatctcttacaatttatttgcattaataacaggggcagcctattaccactgattttagtgattgaaagttatggtataataaaaaaatgataatttgttgaagcagcagtttgaaagccgttctcagtgtgaacaggaatcaacttgtcagtcattgtttcctgccctctgccagaagaagaaaaaagcttaacagtagttagggagctactgagttgaaatctctaaggatgttccaacctatctgttatattttcatccaccctgtccatggatgaaaagtgatgtaatctcaacttattactgactgaaaagcagcgtcaggggcttttctgcagtccttgtaatggttctgactaaccatgcttaaaatccaattgctatttaaatcagacagcgaggccttcttttattgacatgacatttgctagtctgtgacttgaatagttatattcatcaggtttttaactttggggtaacacaagactgtttaactcaagatctttgaaataataactgcagtaagtgatgatgataagactttacctaaaatatctctcaaattgcttacagtcagttctcaaagtaattattttcctagaattatatttataactctcaactttatcagactcagacatcttggtcatacttgaattgtgagactagaaatcactctattgtccatacttaaatgtaacattacacatcatgcattctgataatttttctttcttttttttaatttcttttttatgttctcaccacaccattgtaatgtctacagctcgccctgttggtaagtagccatccttctatccactaagcatggctttgcacagtgcttcataactcatgcatagtaagatttgacagaatgaaatatatttattttacccatgttaaaataatacttgagactgtatgctgtaaaagttgctcatgttttttttactcactttgataaacaattttgtagtgacttttgctacatagcaataagtaggtaacaatttttatgtaagagaataaatgaatgataaatgtttatgaactgctagcttttcttataggagaaaaatatattgtattaggatacaataagaaagcattgctctccttttttgtatgtataaaataatcaattattagttatgtttgatgttaagaaaaaagttatgaactaaattaaaaaattctacgactttccacacttcttttaagttactccgagtcccagtattttagggatatttttagctgctgcatatttattgcctgcatgcctatttaaacaaaattaagtaaaatgttttaagtagatgcttaccctaagtgggggagggatagtggagctgtgttctttggcatgaaatctgagtgtttgtggttttaatatatcttatttttcatttggctttgtgaaatctaagtaagttaacagcttgcttttgcagatatttaagtggtaattatttgtaaacatttggaagataaaatttttcaattcattgacttagtaagctttctgcatctcttttaagcttaagtttaattcaccaataactatgtttaaataaattttggtaattgtgttacatgtaaatgaatagatggatgcataaatggatggatgaaagagtgaccaaatttagtacactgcttctttaatataacaaaaaggtactttaataacaacttattcaattttgagggctttataaattgtccatctagcttcaaaagcttccttcatgtaccagcttgacatcattgacacctgatatatatgttggttcagactcacacatttttcccccttcggttgaaagagtcatggactttgttgctagacagtatgtttttacattgtcagcaaacacggtaaatatactttggtttcccaatctgactttctgatctggtgtttctgagcaatactcccttttgattagtaatttaatatcccttatcctcagtgacctcctctataaaatggagagaataatactgacttatcaaagctgttgcaggaggggactgagtttaagattgattttatatgtgaaaggcattctgtatgccaatgttggtagctatcgtatgcctagtttctgaggcatgacttcacatttcaatattttttaaataaagctatggttcacaattaattgaaacataaactgcagggtgttttttgaaactgatgaaatcaattgtggtttgtacaattgatgtttgaaaattgaagaatatattgtaataatttttaagccttattttcttgtatttgtagggattcctgttaatgataattttatgtatcttttgaatgacacacaaaattaagaaaagaatgagaaagaataagatgatgcagcaacagacaaagaaagagctgatggtagaatacatgaccactctcagatttctttttctcaacatctgtgagctagttttcaggttcagaaattcactcatttatgtgtcaaataagaaagcatgttattacatataataaaataaaataagtggaaagatttatatataaattatatacaacaatgatatagattatatataaaataaaatatatgaagtggaaagattgagaacgatctgacactttttcagatgactatggaatacaaaaactttgcaaccttatttagaagttttttaaagatattaagcattacagtatttataggagatatgaaaatagatgaatgattgaaaacatttctcaatagaaaggatgacagtaggtgttaaaaaatacaggttggttttgcatcggcagcagttgtacttataagctaatgacttttcaaatgaaaaggaaaaatcaccatttaaagtacagatctttgtacacagaaacctcatgccaatataccatgagcacttgatttatgttatagaatagtatgttaataatttccaatatatttaaaatctttaaatgtaggaaaaagtacattgatttgaaaatgtgatatacacagagtattgagatgtatctgtcatctgcaagatgtttccaaagttatttccattttttattcccgtttgaaatgatttcttaaattcccattggactggaactaaagaatagcttcttgacacattgtactttattctggggaagtctgtcatttcataaatctatctcaaatgacttatgacaatgttcagaaatataaagaactatactttaaacttgacaactactattaattttaaaaactgaatgttggatatgttttaattggatttccaaagaagacacataataaggcaattagcctcattttttttgtatctacttcttacatcaattttaattcaagaacatagatatctgaacatttattgtatggtcaaaaagtataagccaagtaaaataatgattacatattaaaatcatagaaaaactacattattatttatatttgttaatgcactaaaaagcacatttttcaactttgcagctcttagcaatagcataaagggcattctgcaaggtagaggccacagaaaggggagaaaaaaacagcttgtagttccaatataaattagatgaagaaatatgtaccaagcatataacgtttagagaaatttcagatcatagtttctgcctagagcttttgaatgaaaattagcaatcattgcagattctggaatacttagagattcagaaaccctcactacattactcactggatgaaacttcttgatggtctgtgtagaaagccccctttagaaatcattacaaacccccaaactgagaattttgtctaaatggatgactcttgtgcgatgcatttgtgttaaagaatttgcaactccttgcagtcacagttggaataaacacctctggcctgtattcagagttttcctctaggtgaacttagaggatgctctagtgtgggaggtattactgaaagcggacgttcatatacttgccaacagaggaaagtgttttacagatttcacttgctcatctgcagtgtcaccagtgggtcagaaagagctctttaatctaacgttcatatttgctggttgccacaaaatctaggcaactatcactttaataattaaaaatccacaagcccttcctgtggttttgacgttttactattccaaaggcattctttatatgaaaagaaaagtacatcgtaggatgtagttaactatgaatgctgaaatattcatttgtttatttggaaaactcttctgatgaggaaactgacagaagaaaatggtctaaattgggaaaaatatcttgcttcctatacccatctgtcttatttttctattggaagcctctcccaagcctaaaaataaaaaaagaacatctattttggagatgggcaccacattttttcccagcagcaactcaaaacatgatgagtaatttggaaaggaactgtggaatctaccagatgccttgcttacgaagccgtcctgttccgtttggtgacttgtataccatatgctagatgctgattgcctggagtataaaactgaaagctgagtacttcacgtgaaacttgtttaaaatatcaaaaaacaaactgacaattcacaacttgatggaaacttctaagtattttctaacttagtgacccaaaagtatgcttccttttgatggaagaatgtaattggccacacaagaatttagaagtaataagaagtacacatgctttttggcaaaattcaccatttaaaaattattttttaaaataagcagccactactctaaacagaaatctacagggacattttttttttaatgtttcaactgcttaaccacagtaattaaatatactattttagaaagttctgttttatgagtcgaagcaaagttttgttaaagcatgtttgaaagcagtctattctgaggccaccaagaagtccaaaaaaaaaaatggtttgtgattgaaaaattcattcagcatgaattataaatctgacattacttgaagaataatgtaacaaatattttgatacccccatctcccaccccaacttgaaatttggaaaatataatgtgctgtacataattggatattggaaaatcacagttttttaaaataagaaaacttaaaggtattatgtatgaaccttttcatgtttggatgcactttttgcaaaagatgttctaagtgtaccttgaaaggagacctagaattttgtttcttgcatcccttttctttggacaagctgttaccccatgacctgaggtaatcatctccctcctgagagctcttaatgtttcctgcacctggcactaattagctactttatgcagagtcccatttacttattattaagcatcaggttttccgttgctccatatgttttgattaaatggtaagtttaaaaaaggcattctgttttatcttctatattccaactgagtttccataatgtgaaacgtttaaaatatcttaagctaatgttcatttctaaagtgaaacacaagcgcgggttacttctcaggctgagctggttctagccttgtgtacttggcaatgtctgtccattgaacaggaggagaggctgggtcttaaattactctcacacttctttctttttttttcctctcagaacttggtaaaaatgtcctattgtcttggtattgaatggtattatagtgtagtctgaaacttaacaaaaaatatatttttttcttggctgggattttcttttaccatatgaatatgcatgtagtcctttctttcaagtaactttgctcagttatatcttggtaatgatcatcctgtaggtaatatttctaggacgcaacaagccacttgaatctgccagttctatgctttaacttgctttatttcaataaccttttcttctgttttatctttgaattttttttctgttttactttctcatttcttcaaattatatttcttcttagttatattggctttccttagtctcaatttcacatttatcaacttctctataataatttcaatcatttttatttcatattgtatgatttctcaatgacaatataccgcgtctctaacttttaaaattgcaatcattatatatttcttatttctaaaatatattctaatttttttgttttttgttattttcttgttaagctctaatataaaattctttatctttacttgtcttttagcctttgtaacccttttttcgtttttaaaagagagatttcattgtatataatttcatttagacgatgcctaagttatttgttttaaattgtttctgtgtttctttgagtaattcttggaagacacaggttctttatctctctttaattaattatgttcattttctgtcatgaattaaataagtaattggttaatatacaggtttttgttaaatttcgttttgcatagattttgttttggttcctatctgattattcattttctggttagctctgaagactagagtttgcatatttggagaagagaaaatgtgaagtagcagggtaattcaataacccttatttagaatgttgttttcaatatcttactaaaaacatactatgttcttctcagtattgtactaggcctggtgatacagaatcaccctttttaagttatgaggggtgtgcattttcctataagactctctcctcatcctcctttatactccctgcttcataataaggatggttttcaggtgtgtcagttttctattgttgcataaaaatgaccacacaatgagcaatttaaaacaatgtcattctataggtcccaaatgcaggcagtctcaacagtgttttctcctaagggtttcacagaccaaaatcaagatattggccaggttgcactctcctccggagactgtccagaggaatccacttcaaagttccttggggtgtttttcggaatctggttccttgtggttgtaggactgaagttcccatttccttggctgttggacagggtgactcactgtgttaagtggctgctcttcagccttcgcacattgctgccaccacaaccttcatagccagcgggggcaccctgaattcctcatgtgctttgctttgtagctctccgaggcctctttctgatttaaagatccagagtattaagtaaggcgcagctgatgaatcaacccattctgaggtcaactgattagtaaccttaagtatatctcaaaatattttttgtaacctaatataatcatgaaagtatttccaggaagggcaagcctgaggtcatggggcctcagaatgctgccaactacagtaggctttttttttttctttctgtcaatacttctttctccgccttctgaattttagcttattttctacagttatgtctcatatttcccatgtctcactcttgactttaagtatcatttttcccataaaaggatcatgggatgggctctcacaatgatgttagataatttttgtgcaactggtattgataaaggattaaggctagttatgttggtgtccagtgtgcatcctcagctttcttcaaactttgctgcatttggcaggggtacttcataatttgtggttttggggctatagtagttttttcttattattcatttcttttgttgtactcaatacaggaaagtgaagcctttactcaattatcttaacctaaacagcaaaaagtttgaataatcattatttttggagcctattcaaataagaataaaataaatattaagtatttctaattagtacttaaaattaaagtactataaatattaaatatcagaataatataaatacttaggcccaaaacggtatgaggagattagtattaagaagtttcactggctgtgtccagaaaaaaatcacattaactttgaattatgtattcgaagaaagtcagaattttcataagttgctgcactttgtagacagggatgtcatgatacatatactgtaaaatatatcttatgatgtgtgttacacctacatatgcatgatatttgaattgctacactatttgcttaaacatattaaatgtcactcaagggaatagtacataattagatttattaaaaatatataaactagcaaactatattacatttttatttcaaatatatctgaatgccttttaaaatctcacttatggcaagtattgctttccagatttactgaggttattattttcatctcccctacaaaactgttagctctttgtcagtaaatacattgttatatttatctttctgctgcctctaggtctagcataacacttacatgtggtgggggcacacaaatgttggtgcagttaattgatacacgcatatgcatacataggtagtacttgcctagaaaatgtttatgcaagcagctttaaatagtgctataaaaagattaagcaacattaatggtaacaggccaatcacatattccccattctgctggtagcagataaaatacaacaaaaagaaggcactaatgagctaggatggtgacttactaagcgtgtaattaatgttattaagaaacattgcagttgcatattaaaattccgttaactaagcaacccttcagcatcagtacatttgttccttggtttcaagtttttctttttctttttctttttttttttttctgattggcatcttcatgcaatctttctctaaaaaatgagataatgggatgtgatcagccctcgtggtttagctggagtgctgacatgacagttctggcaagttgacaggttaagtgagtgaaaatggatgtcttgtctcaccatttacttgaagagccattttaagctatagtttccctctctttactcccacacttacaactccttctatcccaggtatgagaagtcaagttttcccaatttaggaatttaggatcttgaaagaagtttttcaccactttaaactagtcttcttctgctggtcaaaaatgagatcatttctttacaaacaaagagttaatttctctaataatgaattcgtttttaagttaatagcactttttatttcatattaagagtcccttaaagaaaacaaaattttattgttttatttttagtattttaattataaaggcaggtagaaaagcaaagctacaaacgcactggtaaagtacagaataatatgggacaatggaatttaaaagttcagaacttgtttaatattttgacagattttcctagggatctctcaatttatacctatgtataatttaaaagttctgtgaaacttgcatggcgaatctcataatgatttccacagttacatgatttcctatagttacctataattaaggaaatctattttagtaatctgaaatataataaagtttaaaattacctgcaaatgtacccaccttatttacagtgtgagtaaactattactattgattgcaatgtagaaatatttaatatgattataggattagagtggacttgctaaacccagtaaagaccatttagatgaaaaaatacatggttccacccctacaatccctcagtttaatttctgcctggcaaactcgaactatgagcaagttcatagtcgaactatattacttgccggaggccttcaaatacctaaactgactcaaggagcacacccatctagactgccacaggccacaaagaagcaggtggggggaatgtgccttaaagcagtctgcaaaattcctgtctctaacatactgcctttgttttcccctctgggaggagcactctcccacccttccttcctttccaacttaatctaaaagaacaaatcaaatttgtttctctctctctttccctctctctcttcttttctctctccttcttttcttctccctctctccctccatctctttcctctttttcttcctctctctctttctctctctatggtttctccagctgtagaaggccaactgagtcaagttactcttttgcttagtatgtattgtattacaaccttcattgtattgtaacatgtcacaacacaattgtaaaatgtgttgtaacatgcttgattgtttccaggaatgtctcttgtggtaggaggtgacttccacaggacagagatcttagtaccctctgacagaaaagaaaaccactaatgttgtttaaaaaaataattggatagtattatgaattgaattgccatgcaacatctgaattcatttttgtagaaatttattactgtggtacgttccagtaatattttgccttcaaaaacaaaaatataagtgtgaaggcactggcccaagtataaaatggctatgtgcttatagctgttcattacaacactgtttttatgtgcctgcttatgagatctaaaaatgcaagacattttgaactgagttaactcttttcagaagcattctttccattctagattattgtagaattatttcattttgatatttacattgtggcatttcaggcaggagcacattatgtgtgactctaagtgaaagcaaatggtttgaaccactttcataaaacatatacatattttgtggggggggggtgtattacacttaccaaaataaatccaatgcctccttggaattgcctttacagttgcaacacatggcaattcagaagccacttctgttattttgtcgtcatactatgtaattattggctgacttcactgcctttttaagtaatcagattttgaataattgagagttttttttgtggggaggaggttctgatattatatgaaccctccaaaattaatctcaccatcaacaaattccaagactgtttctaaactgtaaagagtaatagctgcataatagtaacatgttttgctcatacaatgaatgaatgtaatttgtatgtatatgtgagacctctcatgggtgtagagtagaatatgaagtctaaatagatgaggaatctaaggattatgactcatggtagtcattctattctctttgattattttttcatatttatgagagcaatatatcatttagtgcttttccttttcattttgacattgaagaagcacatacatatatatgcttattgttgaaagaaaaggtattattgtattagtctgttctcatgatactaataaggacatacccaaggctgggtaatgtataaggaaaagaggtttaatcgactcatagctccacatggctggggaggcctcacaatcatggcagaagagcaaggaacatcttaaatggtggtggcaagagagccctttgtgggggaactctcctttataaaaccatcagatcttgtgagacttattcagtatcacaagaacagcagggtaaagaccctgccccgtgattcaattacctcccaccgggtccctcccaagacccgtgggaattgtgggaggtacagttcaagatgagatttgggtggggacacagccaaaccatatcaggtatagacattggtattttactatggaataaggatttttattattagctacaaggaagtagctggtggcaaagaaagtgtatcactcatctaaaggatttattgccatggactcaataaaaaacaaaaaaaatagttaattagaaaggtaggtaatttagcaatttgatcatttacttttttttttttttttttttttttttgagacggagtctctgtctgtcacccaggctggagtgcagtggtgcgatctcggctcactgcaagctccgcctcccgggttcacgccattctcctgcctcagcctcccgagtagctgggactacagtcgccgccacgacgcccagataattttttgtatttttagtagagacggggtttcactgtgttagccaggatggtctcgatctcctgacctcatgatctgcccgccttggtctcccaaagtgctgggattacaggcgtgagccaccacgcctggccaatcatttacatttcttggaaatagtgacaaatgagtaaaatgtgattaagtagtctctataaaagtgattattttaaatcctatatttctaatttatattttctattataaatacattgcttcctctgagatgaattatgtgttaataagcttcaaatccaacatttccatggcagtgtgtatgcatttccaatattattaacagaaaatcttttgaaatcaaatgaagcattacatagtaaaaattaaataaaattaaataagttgaagaaacaatcacgtatcaattagaacccaaactgagttgaatataaattgagtaaacatttatctcttactactggtctataattgcattgcaaagaaacgatttctcactctctgtttcttgttggtggaggcaagcctattaactaatttttgcagaaactttttaattttttttcttctttttagagacggaggcttgctctgtcgcccaggctggagagcagtggcacaacaatctcggctcactgcaagctccgcctcccgggttcaagcaattctcctgcctcagcctcctgaggagccgggattacaggcgcaccctgccacgcccagctaatttgttttgtattttagtggagacgaggtttcaccatgttgcccaggctgatctcaaactccagagctcagacaatccacccgcctcggcctcccaaagtggtagaattacaggagtgagccaccgccccccggccttttgcaggaacttttaaaacccattgttacacaatgtctttatttgtctgtagtgcttttgttactctggaatgttggctactcatttataggctttgggtcatacattttcaacgttgtgtagcagcactctctacaaaagggcgtatcagaatcggttagatttgtattcaggtaacatacttgaaacaacacatatcagaatcgattagttttttttcaaatcacatatatattgttttcaaacactatatttactactgcaatagtaagtcactgtcactggtgggtatgtgtataggtataatggaataggtataataatgcagatatattattccttaggtataatgagatggaaaaaatattgagtatttgctttagatcaagaattctgttctttttaaaatgtactattccgaggcattcatttagtgttcactgttttgggcttttctaggtgaaaaaaatataccatttatatgctaaattgtagacagcaccccataccagtaaaatcttcaaactgaactaaggaagtcagacatataggctggggaaaaatagagaaggcaatgcaagcaagagcaagtaccttaaattggaaagaacacaagacaagcacaaggtcagagattgttcaggttaatcattgttgacaaagaggaccaaaggataattgatatcggggtgggttaaccacaagaccaagcaaatactagtgattgaaagtagactgctctgctgaaatgctggagctagtttggggacaaatgagtgtcaggattggaaaatcttagatcagctgatggaagccagaatgctacacggagaagaataatttgcaagcattgctatggtaagtattgtaggtttcactgtgatgcgatgaaaagcactataggtttatgaataaagagtgacttgaaggaagtgtgcttaagaaaggttatacttacaggtagtatagaaagagaaaagtaatgggttttatgctaccctaataataaaaacaatcattcagaagaaacgtaatgttattattttgcaaatctttgtagcatattggaaataatagcgttaaagttctatcattcttcttcgtattagatatgacaaatttttagttaatcagatcttggttcgaacggaaccaaatgaatctggcatctcagtgtttaagagttcctactgtggcattcgaataagccagaagtcaaacctgtcctccaatctaatttaactaagaaagctgtatttcttgcatgttgtcacttataagtggaagctgaacaatgtgaacacataggcacagggaggggaacaatacacactggggccagtcgggggcagtgggggcgcgcagggggagggagagcatcaggaaaaagagctaacgcatgctgcggttaatacctaggtgaggggttggtaggtgcagcagttcatcatggcacacatttacctatgtaacaaacccgcacatcctgcacatgcacaggggaacttaataaaccaaaataaattaataaagctgtgttactcatgccctgagtaagattcagtttactggttttacatcattatgatagtagttgaaacataaggcttttcaaatattaattgagataatgcctgtggagggtttaacacaaaccctagcacataataagctctcaatgaatgttaattattgccattctactaaacagtttgtgactaagtgaaattttaactcaagcatatgaaggaagagaatgcttcttaaatatgcttatagaatatgttagtatttaacaagtaaatatatgaaatagcaaaaaaaattctacttgagtttgtcaaaaaattcgaaatggcaattatagaattaaaagtttattcattcaggcataaaattatatccaaagaaaaagagtggctgagcatgactgtattcaccctgtgccacatatgaatgtacgtagctgttgcatgactctctccatgctaatgcctgccataggaagtcatattttcctgttaaaacaactctgaacatgatgtgattaacctttagagtcccccatcccctcatctcaaagcccaactcatgcacggcctgtgcttcctactcatgttcagccatctgatttccatgtcacccactcactctcaccagcaggcattagcataacagagctgcagcgtgactttgattgaagccagcttgggctgaatgcagtatcaaagcatcatttagcagaaatcaaatctaatttactgtgcattgtatttaaattctcaaaacacagtttcaagtgaactgtcccagacctctaatcttaattgacctttttatatttgggtctacttctctggaaatcacacaacatactttccttatagagctattgtttttcagcttgtaagtgttgattaaacactaaattgtgtcattctgtttgcttcgtctcatttctagttatagctgaagcaataaggtataatcacgtgacagattaagcaagtaggatattacatcatagttaacaaaagatttttccaatgctttcaggttttagacagaatataagtatatattttatagtcttctgtctcagagacatataggagaattgccatttttataacaggcatattcttctggagtttataactcaatctctttaattcacattgggtttaagcatgtgtttggaattgtcgtcttgaggacctagtagttttttttttaatacttaatgggagtcattatagaaaatctattttatgtatagcacactttgtgctattgtgctgtgttgataaaatgccacatctgtctactccctctctttggtgccatcagccaaatactgtcttttcagaccattttcactgccacctggcagagacactgaaactgtggagggttattagaagaattattgatgcagtttttcatttaaaacctcaaaaataaattccttcagctgatatcccttcacagaagattgcaatatagatctagggcagacagagagtctacaaaagtaaaagtgattgatgcaatttgtttctttggtccaccttcaggtgataataggaaaggatgtgtattttcacagacttgaatactcttcaaattttttgctttgataaatgtttccattttttcattttttaaaattaaaatatgattagatgattttagttccagcaagatcaatgtggcataagttctggtgacaatagtctattgaatgcatttgaaatacaacacatttccgacttggagtaaatgtacaatatacataaacatcacgtgataatatattttataggataaataacagatgctgacagttttttgttagtggtctttaaaataatccagtattgggtaaaagttccagaaattataatttcctgtcctttttagattataccatcagtggtaaatattatgttttgattttgcagaatttctttgtcctttaaaagccctgatgaaatggtatctttaggtgctactaaaaataaaaattctcaactggattctctgccccaacttgtgaagatttgccagctctttgtctttgctctttctctaatcctcatctacattgcttctaaagcaccctttccaaaatataaatctgattatatctttcttacaaaaatgtctttgaacagatctttagagttttcagaatgaaatgttacacttgtttagcagaaatcatctgtccctatctatatgaccactgtgacctagatttcttttattctcagaatcttttacatgcccctaaaaatccagttcagtgggtctctgccttatgtgctgcttctctttgtcccaagtcaccttaccactcttcgcctagtcagctcttagttgtcctccaaagtacagctctaatgtagccatgccctagcagcttttctctttttttttctcacaacatggcctgattggttctgttccactctttctcccccagtgccatctgcattttttctgttttcattgaaaaaaatcacattttgctgtttttgtgtatttatttatatatttacttgtaagcctctgccacagggcaagaacaattttatttggcttcccatctcctgtaccaaccagaatgtatcatcatttttcgtcaatcagtacattttgtgtgaataaatggatgaattatgtcttttcagaaaagtggatgcatagatgcggtcatttgccagtccttattttgaggactatattttagcagtggtgttaaaatcgtattatctggatgccaaaagcattttgcaaaatcactcatctacaaaaaaaatgtttcaaaagtttgaaaattaaattcttggaagtctgtacttctaaagtacacatggtaattttagtgatagagatttgtaattttactggatagatgaagaataatatgcttaaaactatgaaatacataaatatatgttgatatttcattgatttcatttgatgatttcaatcacgtttattctcagttaatatattttaaaagtttgtaaagaaggactgtatagagtatccaggactctaaggttttactaactacttttgtgaggtaatttaaattctttctggcccaaagcagtacaaattaactaatcagctaaataggtgatttttattcaaatcttttaagtgactgattttgaccaaactgagttttgagtttttaataattttcgatacatgctaaattattcaacactcctcacttggcaagtgtccatgttggcattattatttttctttataggatcacaaagagataactatatactcattcttaactttttcataacaaatataatttttctacaagattgcagatgacggaaacaaaccttaagtgtttttttttttttttggcacaaatacctggtggtttcacatttctattgaaaaaatggtcactgcagtgttttaagagttttctctaaaataattttttaacattgatttacaccatcatttctatgagaaaacatggaacaaaaatcaatgtatctgctgattcgggagaactgtgtggaaataacaagaagattgtaagaagcaactaatctcctgaaaatacaaggcaacctataccacgctctgttcaaacagattcataaatctgggttttccatactgctagaatgagtcttctgttaatctatagttatagaagaaaatgtcatttagtagatttatcccatctgtccctgggttatgcgttagatgcgttgaactaggaggcggtataatagaacaccaaaaaataagtcaatacaaatcccagggaattgtctggaaaaatgctgctgctttttctacgctaggattcttgtaaggatgaagaattggttgcgtgtttggggctgatctacgtttaccccattcttggacctgcacttcttttctcctgaaggactgaaatgatttccagtgacagtttttaccagacatcactcatggttagagggcattaaagtgccactaggttctaaaaattagagttgattttaaagtgttttcttggtctcagttttctagcctaagaagcgagttaaagtggatatagattattagaaaagtcatggaataaacactgtgttttctgctcaacaaaaatggattttggtagggagacgcccttgtgaaaacttccaatgatactgcctactgtctttcactttattctctctcaagatcattagaccaccatttaaatctgaactttcttaggatttttacccccatccctttcttttattttctgtcggagttacttatgtcttggtctcattagcttcacctgtaccattttactagcctcccagccagacttcttgttttatagactaagtggcttcctctccaatccatgctacattcatcagagggttaaagctgccaaaaattacttttgcatctgtcacttttcagcttagaaaaaaatcagaataaaatcctcagtttgacttctgaaaccctcctttgtagccaaaagtgtttacataacttggaccctccatcctgccaaattacacactgtatcctaagcttgttcttgcttcttatactttgctccataatctccttgtttggaatgtgttcatttttccatttacctcaaagctcccataatgcccattttctacacagagccttctgtaggttttacaacaccaagggatttctttctcctgagtcttattgtgtttcgtatatatacaataacttaaattctcttccactgtggtctgagattacctctaccattgcacttaccacagtcttagataagtgttgatttaatttcgtttttgtttttgtcattgtcattgtgtttttcatttcccttagactctaagctctttgatggcttcaggataaaagcttcccatctctgtatctttagtgcccagtaggggaacatagtaattacctgactaacctttatctatctaaatgaaataaattagattgagtcaaccatttcaatacatttatttatattgcttattacccttgtatataattcccatctcttcaattcttcaatgtctttaatctttcaactcttgaattctagatataagcacttttaagaataggggtcatattttataccctttggtatccctgtgccttatataattcttgcagtaactacaaaaactgccaatgcttataaataaattgactttagaggaaggagatggttgagtaagagagtgattcttttcttatctttatttatttaaaaagcagaaccaacttgaaaatccatgtttttccttaaaaatgttaaaatcatttaaaaatctaattttctatgcaagtatatgtaggccaaaggattacaatgtacaacatataaaatacgtctgctaaaaagtttgcttctttcctcacattggattgaatataatgtctttctttttgtgttttgagaaatgtgtaaaagtaaataaaaaactgtagtctctctctggcactgaacagtcaacatagtaccatattttctccttgacatatttttatttgtctatggttgatatttacacgctttcttttcttttaaattatagctcccccacagtttgtggttcggccaagagatcagattgttgctcaaggtcgaacagtgacatttccctgtgaaactaaaggaaacccacagccagctgttttttggcagaaagaaggcagccaggtgagtgtgaggcttcactgcttttctgaaatctctgaacttctactgtctctgctgctcctgaaagcttgccttgcttctcttgttctcaatgtttgaatttattttatttctgaaaaagagactggtgaatgtaaaaataagtaggagtcagatgttctagcaatagcattctttatttgctagtattaatcttttcaaaattctgtctcttacatagaacagcaataaagcagtgtaacaaaattatcgttaaaagtccaaccaaaacctctgtagctatttaaaatctgtgaaggtaaagctaattttgttttcttgtattgagatacgtggtgtgatagagtcaggacatatgcagtacttagaacaatctctgtgacatggaaaacagtcaaatatttgtttaattggcccagaatttcaatcctctctcttatatacacagcataaatgacttttcttacccttaattaaagcatgcttccatttaagagtaggataaatcttttccttctccattcctcctggattcatccatagtggggttagacaggaaataatacatagtacactagaaggaacccatacctgtcttgtctttgttctgccctggtttgtcctctccagggccctctctgggcaacatggcctctcagagtctctatggaaagtcaactggatacactagttttctcatttagaactctgtctaaagttggacaactgcttagcctctaggttcgtagtcaatgagtgaaatttccaggtaaaactagattaaaaattgtgttgtttgcaaaataatttatctgtgcattcccatgggacctggagatattttccttctaaactttctagaaacatgcactactaggcatattctgaggaagagacctactggtggtcttcctcatcacattctgttattactacatgttccagaagaatttccttgggaataatggaaatcattattaaacatctctggaaatctaaaaccttggccagagatgggaaatgtaagttgcattagaagactctgttgattaaagcttacatgtgtttatctgcaacatacatgtgtgcaaggaagcctgtagaagttctgtgcagccattatgtctaattgttgtgggtttctataaattcctgtaccagctcatagtgagcagttctaacagctcagtctggatggacaaatggccttttattcctcactcagctctccttggtggagtcattcctcttgtgatttgtggaatgtaaacgtagtgacgggaatgtaaggaaaggtgatggccactgccttatcccacatcagaactgttccaggccttaactctcaaatcttctttctaatttagtaattacaaaacaggtttctacacatagagttctttaactgtttgctttaaaattcttttcagatgttagcgtctcagactctaaagtaagtgtaaggcagcatgacaattaaacacatacacacacacttagacacacacacatatacacacacatgcagagacagacacacatatacacacacataccacacacatacacatacgccacacacagagacatgcacacatatacacacataacgcacatacacatagacatacatgcacacacatagacacacataaacacacaccactcacatacacatacacatacatacacatacacacacacacacacacaaaaaggagagaattcaaaatccagtttcctccttataaattgtacaacttttgtagtgctatttaaatgtactggaactcattttcttaatctaaaatacagagctaacacattttacttcacacaaacaaagtttaaatgaataagttgctttacacattatgaaggttaagcaaaatgttatgtcactggtagtaaatataatgatgtaaagcaatttgatcattgcatactcacactttaaatccatgtattgagtgaaatctcattataatgtgacttgttattatatagctaagaccatatcaggtgtaaatcacattccctaaagtagctccaagttgaattacaaggtagtgcataaaatgtgtattggccttgtagcttaataaacataggatatttaaatatgctacatctttgttaatggtttcaaaataaataacaattaaatagcatttcagtattcctttttctgtatttgacgaagtggcatataattccagagatattaatgttaaagattacataaaatcttaagtctagttttcttttcctcacctatctctctcccatcagagagatagaggtagagatagagagggatgtggtgggagagaaagagagagagagagagaaagagaaagagatacacagagagaaaatactgtgaatgagaacaagagagaagtgcttgagcaaattataaattctcaaatcatgaattgggatattgggaaaaaataagtcggtcttactatttccagtatccagtttttacagttatctatgaccatccatcagtagaaacagttaaaagcctgaacttaatggtccatatttctcaatatatgctgataatgccaattagctctaataggatacccaggcactctccaaggcgggaagagctgtgaagttcccggtttttgcttgtaatccattttcttttgcctatgtcatgcaagcagagaagaaaaatgatgggttaaccttcatataatgccattttccatgtcaacgaatcatttagaaggtggactgatggtacattgtagaggaagccatcccgtagagaataaagcccatctgatatattagtgctatgtaaattagtattctaatggctaattgtgggaaagtgtgcactttgagttattgtatcattttcaagtgacttcaaaatttagactctctcttttagctcgtttattttgataatacatttggaatctacagtagaatcagctgattctcaaattgtgtttctatgcatgaaaatgtctagccttatataatagtacacattttataagaggtcaatagcatattgaaattacattcctgacatgctagcaaacatcactcgttttagacggagtttaataacatggtaatgtttatgtaaagtgggcttatagtgtcacacttgaatctaataaagtggacatccatcatgttgcaataaagagaagagcttctaattaaaacaggacatcatttgcaggattaaagtcattgagcataattgaaaagtgttaataccctattttatcctcttccattggtattacttcaagggtaaaaacattttaaggtgaaaatgtgtcctgggcctttaattgaatgttattgcctcctgattgcaacgtattgaaactgtttaattacaaacctggaaaattaattactatatggagaaacagatcccagagggttaaaatgtccttttttgtaagtaaatacaacataaaaattgatatctccttatttataatccaacttggaaacatgccccaatataatttattatactcaaatgtttttcttaattgaacaacagtaaagcaacacagttcatccaaattaatgttactcctctcatagatgaactttcacaatttgtaattaggctatatgtatatatgagatatagagtaaactaaagtaattttgttttaaaaagaaagtaatattatgaaattgtttaaggtaacacacttttagaaacattctacattttctttttatcttcagtaatttgcttactcttgcttaaattgtagcatttgtttataaccccattcaaagctgcaaaaactttacagcagaagtacagtcagctctctgtcacacacttttgaacaactttgggagaaattcagttgagtccatcaagtattcaaaatgatcaacagcaatcatattttgcattcttcagagctgtgcggtttatacaacccatacacagtcaatgttatggccagatcttcatgaggccttagtagttgagtcagataagaattgttttgcccattttccagatgaagaaaaaagcttcaaagatattaagtaactagcagaaaatcaggatgagataaagatccccattctttaaaaacacagatgattattctttcaactagaaaatattgacttcttagaggatattattccaccatgatttggaaaacctttatcagtgaaacccactgtgtggcatttaaacatttctgaaccatatatattttaatctgtgtattttctttttcccactgtattccttaattgtagtagcttttattcacataatttttttaagtggaaaatgaatattgatgagattgtgcttgcttccacagaacctacttttcccaaaccaaccccagcagcccaacagtagatgctcagtgtcaccaactggagacctcacaatcaccaacattcaacgttccgacgcgggttactacatctgccaggctttaactgtggcaggaagcattttagcaaaagctcaactggaggttactgatggtgcgatatctttactagatttgtcttatgaaaacattgatttttatttctagatacacgttaaccatgtggagtttgctgatttgttaaatcatttctatgtatgcttatcttttaagtttgaatccaggtcacattcttttggtagtttctaattctccctgattgaataccacttattttccccaaagaagaacttcagagataatttacttaattcttaaaaatagaatagtgcatttttttaaataaatgtcatcacactcactgcatactgaaatgtaatctgtatatttttatttagtcttaggctgacatgattggctctactagacattaataattttatttcactctaggaggaggtcataccacctttaatattatcagagatgagattttagttagctaatcacattaggacattcctatgattttaattatgcattcactaagttaaattaactacctttcaaagtgctgaacaatgctaaaattattatttttattggcacatatgcactttgaatcttaactgaggcacctacattcatagtgaaagttgaaaaggatgaagggctctgcgtaatctggttttttcccagcagtttatttgtcacaattgacagctagcaaatttgagatatttcatgaacctctgagcgtgaatttaatccctattctttgatgtcttaaactgaaaattatttcttactctcctttatttgtgaggatttttacttttgttttctcccctaatgctggcttctgagatacaagtgctttggtctgtggtgtcttcttgatccccttctttctctgatggtgaaatttgatgtgcttttatacaatttaaatttacatgtagattaaaaggtcatttaaaattaatagaaaggcagtattttttaatatctgttcatggtatggcctgattcagtgacatgtcaggaatgggaataaatagaacagacaaacattggctgcagggacattgagtcgttaatggctgcacctgctgatgctgcagagatttactgctatggaactgaaaggagaagtcaggttcaaggatagcagtgatgagaaattcttccttagatgggcaaggtctttgattctttgtacctccatatttctttaaaagaataaaagataattattaatcattaaaaagatcttatgttttcacctgtcaacaaaaatgtccagatacatacacttgaaaaataagatattctgtccaaagcctatgttttattctatattcctaagaacacaccaaatgtaatgcttaagataccggctatcatttaactacttataatattttatagaagattgactctcaaatgtttctaaatgaagaaattgttatggaaaaggcaaaccatatttgtgggaagcaaagttgatgaactagaagagccagttaatgtgactgttatcgttcataaaacaggtggatattcagaattacgtctgatacaattaatggaaaacctttgaggccttacactagctcatgctatattacaaaacagtagttagtctagctttctttctgtggtcaaaaataagtgatgaccaatgttaaatcttctgccaactgagattgctctaaacattttgttacaactggcttgagtattaattcctatattgatttttacttgagtaagcaattacaaagtcaagatccttttgcagagacattgattagaagttacagtgttgttgattttgacagtaaagaaatgaaactataagaactaaatatgtacacacatgttatcaattaatctgtctctaaatatgaagttgccacattggctgatgccttaagcttctacccatagttttgatttttcatacaggttaatgatttaatactatctgagccattatttcattttgaacacatttattttgatataattcagggaattgtagagccatttgaaattccatggtagaatgaaaacgtatgtcatgttcagagaaagaagtgattacaggcataccttcctttgttgtactttgcagataccatggtttttacaaattgaaggtttatggcaaccctgggtcaaacaagtctgttggtgccattttactaacatcatgtgctcacattgtgcctctgtgtcacattttggtaattctcacagtatttcaaacaatgccattattattccatctgttatggtggtggtctgtgatcagtgatctttgatactactataatttttggggggtatcacaaactgcacccatataagatggtaaacttaactggtaaatgtgtgtgctctggtttctttacccactggtttctttacccctgttgttctgtctttccctgagcctccctattcctcgagacacaacagtattggaattaggccagtcagtatctctacagtggcctccatgtgttcaagtgaaaagtcacatgtctctgactttaagttaaaagctacaaaggcttaagtttagtgaggaaggcatgtcaaaaactgagataggccaaaagctgggcctcttgttctaaacagttagcaaagttatgcatgcaaaggaaaagtttttgaaggaaagtaaaagtgctactccagtgaacacaaaaaatgataagaaagtcaaacagcctattgctgatatgaagaaagttttagagtctggatagatcagtgagtcacaacattcccttaagccaaagcctaatccagagcaaggccctaactgtcttcaattccttgaaggctgagagaggtgaggaagctgtagaagaaaaatttgaagctaccaggggttggttgatgagatttgaggaaaaaagccatcttcataactaaaagtacaaggtaaagcatcaagggctaatatggaagctttatcaagttattcaagttatccagaagttcattcatgaaagtggctatactaaacagattttcaatgtagacaaagcatgcatatattgaaagaagatgttacctaggactttgatggctgaagaaaagaagtcaatgcctggctttaaatgacagactaactctcttgtaagtaactaatgcagttggtgactttaggttgaaactgatgctcatttactatttcaaaaattctatgacccttagaattattccaaatctactctgcctgtgctctgtaaatggaaaaacaaagcctgaatgacagcatatctctttacagcatggtttacctaccgaaatattttaagtacagtgttgagatctactctgcagaaaaaaaaattcctttcaaaatatgacttctcatctacgtgtaccttgtcacccaagctctgatagagatgtacaaagagattaatgtttttatacctgttaacacaacatctgttcagcagcccatggatcaaggaataatttcaactttcaagtcttatttaagaaatatattttccaaggctatagctgctgtagacagtaattcaactgaaggatctgggcagggttaattaaaaaccttctggaaaggatataccattatagatgccattaagaacatttatgatttatgggaggagggcaaaacatcaacattaccaggagtttggaaagttggatgactttgagggggttccagacttcagtagaggaagtaactgcacatgtggtacaaatagcaaaagaactagaattagaagtggatcccgaagatgtgactaaatggctacagtcacatgatacaaattgaacaaatgaagaattgcttcttagggatgaccaaagaaagtgatgacttgagatggaatctacttctattcaagattgttgaagtgataacaaatgattcaaaatatcacataaacttaattgataaagcaacatcagagtttgagaggattgtctccaaatttgaaagacattttactgtggataaaatgctataacacagcattgcatgctactgaaaaatctttcctgaaaggaatagtgaatcaatatggtaagctttattgtcttattttaagaaattggcacagctaccccaatcttcagcaaccaccaccctggtcagttagcaaccatcagcactgaggcaagatcctccatcaccaaaaagattaccactctaggctcaaatgatcattagcattttttagcaataaagtatttttaaggtatgaacttttttttagacatagtattattctacacttaatagactccagaatagtgtaaacatagcttttatacgcactgggaaaaaaaatttgtgtggccttccttattgcaatatttgctttattgttgtggtctagaaccaaacctacaatacccctgagatatgcctgtattccgtttagagcagtgtatctgttgtcacatttttgcgcttagactcattttctggaaatatttataattcaaacattcataaaagatgaaattgctaatgatgctgaatagtgctatgttgagcaacaattttactgatcatagattaagctaatatgtttcaatatacttgagtttcaatatatttctctaaaagacttccgcattagttcactggcattgttctgtatttcttctttccttttgctctatctttttctctcagagaattaggaaattgtaatcagcattctgtgaatagagccaatagaagttaaaaagactggggagataagatgtatttatatcttgtactgacaataaatgtcacatcatgatcttatatgaatggtttattgagtatttataatgcatagtgagagaaaaccgtggagttgttcacagatcactggaatccctaaatgttcatttaacctttgacttaagtgtcatggaaacctgtggtcatctttcacccataacatccttggaactgaaaattatgtctggccaggagattttcaattactttattgatcaattcattcaaaaggtgatgagctactcattagggcagtaaaaaaacagaaagaaaaaaactaattagatgacctttggctgcatctaatgatttcagggatatgacaataaaagcaggttataagaagttacctgaattctgcataggtatttaatttggaaaaaaaatcgtttaaaatttaattagtatgctttactctggtaacacagactcactttctcactgcattaaaaaattactcatagtgttttgttcattggccttctctttttgacccataaaaataagtcccatgaaacttttagtttgaatttctatttgcctaattactgacagatgtgccagaattattacaatattctacttcaatattttcttaaaatgttttatttagtattaaaagtaagaatttgatgaaaaaagcagtgaaataaatgattctaatttttgtttgtgaatgataaacagtttttattgtttttcttaggttttatcactgataaaataggtttaggttgactagaatctgcaatgtcttgatatgaaggtaacctgtatcataaattctagcttcaattaaatttggttggctttctcatgataggttctgaaaaggctgcttaactttaatcttttgttccctaaaactatgaactctagtaaatatgatgcaagtaaattggaaagatagtaattttaagctgccatttataaaagctggtgggcaaaggaaatttgaacgttaagcaaactgttttcaattgtatacattgcaatacaaggtgagttttttgagaaacaacagtttatcttcacagttgcttagaaattattagaatccatcattcattttttcttttttgtggaagtctttttcatatatattcttttatatactacatgtattttatatgttacatataaccatacacaataaaaagcatattttggataattaaccaaagtctatgctgtctatgccgaagtttatagaactttctctttagaaagacttccctggacctggacatgtccttttgattatatggtgatcttctaatgaattctaaatgaaatcttacctccggtcaactctatatttttcttaaccatgtaaataatactgtacattttgatgtccttcttaaataatcattaaatacttctaaaagcactgaaatgctactacgatacagttgtattgtactaccgaaatgctactacaaatacagtatttcataaataaaaagcaatactaagctaaacatttagaaattatggaaaatttatccaaatgaacacaacaattgatatacatgtaaacactgattttgcacaagcactgtttttgtcatatgataaatataatctagatgactttcctttgatcaattataagcactaattaaatcaaatcatccaaatgatatgactgtaatttgatgagctcatgtcacaattttggaaggaaattatttataatctaatattttaacatcagcagaaatattttagcctgtataaatacagcacataactggtgccataagggggaaattatgtactatatttatgataaatgcaaaagtgaaaattggctgtactcatatgatacttcacacactttcttaaatatgcatatgagataaaatgaacatttcataggtgactgactgccataagctattcaaattttaattttaatacgactaagcctttttatacaattaagtctttataaaatgtcagaatttatctcaatgccattttaattataggtaatgcagaggaagttattgacaataaatagtatggccttagtatagtatatatgtatgtacatatatagatgatagatatatgatagatttagaatatacatgaccaagaatatacatattgcttagaataagttataagtaatatatattgtgttggggctttaaccttactttcagtgtcaatatatcaagcctactgaactacattgatgttaaaatacctgaaaagagctttattcttcagttttgacagatagacctccacctataattctacaaggcccagccaaccaaacgctggcagtggatggtacagcgttactgaaatgtaaagccactggtgatcctcttcctgtaattagctggttaaaggagggatttacttttccgggtagagatccaagagcaacaattcaagagcaaggcacactgcagattaagaatttacgggtaagtaatattggacttgtacatgaattatcatctacacataagtactgctctatggaaaaattgcatagtgaacttaaaatcttacatcctagtataattgctgcacgtttaaaaacagttaatgttattacttattttaaaaatgatgaaatgaaattagaggaaaggtcacagtttttacgttactcacacattcataacagaatctcgaaacttttattcctgtatcccattccatatgtatacagtcaacaaatctagaaatcttaaacacatagcattaatatgagtagtagggtattggaaatgacaaaaacaacaaatgcttctgatttactttcattcgcaaaagaaattgtaaggaaatgtagataaagtggcttggccaaagagttgagtagaagaaaaataaagagatgagactgagtacataaacggcgagtttgcctggttagtgggaaaccttaggttgtaggttaagttgttgtgtagtttagatttaaacccatggaaagaacaaggcattggtggttttttactgacgtttacatgataaaaaatgagcattcctggcaacttaacaagtcagtcctgcttcaggagcaactcaaaataaaatgtctacttctgaatattgtatcagttatctattattatggaacaatatgaacaaaaatacagtggctaaaagcaacacacatttattacatcacagtttctgtgagttaggagcctaggcatgactgagctgtgtcttttgcttctgggtcttacaaggctccagttaggtgtcatttagagttgccgtctcatctgaagattgacacaggatggatttgcttccaatcaacattattcttggtagcactcagttccttgtggctactggactaacaacctcaccttatcaatggctgttggcaggaggttgcctttggttccttgccatctggatcttccccatatgactacttgcttcctccaagtcagcaaggaagagagtctcctagtaagatgggcactacagtcctgtggaacaaatcacaaacatgacatactgacacttttgcaatattatattggccagaagggaaccaacaggtcccacttacactccaggtgagggattacacaagatacaaataccagaaggatgttatcatggagggcacctgtcctctatcagtacattcaactcattcaactaggtatggtaagtcccttcctcctacctgccatgtagcaagtgctatgtgaaagctggagagtatattttagtaatcacaagattggggatgagacccagaactaaggtagatgatgtaatagtgcatgaagaaaatttcagtggaggagaaatctgtagaatcttgggtccaggttgaaattcagagccaagatgaagaaaaacaaagcaaaacagcatttagaatcttcccattctggagctaaaaagaaaggcaaaaatttttaactacacatatttccaaatgatcacaatttggcatattgttcttttataatgggaatatgtttacaattatatgtttatctgattatcgctatatcatacagacgtatatcagaaaacaaagtgactatttttgctacatgcacacacatgcacacataagtttttactttatatatataatatttatctttaatttttgagatacaggcattaattattgctttaaatagaaaaaatgctgccaagttgagtttaaaaaagtaaattaatacagatattttgagcctgtctttttattgattgtaaattaattgttaaccttctttgaacaaaatggaagttattaaaaaattaatgccaactctctttgtgtaaacactttaacctctatttctgggctaaaggcagacttgggccatagaggttaatgcattttcactgtatcactgaattaaagggtatgcttgagtagtcaagatttctagtagtgtttgaaagaagcaattaaaggtgggtgcttgatgatgtcaaacaaactttgagccctctgacaggcttctgagtagtctctctgagatgccagctccttggggcttgtctgcagccaagtgcacaaggagaaaagtagatgatggaatttgcctgcacattaatctcattttaaagcaatttattaagggtaaaaggacaagcatggaaaagatgagaagcactcctcaccagaaaaagacattatttaaaattaaaggaataaaattaaaggaataaaatgtggtgatgatggtaataccaagagtgagttttagcaacgatatttaggtttatgaggaccccaaaatgaaaacgttgttcttttcctgtaacatgactgtccttacagggagacagaagtgggctttccaatagttcactcatacagtcaagagagtttctgtaggctgtattcctttgtgtctcactatttttttttcagtacttaatgcaagggaaaaaaataatgtgatgaatactgtgttcttctaggccagctaattggtaactgaatctttatcttttgagaagtagaatattccagcactcattaaaatatacctaccgcagctaatgtcatacttgtatctccacacaatgacaaggagatgcagttaagaagcattacctacatacttttcttttagcatttgcaagtaataacaagtgctacattttagttcaacagctataataaaatgcaaattcttttactctttcacagaccatattcaaatgaacatcccattaaaatccaacctcggctcattatatttagtttgtgagtgatgcttcttaaatgcaaagatttctaatgactataatgtgtgcacagccacatttgaaagaatggctctttctacaatggctatccccatcttccctctgtgtaatagaagacaattgtacagagataatatggcaaagaatgtcatgccagagcaatttggaacttaagttaaaatacataatggcatttaaaatcaattaagatagtgaaatggcagtaacatccaggcactaatgatttacctgagaatcaatcgagaaagcttgagtcatcaacacacttatagtttgaacccagcagatataatattccatgagcgactatatttcatcaacaattagactgatgttcatcacagaatattaattctacatcttctgccttgtctgactttgtttggtcatcagtttctcttcccagtgtgacttttcctttactcctaaattgatgagaatgaatgttgtttgcagtgtaagccacaaggcttgatcacacagaattttggagttgcctcttttattgatcttggggctttattcaaaatataatcacagaatcttctgcttcttgcatttgtaaaagaggactcttgattatattatcaactttttctgaaagtcctttgccactcttctgagaataataaaaccattttaagtgatcgatgaaatggcaagtttttattgtgatcaaaaaagagttatgaattatgatatatttatgttccctttcagcttgaaattgcagtcactccatagccacatttttttaatgatactttattctattcatttttccactactgcaatttacatataagtgaatattgaagtttttaaatgaagaagtttaccttaaaaatatttctttttctggctgggcacggtggctcacacttgtaatcccagcactttgggaggctgaggcaggcgggtcacctgaggtcaagagttcgagaccagcctgaccaacatggagaaaccctgtctctactaaaaatacaatgttagtcaggcatggtggcacatgcctgtaatcccagctactcgggagtctgaggcaggagaattgcttgaacctaggaggcagaggttgcagtgagctgagatcgagccattgcactccagcctaggcaacaagagcaaaactctgtctcggggtaaaaaaaaagttctttttcttcttcacttttttccatgtctttcaaaagaaagaaagtgtgatcccttattgtcttattgcttatttactcgggtatgttttattcattgaaacatagtttatttgagacagaacagttttgcattactgcttctctggaattttgtgagattctgaaagagttctgttctgagtcattcataaacaacttagatatagtagagccctgccataaaatggagttaagaggtaagagtattatcacagaggaagaaaaagagaggggcaaattgtttatcagacaaattaacattgaggtgcataaatattattttaaaagccctttggaccaatgttatgaataatattatatgagtttatttcattattttatgtatacatatgattgactctaatgcataatttagacaacaaaatgatacatctaattttaagaaattaaatattgcctggctgtcattgagtaattattctgcaaattgactgaaacaatttaattctctcccttctgtgcacactagatttctgatactggcacttatacttgtgtggctacaagttcaagtggagagacttcctggagtgcagtgctggatgtgacaggtgaggactttgtgaattaggagaaatcttgggccccttttctgatagctcaatatcaaataataagttaaggggggatcaaagtgtttaattcactgaatgtaaattttagcctttacattcaatgccattttttaattcatgcatgaatttgcacacaccattacatttgtggaatttaatacacttgtctttgataaccttattattttatttcctctgaagtgtaaggaattctaatgatcctatgtaaaaacacagcttacttttattaacatgtaggagaagcaaacattcacttacatacttctgattcatggagatgaatttctcactgtctaggtcaggtcctttagtagactgcttccttcttttaggcagtattgtcaacttatgcaatcaggaatgaagttttttctgtctgtcctctatagagtctggagcaacaatcagtaaaaactatgatttaagtgacctgccagggccaccatccaaaccgcaggtcactgatgttactaagaacagtgtcaccttgtcctggcagccaggtacccctggaacccttccagcaagtgcatatatcattgaggctttcaggtatgggacaattccttctttctccactgggttttgtcttagctcctttattctaaaatgtcacctgaactatcctgctgttttattaaagacatgtccaatcaatgcattttaagaattgatctcttctctctgactttattcaagaacagagttaattttttttagtttacaacttaattataagatttaaatatgcattattcatgcctaggtctatggggatccagttcataacataatcacttagctccattctttacccagaccattgtagggatttaaggtgagaatttaggcatctgaactgggtagaaaatattttaattaggcataggcacaggcactttttaaagttatgtgacatttattgaagcagaggactctggcatttatattcctaataattagagcagaacttaaaataatcccaatatttttataccatatattacatacatctattagatatgcctgagagaaaattaacaacaataattaataaatttattccatgtgcttctagttgcttaatggaaaagatgtttccacgtgttatctgaaataattgttgccaatttaaagatttaaatgtaaattagcaaatatcagtataaaattgtcctatgaaaatttgataaaatgcttacacaaatggtaaaatatgctttcatattccctttcaaatgtgcttctacgtgacagtataaattttaatggataaccactgttttttttaaacattaggacaaatgatcactttcttataagcttctctaatcattatttaaggtaatgctaggtacttaattttcaaatttcaaaatactacgtttctatcattcttatgcgtggacagttaagcatatcagaaaaataaactgaccaccctgaaaattacatttgccctttcttctgagcaaaagtggcatttgaccttagacaaactgttctaaaatggcatccatctgtggctggctgtaaatgggtcctcacacacaaattcagagagatttcaccgttctgagatgagaaatcacaatactgtataatgtacaattttattaacaatgtaaccaagggaaaatattcattacctgcttcctctcttcttttacagatatgtagtttagaaggctcagttataatattgcatgtggaaatgatgcaaaagaaaacacaccttgtaacaggaaaatgtattggcataatttactctgtagtccatttattctttctacaggttaattcttttcaaggtatatatatatatacatttacgaggaccatacttattgtataaacttgatgttgtgatcttggcctctgttccttttacaggtattcatttagtgggctgctgtgcattagcaaagggctgtcacatctcctgggctgagtttaattttgttgtgcatggcacttttgttaggtgggctcggctttgttgtggaataaattgaaatcatccaaatgtttcatttattgggctgaatacttcaagtgttgtgtgtgtgtgtgtgtgtgtttaatttccagccattaacctttgtcattgatacccaactccatttccaatcttcaaatgactgttctttaaatgaaatttctgttcgcgtttcagccaatcagtgagcaacagctggcagaccgtggcaaaccatgtaaagaccaccctctatactgtaagaggactgcggcccaatacaatctacttattcatggtcagagcgatcaacccccaaggtctcagtgacccaagtcccatgtcagatcctgtgcgcacacaaggtactttcaacagctgtcaacaagactggttctaggcagaaacatcagatatttaagaacgaggggcttgatgaggaaatatacatgtgcctgcattgctttgtatgatggctcactaggctttatccagggaaggagaaggtagcttgctgtttatcttggtgagatgtgttctctttctggagtttttgggtttattcagcaaaaaataaaaataattgggtacctctacgtcgaatgaattcactaaattagagctttactatatttcaaagggaggaaaatgtttctccttctttaaaattaattacacaataacagaaaagtggtctttaatgagtagatgcccaaatagaggtataaaaattatgtcctattgtttcggaattctgtttttatagtgcagtcgttctcacagtgtggttcctgggtaagcagcatctgcatagcctgcaactgttagaaacacacattttcaggctcaaattcaaacgctctgaggttggggcccagtgtttgttttaacaaaccctccttgtgatgctgatgtataagttttacaaccactgctacagtgaatttcgttaaatcagatgtttaaaggagcaatttattacagacagcaggaaatcaagttttctttctaaagaactcaattctttcgactataatgtaaaatacacacagagtattaaaatataatttcaaaatggaagatttcataattttatccttattacctgtctcttcaaactgagaagtcactggagtctgaggtttaatatacaatgctacattatagtttcccttctgacaagtaggaaaaagaaattaataaaatagaaacggtaattttattatttgttataacctacttcccacagggttcttcagaaagggttaattatttcttatttgtaaaagactttgaacaagatataattcaaagtagtatttttatgcaatgaaaagcaccatacagccataaaatattattataattacaatgtagttcggtgatagtaactagcatgctattataacggagaagggcaccttaaaggaatcgactgaaataaagtcaccacgtgactttgtaacgttgctgacatgatgacagtcaagggaggaggaaatgccattttgctattgttctctaagcagtaatgtgattaattttccatggcgataaagggcctgtaggtaaagaacctgtctcttgagaaagaaaaagcacaacaaggaatttgaaaatctgaaatttgaacctagtcatattttaccttccttaaatctgattgctttttactgtgtttgaattaagtgtgtaaattttattattgaacttaaaatggaaaatgtgtacaattttacgtcaagaaattgtagtaccgtgatcatttatacctttgtgcatagaaatagtttttgtgtgtagccagtgaaacgtagagagagatcagaatgggaagatatttggtgtgattgtatctggcagacctttttgatcattcgataactatgctagtcactaaatcttgactcataaaataactcgcagtgaagaggtcaagaaagattaatgaaaagttgtttgtggtctggtttgttccaatggaaagaatatatagagtgaaagacttctgtgctcttaacaaatacttaataggaaaacccacgtgttgtgtctgaaggtcaggattatttttgggtaccatactttcagcagctttgcaatctgcaaagcatttctttttcaaagaacactttgcactgtgaactcttatttttcaaaggtattaaataacagagaatctagaaatcttttatttcattaaaagtacaaatacttggattatcagcatcaaaacagaacatacatatataggcatagattaatgttattcacataaagggacttttttcaaattaagtaaaacttcattttactgtttatgttaaaaatgaaaaaaaaaaagtagaactggaaaaacattacctaagtattagtctcaattatttacgacccaatttaagttagtgctcccaatttaagtaatagctgagaaatgttcttaaaaatactttcgcgagagtgctgcatgcattgtagcctgagataataagaaaaaacaggattacgaaaataaataactttaaattggacttcctttcttaaatacaatagttggagaaaaacaattcaacaacattgtgtgccagcttaaaaagttaatctgagtatgtgtaaaattcaatgtttaatatcaatttgatggacttagctgcttacgatttatcattttttcttaatggacacagcctataatttatccttttttcttaatggaccgagaatataaaccatcatatggagaaatagaatagtacttaggagactgatgaataatgtggcataacaatgtgtgactgagggtataatattttaaacatgacctttctttcttcccttctccccaccactattcctaaacatgtctgcatgacctcgtgtcaggtattagagtactgctcaaaatgtattactttagaacatgttatcagtattataactatttctgtcaaaagtatctttgcaaatttgaggagctgtttcccctcttcccccaactctatttacctttaatgacagaattcactttcctagtccaccattacttctccatccatgctcccagactgaagtaggtcaagaagaaaacacaacctgcaaattgggacaagggattaacaggtcccttagcatcagtttttagatatatcccaatttacacatccagaaaatcattcaatacaccaacatctgtacaaagctgctctttctagagatctttctagacttctgtagagaagtcttacagcacatactttatcctttagtaataaagtaagtgatcttatacaacagtgtgtctgcatttgaatgcggatgagggattacaaatactcttctattagtatatttttaataaagatcaatatcatctttcattatgtcctaccacagtggtatatttatatatataggcttaaatgctttttgtcacaagagagttttcgttttgtttccctgtaattagttctaaagacatgaggttgatttacataaaataaattgtaattttaatatgaatttttaaaggtgggaatgattctcttctctaactgcagatatcagcccaccagcacaaggagtggaccacaggcaagtgcagaaagagctaggagatgtccttgtccgtcttcataatccagttgtgctgactcccaccacggttcaggtcacatggacggtaagctttcaaaggcaatgttaatagtaatctcttctctttcgggaaagcaaaacatggaaaatgcaaatgaacaaagagtgataataaaaattcccgccatttaaaatcaaggtgtaatcaatgatagtaaagaaaatcaacaaattaaaaagttactagaataaccatagtaagaatagattattatataaacatggcatatcctgtcttctgaattttctaacagctttcttgcgatataattagcataccataaagtgaacaacttcatgatttttagtgtatttagagtttctaaattatcaccaaaatctaattttagaacatttcatcatccccaaatgaaatcctgtgcctgttaacattgattctctcatttcccctaccgtagccctgtgtaacactaatctactctatgtttttgtagatttgcctattctggaccttttatatgagtacaattgtgcaatatgtggtcttttgtgtctagcttctttcactctgcataatgtttttgaggttcatccatgtggtagcgcgtatcagggctttgtttcttgttgttatcaaatagtattccattttatggatacttcacattctgtttattccttcttcagttgatggatgttcgggttgtttccagttttgtctattatgaataatgctgccatgaacatttgagtacaagtctttgggtggacacatgttttcatttatcttggtataaacctacaaattgttcagtaatattggtaactctccatttaatattttgataaactgccaaaatgctttccaaagtggctatagcattttctattctcactagcaatgtttcagtgttccagattctctcaaatccttgccatttttttctcacatccttgccaacacttattatcatctgccatttggattatacccgttctggtgagtgtgtagtggtatataattgtggttttgatttgcatttctttaatgactaatcatattcatcttctcatgtcctaattgaactttttttttagagaaatgtctattcaaactcttggtccatttttggacaaagagtttgtcttcttattgacttaacaagtgtttatatactctattttgtttgtcttcttattatagacttataagtgtctatatagtctagatacaaatgccttatcagatacgtaatttgcaaacattttctcccagtttggttactgtaaccctgttatgtatttaaagttgagtggcatgaagcctccttcttccttcttttttgcttaggattgccttagctattcaggctttttttgttattgttccatgttgttactccttaaagcaaactacataatcagtcaaattattggtttatgagtacaaaattgggttgtatatattttaaaaataagactaagtttataatattttaagagtaattatgattatttaggattacactttcttattccagttttgacataattttgcatagatttattctattttctgcatatattggtttctattcttctgttcccatgaagggaacacaattacgttattatttttacagtggcacagtagggggtattatctgccatgccttttctatctttcagtacccttgagtagatacaaaactaacaaagccaaaatactacgctgtatttttcacagcgtagtagttttcctcattctcaattgaaaaaagtctctgttctgttgcaagttataaggcggattcttttaagctgcatctaaatgtgggaagtctttgggtaagaatcaaagtcattatgttgatgaagttaatcactttaaagtcacttagtttcaagagtaaatagcattagatcaaaattgcatgacagcagactgggagttcttccaggagggggacgttgtctattcatctctgtaccccaagaagctatcattactagtttgcacatctatccccgtcatgggctgtaacttctgtgaggctacagccaatttctttcatttctgtttttttcagagcagagtgtctattatgaagtactctttttaataactgtttgttgaatgatcaaatcagttgttttcatacattttacactttttttaatagaagaaagaattcagttaatatcacggcatattgttctctatgactttgtagttgcacatgacataagtatgcatttgaaagagataaattaagtgaaataaagtcagactggggtgtgtccagtggtcaaataatttgtgtaactcttttattgatgtaatatttttgatttactaaatgcatgtgttatttaaattatcaaaatgttagcatttgctttacagaagtgttggggttgaagggagaaataattccccaccatgtgattaggttttgggccagctgaggaagtttcccagtggttggcaggattaatgaccaaaggcacaagacataactactgtagagaccattcgctgtcccccttctcaccaggctaaacttgaaacaatagttagcaacaactgctttctaaaatggctgcttttagaatgagtgtgggcaaaaatgataagaaacctgctgttccacaaagaaaaatagcaataagtcacttaccgaaaaatgattattctagctttactttttgtctttgttttgttcaaggacaaaaagaattacatactctttgcccattaagcatttttccacagagattgaaaagagtgcttcgacaaactagaatttcagaagtctgctaaaaccagatcagacccttagcagctaaacccatcaaagaaaattcactttgaatttttgctttatattgagttgttatgttgttttgttttgaaaatggaaaaggtaaatatgaagcatcacacttaaacagtttaactagaatgctgattttagggccacatataagccgtcttcttttttagcctgttgcttccttaacaattatgttttatcattgtgcatctctaaagccagcaaaatgctttcacttatatcagtcacttgattgtttctgtgcccttgagatatgggtattatgtgagcaaattaagtaaactgaggttcagaaagtttaagaggttgaagcctaattcaaattgagacctatggctggaagcctgaagttctcgtaatcattttatttttccttaagacaactctttttttattcatgtttcagaaaatactattttaaaaaaatatataaacccatgaatctgtggtcagactctgattgtaatcaactctaaaagaaaatcctctttcttagaatgttaataaaactcgtaacaaacatatggcctaacttgaaaatgaccacctgtcaaaatgagctccaaaatttagtgaggtagaacacacatccagtaaaaatctcacctattttttttaaagtaaatgttcagtgttttcatttctgcttccacctgtaacaacaaatttcgtcctgaaaaaaaaaaatgcattgccactgcacacaatcaagttaaactatttaattattaagccccatacgatatactggccgatgatagtgtacactgaagtgtgcaagtgtgcaaaacaatgttttgtggtaaacattagcttcataaagtccctaaaacacttaattaatgaaaaccaaacatggataaaaccaatttaccctgatttacagactcccttcatctggaaacagctgcttaatgttcttcttaaaaacacagcttgcttctttcagtattaacaagctattattgtgagttatgtctttctttcagtatataaattcacttaaagcaaatgcagagaagtttataaaatgcaaacttagtgttgttttaacatatactgcaagggtttttttgaacactgacagttttgatgaaagtcatctctctttggctctcataaatttaacttttcgcctcttggttgccttatttcatagtgtcagaaaaactcctgcttttcaaagaatgtatccaatggtagaaacataaactggtagcatgaatgaggacttgccgatcaccagcttccatgttacacctgggctcactttttttttttacctgacctcatacaagtgtagcactaatttcagaaagtctttgagggtgagaaagctttcaggtgggtgaaggaattcattcttgttgagacttatctgggaaactggaattagccgtacatagaaacacacacacacacacacacacacacacacactcacttaattgagggagttttctcgtttggacattctaagtatttccttttgttccactgtatttttattgaggctctgcatttttaactttctaaagccaatatttttagctaacattcatttgttgcccccaattaaaaataaataaaacaatactgcaactaaagaagggatattagtagttaatacatgaaagaatacgttttgtttataaactgccgacaaatttcaacatttcaacaaaagttgaaacaaatttcaaatgctgaacaaatttcaaatttcttggataaagaaatttgtttaaagctgaaattaataaccgtctccataattctcttttttatttcctctttctctacaaacttcctgaaatgaggttattccatttcttttccattaatctttacactttatttgatagtgaagtatgtcaaatttaagccttgttagactatagctattaaactatgataagggatattagttggaacatgctatcatagtttgtgtttaaatcaagtgtttctaaaaacatgacaaagtattaaaagatgcttaatttttaaaaataatttttaaaatccatagttgttttctccctgaaaatgaaacaaccataaaaccctggtaaatattttaaaataaatgtatacagagaagaatatatttcattttttaatcttgcatttttatatatttcatttttaggtgattgtcaatagcaaacaaaaacactttttaaaagttctatttggtatgagtttaatcttagattattatttaaaatagcttcttactgtatcttaaataaatgaagatatcaaaaagttgtcaaattttgtcaagaatgggacaattgaagagtcagaagttggtaaattagtaaaagtttttcatttaatatttggtaatgggcataaacgttcatatgcttttaaaacaaatgctctagctctacaactttaatctgtattatatgctttttccagccacagggactttatacatgatgtcctcacatttgttttcctgggtaaatcctgctcttcttgcctatctaagcacttacgaattcttcagggatgctttgcctctgcttcccaactcagtcacctttctctccactataggctttcttagctcttggcacctctcattcttaacatttgtttatgcttttttttttatgattgtaacttgaccatggttcagtcattattagaccactcctaccttctacctggactccatcttctcacctcagctcatgagggcaggggctgactctattttcattgtccattttatccccagagctcagcagaatttctggcacctatgagtaggaacccaaaacatgtgttttgattgagtgatgatgttagtgaatagacaaagaatgagaatggaaatccctgacaaagggcatattacatataaagccacataaaagggaattgttggatgcagaaaatgggtaagcagaggagacataaagttagagatactggcaggtctggcctttgagaggcccttgtgctaatccaaggcatcttaattaattaggttggtatcttagatactgtgaggtattttaaacaggagagagagttctcccaatcttcattttggaaacaatcttaggagcaatctgaactctaaaaggatagaagttattagaagcagagagattagctagaaagtcatgacatcactcagttgatagttatgaggacagaaatgggacaaatgaaaagaggacaaattcattgtgttgtctaaaatactttcctttagtttcaaatgcccttaactatgtttttcaggttgatcgccaaccccagtttatccaaggctaccgagtgatgtatcgtcagacttcaggtctgcaggcgacatcttcgtggcagaatttagatgccaaagtcccgactgaacgaagtgctgtcttagtcaacctgaaaaagggggtgacttatgaaattaaagtacggccatattttaatgagttccaaggaatggatagtgaatctaaaacggttcgtactactgaagaaggtcagtattcagatttcgaatataaatcaaacatgatgaaaccaatttctgttacagtacctatttgttatcttccttagaagaatggaaagatatcacctaaaagtaaattgaggaagtgtcgttttctccttttattctgagaattctatagaatctgacaagcagaaaaaaggacactaatgtaatttgaatttttcttaagtaaccatttgcaccaaatcttatgtttaagttcacttgaattggattattaaatattcccctatattttgtgtagatttagttcatttggatcatgaaagacagacgactggaaatttgagaacacaggctgttcattgtgactactcttcttttgttatagttaagtgtgacattttcttttattagccactttttcctatgggcactgccagtcaaacccatgatttctaatcaggaagggcacttgcgtatttgcagtagctttcttcttagtgaagttccctcgttctccccactttggaccttttcttacctaaaggtatgttaaagtcaatctgtgatgaacacaagctttccaccagttcatttagtagtatctctttcactaaacaagaggcttataataaatgttgtcattaaagttaaaaaaaaggagatgcgaaatgaaataaatccctccattctgcttttgtattaattttgtgctcacaactcttgtaaaaagccctttctttaaacatatttcatacaaaataagagaagcctttaaaaaatgtatataggttgcccacgttaacatctatgtgcttgaccaaagagctcttaaattatacatttcttacacaacatggcaaaaatgtcatcttcccattgttttgcagtgtgatacactggcaggggcaaaaatgcatattcaaaaaggcatcattaatctatttttaggatatgttgaaaagttgccagtaattataatagtatcttttctccttgccaacatgtttaaaaataataatcattatcatcatatctttattcatcgttaaatttcactctgtgttgcaaattggtagtattaatgagtggagcaggtaaccttaacacagaatgctctctttgaagcctgttaccaaaatcaatttcactgcagttagacttttcctctggattagacatttgtccctgttgggtatacattcatctccaatttctgtggctatgtgatggtaacaaatggaactcagctgggctgtgtctgggaatgatgagcggcgatttgggttctttcacatctgtagaacgaagctgagtcctggaataattgacctgtcaggaagcaggcacggtgttctcgccgagccagcagcaaggtgaatgagaaacccattctgaaagtcttatttttcaatgcattctacttaataactacaaggctcgtagacaagtggttggatttattcatcatgccatattttggagcaatattgtcacaaagaggaataggaaagaccagtactctattaacatgttgctgtgtgtgtcctatatctcaatgcaaatatggctatacctaagtgaaatatgtcatgacatatttacaaaacatgggatatctgctgtcaggcttttaaaatatattttaggatatttaggatagtttcaaaaaactaaaccatgtagagctatgtaagcattgatgattctacataaaaagccattaataccaccaaattatttgatattttaaactgttaagaacgatgttatgtaatactatgattttaactacccccacctttgattttaattcagagaatcactgagaatagatgaatttttccacaaagttattatttcttagttctcaggcacattaaatgagagatgtggcattctaaaatcaggaagagcttctctcttgccttttctcagtatggttgtaattagttataggagaaactataaaggcagagaattattgtaggaaatcaaaatcttcccatttcacatttgacccaacatgaactgttttcatttttatcatcagagtcccttgcccatccatataatataagttttcaatcttaacttgcgggtcaatttatagcagtcaattatttttcccagtatgggaagaaaaagaagttttttctgtgttgatgacatttatagttatgtttctgtttttatttagtaagcacaagctaaaagcataccaaaatagctatcaataatgccaccgttcagaaataacatgtgataaatactggaatatgtcttctcagaataattttggttagaagaagttatggttgtttttagaaagacagtctattagagtagagttctaaaatcagacatacaccggctcaaattctgacttgctctttgactttcctaagtctcttacagtaaccttctgtttcctcatctgtaaaaccgagataagagttgtttctacctcctgagattaatgcaagcattaaacctgacacttagctctgtgcggggtgtatagaaaacacttattagaatgttagctgtaaatttattattgagagcatattacaaaagctgttccatttgctttaaatctagatattgtatttaaagaacatttctcaaaaaaactgtcactgttgaacaccgtgtgcattcagaactcctggaagccagagtctcctgcaacttgtctttatactcatattctgaaagtagcatgaacgcacaccaaggcttatagtttgcatttattctaattacttcctctacagccccaagtgccccaccacagtctgtcactgtactgacagttggaagctacaatagcacaagtattagtgtttcctgggatcctcctcctccagatcaccagaatggaattatccaagaatacaaggtaggacccgggtgaagaaggacagctctcatgtaaaggttcccagagaaatctcagtgtctcacgaatgagacacatctctaaaggttctcttattcagtttaagtgtaaagtttttatttatatttctgtgtgacagagaatgaaacaaatgcataggtattagaacctgagttcaaggtcagagatcacacaaacccagttgaacaattaaaccacaccagtgaaatggttttctgtatagtgtgactctacaacctcaaggatttaaagagatgggacacagggtaggttgtgaagcctagaaaatggattttatctttgttattagaattctgcataagaggctttaaggcagctgtttttaaaccacgttctcagaaaaaaagatgcttcgggggttaaagaggtggagtgggttgtggcagcaccgactctcactctagatgctacttttgtgtatttattgaggttgtgtagaatatttcacctgaaaaaaagccactgaacatattttacaaaatactgacttacagaaaaaacagttgattgtctcatttttcaactgatgaatttttggctgtttagaaacatatgtatctattgtttcattgccatcatttggtgtgtaaagtagaaagtatgtctacgttttcaaaataagattctgtttgtgttgtgattagaccacatgtgaatgaaaaacccctcattaatctttgtaaaattcaaaactataatttattaataaatcatctattgatatcatttattaataaatatttctagatttctgaaaatagcatattctatacatctaatataatacaaaactagacacccatttcacctacaaaattcagagttggtatttaatattaagctgaataaatttactcaaaagtttgcagattaaattttatttctaaggaaatattaatttttacatacaattttattaaagaataacttgctaaagcaaatgaatggactaaatgtataaggctttattttaaaatgatttctatcatgttgtaaagacacatgcttaagaaacataagaataaatgcttttacaatacaataattatatagattctaagattttataagcattaggacattgttttaacagagtaacaaattatctactctgtgtgagtttgagtgtgtgtgtgtgttttaatgaggttaggaatttatttttgtaccatttggcactaaatatcctaaatttccatgtagttaaatattgttacttttttttacaacatgatgaattttttttccataagttgtaaatgttctcactctctaggcacttgccatattttggtttcaaagcacatatgtaggtaagagctaaatattccttcactaagaacacagataccatatatcaataaaagaaacacatgattcacaagaattattttttactgaaaaattctgggaacttacctgctccgaaacaaatcatatgttttcctacatatgtgtctacatgtagatttttaaatattgtataatatgaatacaaatgtggatacacagtggatttcttttcataacacatttcatcagaacaatttctatatccaagaagatgccctaaaatttgattcctacttgaaataaaagcctgacttccttaacatcaatatctaaagacttgccaccactttgttctcatgaatgtgtatgtgtgtgtagatatgtgttgatcaatattagatttattgctgtcaacgtaaatattggctttaatttcattttagtcaatacctataacttaggtcaattcatcttgttaactacttctgtgtaagttaatattttcttaaatgaaatataaattacttagatgtctacctatataccttagatattacaacttataatcaccatattttagtggattatatgcataataaatcttgataaataaaacagaggaaattatgtgttttaatccatacaaaaatgccatttgcaaccaaagaccacataccagaggtgttaaagaaatcactgtgctttctaaattactcactatgagcatgcagtgctgagaataagatataaatgaacatggcatagtttcagcttcccttattgttcttcctttaatacaggtgcatgtgcacacaaacacacttacatatacactcaaactgcagaggttgggctttagaagatgtcatttgcaaaacttctataagcctagaagatagacaggttatgattaaaaaatatttgatcagttacagtagtctcgttaccagaaacgataatcttatatccatgtgttattcactttccatttctgtagatctggtgtctaggaaatgaaacgcgattccatatcaacaaaactgtggatgcagccattcggtccgtaataattggtggattattcccaggtattcaataccgggtagaggttgcagctagtaccagtgcaggggttggagtaaagagtgagccacagccaataataatcggtgagtatcaaactatgtggtctgtgctttagaatcagtcagctgacaaggtggatgatgattttgcatcaacctactaatagtgaatatacacttatgaatgatagggtacacatatcatattgacaaatgggttaactgactagagttttttacaaaaatacttggtgcaattgatcatgctcttaaaagtcccagagccttattaaaattgcaatatttaagagtttaaatgctgaaaggtagtttaaaattacttttaatcaattgcctcattagcaattttggtgccattgaaatataataaaaatgagatagttactgaagagagaccatcatgtttcaaatctgtatgcttcctcttagtcagagaaatgtcaaaaattaacaagaaacaggtcagaataagctttgtaatctaaatataccatcccaaagaagaaatcatattaaatctaatatcatcattgcataaaattgttccctcttatcatagattatgtttgtctgttcttgagatgtatataaatggaatcatacagaatgtgattttttaaatctggtttctttcactaaggataatgtttttgaaattcatccatgtatgtattattcagtttatatgttttactgctgagcagtattcaattgtatgaatatgccatattttgtttatctgcttttcacctgacagaatgaatattactgtgtaaatgtttgtgtccttttggagaaatacctagggtctaatgtctgggtaaaagagttgtatagtttgagtttatgagaaactgctaaacaatattcaaattgttatataatttcgtactcccaccagcaagaaaaatgacttctagttgccctacattgtcaccaacatttgatgtttccagtttttgtgattttagccattctaattgggataacctgtgattttaacttaaattttcttttatgactaataatgtcaagcaactttacatgtgcttattggccattcacataatttcttttgtgaattgaccacatgtttgccttttaaaaattgggttgtctcttgttactgattagtaggagttatttgtacattctggatacaaattcttttccatgtatatgtgttacaaatattttctcccagtccatgacttccctattcattttcttaatagtgtcatttgatgaacaaaagtattacattttaatgaagtacaatttatcatttttctttgatatttagtgcttcctaagaaattgtggcttacctctagatactgaggatattttcttctagaagctttataattttagcttttatgcggaggtctataattcatctgatggtaactgcaatgtggttaaaggaatgaggcttatttatttccatatgtttttctttcatagaggttatttataagtgtattatttaatttccaaatgtttagggacttttccagatatctttttgtttctgatttctactttaattcccctgaggccagagcctcagaataatttttctttgtgtaaatttactctattaaatatggagacttattttttgacacaggatttgatctcattgaatgtttcttgtacacttgaaaagtatttgcatttctctgttttttcagtggaaggttttatctcaggtcaaattatttgttagtattatcaggtctttattgatttctatttgcgctcttaattactaaaaacagtctggaaatctattgtaattatggatttatgtatttccccctttcatctataagtttgtgtttcatgttttggctactttgttttacatgagtatgttttaagattattatatcttctttttaaatttaccctttattattattaaatggctacgtttattttctggtgagattccctatcctaaaatttactttgtctgatattagcatagctacatcatcttttgtaagtaactgcatggattgtcattttttcattctttcattttaacccatgtttctctgtatttaatgtgcagttctattaaattgcatattgttaggtgatctctgctcactgcaaactctgtctccaaggttcaagagattctcctgcctcagcctcctgagtagctggaactacaggcacatgccaccacacccggctaacttttgtatctttgtagagacagggtttcaccatgttggccaggctgctctcgaattcctggcctcatgtgatcctcacaccttggcctcccaggcatgagccacctctcctagccagtcttgtttttttttaatccaatctagcaatctttgcctttttaattgcatactcagaatgttattattaatgtaatcattggtgtgtttgtttagaattactatcttgctatttgtttgctaactttgttactatcttccaaatttcctgctttcttttgataaaatgagaaagggttagtattttttggctgctcttggattattaggtacacctcatttctttgctgacagttgctctaggatttgactataagtatcctagagcagtatagtgtcactccttttcctctcatcttttttttgttgttgttattattataccttttacttctatgtaataaacagcaatatacaaattatagctctagtgttgtttttgccttaaacatcagttatcttgcaaataaattcaaaataaaaagtgcagttctcatatttatctgatattctgctccataaattcagtccctggtcaggcgcagtggctcacgtctgtaatcctagcactttgaggggctgaggctggctgattacctgagctcaggagttcgagaccagctgggcaacatggtgaaaccccatctctagtaaaatacaaaagaaattagccgggcgtggtggcgtgcacctgtagtcccagctactcgggaggctgaggcagtaaaattgcttgaacttgggaggcggaggttgcagtgagctgagatcgtgccaccacactccagcactccagtctgggtcactgagcgagactctgtctctccaaaaaaaaaaaaaaaaaaaaaaggaaaaaacattttcagtcccctcagcttccatgagtgcttcagtcttttcaactcagggatgctgttcagcaatgtttgggttagtcttggctgcatcatattttaaagttatctgtaggtacaaagctgtgaaaatattaaagttgtccctgtttctttcccttctgtctgagatcacagccctactcttttctttcacatattttgcctagtcttctacttgtttgcaatgggagtgcatatcccaatacctgttatttcttcatgggcagaagtggaagtgtccagggaactggtcatttcatatattacactttcctgttctataacttccatttgctttcttttacacttttcatttccctctgatgttttccatgtaatcatttattatgaccatattaagtccatacacctattgtaatagctgcttcaagttcttttctccttatttcaacatccatcttgtctcatagtctacttctattgattatcttttctgctgaccttgggttatatttttctggtttgttgcttatttattttcacatgcctagtaattttttactatactgaacattgcagatgaaataaaattttgtgatcttttgaagcatgtttgtgtcctagcaggcacatacattactgtctggtcacctttaaccagtgatgtcttagtttttacattggttagtatgggacttcttatgtttgcccttattctcaagacaaaacctcagtaaaatactttcaaggcatgatcctctcctgggcttccggtgagaagcctcatatgtttatctggtcttcctaacatggtttggaagttttgcggtgaacatgagcttaaacctgtgctttcaccagatcctacaatcttctctttgcatgcacagttcagggttcacctttggatgtaaggggagagtatacacaaatttgagagcatcactctccaccatctccctctttcatatggttctcctctctattttaagtcactctggcctccctgaactccaccctgagacacctcatatcaataagattgagttttttcagctgaggtcctaactgcctcacactgtatggattgcggtgctccctaagggaaagaaagcctcacccctgcagatttcctctggtaaagcgccgttcattcaatacatgcatccccttcagttttccctgcttttatttgcttgccagtgcctttaaagaaaaataaacaaataagaaatcttcttcctagagtttacatgtttttaaagtgtttgatataagccgttctcatttttttctatttatttgctaaaatgatgcatataaagctgactgccagcttctagagaattctttctattacaaataagtattgtatatggacagatttaacattcagtcatagcgttaaaattttttagattctctaggttttctttcttttatatattaaaagcattgtagagaaaaagttacagtattaacttttctttaaattgtcttctctttcttaattagtcattcagactgaattaattccttaacctgagggaaacctacaatcttgtccttctgagattttctaaaataaattggaataagaaagaaatacaggtataccaaaaaggatttaacttacatgtgtgtgtattcatttatagtatttagaaataagcccttattttttcacttaagaagttatatatatatgtatgtgtgtgtgtgtgtgtgtatacacacatacatatatatacatatatatatatacacacacacatatatatacacacatatatatatatatactatatactggcatatatatgccagaaagacagtacaaaatatctatatctgtatatctttatgaaatggattggctgaatataattgttctaagtgaaggataactaagattgtcaagtaactgtcaaataacgtattttcctttcatagttttttttggttatctttagtaataaatactaaattcttaagtagagctttctgtttctttttcttcctagtgactatctgtttgccagatattttatctgtttgccagatatttgggggatttatttccttatagggaagtaaaaaattacaagcatacgatataaccaagctcatgtcatgacaatcacagttatgcactgaacaattgaactgtaacttaaaataataaagttaatgattattttaaaccaaatagaaaatttcacttaatttccctatcatttataaaagtctgagtcttcagatgggtaatgagtaccttttaatttactatttagcatttcatacaagtgttttcacatttttctatgagataaaagtaacctagaaaataatatatctatcttttgttcaaatagttggaatatgctgtactcaaaatgtaattataaaaatagaattacagaaattctattttttgtgtacacacacacacacaaatcacaattcaacctagaaaaggctatttgttcttcagagatttatttctttttaatatctactcttgtactgagaagccttctaattgtttctttaattactccttcgtatctaccttaacatcttgtctgatgcccttatctacacaactgttattccttagttgagaagtgatttagtgatggctaatcttcttttctgtttcaatttacactttcccattgtctattcagaactggaaacggcacttgaagtgactcaaactgtatcacatttcccctttgttttaattaaatcatgtattggcatttgatgtaatttatggttgagaattttagatttgtactatgccagaccatgtattgtttcatctattccttctcagtttagccttccttccagaaagttccattaaggaaccattaattaaaacattgtaaaaatgtaacacgctgccttacactggcgtaacattggtgttgttcttttctgtgcagtttcctatggtaagatgacttttacatcatagtgtccataattctgcatcattgcatttacagacacaaaaatgcaatcaaatacattcagatatatatccattaagcagcgtgtcatataaccaatttacattgacttaagagttttagttatcttgcttaatagtatagttattgcttctctaatcatttggcttttcacgcttacattacatagttggttataatatgtggaacagctgcaaactttcacggtaataggtacaatcgaatctgatgtgtctaattaatttttagtccaacaaattagttttgttcttcattactctccaatgggatgaagacattatatttcattatatttttttgtctgcaagaacaatggagcattacaggtcacacacatcccttgtctatgctctaattagtccaactgacaacattgtttcaaaaataccagcagcataaaaaatagcaatacaccttgagtaacataaatattgcaccttaataaaaatgaaatattatggatcctttacaaaaatgaaggccaaattttcttttctctttgttcaagaagttatttgttttctttctgataattcctaatagttaaggaaatcaccagataggtgtatgtctcatattgaaaatatgagctcattttaaatacagctttgactatgtttaataattatatgtataataatatataatattaaacatataataaatatatgtataataattaaaggcagacatagtgggaaaatgagccagatttactacataaatgacgctggtttttaaatctgaaatttaatacaaaagacctttcaggaatggattataagtatgtataaggaaatgctagcagctataataaaaaagcctgaattttgaaaagattaacaaaataaaattttatttctaattcacagctcagaccaatatgggtcagcagaatgggaaatggagtttctactccataccgttattcaggggttttggatctttcaaatcatagctctgccatttcttggaagcttaacatcctccaacagatcccctgtttctgtccaacagtgaggaaagagagtttcaagtcaaggcagtgttacggatcaggcctggagggtcgtgtgcactttttgttcctagttaccactggctaatgctcagttacttttttgaactctgctgcaaaagatgctaggaagtgtaggctaattttctgccttggaagaaaggagaagcagtgaggtaaacaagtgaattgagatttgcaggattctcaaatctagataatttatcactcatgacactgaggttgactgagaagcccttaaagcagcccttaaacttacatgggtcataattttgagtcaaaaactacatattagcctccacttcaaccctcccaaaatatatgaagtagacaatactggtgccaactaattgacaggggctctagaagatttagtgccctatataagcttactgcttacttagctagtaagtggcagagtggtttcatcaaaatcatgacttcaaagatcatgatctttttaacatattacagtgctatagctaaaacaaggaaaatcccacacattcctttgatgtgatatgctgaaatgtgccatttatattttgcttaccatttaccttttaaaagtctttcattaatcactaattaggcatgatattaacattagaaatcacttaattcccagcatctacatttcttaatctgctaaataagccaataaatcttatgattccacaagtttaagacctatttaaaatgtagattgagattttcttaattatctgagaggcctaaattttccaaacatgactagttctagaataatcttagttcagatttaaatgcatttctcagtaatggagacctcaaagttaatttttaagttgttctttaaatttagctttcaaatggattttcaaattagtttcagatactttaagggaatatatgagtttcatctttttcatattttaattatacacgctgatctctgtgaaggctgtttacataattgtcattgttttgtatagtagttttaatacttcccagaaaattaaaggatattggctcaaaataagttctttggtagaatattaaggtcaacattaagttacatgttcttgtgaattatgaacatttggaatatggaccgtgccttagcagaaaagcaatttgcaaataccccatgttaaaagttgtaattgctttcttaaaaatgagaactgtatttaaaaacacttgatgtaattcaagataagttattaattcaactcctagtacttatttttataatttataaggtgataaatcaactacgttgtgaatccatccatagcaaaccacaacacaagaggtcagtgttcttaatcacatttgcaaactcacgatttgattattcttttgaaaattatgggctatgcttatcaatacttgtgataggctcaaaactaaacaagcatttcctgccttcaaataatttttcttcatttttgatgcaccatgtttatattcctgtgcttattttcgttttaatatatactaatactatggttttttccatagggagacgcaatgaagttgtcattactgaaaacaataacagcataactgagcaaatcactgatgtggtgaagcaaccagcctttatagctggtattggtggtgcctgctgggtaattctgatgggttttagcatatggttgtattggcgaagaaagaagaggaagggactcagtaattatgctggtaagtgactatttccagctaagaaaatctcttgtctgtaggaatgtaatgaaatgaatggaaggaacagaaaggaataacaaatgagtgatttgggcttattttagaaacctgcactgtaaaatgcaattacactcaacatgctttaatgcattgctcttgacctatcgctttataaccataaggcagtctgtttgcttgtagctccagtgaagcataacaagagcacagactgataaaaatgcttaactgtttttctcaactagttctttgaaatcataaactcaaacacacacacacacacacatgcacacgcagactatgtgttacatgctatgaagccatgtttgagaagtggatttatgcatgagcattacttcaatgttcaggaaagaagaaaagtttgaaatatagcttttagtgtgtcaggatgcagattacaataggaaatgtccctcgtgaaaaatactgacaagcaaaaatctcaccagaattgataagactgatgaggcatgaattaagtgatttactgttcacttaaatagactcttattacaatgcaaatgaacagtattttaaaagaaaaggaaaacgaagaaaaagagaaagaagccgaagcagaacaataaaaagaagaccctagatggtctacatcttcacaacaatgttttcttcttagactccaagacagagtttcaagggtgtcctataatgtggccttcaaaatatctccatggtagagagagaagagagagaggacacacaaaattgtaaagtcagtgattgagagaatgaactcaatactgaagcaatgttcaattacaattttaagtgcactttattttaaatattttctccaacaacaatgataagaaatatctcacaacatttcacactttctagaattaataagggagcagttttaatttgacattattttacaaatatgtaagaagtttttgagacattatattcaatcttgtattcctaatattaaatttggtaggaagcataaatgtcttagtaactgattttgacagaggcgtcattgattattaagcttttacgatgctgtggcttgtaggctcctaaactgctgagaatgtggaaatagtgcaaaatgctaagtatagcactgacttggttgccttgtttgttatttgatgcatttatatgtttatgatcatttgattatagcattgtagcttgtgtctatatcttatgaagttaaaatttattagttacttgttagaagacatttccaggactagagaaagtactacagcatatccattgacaagaggcttccatgtttggtgacatgccatcattttgccattctcatttctcattggttgctgcctctctgcttcctcataatttgtcacccaagtgctatatcacttcaacagtgaaggattctttgcagaaaggggtgctaggcagtaactgagtgtcagagtctggaaaattaatgatactttaatgtaccttcttgttatgcagtccggttctctgccttcatcgctgaaggtattgcccatcaacctttctgtttaatcagccaccatgtcatattacatctctgtgatacactcgtataaatcatatgaaatataaggaagaactgatttaattcatggactattttgtgtttatccctttgcttgatgttagcaatgataataaaaaattgactgtgctggtcagttcggtgcaaagttctaatatattcacatttggagtgttgcatttttatcttccatacttcttcattcactcactccttataaataaaatatctctcatagttggtaagtttatactgttagtaaaattacaccagagagacttttcttcttttttttaacagcaattctttgcacaacctatgcacttaaattgaaaatatatgttgatcattgagcttgacaagaatagtgcatttcctgttacaattttttattgttattgctactcatctgcttgtagacgaactgctaactcagaaggtgctatgcccttcaggtgttttggagtaaggccaagccagagagaagcctttcagaagttttttacttaactgatagatggctcactatgaagataacagattttatgaagctcagtaaatataaacaatttaatatgagtgagcaaattatgtgaaatgctaaacacttcacacataggtcttaaaatcatcagtgaaatatacattattagacaaaaccatccaaggcacttaaaagatttgatggattttttatactctgattatctgggctgagttagtgcttattaaaaaaggattaatctgcattcatatttgagaaacagcttatcgggaaagggaatgaggcttgcctgcaacagtaaagtttctatttggagtaggaaaatgtgacctactaaagataggcactctgaaagcttcctcactcaaaatgtcaatttgccacagttatgttttctcctcctctaccccagttgtagcaggcatgagattaggattcatcctgtgaggtaatattagagttactttttgtatgttataatcttgcgaaatctctttaccttatatttgtgtaaaaattgcaagaaattcaaaatatttcatgcaattcaaaaacattttaaattgtggtgtctgcagaactttttggaaaccttagccctattcagttagtgtaagctaaaatattctgtatgtaactccttgaaagttcttaattttagatgctaacagagacttttgattgagagtcacagttattccatatgtatctctaataagcacaaagttactactctgtgattatcaaaattgtgacaagagcaagattgtctgaccaccccaacccttcttacagcttcaaggcaaacacttatttgaaatgagaactacctcaaaatagctttcaatttgctctggaatttgatttgtatgttcatctctctgcacacagacacacaaaatgctgatcaaaacaccagatatgatttccattttaggagttctaattgttcatagttatttgtagtctgccctaaatctcatgatctaatagaagttagttacttttgatctacttttcaaaatagaacaaatctaaaagttttgaagcataaagtaaaaaatgaaacttgaaaaagtgttccctgtttttcccttgctttaaaaacacaactaaataacccattaagataagggtttttaaaaaaattctgacagaaacaatacaaaatggaaatttagattgtgtactaaattgtatgtgaacctttttaaggtcatcaaatatttacataatgtgtgaagttttgcctttgtatacttaatatgcagagatacagagataagtgtctttatagaatattttgacaccctattagcagtctagaatcatttgaaaaacatattttaatgatgacgggaacagaaacagaaaatagattgtcccaaatgcttaataagaaatatttttaaatttaaattattttgctcacagcatttaattttcaattgccagatatgggccatacatactatagtgttcatactctaacaagtttgcaaattaactttaatgcattatgtgtgtatatatatataaatatataattttttcttttgagagagagtctcactctgtagcccagactggagtgcagtggcacgatcttggctcactgcaacctccaccctccaagttcaagcaattctcctacctcagcctcccgaatagctgggattacaggcacttgccactgcgcccggctaatttttgtatttttagtagagacggggtttcaccgtcttggccaggctggtcttgaactcctgacctcgtgatccaccccctccttggcctcccaaagtgctgggattacaggcgtgagccaccatgcccggcctcatgatatattttttatagggttttcagtgttctattataatactttaaactttacatgtcatgaagaatttgccactggttcatgtattaaagttaagggccactcaatgtttgtacctctgtgtctgttgtcctccttttctctaatattatttattgctctggcagtaacagaaagtttgaatgggacaaaagagcatctaaattagggaaaactacttagcttctcacatatctcttgaacagcacattttgaggtgtaacccatgagcatctgcttatttgcatattcacaatgatattcacaccattatcttaactctcttttaacagactaaaacaatcacttgatagtccattaaaaaaaaaaaaaacacaaactagaaagtcacatcagatggaaagctaattagctatactgttttcacattgcatgtgtactaatcaggcatttatttaatatctccagtgctcaattttttgcattaattatttcagattaattcttttttgttaaaagcagttattaaacgggcacaatgtgggacagatgcactgctgattcctgatttcccgcatttcagtgagccttttcatcttctctgagcatgtgcctatagccagtgttgagcagatgcaaaggttatgtcaggattgttttgcaatgcatttgagatattacacataaaattgataaggcagtatatttcaggtaccaataagaagttcctaaaagccctgatatgctttactgtctcatgaagacccttggagtttagagtcatattacctgattatgatagcatgagagataatattagtagataaccttaaaggagggacttcatttggaaatgtgtaaaatttaaagagcgatcatcatatttgatagcccaaacttgagaacagaggagttatggagagttattcaaagtaagaagtattcactatgtgtatatatattaagtggcaatatatcctctatttacttacagtatgaatcaactaattaaatttcatttattttcacctgtactcaccacaggaaaaaaaatcatagtaaatataatcaaccccttccaaagatagggtttattgggttcacagctgtgaaaatagtattttttttccttcatcccggtgattggtttagccaatccacattaattgtggtcagaattgcaggtttattgcacttttgcaagctgtacacttctaaacaccatgtttctttttaaaaataattttctagttaactaatttaatggcaaaatttgatccaaactaatgtgaagctacttgtagactttatcctactaatcatggatattcacattccactgcagaaaaactaaataactttgaatacagtttactgtctcagaacctctttgtaatatgcaaagtatattacttttctcaattctgaatcattctggagtccagatccatttggctgcaaaggtttgggtaatggatgatggacctgaactgataataacattctttggccagtccttaaaatccactttcatgttgttaggtttgtaggcttgaaactatcggctggagagagtggcttcactggctgtggctctggtggatgcttattggtgttgctaataagttccatagttacatggaggattcaacttttctgatcactacatacaattaggaatatattcagtatcaattatttgaaaatttcattttcatgagcatgttattctctattaattatagttcacacctgttgtaattatcactgtttatgagggtcataaaaggatttgtgatggtgaaaaatctgtagtcaataagtatttgtttttcttgtttcattagaacgacgtaacatgttggaactttcctgtttcaatttatattatgagtgttttgtcttatgccttctaattaggacacctttgttttaaaattaaaaatcttgatttgataaattcacaataatgctacgttgatcttgcaataccactatatatactaattgtaacaggtttgacatttaaatacaaattagttctttaacttaaccatggatttggcttaaagaatttgaaaatgtcctattaaaattggagcaaatgatggctttgccttgggccaaaccactgcttgttactctctgtacaatgatgttaattatattttgttaaaattcccagaggcctcagctctaaactaagggccaatatgtagttgttattaattgtaattaatattgactacttgtgtgtgcatgtcttcctttttttcttttttcatagttacgtttcaaagaggagatggaggactaatgagcaatggaaggtatgctacggagattgtttcattattatttttatttttaatcaggactggggaaactctatagtaagagcctattattgtaataaatgatcacttaaaagtctgagaattctaggaggaattaaatggcttaccacaaagtttaatgatctatctgttgtgcactttagaggaatcaagtccagatgtttcataactcccagatgcccctgaagaaattagtagtaaatatcacatggaatgtgttcatttgttagcaggatgtttattgcattaattagacattagcaaatgaagttgctgttgtttaagactccttataggctctcactaaattgctgtgagtgaacaattacacataatcgatcacaaagtaaatgattcatggatgatgaataggctatagattgataggactggattccacaactttggatattcaattgaaattgataaaagctgataacaaactcatatatcctcatctattttccctttgccaatatggagattgtaattaggctctggtaataacttccaatctcccatttaatcaatattttagcaaaaagagattaagtctaatgagagtttgtggatgtagcaagaaagcggttgggtcttcttattgcagtttccatagaaacacatgtttctcttagggattgtaccagaaggggtctatcaaaagaaaagtgcaatgattatagatgttctatttctgtgtaaatatgctagtaatctggaaaggaatcagaatctcatcttttatattaaagaaggaagttctttactaaatatgacgtgaaggaaattttacttatagactatactcacatgctggatcagatcacagtgtatcttttattacctttaaaaaaaacccttaatatacccctgatattttgcaatttagaacttggaaatgtgctatttatggagcagtataaatactgttcattaatttcacttcagttccttgcctccaaatcaagcatgagggctcataacaagggttacagcctagagggaacagatacgtaaggtagctgcaggaattgaggaaggaatagcccaaagtcttagaaatggctgacatagagcagtcactttgagcagttgttcccttgtggtgccaatgtatcatcaaaccttgttttgggatcctagtatgttactgatttctaccagtttcagggcagacacctgaattcatctggacattgacaaaatcccgggcaaggactccctgcgtccactgttaatgtatgtatagccttaatgaattgctggagttctttaattccagggagtctacttatattaatttgaagtcaatgaaaatcttccatttcttaacgctttatattgcatgagacgagtgtcaaaatcttgcattgagctccatgtgttgatttccttgtaatttctgttttagccgtccaggtcttctcaatgctggtgatcccagctatccatggcttgctgattcttggccagccacgagcttgccagtaaataatagcaacagtggcccaaatgagattggaaattttggccgtggaggtaagttgtgttttttaaaatagtgttatttgagttctctctctctttttttttttttgaccttcctggatttttttaaagaaacatatcagagagtatttactcccataattaaaatcaatgaaacatatgcactaacagtgttgtacatttgctaaatattttaatataaaacgattgtatcttcattaccttgagtaaaaccaaacttttaaggaagctattactaaccaagatgataaatatttataatatatatgctttcaggattactagtacaagattactgaactcagagactattttgttaactagggcttatggttttggactagaggtttcccttctccatctcatttaacatgtatttattgagcatctcctgtgtacttggcactatggaagaccataagaatataataatgatataaaaaagatggttcttgccctcatataatatgtcatgtaagaaatagacaattaagtcaatataacatgttgagagagaacttttctgtagttccacaactagtaactgttatccaaaaataaataaataaataaataaataaataaaaaagacaaaaaagtgctaagtagccacatgcaagccttcaaaatttggtgccagagtcctctccctgtgggtttgtaaggagacacaagtaacctactgtaaataactaccacctcccctgacttcaccttttcatccagtcaataggagagagctgggtttagagaatgatgagaggagtagggaactctctgatctcagtgtggcttggcaggttcatgtgagttttccgttggtggaagattgtacagacattaaatgtgcttaaactgccttgccagaaccccatgtggcatgtctaccaattgggagtaagaaagctctatgaacagaatattatttaagttgatacctgaagcaaatttaaaaatgagtcaaaagtatggaaaaaaaaaagtgtttagaaaagaagttgctgtattttaagttccacaaataaaagagacattgacctacttgagaaatggaggaatttcctaatgacttgagtataaaatacgaggaagcagaaatggtaagaaatatagaaggatagataacaaaggaccttttaagccacatagagaatttagacttcgttcagagggtaatcagaagctgttgatggatttttaagaggagaatgctgggatccaagtactccaagtactgttttaagtcatccagcctgctgctggatgaagaatggagtaacggtagaaaattggagtgattaattagaatagtgctgtaatccaagcaaagctgtatgaattctctgtaagatttctgcacttttagaattaatgaaggaggcccagggctctgttaaatttttctgagtccactataagccttgatgggttaatttcatatgtatgagtatataaccagattgactgagaactgagaaggatattcatagcatgttctctttaagaatggattaccactatgtttgactatatttgaagttgtatttcaaataatgaagctactgattattgcataagtctgcattctgtcagtaccaactatgagaaggggaactcccttcccttctgcaaataaaatacagaaaataaccattcctacttcataggtgtgtaatgaggattaaatagatgaatatatatatatatttatttatatagaatatatatatttatttatatagtgtgtatatatatatatatacgcacacacatatatatatatgtgtatatatatatatatcccaaagcttggcataccatcaatcatcaggcatcagtgcagtgagtgagagaatggaaagtaagttatatgactcctcagcttcctcttccgcttctgcaagccaacacaccccacttaggactctcacttgcccagatactctggtagtggcttcctcccctaagtgacccgactgtgagcaactgtcagctatcactttgccatgggtagtttctgtgcctgagcacctgctcatcaggaaacaagaatgtccctccccctgctatgtcgactgattttgtcaaaaggaattctgttcccacagcttttgtcaatgaaggaatagctgactcttttacctcttgtatttttattgaaataatatgacatgctattgttacatgaaaaagtgaatgcttacagatggagaaaatgaatattcagtttccacaggctaccttaacgtctaaaatatctcagtcaaatttaacaaaagggtacacctggagatttgcaaggtttttcttccattttcccttaattttcatgatgtgaaatatctcatagatgaacagcaaggccaagacaacgtttttgtagagttgactgtatcccttatccatgtgatagtcattttaagcatttactatgtgccagaaatactgttaaaattttttgtatattttaattcattttgcttgcatagtaatatatgaaatagtcatatttccattttaaggatcaagaaactaagttttctcaagataaataatttgagatctggttgtagaaaactctgctttgtattgtaaaggcagattcacatgtatgactatataaccatattcacttggaagaataagaatggatactgacattttcccacaccacatgttctcactcataggtgggaattgaacaatgagaacacatggacacaggaaggggaacatcacacaccggggcctgttgtggggtggggggaggggggagggatagcattaggagatatacctaatgttaaatgacgagttaatgggtgcagcacaccaacatggcacatgtatacatatgtaactaacctgcacgttgtgcccatgtaccctaaaacttagagtataataaaaaaataaataaaaaataaataaaatttggcaaaaaaaagaatgaaatgacaatacgtttgaatgtaataaaaatagtacttagaataataaagttactaattatagcataaatccatattttatcaaaggaaaccataaaaaaaattatttaaccattcaagtcagcaagtgcttactctcttcaaaacactgggtgagcaactatgaaaatgcagacataaatcccatatgctcctgtcttcaaatgacttcgtgatacagtgaaggagacagtcatttgtacagataattatataaaacaaaaggaaataaatgtgagtacaagtataaccaaggtgctgaaaaactacagaatgaattaccaattccaagtagaggaagcatttccataactcataggtttcaaacataagtgttaacaagcaccagtcagacagcctaaaacattaaggactggtaggtggggactgctataaatggaaatggaaaaaagacctgctaaatatgacatcacctatttaggtctagcctgttgggaggaaggctagcccagagttccaaatcatctggtattataggactctccttaacatccaaatattcatgtgcaatattccaatatttcgatgctagaatacaattcagtttattttttgaaaatgtagggatgatcaaatcatatttgaagacaatatgcagcctaaaaatcaatacagaagcacttagacttaaaggctgactataattttatctagcagggagaggagagattcaatttccagagccatagcattagttgtatagcaatattatgtaggattagattcttggaccacttttcttcattgtttaacatttgagcacacagccatttgaaaagcttgccatcgaagtggcttgcaatccacatctaaagctttggagaactttaaattcaaggtgtgtgaaattggagctcaagttggggaatcaagtatattcacttaatattcatcagtgaaggacatggtagaagcggcagaaacaaaagtctgaaaaatcacccagaatgaaggatctattgtgaccaatttggatatactacatattaaaagtttttgagaaataaaaataatactaacacttgagaatgcagtatgcttaacatcaaattttgtaattaggacatagctcaaagaaagaagggcaagaaagtagttgtgaagttctgaaatttaaaaataatgttatttgcttatacaacctggtgaaatatgataagttaaaatatgtttaacaacttcactgatacacatttaagatatttacttcaatatcttaagtacatatccgctcagctgtaaaacaagctccaaacttcaaaaccttcataaagacttaagttatgcagtgtacaaaatatagtatacatttctttctacacttgctaaagaagacaatttttagcttatgtaaaattcaaaagcaaaagtaatatttctataagaatttttatttcaggtactattgagtatcagctaatctaaaagttttaagatagttgaaaatgtcctataatgaaagaatgcagtgatttgatggcctcaagtcccatgaaatgaagctttcagaagatagcttattttaaaatgtactatataataattagattcattttaacgctacaggattaaaaacagtgttatttagtgatttctattttagattcacttagtatctttcttccaaaaagggaaaataagagctcaggagagaggcagcagttctgaattataaagcatcatgtaaaaataattcagcataccaaaatgaaaaatggactgattgatattcagtgttgctcctggagtttaattttactctagctgtattacaacatgaaactgtaattctctagttcggagttgatagcataaattaaactcaccgatcactgagattgctttttctatagttaaattctgctatattgtgaaaatggcttacacctgaaaattttcctttgttatacaagaaaaaaaatgcactctccttttctggagcaattaaatcacacaataagtggcaagttatagcttcaaaaaatatacttcatagtcggtatagtataatttttgaaatgttagcatgtatttagcagttgtagtccatgtctcttgggataaagtggaaagagatgtttttcatctgtgagttgtggattcagtatcattgcaactgtaaagtgctaacactttcattggctctaaaacagagtgaacaactgaaagcatttttctgtagtgaagtatgccaaccgtctcattcatggttaaagaaaatagggggaagggtgttttaagcagtgagacgtgaagggcgagcagtaggcctgcctgtcactgaggctgatagcttggcgatggttgtatatcatctacccttcagtggctcatgaagcccatctcagctgaaatgcaaacgtgcagtgtgacacacttatttttcatcttcagtcctgatagttttgggcttccggtgcctcattaaattgtttcatttccctatgttcaccacagatgtgctgccaccagttccaggccaaggggataaaacagcaacgatgctctcagatggagccatttatagtagcattgacttcactaccaaaaccagttacaacagttccagccaaataacacaggctaccccatatgccacgacacagatcttgcattccaacagcatacatgaattggctgtcgatctgcctgatccacaatggaaaagctcaattcagcaaaaaacagatctgatgggatttggttattctctacctgatcagaacaaaggtaacaatggtgagtcaggttcttgtgtcctgaggaggtattttcatatcatttgtgcatgagatagaaattagtatttgttgtttgacttagtgattcattaccaggtttactacctaaactaaaaaaagataccagcatgtttccagtaacttgagtaattcctaccaccaccaccgccaccaccaccaccaccaccaccaccaccgccgccgccaccaccacctcctccaccaccaccacacaccagtgccaatcggtttcatcttttagctctttttcaacctaatgatcaacaatccatctctacttccattagggcagggtagacaaaacattcctccactctcccacaacatctgcttctgagttgctaactgcatgttctgcatgggcttgtgctgtgaactaatcacatgatgccactatgacctctgccctttaacccttagccttactttacattcctgactaccgattggctgagggattgtctaatagaatgccacacaaccagtctcaggatttcagcaccaccagctctcacaacagctcagaaaggagtggcagtctctcaggttggtctcatcacagtaaggagaaatatttgtttgtcaccagcgtatgacctgtgttcctaacaaccatgaagatatactgaatcacagctcactgtcaggcatttatctgtcaaatgacaacagtttatgctaatgaaatcatgccttggtgggataaaagggaagagaaaaatcactgtccccttttatatactaactctatgaggaaatatttaaagaaaaattatgccattctactaaatactattcattaaagaacgagtaaagagaattttataataaaaagatcatacatgaaagtcaattccatgttatagataccaaaagatgaattcaactaaaatgaaaatgattttggagtagttcataatattagtatatcattgatgtgacctcctatttttggacaagatttcgaaataccatataataggattttttatctattgaatgatattctactgcactatacaagaaagttaatatgggaaattaatatttaatttccaaaaaaccatataatctttgatattgctaattcttttatggtataaattttaatatgtatttgagatatatcagctaaactgacaatctataatgtcagtatcatatagcacaaatggaaagaaacaccctttactggacaaaaatatatacctattgtaatgacttatgaatgaaattttcctggcccaaagatccttacctgtaaaatgaggaggttgtagtagacacactctaactttcaaccatgacatatacattgtatggctgatgactttgtgcatttctaatttattccatgaccccacttgtttaatttgtttggattaactatatgctatttgtttgtactgagattttgttttatttttttaattacaggttatttgtaaaagactatagtgtattatggcatgtcacaggctaccaagcatcaaagccataaagagttaaactttttacatcattagggtaacattttctaaattacttttcctcaggagatggaaccctttcagtctgaaaatgttaatgctccctcttcccttcaaaatgggtcatttgctcttcttgcctattggtagaattagctatattatagaatccagaaaattttaaacatctgttatgaatttaaacaggtttaataatataggagaactttttgaataaccttatatgtcatttagactgccatttatttataataagtctcacaattgttctgaataattaaaaagtaatttatcctgggcttcctttttatttcattaaagatatgcaaagtcacatgcagtatgtaaaaataaatctatatactataatccatggattacttaagacttttaaaaatctttctttaagtattctatatgtgttgattgccaccaccaagttttaaaagttgtcttttgagtaactgtaagcagaacacaattcacaatagtacttagtgcttttttgaatccattaatctcctgagtgacatttatatatatctatgaattatattaactacttcatctacatttgaatacaaaattacttaaattgatgatagaaagcattctttagtaggtgagagtgattattctctttttagtttagttcaattgagtttaatattagagttttgtcttatgcttataatcataggtatctttcctaagacttaaatttaagatcaaaccaccttgtggataactaatcatatggtattataagattttcttaatttgtggatagcaatgtaagcaatttaaaataatcacagtgataaaagtggacatttcagaattatttgagtgtattaccctctttgaaacacttaatatttattcaatatataagttctgagcacttccattaaaaatctaaccattaaaaatataaaatcaccagcctgagcaacatggtgaaaccccatctctgaaaaaaatacaaaaattagccaagcatggtggcactcgactgtattcccagctacttgagagtctggggtagaaggatgcttgagcctgagaagttgagcctgcagtggatgtgatcgcaccactgcactccagcctgggtgacagactgagaccctgtctcaaggaaaaaaaaaaagtatatatatagtatatatatacatatatattaatatacacacaaattaaagagtttatatatgtaagtcattaaaatatgctcccttaaaagataatataagaaattctcaccttaaagtgattgaaggttctttgtttgcaagtaacagcaacagactgtggcttacttcactcaaggttcagatctcagagaatgtaagtggctttggttctatgtatgctctccaccatgctatgaacctaccattgctcactgctaaaagaagtcaggtgtgttgatttgtaatcctacacgtactgcccataatgagagagcagaaatttcctcaaaagaagagaaagtgattgttggatagaaagccctcacatatttcttctatgaatcacccgtttcccaaatagatttttaaatctgtttggaagagtaggtaatgaatggctttcttgaactttggacaatgacttcaacagaattcagggctctggaagtagtaatttccagtaaagaaagctgctacattctgaattctgatttttctcttactgggtgaatgtggaccacgtaacactcagaatgaacctcagttgcttcatctataaaatggagatgcaagaacttgtctatttctgttactcagttctggtggtgaccacctaacatttctaaaagtaccatggaaaacgaaaagcactctctctatatataaataaataaggaataaaggaggtgaaactagagagaaagctatggaagacaagtagctcagtctgttccccttttaatcattgaaaccgagttctgatactacaacagaagaaatggttcctgtctgataattttgctgactcatcaggaaacaaaggattaaggttcatctaccttaaagacaaacattacagatgtatattcaagcaagtttattgttattctgagtcaggctgtttgtgggatactcatagggcctggagaagttgggagtaaagaaagctttagaaatcaagaggagctgggtttgctctaagatagaggatatgggggaaaaaaaagaacacaaatgagtggcatttattgaatgttctgtccattctgagtagttgatatgcattgtctcttgtaattctcaaaataactgaaaaaagtagtaactttatatctgttttacatgtgcaaaaatgtaggcagtaactattgagtaacttatccagtaagtgggaaactggtctgtaaacccagatacgaaactcttgtcctctaagcaaaagatgtctgctctccttcctcttaaaatcttttattctaccaaacaagtatactacaaggcaagatgaaagcaatttgtgtgcagggatgttctttgaaatatgtgtgaaggtgtgcatgctatgtggaaaacacacactattttataactggcaataaagtatatatccagtttaacagttttatcacttcctggtgctcaaatatgttcctattaaattacataatattcaacgtggctgatgcagatgagtaattggtagaagtaaggggaatagtaggcttctagtgatattataatacattgctaaatagccctgctacaaatagtttttgctcacaacttgcggttccagaaagatgaagtcgaaagaatcagtaagatttttggcagatattgctgtaggctgtggtgggagccacagaagttatatagtgtcccctgaaatgtcctttgttattctgctccaagaagtactcattcctcatttaactgtagtccacttttaaggaagaagctttatctacttaattttggaagagtaaaaaccatggcactgtccaaatgataaattgtattttttatatttcattaagctccatgtaatcctagatatggctcatatgctgctagcttactttcttctcatattttgtgcatgaattcatttgtattagaatgccactgaaactgattactgtattaatttttcctcctttttggaatattatatgatgttatgcttaaaatagctaagaactattcacatatgcaaaaataattgtgccattcattagttaaaaagtctataaaacgtatcttcgcaaaatatttacaggtattttcctgattgtagctgattgatttttatcagttacttttgggataaaaattgttacccttcctggattaattaaattgaataaattctaatggaaaagtttagcctatatccttagaccttgcattttccactgagagagattatgcaaaagagcattataagtgtactaaaatttgacatttaaaagaatttgttatggcccattatttcctctaacaatgaaaacatgaaggcaccagacgggaataaatcaataagcatgcttttgatacagcagccatgtttttggttcattcagctctgctgttaatgcactggggaaaaaaaaacagtatcattttgagtgatttataaaaatgtttttctgattatatcatttcattgtttatagcttttaacaactccaacatactgattctggtgttttgaaacataaatacaccttgccatctgatgtattctctttattctgctatttggcatctctgaataaatacgttattactttcaggtgggaaaggtggaaaaaagaagaaaaataaaaactcttctaaaccacagaaaaacaatggatccacttgggccaatgtccctctacctccccccccagtccagccccttcctggcacggagctggaacactatgcagtggaacaacaagaaaatgggtaaagatattttatatactagcaaaatggccagggctctcctctcctctctgttgttcatttttgccatcatcttatgttctctcactgtttcctttgccccccaccaccatgttcattgcatttccccctctttcattgtttgcactgtctatatatttttagctgataaatacaaaacagcacatattgaggactgagaatccttggccttcaagtgccttagattgtctgcaatcatgataatgcagcctccatttataatattgcttgttagtttgaaagcaagtacccacagctctgtgaactaaagagccactcctgagaagggctgaaaagggaattaaaataaccttcttcatcatcccttgcagttctctaatgacttgatgtctggccatagcagggcgccactgtagagcaccatcacaatgggataattgtagggacctggccagtgggtagaactttaatcatcagctctgatgggaatttaggggccagaacaataatagagccaatgcatactctgtaatgaaacctttttaagatacaaaattttcttcgagggtctttaaatgggaccagtttccttattctttcccaaatgtctcacaagagttagttttcctctgttactttaagctttaattgattttaaatacaaagacactgatattttttatcctctaattccaagaaaaacaaaaattggtcaaaaaatcatactgtttccttttctagtttaataattctgaatgctttgtcttccttataattcccaggtcactatttattttgactgggcctttatgtaagctaaaaatacagaaaaaaagcagtttttcttttcacaggattttttttcacttagaaatagttagatattaaaataaatctatttatttctataatggttgtttatttattatcttggcttaaaaaatcacatatacatgtttataaatttcttcttcatcctcttttctttgtacataactcctgtctttgaagtcttcagattaatttttctaactagaattttctatgtcataacattggcttcctttaatgatatcatttgcctttttttataaaataaaatatatatacatatatgctctatatatgcattatatatgtatacacacatacgcgaatattttttgtctatgtcttcctttccctccaaaagccttcatttgtctctctgagactgtagcacttattatatatgcatatattgttattttacttcttttaagttcacatttgaaatgggaaactaaaagtatatcctgtgtcctccttctctaacataaaaaataaaattctgtatatgatcttaatttatattaatgttataaatgtgtcagtgtcacataaatcatgagcaaagaaaaaccaaagatgtgtattccacaagagattaatacagagcttagaaacctgcattttaaaagctatagtcagagactacagacatggggacttgtaaaacaggaagagaaagtagtgctgttaaagctttatatgcataaagtcttgaactcatatcacatgaaaactgtggataatttggagggttttttttcccattgagtctactaaaatatacatagactatgataattcctgtaaccccctgcaataaaaccaattaaatcaaaatcaatgctaaacttctcactttattttattatcttgcagtagaattgaaaatattcatgaaatagtagatggtgcaaatttttattatttaacacaaattattttcagtataattaagatataaaacacaaaattgtttctacatatttggaaactttatatatacatatatatatatatatatatttatatgtatgtatgtagtttgagttaccttcaagtttttgtttgtcttaaatacctagtatttgctaaaaaaagaagttatcattcttactaaaaatagtggttagatcttagccagtcagtaatattgacaacaaaattcaatttccttatttttttgagctcagtttttaaaaggctaacacttgaaaattattattttaattatttgtaataaaaacatatttaaagttaatataaaaacaaataaaaattaatagattgggcatgattttgtccattttttgatattctttatacttttatattttctaatcggtaaaccatatgatactgaaaaagaaagattattgaacacagtagagtattctactattcataatattaagtaagtcaaaaaagaaatcttcagaattgatcttctagaaaatttttctataatttagaaccttcataattcaggtttaagcttttcttggcatacaaaatataaaaacttcagatacttttttgctctccatacttattagagaccagacactaacattatcctgttcctgacacacacacatgcacacacacaaacacacacaattttgtatgataagccctagctgagcaatgtggaagaactaataatctccccacagaaaggggcaatcatatataccagggaagccaggggaaagcttgtagaagttaagttttgaggtgaatctagaatcatttactcacaaataatagaaaaacatttggtggctgttggatgccaggcactgagccaaaaataaggacaaagatagcaagaaaacgtctctgtccaaaagtggtctagcattagaatagattgttagtcaacaactataacaaaattttactattgttgtgattttctgtgcaaatggagacaaatttccctggccaaagaccaaaaaaaaaaaaaaaaaaaaaaaaaagaaaataaatataatacaatgaaagacgagaaaacaggaaatagcagatagtcccattagtcttcctttggaaaccccaccctcttttctttaaggttatctgccttaactaaactgttgttttggttattcctaaagcttgctcctctattgtagtactcctcatattgcacttaactgcttgtctgtgccctttatcaatttgtacctgatgtatgaggcttgttgagtttgaaaactgcatagggtggctgggcgcggtggctcacacctgtaatctcagcactttgggaggccaaggtgggcggatcacgaggtcaagagatcgagaccatcctggctaacacggtgaaaccccgtctctactaaaaatacaaaaaattagctgggcgaggtggcggccgcctgtagtcccagctacttgggaggctgaggcaggagaatggcgtgaacctgggaggcggaattcgcagtgagccgagattgggccactgcactccagcctgggcgacagagcgagactctgtctcaaaaaaaaaaaaaagaaaactgcatagggtaggagataatctaagaagacgttttgaagccaattgtgaagccttgtatgtcatattggagttctgatgtttgagtacagatgatggattggaggatgtgaggctgaggcaggtagataaagcatggaatattgcagcagaatggctagcagaatggctaatatcatgtaaatgataagggaataaaacaaagcaaggtcaatgggttggaggaaaggtaagtatttaggagatatacccagctaatggtaatcatcaccctgaaaatattgtctctagttttttgttacaatatttagtattatttctaaaagcttagctatcatcagttttcattctaagcctttccccacaatatcaaaataaatatcaaaatcaaataaaaagtatcagaatatcaaaagttatcaaacaattgcccaaagaagaaaagtatttgttaattcaggaatataacaatgatggcaatgttttctcctatcattattcttctctcagcttgacaaaaatatgtcaaaatgtattaatccctagctataaatacagtgcattttattatactcatatgattccaggaagaattctatggtaattaaattgaaaagtggggcttttctttgctactgcagttagagattggcaagcttctgccagtgttgaactttattgtatttttattagtaatttggtatttgtatctggcctttacaagttaattcacatgaaacattgatttgttgtcatctttatcattagttgccaggcaagacagataatatgatgcctcatagttcactgacaataagtcaaagaacaaaaccttctccaggaaaggttgaccaaaagatctttggtttggcattagcagcattttcacagtctttttcaatgttactacaagaaaaagttgaaattctgtcactcaaataagatgtatatctgtaaaatgtgaaggaaactataaaaacagggctacacttcataaaatttgtagagtcatctgttactttctcatccttcttcggtaactgcatgaaacctaagtatttgttgcttgcaatggattaagacgtgaacaccatagagataacagaccattcttctccttcatatgatatacaccatgccccaactttccttcatttattcttccaggttcttctagtcttttcttttatctcattttccatttttcctcttttggtacatggtaggtagatggatctgtggacatttttcagtttcgctatcccaaaggggtaaagaatttgctccttcttgttctaaattatcttcacacacacacacaaaatgacacagaaaaattggtgataactggctaggcgcggtagctcactcttgtaatcccagcacgttgggaggccaagatgggcagatcacgaggttaggagatcgtgaccatcctggctaacatggtgaaaccccgtctctactaaaaatgcaaaaaattagctgggcatggtgatgggtgcctgtagtcccagctaccagctactcgggaggctgaggcaggagaatggcgtgaacttgggaggtggagcttgcagtgagccgagatcgcgccactgcactccagcctgggtgacagagcgagactccgtctcaaaaaaaaagaaaaaaaatagaaaaattggtgataacattaattctagttaatgggaatagctaatgaaatatgttttagttaattaatgcattaagcaatgtatttgactaatgccaaatacaatatttatatggttaggctctccttggcctgacattatttgattaataaaaatgaattgagtacaccaaattataacttttcttatgttttcttagcacatgatgcatataacacatatttcttctaatatattctctatgaattttttttttttttaaatttcatgtgtatatccccattagattttcaaaagtaaggatatcttactacctatggagtttcagaaaaatcttaggaaataacagactatttccatttgaaaaattgaatatgtgaacattttcgttcttttttccaaggtatgatatccttggcaacgaacgagtgtaagtaaggaaagtccacccattactttttggcagaaaaaaggactcttttgtagtaagagttacaaagtaaatttaattatatctagttatgaagcagaacagcacatttcatattgaaaatagatagttctcttttgattagcctcctcttacgtatttctgtttaacttaataatgtggcttaagtcagataaataaattaggaaaaaagaacaaagcattctaattagtggaatgatatgtgtgttttcaaatcaaatcaatacatacgcgtatgacttactctttttaaggtgttatattagatgtaacaaaacaagaacagttcaatgtcataactataatgcacttgaggaaaaggtattataaacatgtgaaaagttaaatactaaaataaattagtcaagagttacagaaaccagcactggaaatgacataagactgcatataatcaattttcaaagaaatgtacatcaaggaaaccttcatacaagatatgggatttagcctgcatcttgatggatttataagattaagataggtaaaactggaggagtacagcttattggaaataagttggttcttataaataaatgcaccaggatgggaagaaagtacaaagaaagatgaaaacaaattaatttatttgagcaggagattcttgttgtaaaaactgtctgaaaaggtagattgcggcttagacatattcaatggatggaataaagagaagtaaatcttcttattcagaccattctgatattttcatagatgaatttgtaagtggtgggcaggattggttagaggatgcgaaaaactgaaagcagaaaatcccaccaggacagtgagttacaatattttaaagcaataggatcttttttccacatgaaatttaattgtgatctccaacatataaaacagataaaaatggcatcaattttttagagcaatatgttctttaaattcagattagcactcattatatagtcaattaaatgggaatacagtttaaatgatggtattttctagtataaaaattgctatttgtaacacactagtgtgtgtctgttgtttataatgtctaatattatagtagatatttaggaggaaatattcctatcaaaccatacagggcttctgaaacagggtcttgcaactcacttaggtagcctcagcaagagaataaaatggccatggaaatgaaaataaaggagttacaattataactaactttgaaggaagaatctttggaattcgggaaaaagcatttaggggtctaaggaaattgaacatccaaagatgatattattcccccaaaaaaccaaccaaccaaccaaccaaccaaccaaccaaacaaacaaacaaacaaaaaccctttctgtaactatctctcacccacaggaaaatttcaaactccttgtaggggctgataaggccttcagtgaccagcctatccctaactctcttgcctcttccgtggccaattttcttctttctttgccagctcttggcatttagggaagtatttgaactcttcaaattcctttctcttcctccgggcttccacacgtgttgtttaaaatgttccttttactggtggtcaacatagccctgcccaactccaaaactagtttagacctcctgctttctacttttatggcatcttgcatcactgattatttgtttaatatcagctttccccactgaattgtatgctctgtgaaatagattcaggaccctgacacataactgtccaaaaaaataaattaagagtttttttttaaataaagtttatttttacatctgttttaggcttacagcaaaattgagcagaaggtacagatttatcccagcccccacatattgatagcctccccaactatcaaggttctccaccagagtggtacatttgttacaattgatgcgcctacactgacacatcatcatcacctagagtccatagtttacattagggttctctctgtgttgcacagtctatggatttggacaaatgtaatacatgtatccaccattattttataatacagagtggtttcactgtcctaaaattcctctgtgctctgcctgtccatggtttcctctcatctagcctctggaaactactcatctttttcctgtctccgtagcgttgacttttccagggtgtcaagtagttggaatcttattgtgtgtaccttttttagacctttcacttggtgatatgcgttcaagtttctgccatgtctttttatggcttgacagctcatttctttttagcaacgaataatattccattgcatggatgtaatgcagtttatttatccatctacctactgggagacatgttggttgcttccaaattttggcaagtatgaataacaccaataaaaatatacacgttcaagttttatgataaattcagcttttaaacaaaataaatggaaaggcattcaagtgaaaatattcaagaatcatccggacatttataagttactctttgtaagagagatcaagactagagatgtacatttctgatatttactcatatcacagtttccctaatgaatatctcccatgtaccagaaactgtatgaggtgcaagaagtagataagaatgacagctttcttgaatttaagaatctcacaaaatagtgggagaaaagaaacacagaaacaaataatctcaatataatatgaggagtaccacaatataagtattatggaattgcaattaattccatttggagtggggaagagaagacttcacaaaactgatgacgtttgaagtgactggttgaaggaagagtaggcagttacaagcaagtgatttgagaacagtcataaacagatgcagactttagagaaaaatatagtatatggatgttgaggaaatagtgcgagattaagctggaaagatgagtttatcagactaggatgggttttttagacctagctaatgagttggaaaggtttttttttaatactagttataatcactgaataattttaggcttaagcgtgatgtgaatgaagattttagagatataattctgttgcacgtgtttaacaaagggtggaagagaagatgatgataccggaagagtaggaaagctaatgagcttgtttacagcaggaaagtgatgtgtgattgtgggagtgggggtgaagtttggagaaagattcactaggtatttaagaggctgaatgtataagaccactatatccaataatattatttatcttttccttgtctgtgtttaaaaggatgttataatccatttgatttatgaaagtattcagactacagagaattgaaataaaaaagctattgattttgtctcatggttaaaactttttggattaattttctatattcacagaccacagtccctaaaaaaatatggttttaaaataattgtcatattttatactcaaaattttttaaaaggatagatctcgtgttaaagttttttactacaataaaagtattatttttattttatagggcaaggttttgaactcctgttttgtgatttgcatttggatgacaagataaagaggacattagtttctactgagaaaattaagagaatcaaagagatactgaatgcatttatatgatagtcttaatgacatatggaatgaaaggttgtcagatatctagaacaagaacaagtaaaattctccaatacttcttagataatcaatcagcgatattggcatgtaatggtgcacaagtatgaacaggagaaggaagcagttaaatctacaagcactaaattcattaattgtctttaattagcaatttggtttttccacatgagtaagtttgttgggaagttattgcctcttgtaactgtggggtaacaattagctaaaaaggtcttttaagaataaattgagatattgagataacagatgtaattacaattagaaattaagataacagccaggtgatttactgtggtgacaccaacagcttcaggaagaaataaaccgagagaacatttcagataccatgtggttgctacttattgccagtataattgtgtgcatgtatgtgtatatgtatttgtgtcaatgtgcatatttttctcatttaatttcagctatgacagtgatagctggtgcccaccattgccagtacaaacttacttacaccaaggtctggaagatgaactggaagaagatgatgatagggtcccaacacctcctgttcgaggcgtggcttcttctcctgctatctcctttggacagcagtccactgcaactcttactccatccccacgggaagagatgcaacccatgctgcaggctcacctggatgagttgacaagagcctatcagtttgatatagcaaaacaaacatggtaaatatcttcattaagtcaagagacccatgctttcaacacatggaaatttttttcagaataaattcacaagagattctgatagaactacacagctagggttaaaagtgattttgtatgactccttaatcatttagataaatgtatccactgagaaatgttaaataatttggccaaaactagaactagaactagaactagaactggaactggagctgtaactgtaactgtaactagaactagaactaaaactagaactagagcaagaattcaaatctgctgtatttcaggctaaagtgctcttggctacaccagaatcttttctaatttatggtttatcttcaattagcttatcattgaactcacatcccatgatgtaataaaagactccttttagattcctcaaagtgcctgtgattaattctgtatgtggttgtcaatatgtaaatgtgagcttctgcaaatcacatatggtcagtattagttattaaaagactctctttacctgagttaagtgcaacagaaaaaaaaagacaatactagtatcagtaagtgcataaaaagcaggagtaaatcaaaaatttcacatttctttttctaatctataaacttttgtaaactacaggtgtcagtttacctaggtatcctgtggaattaacacagatatataaatgggactaacgctaacagttttatacaggatttttgttattcaatctttctattttaattttcaaaagcccaggcttttatatcactattttaaagctccatgtcatactccaattttcttctgttgatttaccctttgtgcttgaagtctgagtaaattttttaaatagtatttgttttgttttttaaattgttctagtcatggggataaataattcttattctcattattaatgaagtatgtattattaaaatacagctaactatacatagaaagagataccaaaaggaagagtattacttaaagattattacaaacagcctcttttcttaagatattcttgaacattttccaacagtcatcagatgctttctcaaaggtcaaagacaacttaccgttaaacgctgttatttttcatcaatctgcttttaataaaacatcactatgtaagttgaagccagctgcttcaagagccacagggcttccttcacgttaactaatgaagcaatgcagtttggtcatctaaagcacagactcaagctgaagggttctcaaatttgccacattttagaaccatttggataaccttaaaatatattggtacctgggctccactcccagagaaagattctgactgccatgatctggaatttgatccagatcatgggacagccaaggttgggaccactgccgtggagatgaacctgtcttactagctgcatgactttgggcaacttgctcaacatttatatgctatagtttccccatgtgtaaaatgatggtgatgataatagtaattagctcatataggaaattagagggcagtccccaagacaacctatatttctgataccaagtacaagtttcaagggtccccaagaccaccctgaagtttcagaattctctatagtaagtcatagaactcaccaaaagattttacactcaaagctacagtctattacagtgaaaagatacgcattaaaatcagccaaaagaagaaatgcatgggacaaggtccaggaaaattccaaaagtagagcttccagttgtcctctcagtggaatcatagcgttactttcccaacaaagggtgtgacattacacaccatggagaattgccagccagggatgggcacaccttccttgaggtcctgcgacttcattttggctctgtcacacagacattgttgactacccatatggctgacctcaatttccagcccctccagaggctgaggtgacaccatgcaactccaagcccccccataatcatattgcgatgctttttggagtagcctaaggcctctaggtaagcagagagacttttatccacaggacattctaagggcttacagattacctcccaggagtagagggcaaaggcctaacctctcttgggtcgaggttcaattctttgttacatatcctagtttttgtgagaatgaaatgagtatgaacttatatactactgtccctggctgtatattagctgttattagttagaaaggcctaggttttcacccctgagttgttcacttctgtcttcccacacttagaagagtgtcccacttagtaaatgcttgatagatatttggtaaaagaatgaacaaattagttcatctccacctgctgcaaatacccatagaggacaccctgtttcttcttctgagtgtgttcctactcaaccagcaatctttcagaatgccttggctgactccacatctgggagttatgagcttgcatgtgcttctggtttggaagtgactcaccatctgggtagcacatcaacatcataggactgtttaacaaataataattcccaggctccacctcccaggatctgtttctattgattcgtgaagtaaacagcacagtgcctgtcactagaagatatttataaatgttatgtgtcctcttcctgtatttcaatttacctcttaattttgcttaaataggagtacattttttattccatcaaggtatatttgttttatcaagaggtatcaattcataagcatattgatggcaacatttatagcaagatgtgctcatctatcctcaagcttttctgtactaatacttaggaaacttgctatttcttcctatttttcaactagcaggctgtgaggaatgctgaatactaacttggggcctgaactttctaatctgttaaagattgaagattgggatctgatgatattgaggtagcttccagaattagaaatttttttaacattgaaacatctagaatcctgttaacattgaggttggttacaagttcaagaagccagttgggagaggaatattaaacaaattcgggaagattaaaatattttccccaaatcatgcaaatgacaaagaaaagtaatctaatgtctttcattcaccagccaacaataaaaatgcatagtactttttaagatctcacctaaatagcacagccttttaaataccttttatatgaaggcaaagaaaatacttactatgttaaaacatgtagtacactcactttttaatgctggtaacaaataacaataaattcatttcatttagcattttatggtttagaagaaaatctgagtagactcaaagcaaatcaactggaccctactgcccagcttcacactttgttagctacctgatttgaaacaagtcacttaaatttgaccttcactttaataaattctaaagaaggttgggccaagcatgatagctcatgcctgtaatcccagcactttgggttgctgaggcaggacgcttgcttaagcccaggagtttcagaccaacctagacaacatagtgagaatcccactctacaaaacatttaaaaactaattgggcatggtgaagcacacctgtaatgccagctacttgggagaccaaggcaggaggatcgcttacgcctgggaagtcagggctgtagtgagccatgatcgcatcactgcactccatcctgggtggcagaacaagaccccttctctccaaaaaattaaataaataaataaataaataaatgagggttgataatgcatgatctatttatttcataaggttgagattagaattatttattcattgcaaaaggtttatttaacacactagtgttccaaacacagagaatccttagatgaattgtttatgcctttgaggagtttaagactttgttgggtgagacagatacataaatagctactagagcacaaattagttgtgcctaccctaaactgggttatagtgaaagtggaaatagccttccagccttgatgtgagagagatcgtgtggggaggaagccttctagggtgggaaatgtgttcagggttgggaggtaggggatattaggtcctcatgtgacatcttttcttcataagggccagcaggcagcatgggttacacagactgagtagaattttgacactaaactgagaacaaaagtataatatttttggagaaaaatattcactttaaatagttactcgtggcgaatattcctagtcccctctagataacttcttttcacaaaaatactgggcccgtatttttttttctccgtgtgttatcctataaataccaagtgaagagtttaatggtttatgttttccttgtttggtgaggctcgtattcgtagccattgtttctgctgaaagcattatgaactcctaaattagttaatggaaaggaagaagacagtatgagttactatagcatgcatttaattaaaattatgattttgttgcatgttaataagttgcttttcttttttaaatttcatttgaattctaggcacattcaaagcaataatcaacctccacagcctccagttccaccgttaggttatgtgtctggagccttgatttctgatttggaaacggatgttgcagatgatgatgccgacgacgaagaggaagctttagaaatccccaggcccctgagagcactggaccagactcctggatccagcatggacaatctagacagctctgtgacaggtaacggaaccaatttaataggaaaaactgacctattggtaacattaaaatgcatcaaaagtcaactacttccttattgtaagatttattccactccatctatttctgtaacattttaaatgtgttaatattaaatacaaaattcaaaaaggatttggaaatacttttgctttgctgcaaaaatgataagaaaattcatgaattttaaaaagctttaaagacatgaaagaaaactcaattatatctagggctttcatgagaagttcactctactaggaaaccaagtctattacattaaaaaccttgacttttagaaatgatcttttttatatatatcaggaataacatatgaagtgaatgcaatcttaaaatgcttcttgatatttcactctgtaaaatcattcactgatggaaagtaagcacgtctcctgaataagccactttaaggttgcacaaggtattatttttagaatgaagaaaatgtgtagtgagataaaccatatgtttatgcatttcacattgctgcatctagtaaatgcttctcttccaagaaatgcagttattttttctgtttatttctttggcttcctcttgccttgttcatcaaacgaaagagttgcattggtactcttctatgatgatcccaggactaaggtataacctattttcagggatttaaatgtaccaatttttttaaagaaaactttaaatcctaaaatggacacaatgaatttggagaaaactaaaaattcagtctttctattcaaatagatatacactgttggacacacaagaaaatgcctcttacatgactgtgtagaccgagctactacaaactgaagtctggtctctgcatttcactgggtcttctcagaagaccactcatatctgtatttaccgtgatgacatctttcatcctaggagatattttaccacaatcccgcttaattcatttttatgccaacagcttccaaactttcacagattttacacaatgtgttagagttctacaaacactgatgggaactggtttatgacaggataaagcagcatcagcgcctatgattttcctctgtattcctccctgaattactcaatgtgtgatgcatgagcccatttttcagtttttcttcttatccaggggctggtctgcttgccagcctaattaagatttaagagctgcagatacaccgctgtgatttgaaatccagatccaaccgaaggtgacagagcacaagttaaaatcttcaaatgcagagagctgacttattagtgcactattatgttaagcccctttgcctgaatttccagcataatctccttcagggtaaaattctgcatatttttgcatatttcactaatgatactgaactcttttccattaggaatgcagtaacaaattgcaataatgatgaaaaacagtcagctatagtctgtgtagttcttttattaaatattataatgtcaaagatgataaatacgtctataaatcaagagaatgccattttgcacttttacatgctcacctgtgacatgttaggctgcctgatgtgactgcagctcaagcagtctgtatttctcctgtagctagtgtaatgttcattccaaatgaagcttttattgctgagaaaaaaagtctggttttctccttgaattcactgcttaattactgccatatataaaaacctcagggtgtttaagtttgtattccatgatgagtttatcctatgaataatacatctctttagtaaaagaagttgtgttctacacaaaagtagccaaatacaaactcactttttttttcctttctcttccacaataactttgtggagaaggtgtgatcaaagatttaatttgctttctatggtatgtgagtaagtgcttataagtgtgtgtgtgagagagtatgtgttagatgtgtgagtgtattagaacgtgggtgtgggtgcttgtgtagggagtgagtacgtgtataaatgtgtgagagtgtagataaggttgtaagtgtgatatagtgtgtgtgcatgcatgcatgcagacatgtatgagaatagccctgaggtagatgtatatagagactgaatattagagaaatcagcatgccaatgaatgttgttctaacatgcttatgttttcctcagacacttaatgctagtttaatggcgctgaatgaggtggacaataaaacaggcattatttctatgagctttttatgtttttaacatggtaagtgcccatacagtggatgcggatcataccaccagttactttgggttctaaatatatttgtggtgtgaataaattagtcattacctccccctgaaatgctgttagttattttcactttcatgaaactaatgaccattttattaaagagatctaacagttacaggaggcagcatgggttacacagtccctgaaaccctgaaaccaatcagaatattgggttccagtccctgcaactctgaagccaatcagaatattagttcaataacaacactgggatgggctggtaagcctgtatgtaaaattatgcaggattttacttggatatattgcacttcacagctgccacattagggaatatatcagcagttatccagggacagagcccatttttttgtaaagaaataagcatgttaactacaattagttgtttttataacaactaatttgtgagggatctcttaaattttgaaatgatgttctatgagtggaaaaggctaaaaaaaagaagaaaatatcagcagttccatatcccataatctcagtactggataatatgtatatttgcaggtctgctgttaatatttctttcttcctacaacaaacacctatcgaatgcctattacttctaatcacttggctaaaaatttagattcagtaataataataataataggtaacacatatacaacctttacgaagtgcaagccatctttctttctttcttcttttttttttttgtcggagtctcactctatcgccaggctggagtgcagtggcacgatctcggctcactgcaacctatccctctcgggttcaagcgattctcgtgcctcagcctcctgagtaactgggactacagacgcccaccaccatgcccagctgatttttgtatttttagtagagacggggtttcaccatgttgaccaagagggtcttgatctcttgacctcgtgatccatctgcctcggcctcccaaagtgctgggattacaggcgtgagccactgcggccggcccatgcaaggcatctttctaagcagtagcctgtattttgtgtggtctcattagctaagaatggtttttcacatttttgaaagggttgtaggaaaacaagaaactaactaacaaacaaaaactaagaagaatgtatgacagagacagcaaagcctaaaatatttactatctgtcattttacagaaaaaagtttgctgatccctattataaagttttaatgtatattaattcatttgatcctcacaaccctattaatagtattattttcatttaatagattaaaaacagagggttttaaagcctttgtccaggttacccacctgataaatggaagaagaatgttcaaaatcaatcagtcttactctaaagacaaattatcatgatccctgctctggaaacacacaactttcttctaatctgaggaataggtatatttaagaggaaaataatatgctggtttgttgcttcatatgtggaactgagtgtgtgtgtatataaacacacatgaataaatatgtatacaagcacaacatataattttctctctcgaaacattagtcctttttccttatgcatttaatcaagatcaagatattaattttagatgtgacttttgtgattcatttttttcacattcagttctatgtttatttaaagtgacccatgctaacaaaattcaactgtatcagcactttttgcaatgaacctcattttaataattttcattgtaatctatgctcataatgcacacctatttgattgtaataaaatacaacatatttatttattgcagctcattgcactctgtttgggctagaaagtaaacataaaggcttgtttctgtcttcaggaataagcctgtaatttcttcctaaatgccaaaccgttgggtaacggggagggagagggctacaatacttctttctgtaatttccatggcaggagtcaatggtaattgtttcccaaatttcatgacaccaccaggaaaaaagaaacagaaggcagtaggagagagtgcagggggaaaatgccctcaacgtgtagcaaagattctaactgcctcagtgatcacaaaaaggaagactgagattgtgtgctgttcagtgaaacaagtaaaaagtttccttgactgctggaccccacatgaatatcacagctgaaaggaaatcatggctctatattttgtgttacgtttttggaggtttgttgtggaactcccacaacagatcagtatggaaacaatgaaacctggtggcctcaccatctgactcgaccacacagcttttagagcctcggccactaaaatatttgacctgaaactttgcttttctacaaaacttaaaggaaaataagtttagtattagggaaaagttcagggataatgctacagtaatcaaattaatttcttagactacttttacaggtttgatgcctttaaagaacaattaaatgtgtatttcaaaattgaacagataaaaaggggaagtgggatattacacgtgtaatttttatctgagtgaaacaaggtatcaagcatcgtatgtcctaatgaagatatttttaattgcttattttgctttccatatatattacacattccttttctttctttctttttttttctgagatgttgtctcgctctgtcacccaggttggtgtgcagtggcactatctctgttcactgcaacctccgcctcccagattcaagagattctcctgcctcagcctcctgagtagctgggattgcaggctcgggccaccacgctaagctatttttttttttgtatttttagtagatacggggtttcaccatgttggccaagctgttctcaaactcgtgacctcaggtgatctgcccattttagcctcccagagtgctgggattacagatgattacacatccctttctctctgaggcacgcaggtggaattgttgcacattcaatatgtttgagtgaaagaagaagttctgtagatttgacatgtttttctacgtgtaggcaaaggtcaatatttggattaatttgtctaaagacatttgtagctgcagcttttacttaataggtagacaaataacatttaataggaaaagttcatagattaaatattggttgaaaaaatggagaatggctagtttttgtatctcataaaaatggtaatgcaacaattagcagggtcatcttataaagcacagactttagcttaatggatctaaggataagcatttatcagcaaggaaagatttagcataaaatgacatgtaaatgaattgatgactgatcataaattaattttagtgctgaagatgtaatagagacacagcaagatgccactttatcatgatattttactgctcagtaacatctgagcaacaacttaatgtcctatgtgcagtactactttaacagcttgaatacatttgagatttttttttgccttttctgcaatttaaatcagggaaatttggaaagattgaaaatgtaaacacaaataaatttggctatctaacataaattcattgttcattaaatgtttaaatatgtattgattatgtttggggctgaaacatgtcaaattggtatggagtgcttattaatttgtaagaagcctctagccgaattggttttacctggtgttcattttaattttcgtgtttatacttatgtttgtgaaagaaaatcagttatcacaaaagtgacttacttttaaatttgtagattaatgtttttattttcattcattcattatcttttcttctctctctctctttttgtggggggggggtaattgtttacctaaatcttcagctcattgctcttgtttaaatctcaacatttttccttttttcagaaaggccactagacgtaaaatcagtagatgttcaatacattttagccattttacagaaggaattctaacatcttatatactatttgattcatggaatgtggccaaatgtcttttaaaaatatttaccataaatatgcccattccatacatcttaaccaaactgtagaggaagggatgtcgaaaatcccagacagagaggcagagagacaaagagaaggagagagaaaatttctttctatgttccttgccctccgttttgaaggcaaacacaactacactaacgtgagacacttccctctcttcagattgggtcatgagatttcctgttgcccaatatggccaagtatctgtggtcacatatctttaattctgaagtcatctatctagtctctttgctcttacaagaagtacaaaagaaagaatagctgacgttctttctgtatttaccaatactcacttgaagccctggcttccatgtgactctctcttcccagagggagacaaaaagcagcagggaaaacttcatgaataattgggagttttaaggacatacaaggagcattaaaggctgggagaaaggcagagcaaagacacaaaggctggaagtagtccatttgtttagagtatcacaagtgtgtgtgtggaaatgctcggatgaagaactgtcaagttaccacagggagataaacagggttatctgaggcggaaagttaggctgattctctgctaggaggtctcacaggatatcatttctttagtgatgctaccgtggtgtaggatttactggtttcacctgtcaatagctacaccacagtcagttttataggttcagagactaaatgtgtcactatgctagatcctcaggctggaattacacagcaagcagacatagacaggaaacgaaagaaactcaactatttttaggctggttatagtggaaaaagaaaaattttagaaaacaaatcactgggccaagtgcattaagatggataaatgaggatggaaaagttacactccaaagaaacttagctgccacttaatgtaaattttttatcttaatttgaataagatattgctaaatatcaatattcaagtatatcaaagcataaccaatacacatgcatatatatcacatatatgtatactatttatatagtgtcatcatattccttatttaataaactttctaagagttcttataagaaaattctttctatagttaaaataaggacattgctaagaaattacacatcaaataatgtcatacacagaattatagaataatgaaaacgttgaatgcatttaattccatatgcctactgtttattgaatttctaatgtacaatgtcactggacaataaatatgaaaataaacatgaaatagttcctaatctccagaattccattgtctaggagaggaaacacatgtgcagtagaccataatatatagagagaactgatatgcgagtttatgtgtagtgtttggaaaccaaaggaggtagagagattgattctcgctgtaataggacagaatcatggtgataacagaaatggcatttaatttagactttaaagtttgtcagtggttaatagtgttagtggcaatatctctgtctaaagaatgaaggatgatgttacataaatgagcaaggagacacacaggctgtaagagtgaatgaggactaatacacagcaggtatattagtctgttttcacactactgtaaagatattaccggagactgggtaatctacaaacaaaagaggtttaactgactcacagttccacacggctggagaggcctcaggaaacttacaatcatggcagaagacaaaggggcatgtcttacaaggtagcaggagagagagagcaggggaaatgccagagatttatcgaacaaccagttctcatgagaactccctcactatcatgagaacagcatgagggaaaccgcccccatgatccaatcaccccccacaaagtcccccccttgacacatggggattacaattcgagatgaaatttgggtggggatgcagagccaaatcatatcagtaggctagcctagatatggaagggttgcaaatatttaattagaagtttagatatggcattggctagctgggtaaggctttaaacagaggaacacatgtatgtaagtgcttcacaaaaataatgtagaaagcaatgaggaagatagaagagactagagggaaatcaggtaggaggggtttaggagtaaaacaagatgaagattaaagagatgcttatttggaaagtaagagcaggtatttagaaatacaagagcaggcatttagaaatacagaaaacagcacagggaagggactgggagtgaactttcaaatgtttttaaactatcctccgttccagagtttcatattcttttgtgaccccctcactgaatttctttgatttttttcttatctagtatagcattatattgcaaagcctactgcattatttcttctttcattttggatcgttggtccttgacttgtggttattaacccagaaatgattctctcagaagaggctcagtttctggtgttatctcggcttccttgcagtggcctgtgtcaagggaatttgtttgaaaagtaaaaagtgtatctctgtgcttttggcaaccagaatcaaaactctatctttctttgctacacttaacacccttttaacttctccgatcattctaaccagttcagcttctgttttctctgtattgaaagtgcatgaatccgtgtcattgtatcctggcctcttgactaaaattacaaatacagcatcaaggcaacactcctaactattctgttgttgcttaaatattacagaaaaaaattaaatggtctatagcatttgactttcatctcttttatgtaaatatgtatttggtttatttagaaatcttaaattagtttcttacaaatattttttgcccctcttctaacaaatttaggataagcaatacttggtagttttttgtgtcatgaattaatggtataccaacataaatcttgtaatattaattttattaagtaggaggttatgttctcagtctgtttttgtctaagaaaacatataaaattgtaaatgacttgctagaaaattaagaaaaaatgtttctgagtatcctcacaacttacagctctttaaacgtaaaattaaaattattttcctctattctcatgttgcattttgcagaaaaaattcatattaatgctgatgatagtccttataagtgttactttttaatataaatatcagtattaaagagaaaactggagttcttaaataacttaaaaggcaaagtaagcagaaagagcatttaaattaatagaacttctttaaaatacattttttcttatgttctaagttcatttgctttgatattgtttatacattttttgtttgtgaatttttgttgttatttgtaattaagtttaaattttaaaatcttgaaataatttttgcccttttatgatatacagtgtagtttctatgcagattatcattggagtctgcgttaaattcaaaatatattcacactatttcttcaactgagtctttgataagtttaagtacactaagtttgttttactaaaagtgttaatttctgaattatagtaacttaaaatacacatcgcagctctcttttggaaaacgattgtgtaataatttaaacaatgtaagagttgaacagtgcagcacatgctttgcttatgtgctgcaaacagatacaggtttcaaatgagcttcattcttctgcacaaaaaatgtttaaaatgtacatgatacttgcatttggctaaagaaatcatgatgaaacttcaaggaagaagcatggacaacttacttgctcattagtatagtgtgtacaagcagatgagattttcaatatatacaactcactagacaactacatttgtttttaggttcaatggtaaatggatggggctctgcatctgatgaggatcgtaacttttctagtcatagatctagtgtaggtagctcctcagatggctctatctttgccagcggcagttttgcacaagcactggtggcagcagcagataaagctggttttaggctggatggaaccagccttacaagaacaggttggtagactccaagtcaacactctttgcatgagagaatcttgtccttggacactgtcctcttttctcctgttctttctccttagtgagtctgactgtagggctttctttaatacgcatgaatacagtttggatgctccattacccaaactctcttctgatgctagttttgcagagccaagaatagactcctcctcaacactttctcttattttcctttctcttcacggctttactgattaattggaatatgcttcctttttatattacggcaaagcagcaactaagattgccattaaattttcaataacacattttgcaaaatcctcatacaattaataatgtacccagtgattaaaattactcagcttttatctccattactttcctttgcctcatctctttctgcaaatgcattttctgggaaggtttccttagcatggggtgaatgggtctaaggttgtcggtcttaccagttcaaatagcttatgatctttttaattgtttggctagtaagattttaatacaataatttattatttgtcttaaaggatgctaattaaagatacacccactgcatttgcaagttgaataaaataatgactacatgtgtatttctctttagaataatttaattttgatttctgagagtgataagtaatcatataaaagaacaattatataatttttcaagtgctgctcattccacaaaaaagaatgtgggattaataatagatcagtaatttgtaaacttttgcaacaaaataacttaggcatgatgcgtgcttttacatttgtatgtataattcttaactatacatataagaatattctaatatatgaattaaactgaattaccttgcaaagcaaactaataaaacattaagtacatttgcaaaatcttaactgtaatcaaatagtaaagaaaaaagatttttacccttcactaaactctcaggttataaaaatgagtcttggaagttttcttggaattataccatcaatatttcttttaagcatacattagctatctttaagtgaaataaaaaagatcttctaagcattgcagaggtttatttttcaaatagcatccaaactaaaatacgttgtaatagaactgttatttgaattgtcttgcattataaggcataagtctgaaactttatgttgcttgagtgctttttgcagcattagctgtaaacagagcagtgagaacgtgcaaggaaactaatacattagaaggcacaagtgcatttcctgcatgtatgctaatagctaacacagcattaagtaatatcatatcacgtcgtcgtaagaaaatgtaactacatataataatgttgtatgaaatgaaaacatacacaggagaataaatgcatgcacataaaccaggcctctgttactacaataaacatggtattgaaatcataagttgttgaaaatttattagctaaccttttcccagaataaatttccccgtatacctactctaaaccacaagaaaaggacacagcacatatcatttttcaatgagaatttggagcctgctcagatacaataatattaatcagaaaatacctattgcatgctggatatacaaggtgattttaacctgctatcctctacacagatgttgttgagtttctgccaaaagagatagaattcattgtgtatgtggataagtggtaaggtcaatttaatatatgtgtctgagcagacctttcatgtaaaatttcagatgtaattactatatgacatttttctgtgttcagagagattttgtaagtttccaaggatgaaattttattaaacaaatacaacagtatatacttcataaatagcttctttaattttaagaaataaaaactgcatgaatttgcatatatctttgacaatatcaataatattgtcaaggttaaataaaagtataatcatgcaatattgagttgtggattggtggatctgttttatgttcatttgtttgattttgagggggccagtgggggtgttgttagcttattaaaaattgaacaaaatatgtgcagctgagaatgtagaaaatacatttttctacagagatgcaccaatatttggtatcttcatatgttatctctaggtagatttacaggttagtcatagtgcagaaatataggacagaatcagtgtgctataatgtcattctctagaacccattccctttattttcattttaggaaaagcctttacctcctctcaaagacctcgacctaccagcccattttctactgacagtaacaccagtgcagccctgagtcaaagtcagaggcctcggcccactaaaaaacacaagggagggcggatggaccaacaaccagcattgcctcatcgaagggaaggaatgacagatggtaggtttcttccctttactcttgtttcctcgctgaagagacgtgctccatgcaatcatttacttagattaatgtagtcatggtagattagccattgcttcattacataacaagacaaaaacctggcaatatggccttgtttaaataaaacaccatttttaaaaacaatctagaattatttctatattattaagcctcaagaaatacattccatgcaattttttgaggttgatttttttttttttgccattctggcatatttcataaatgctttttagtgagcatttaagagtagggaagaacataagctgcatgtgcacttatatgatcagaacttttatcatattaaattacaatatcttagctgctatttcacttttggaaaaaaagacttttgaaatgatttagtaattttttagtcacaaatttcagagccaaaatcaggctacagtagttgaagagtgtcttagtctgtctgggctgctataaaaaaatagagtcatgcattgtatgacaatgtttcagtcaatgacagactgcatataagacagtggtgccataaggatgtcatactgtatttatgttgtaccttttttgtttaaatatgcaaatatttaccattgtgttataactgcctataacattcggtacagaaacacgctgcacagatttttaccccagatcaatggtatgtagtcagctataccatctatgttcgtgtaaatatactacgtgacacttgcataacaacgaaatcacctaacaccacatttctcagaacttatctccatcattaagtgacatgtgactgtaccataagctggtagattccaaacaacataaattttctccacaaatctggactctgcaaagtccaagatcaaggcattggcagatttggtgtctggtgaggacccactttctggttcatagagggtgccttttcattgtatgatcacatagcggaagggacaaggttctctctggggtgtgttttatagggtgctcatcccttcatgaggactccaccctcatcatcgaatcacctgccaaaggccccacctcccaatatcatcacattggggattaggattttaacgttgaattttgggggtacacaaacatccagactctagaaaagggtcagcaaacttcttctattaaagtctagatagtaaatatctttggcttttgggacatagggtctctgtcacaactactcaacactgccattgttgtatgactgcagctataagaaaagtagaataggccaagcacggtggctcaggcctgtaatcccagcactgtaggaggctgaggcgggcagatcacagggtcagaagatcaaaaccatcctggtcaacatggtgaaaccccctctctactaaaagtacaaaaattagctgggcgtggttgcacgtgcctgtaatcccagctactgaggaggctgaggcaggagaattgcttgaaccagggagtcagaggttgcggtgagctgagatcacaccactgcactccagcctgggcaacagagcaagactccttcttaaaaaaaaaaagaaaaggaagaaggaaaataaaagtagaatgatggaaatgattgacttccaataaaacatcattcacaaaatgggcagtggctggatttggcccatgggccatagtttgctgatctagctcaatatttttatttatatatagcatccaacatttgaatacttgcttaaacactgttagtttcaggaaacacaatattactggaagatatccatgttcgataatgagtatttcattagctttacagaatatagtctatttcccgtatttttaatttaattcttataacttttaaagaatgaattaaaatatgtatcctgaagttatattctaaggatatgtaacacatatttaaagtgtgtagtacaatgtcagattgaaaggtgaatttctttttccttttcagcactgtaccctataagcacacaaacattatcctaacatagttcaattaaacaccaaaaggataaacttttaaaaactgcacattagaaccatctggaaagctcttaaaatataccctagatattcagatttaattattctggggtgaaacccagttacaggtaattttaaagctccacaagtgaatctaaagtataactaccttagagaagctatgacttagtccttagcacacttacacttatcattataggacagaatgaagcttagttgaaaaagaagaaaagcattggttttttattagtttggggaagggagtatccaatcctgcagccctatttgtgctttcttttgtcatcttgcaaaggtaagaggacttaaaaagccaaatatattgttctacatactttccggtttacttatctttcctgcttcctttgttttcaatagaatatgaaggttaagggtagaattgagatttttgagtctctataaatgtgtatcctgtggtgagtaaaaatggtcaccactgcctttctgccttatatgttcagaagattagctgagcatttaaaactattcgtagtgttcatctaattcttcgtaaataaaaaaggactactttcactgaattgctaggtataaatctagtaattgataattttgtatattttttctgttgtgaatattgtggagagagaaaaatgtctaggtatagaattttctgtggtttttcagaaatgtttgaagataatattcagaatatgtggaagatataaaatataaatcaacaaaatacagatctctttttttctaagacacttttattgcaagcttttttagaatgtttccttaaagcaagctacctcctagtttaaagtatgatcaatatattgcttatctttctaaaaaataaatgtttctaaattttcaaaattgccagcatttcaaaaaggggttatggattatgtgttattagaaaatgatacattttagaagtagtgatatagcaaaggaaatttcagcccacatatcttcccaagtgcttaatccaaagccattttaattatgatacagtgcaaagacatttattttggatggtgctctacaggttatccttaagaacattgttattttgcagcaaatgcatatgccatagcatttatatggtatggatccatatgtcagaaataatttcataactttttatgtaaaaatcaagttgttctttttgggaaggctgatacttagcagcattgattgtacagacattttacaataaaccttttgcattatagattttacaacagtgtttgctgttttctaagcagtattgtaaagatgtaggcctttttagcactgggataccatcatttctggatcagacctttatggtttctgaggggaagacagaacatgagtggttgttgggaggttgtaatggcaagtggcacacatcacttctatttcattgaaaacaactctgccacgtggtgtcaaactaactactggggtgagaaagctgccttccctgtgtcccataagagagattatgaatggtgggaaatgtcagtctgtatcccaaagactgaaaaacccacacacatcttaaagagtgttcttctcccttttgtaaagtttctccaaagcaggcattgctgagtccaaatcttgtattccatttgtcttataaatcaaagaatacccttggaagccaatatattaaccaatgctaaaaaagatagatctgtctatccatcaacctgtttctcctagataatttatttccagcctattctccctttcacctagctttttttttttttttttttttttttgagagggagttttgttcctgtcacccaggctggagtgcaatggtgcgatctcagctcactgtaactcccaccttccgggttcaagcgattctcctgcctcagtctcccaagtagctgggattacaggcatccaccaccacacccagcaaattttgtatttttggtaggtagggacagggtttcaccatgagggccaggctagtcttgaacttctgacctgaggctctctgcccacctccacctcccaaagtgccaggattataggcatgagccaccatgcccggcccctttcccctagttcttaatgtcctgttcagagaaggggctctttctcagctctgccacatactagctttggcctttgagcaaataaatttacatattaattaatctattcactcaaatacttattaagtatataacatataatagacaatgggagccaaacagacaaaatcccctgcctttttatattttagttggggaagatagataaagaccaacctaagtacatacatgaacatataagtaagatggtgataaatgttatggggaaaaaacaaagggaagggagttgagaagtataggtgtagggaggaagtatttttaagtagagtgactggggaagtcctcaccaggaagtcagcatttcagaaaagactggaataacataagcaaaaaagtaatgctgatatctgaggaaaggttattccaggaaatgagaatggcaagtgaagcttgagacttatttgataaaaaggaaagggaacgatatgactggagcagagagagaaacaagatagagtacgaagtcaggcaagcaaacaagggctagtgtttgtgagacctttaagctaccataatgacattggctcttactttgaatggtaaaccactggacggggtgtgtatatgtgtgcatgcatgtgtgtgtgtgtaaggcagggaagtgacatgatcttatttgtatattttttaaaaagtcattctattctagctgctgtgttgagatgtactaaatgaggcaaggtggagattgtggaagctacctagggaatagatgacggtggttcataccaaaggagaatcaatggcagtgttaacaaaggttggattttggaggtagagctaacgggagttgttatgaaattaacataggccataaagaaagcaaaccacattactctgaaattttggctaacttgtagaatgtaactgtgaccaactgagagaagaaacactgcagaggaagcattttttttttttttttttttttttttttttttgagacggagtctcgctctatccgccaggctggagtacagtggggcgatctcggctcactgcaagatccgcctcccgggttcacgccattctcctgcctcagcctcccgagtagctgggactaaaggcgcccgccaccacactcgggtaattgtttttgtatttttagtagagacggggtttcactgtgttagccaggatggtctcgatctcttgacctcgtgatccgcccgccttggcctcccaaagtgctgcgatttacaggcgtgagccactgcgcccggccgcatattttatataggatgatctagagctgagttctcatacatgaaatttgagaagctttctgaacacctaagtggaactgtccagtgtagctctggttacatgagtctggagttcatgggaggaaagatccaagctggagatttttaattactttgtgccttcattttcttgtctaaaaacagaaggtaataatggcacctatctcattggactgttgtgtgcctgaaaagagctaatcctcggtaggccagtaagagactttatagtgaattgatttagtggaaatgaatcaacatagaaatgaataataaatttaatttaagtaaatgtatttgattacatacttttatttttcaaaaaaccattcttaatcccatgtctttttccaattagtttatttcagtgtgcatgtaatgtcctttcttaaaatatacaaactccaaggatattacttatgaagctatataattttaggttaaattaaataataatcagaattttagctgcataagcagatgccgttttggccattttaaaaattaagctgctctgatgcagaataaaaatcaatgacaagataagttattttggaagaaaatacaataatttctcctcactggcagtctaagttcaatcaatcaaatgaaataattaatttgcatttataataacatatagtgaaggaagtcagtactatcgaatataaaggaaacaccaaactcattggattatccaacaaacagatatctcaatattggattagctcttcattttggaaaaatattccaaatgcaactttatcctccgaaacagagaccctgttcccttcagttattagcaattcataatttaacatgaggacatacgtaagaactggcaatgctgctccaacttaggaactcagaggagatgctccagagaccaacattatcagtccaatgcagattagtatcactttgctcataaaagagagtataaaggttcttgaagtttttgaaaggagcggcttagctgactgttaaggaagctatcttttgtctacaagaaatttatactttttccttctaaatttcacaaacagaatattattagagacaacagaatacatttacaaaaatggcatcagaaataattgaatacattgtgtacaatatcttctattaatgaaataaatgtatattttatatgatatttggtctttatgaaaaaataatataattaccaatattctaaggatgaacaaagaagtttacaatagcatgcaagaaaaatgagaagaaaatgatacaaattgatgttcagaagatttcaaaatcttcagcaaagtaatttcagaactaatacatacttaaaagagaaagaaagaactgtgatttcacagtcgaaggcatacaaaatataaaggtattatgatctgaagagttaataaaagagagatgaaaagggagttgatattggaaccttaaattttttcctatctgatatttactttaaagagcttttctgaaaaattatctcttctactctatctcaaatttctgtgaggcattgtcttctctagcaccataaaacacattcagtctttactctgaacattggttattacttattaaaattaatacatcggaagattgtaatatattagttgtaactcattagctaactcatgaaacgaacagccagaattggttgtcaagcagaatattaattgcatttaataaatgttagtttaatgttgttaaatgtgccacatacatgggtaaaggcagtcatatgttgcatatgacacggcatacagttctaaatttcccgagggtgacattccctttggagattggcaggagagcttttgttcttggggccttttgttagtacagcttcaggaatttctagtgatcttattttgtgtcatggtatttctactttggggaaggagggttggacaatggatggaatataaacaatgaactgccctttacaccttgaatgatagcctcaatatgtaactgaaaacactttccacatttaactgttgaataaaactagtcaattttgtttcaatgatgctatggccaaaagacagcagagagagcaataatatgagctttggaaataaataattgacttttattttccccaaattttttttgtatgggtaatacctgtataagggcaaagattttcttcaacttgaactaaaacctgtatttttcattaaattttagtccattctaaacattattcaaaatttttagatcttccaccaccaccagatcccccgccaggtcagggtttaaggcagcaaataggcccgagccagcaggctggtaacgtggaaaactcagcagagagaaaaggaagctctctagagagacaacatgcatccagcttagaagacacaaagagctcattggattgtccagctagaacctccctagagtggcagcgacaaacccaggaatggataagctccacagaacgacaagaagatatacggaaagccccacacaaacaaggtgtcggatcaggtgtgttctgcacagtcccaagaaagtgtggactgttaccatttcttttcctaccaggtattctagaaatggcagttgtttaagggcatctgaaaaacatttgccttcaatcgtaatggaatttggaattccttaggagattttaccagtacatgccttaaggctgattccaacgggcattgctcctcagtcagcctctccacagggtctttgatcccaagagacttccaggcttcatctaaacggctcagtagaaaattttattttttggcctattaatgtttatattgagtactttaaagatcgctaaatttaatcttttctgtcagtttaatctctgccttcagcaagtttgttcattttggctgaaataaccagtcattcgaaaggagaactcacatcaaatatgtgaattcattaaaattacaaagttgcagaaaaatgcccaatcacagatcctcaaattagataaggttatactgggcttgcactttctccaactgttaatcagttgattgatttagttggttgttaatctgtctatgggaaatgctcttttttataaatcaagcttcctggaaatgtcacagaaataaatttcattgtttgtagttagatttttttggggggagaggtgtggcgcgggaggtggggagcctgctttataaacgcattttctgagacatctcatgtcaggattcattgagtactgaaacacacacatacacatacacacaatctttgaaaaaatgtcttttcacttattcatttggacttaatgtgttgtagataggcctctccatgcatttcccataactacattttgtcacaacttggtgctcaagtttttggaaaatgtcatttgtgcaagggccagtagatgacaattttaatatctaggtttagtgaaacatttagaaaggttacaccattcaggctgtgagagaaaaatcatgtggttcttgtcattgaagactatgtaaggggagaaatagtaaattcagtgagcattaatcacaaaataatagcccatacatagaaagaacgtgaaagacagaggggatggggtgtggagagggagcaatgagaatagagagggaaagaaaaaacaatttttgaactattgagtgattatttgtaacatatgtcatgagttatttgtagagagacaatctgtaaaaaaaaaaaattagcatattatttatttaaatgtgtgagtttctcttttacttttaaggaaatacatagccctttaaataatgtatttctgtctcaaaaagcaacataaattttaaaagcttatttaactaatatatagttctttatctaaatcaattgagaaaatgttgccataatttaagctgaaacaaaaaacatgtttctttaatcttaatgggaaaattaaattggagcctcattgaactttagaaattattctcagatatgcttttgttaaactgtagttcattgtatgcagctctcttttataatgaatttaaattttgcaaataatatataacattgtgtacttatcccaagatctcttttaatttaattctgctttggttcctattgtaggaaatgttgcttgcacatagaaatttctttaatatccggtcctgattaaacttcataattttaattttattaaagaatgaaatggtaaagtaggccattcacagtgttatattcaagagttaagtttagtttgcctccatgtttctgttcaatttagcctttgggttttttttctttttcagaggaggccttggtgccctatagcaagcccagtttcccatctccaggtggccacagctcatcaggaacagcttcttctaagggatccactggacctaggaaaaccgaggtgttgagagcaggccaccagcgcaatgccagcgaccttcttgacataggatatatgggctccaacagtcaaggacagtttacaggtgaattatgtaagtgcttaggtcatttaaaaggctatcgtgattcagaaagaatcttgggttaataacattgccacattaaacaaatttcagattaatagaaaacttgctctgttacaaaaacaatcaattgcaattttcaacaagtttggtcataacttaggccattgctatatttattgaagtccatttttataaatgtttctgctatttcacgttggatttatgctataaaaattgttttaagttaggcaagtagtcttaacacttatacatgaaattaaatatagagtgtttatcattttctttgcctttttaactgaacacaataaagaaatggagacactggccttttggtagttttaaagaaactcctaaggaatgcttcattttcaagttactctatatttattttttaaatttgggtagtcacccttgaagagttgatctttgattgttaattaaattgtaatgttttgactacaataacattttataaataaatttccatttatgaatgaaaactggcataggtagttagtacaattaattttctaaatgtaaaatactaggtaatagggaaaattaagaatgtcacagcaaaaaatgttgaactccttgtgttaatttcctcaggaaagttaccaatacagctttgcattatcagaaacatatttgctgaatatttttaactgcctcatcagaaaaatagcattaccattatcttcacatcacagattgtttggaagattctgtgagatgatgaaaagagaaataatttcaaaattataaatttctttattgatctcagttgtcattgttgttgactattgctaatctattattaagattcatttataattttaatttgattcataactacttgaatttttctttaacttttttttgaagtaatgacagactcacaggagtaccaaaatagttctactgggtgtttacatttccaaattctatagtgttttctttccttttactctttgatcatctccttcaagtaaaattacttaaattcacaaactcatctatctgaagaccttattttcattgattatctgttggctttgctttttgttatgctggtcagaaaagcagaatgcttaatttatattttatttctacttttttctctttctttagagtaaatgagaggagacatacaaagctgctctgaaggaccatcaggtccggactcatggaagtgatgactctaaacagtgcaatgaacaatttatttatgtactattaaaagaactgtaaatgcaatgtaaagacacacagccacacatatcccacagatattttcattgtgttcttctcttaagtacaccacccaccttaactctttcttgtcaggagtatataaaaaagaaagaaaacaaaactcgccctacaggaagaaaaggattctcctctgtatataatttcttttgtgcattgctatgcaagctcactctttttagctctgctcatattattgtctgttcttattggtctgttgtactatatgtgaattaataggctgtggtgccatatattaacttttaattgtgtaacttttatgtttaaattttgcactgcaattttatttggtgataagcacaaatctctactcctcatgacatgaagaaaaagactgaatgtgaagggagtttctgtactgtaagctagattggataatgatggctgtaacaaatcatgttagatggttttcagttggggtgtagaaataggaagatgcaaaggaacaatggtgttggcaaagtcttctttgaatatcagggactgagtcaataaaaaaaatagtagaaaggtggcttttactattgacaaaagccggggtcaaaaaaagtagtttaagtcttaagactgaatatgcattaaagtatgcaggtagcaaagatgtaataaatttgcttaaaaaaagaaattaaagttttatttagaatcaattttacctgtcattgtaattgacccatctgagaattacaataagcaagaggaaattaaggtgttttgcaagagctgtatttatattacagttttttaaaaacattttctgaattatcgtaattaagctctccaactcgttaagtcagaatataatatgaagttccccaaggaaacgaacaaaatgaactctagaatatctagcaaatagttaaagaagcaatttattattagggcatactcgggctgtttc

SEQ ID NO: 115 - DNA, 258573 bp, Homo sapiens
gagttactcttgcatttggcaattaaagatgatgtttccatggaaacagttgatcctgctttcattcattggctgcttaggaggtaaaaaaaaatcctatattttctaagttgaggttagaagtatactcgagtcatatgcttacataatttttagatgttgaaataaaactccaccagtagcaaagaaaaacaaatgtttttcctcccaaaaggaaaatttaaattctctaatctgataattgggttcttattccttcccttatttttgtaagccatttttatttccatagcaaatataatgacatctgatattacagatctactgtaatattatgctttggtattatgaatataacatcaaatttgagcatgttaatttgtgacattttttttccaaaggaacttaaagaggtgagatctcacatacaaaggagcatataaatttaaaaagtgctggtattttcatatgttttacttttagcaaataacttatctaaaggaccaaaactgaatatagatacaattttattttttaattttggaaaatttgaaatttagaataaagtagaaagaaaaaatgaaaaaaaattatcgtctttgacacatacaaaagcaactattacaaatcatttgttgtattttcttttgttaattttattttattttctggagaaataagtaagtgaagagtttttttaaaatagtgtatatataactaactttttgtttattttattttgttttccctctttttatgatattctcaagcaccaaaaaagctgaaacaataatacaatgaatgaatacatctgtaggtattattgagatgtagctattgtaccattttactgtatttcttctgtatatatgtgtgtgaatgtgtgctttttccttttttttttatctgtctacttattttggctaacccatttgaaagtaagtcataaaaagcattactcctaaaatttaatactcatctccttagaagaccacttttctacataaacataatttcttcatgatacctgaggaacctaagaaaaaagtagcttgagacttttctaaaagaagaaaatgagtgcggaatgaggccaaatggagtagtcaggtaaaacacatgttatttaaagacatgaatagattggaatagacttttaggctcttatgtcaaagttcaaacatgcttcaaatatttacatgataatatatagcaaaaatccataatcaataatagttacagattaaaatctttaacttttaaaagaaagaggttttttgtagtttttacagatttttactgtgatgcctcaattttgttcctaaaacattttcattgactgctactcatcaagtactgaggacaaaaagaatagttgtttaaaaatttctgactttcaaatgggctttggaaaaagttcaatatggtaaaatattttattcttggagtcttttcttcatttataaagtttcaaatataatctctgttttaggaaaaggagcaaaagtgacacaaaatgtactgcagcagtattactgtttatgatatgaaattttgtaaaagcaatgttgaaattttccaaatagttgaggagacattcacagaaagacatactcagaaagaggaagacatgtttagaaagtagaaaggcagcaaaagaaaatgagatcagcttttaaaaggtttcacatttttagttgtaattttacattatgtgaaatttgtattgtgtttcagcatttttgagaaatgttttacatatttacgaacaaatatatagaaaaagcagtgtccactttagtaagatgtgaagacatcataaagaatttaaaggtcaacttattctctagatatggtggtaaaacgttataaggatttgtaagggagaattggattaatttacatgtgacaaattatatgtaattatatatatttgcacatatatgtagatatgtttccatgtgtgtgtaattatacatgcaaatatatgtaatgtatggacccctgaactttatattttcctctttagggaattagaaaggcagtggaggcctatgtccatataaatatacacttaagcctattataattgagactacagatcatactatatgagagaatttagattaccttcatgaaattattttttaaaaattatcaatactatagtgaaggataaaagacatggtcaccaaacaggaacaatggcttactttagtattgtagatttagtcatggacaacatatgcccacaaaattcacatatttgggctgcttgttttcacagtgatagttgcagtgtatgcaaatacagcctaagactgctgacacacatcttcaaatgctttcaatcatagcattcttccattctatgtcatgcaaatgtgaatgaatttctgtactagtcttcccttaatagtgattaaggaatgctttgaaagcaaaataaacttttcaagttcttcctgaaatgattgaggagtattttccatttggtgggtttaataacaccactcttaaaatcactgagaaaatgatcaagaatgcctctggactgcagttaatctcaaagcagatttggaactttgtgagtttgtggtgttggatgtggcacttcgagtaagcaattgccataaactcaagtggctgtcatttcttctgtagtatttgtacacagtgtaatatgatttgatagcattgatactggtggaatggagatgtcactgatccctgcatataaatcttgacatcctccatgtttttacagaaaaacttatttcaaatcatcccctctattgcagcagactaaatcttgaattgcttttcatttataccatttaaatcttgacagtttatcagagtacgcatgtgagaatcagtaaaagatgcagacactgttggtgtattttgttcttataaccttgatcattgattactccgcatattggatattttgtaagctgcatggtgactaagaaggcatgtggggaacttaaaaaatatattgcaagtgctattagagttcaacaaacatttaaggttaaatacaacccacaattttattttgttcttaaaatagcagtctcaaaagtatctgttggttagttaactgactcctgcaaataaagtgctcactcaaatgaatttaattgactgttgcctaagtgttaagctgtcttaaagtactcatcacataaaagtgtttttaaatacccctgagtaggaagtctgttgaaagcaaaagaatggaagctggtatattcacaaggggtgggtatcattgcaggagatcaggatagggaggtgtttgcctggtgacagcaacagaggagaaggtttaaggatgaagtatggagaattaaatgaaaggggcaggctggaacctagggtgaagtgggagagcttacaaaagattgaacagagatgtggaaggatctctagtgcagcaggatgtcatggaaattgaggaagcagttcaggaaaagggagaggtggaagaagaggatgtctgaggaaaagccactgaggcttgtgagtaggaagccttgaattactggaatgtagggctttaaggggggaagaaaatacattgaggtccgtaatactttgataaaactgaattatacttactgacatgtacacatgtatacagttgaccctagcacaatatgggtgttagtgttactgaacggacagttcagtaaatgaaccgtttgctttcctggtgcagtaaagccaaacatccacaccaaggctttgcagtgggagaaaggagagtgtttatttgcaggcagccaagcaaggagaattggtcagctcacacttaagacctgatctcctcagtggcttataagcaagagtttttaaaggtagtgataagtttcagaaaagcagaagttaaaggccagatcgtaagtcagcacatgcaggttatacattggtttggcctaaaaaggtgggtatcttgaagcaagaggagagggaggttacaggtccctctcctagatggattctggctctctaatttgagtttggttaagaaagtgaagctttgtctaaaaacttggagtcaggagaaaggactgttaaggtctggcctgtgggcatgacttcctctggggccctcaggaagaaatttagaagcaggaactgtggccagggttcagtcctcatttcccccttatctgaggtctataggccagaggttccatttggtaaaggtcccttttactgaaaaacagctcagggatatatattaacatgttgtctttagtttctagaggagccagacatcttgtgactccaacttccttggatattgttttaagctattactatgttcttacttaccaagttgctcatttacttatcagggctagctcagcgcctggaatttccgttgaaggaactcaagatttttctttacttctatgcttgggaaggcctggcaggcccctaagaaggatctctgccccatctcaataggtgtgttgaccatccccccaagtatgaaaatctatgtataacttttaactcccccaaaacttaactgttatacttagagcctactgttgaccagaagtcttaccaataaaatagtcaattaacacatatttggtatgttatgtgtattatattctgtattcttacagtaaagtaagctagaaaaaagacaatgttattaagaaaattataaggaagagaaaatgtagttactattcattaagtggaagtggatcatcctaaaggtcttcatcctcattgtcttcacattgagtagactggggaggaagaagaagaaggggggttgctcttgctgtctcagtggtggcagaggcaaaagaaaatccatgcaaatgtggacttgtgcaattcaaagctgtgtagttcagaagtcaactgtatttacatgcatatctgtgtgcattccaggcctgcccatgttgtagatggcacagtgagatctagagcatttcaggtacttgttcaaagtcacatagcttgttattgactcagtagagctttttctagactgcctgaattttcatctagggggttttcagctgcactaagcctttcatctgtatggtgtgttgtacattcttctacagaaaagaaccaagtggttcctccttggtggtgggtaagagagactgttgatacttatcagcgattgggagatagatgtgtgtgtgcacaaagacctgggtgtgcactgagaggagttgaggagagttgtcttttgaaaatatctctgaagattttcaactaataagtgttctcaaggtgaaaagccttaagtgaatggtcaaacgctgaacttcccaggaaggttgggttgctgaaaggaaaatgatttctttcagatagagctgcttctaagtcaaacaaaacttgagggttcattgagatcaactggctaggaatttccttgacatgccaactggcttagtgaatcagaatttcattcacagtgtagatatttgatatgttcaagccctggctgctatgttgacctaccttgtttttccctcttgaagactgtacactgctctttcggaatgaatagtgaacacatactaatggtttcttgcgtcaaataattcttgctgatttatttcacccactactgagtatttgggagactgggtccttaaacaggatgtgtatttcctttatagtatgtgtatgccatcttgccaataatgatatgagtttgatggtatgaaaatgctcaccagtgtggaaagaggccatttcctcatgattatcagttgccagtcattgtcttgaagcttgcatacaagtaatgaccactatcacttgaccatcttcagaggtgggccctgtgtgaggtattttacatatgtttttctgtaattctcatttcaactgtgcagtgtctatctcccacatactttctatgttctgtttcctctgagttttaaaaattttctttttgcttgatataacattcagactctatggagtgaaaaatcctgtggggtatcccttgagggtcccttcctctattaactagaggacttttccagtgtttattcttttcaaacttcccacatacccaactccctccccacatccagaaattcaaagcttgaacataagaaaatattcatttctaaggaccatttctacattctgtattacttttgaggcacaattctaactcgaaaaatggttgcatattttaatttgagaactggcagagctcactgctcttgttttgttaggcctaagttgctgtgtgttttctcttttcccacagataggtatgtaaaacaatttattttcacttctctgcattttgcttcctttgaatatcaaccaatactaagtctgagacaatgcatagtgaaagaactctgtggttacaaatctaacactggatactattttaaatagagatattttgcatttaaaattattttgcaagaactatatgcagtagagaaaaatcaagttacacatgcatccctacatatataagcatctggttgtgtaattggatgaaactatgggagaagatagagtcattttatcttttatggtattattcttatcattttaaagcagtgtcacgttaatgaacaacttttagaagttatttgccaactgtggtagggaaaagtatagcccagatattttcctaaggtggctgattgtgtaatggttgccagttttttcatttgccctaagaccaactaataatggctacaaaaacatcatattaatttctttgaagaatgtacagtgaaatggcaaatgacttctagaaatggagagattgttagaatttatttctctatcagtagataaatacataaatgaagattattcaacatcctttttattgattccttggtctgtcaaattgttgacaattattggagcatattatcactaccattgcattacaaattcagttgtccaattttgtatcattgtgatctcactatgcacatgtgatttcatgttagacggttaaggctgaaatattggtgaatatgacatctttcctcaatgttctattagttttgaaaaaataacactttattaaatattaaacactgatttttggttatactacattgttgatatttatcacttgaaaagaaggaaaataataaacctgatgttgaccaaaaaaaaaaaagtcaaaaaaattctgtacccctagctggccattagacttcccaatgtgtttccaacttctgcttggcaactaaggaagtaagcaagtcttggcatttgacttattactttctctttataccatctgggcttactttatttataggactaggggtgacaaaagtaatattcctacctgtcactttaataggaggcaatttattcctcttaactacaaggacagttcaaaacaaactttttgcacaggctgacctgggcctcagctagtggtgagtgccctcgtgaaactatatctttttaggaagctgctctttttttttttttggactgctcggacagccattgaagatccagcccttatttgtggaagctcttgagggctagttatgggggtgtgaaatggtgtgttaacacatgaaaccatattccctgaactttgtgactgtttggtttctttatctggacagctttctagtgtctgctgacctgagagagtggaatatgtaggctgccattttataaatggctctggttagttactcattgtttattctaaccatgtgtacattatttgctcctccaatcttataagcagggaggttgtggtgaaagctgctattggctgaacttaaggcatcaggcaactctgggatcagttgctgccattgtgacattgattggtgtcacttgtggacatggaagcactggtacgattaaagttttagtccaaaagcacgtgaatcctgggaatagtcttttccttttttactttgttcatggcaacatcattcattctgtcttgttctgaaaacttttttgatttaaagggcagtctgagtatgtcacccagtaagtaaagggagatggcaacatttgtgtgtttttacgttagccttaagctttagagctcctagattttgtctccaaataagtttttcattattaaatttttagtggatattaaaataccttgcatgacttcttcactctatggcaaaatagaacttttcattcttatcccatgagtgtgtgtgagcaaatgtctgcacacttgcaagcgatatttaagctcagacatatgtacaaaacgagagaagtggtattaagtggagcataattatgtagataattatgaagcattgactgttgaacagtgtactgtgtgggtttctgagtgaacatctattttttcattaaggaataattttactgcagtatatacaaggccacaaatgacatgtttctttctttctttttttttttttttttttttttgcttgattatgcagccaaacaaatgagaatactcagtgctatggccattatttctattataggagaaaataaataacagtataaaagaatctaatgttttttttctgcctcatggggtttttgaaagctctttgctgcttattttgttgagtttcccattgatattgctttggtgagtaattatttgaagaaggggtagaaagtaaatacttgctggagaattgtctctcaatgagaactgatccagtgggcattatactgattcccccttttccccctctttttgaagttactaccttccacagattaataggaaccttttgtctcagacttaatacttgcatttatttgctcaaaccagataactgaacacaggtaccagtattcacaactaccatgaagataacgacaattccatcctatttttcaggccatgtatataggaggctatagtgaataaaatcccatagtagactgcttcccataaattatgattcctcagtcagaggtaattaaaagtttgatgcaatgctaagtaaacaatatgcaataataatatcaaataacatttattgcattgccactgctgcaatgaaaaaatactgcttatctttgcatcaaaaatcctatattatagatatcattcccatataacagtagagaattcagtggctcagagagcttaaatgacttgcctaaagctaaatggaatattaatgggaaaaaaaatcatgtttattgtggtccagagtcactgttcctcctagtagacatgatctttcctaaagctggggtcagcagaatttttcataacatgcgctagatagtaaatattctcagctttgtgggccatgtagtctctgtcataactactcaactctgcccttgtaatgtgtaaaacagctatagacaatatataaacaagtcagtgtggctgtgttccaataacattttatttatggacattaaaattcaaattttatataattttcacgttatgaaatgttcctttgtttgtttttagagacaggggtctcacttcatcacccaagctgaagtgtagtggtaagatcatagttcactataaccttgaacacctgggcccagcaatcccctggcttcagccctcccaagtagctgggactacaggcacaccaccacgccaggctaatttatttatttatttatcttacttcttgtagagatgtgttgaattgaatttctgataaagtggtattatacttagatgtaccttcaagactttatgccttgaaggataaagggcaaaaatattccaggaggaagaatgacataaatcaatccaagatatgttatttgataaatcaacttattttgcaagtaattatatgtgaatttcttgctgacatccatggatgtcttactccctgtagggctgtagtctatgaatatggaaattgtgctctgtcaatatggaactgctgaattgaagattgctagacctttgattttttgtttgtaagaaggtgaaatttgactttaggcctaaatctctggatttttttttaaatgaagccattcaatttaaaggaagtgttttctcccctcctgaaattctttgatccaaatttaagaagtgttcaagatagatttggcccaatagccaccatcgtgcagctctgcaaacctaaattcccagtatctatgataggtcatatacgtatcatatgattgtagaatttgtgatttgcaaaaacttgaaaaaaacaaactagcccaggttctatctgaaaagcagacccaaagctcaaactgagattaagggaccgagatgtggaatgtgtccaggcagccagcaggtgactgatttgaatcctaactttggaagatttagattaaagtaagaattgcttgttgattacttgttaactaaattcatagcttgcataaatgatttctcatagatttggggatattttgccaaaagatacattccgtaggaatagtaaggcctttgcaaatgctgacccttcctgaaggtaactttaaccacagtaaacattcttagagatttgagtaagtgaaacaccaagcagaactcagcatttttgttttgttttgttttaatgtcttaggcagctgttactttcaaacaagtcattaaaatgcagaaaagggactttagttcagcactctgaggtttgcaaaagattactgttagggtgctattgctgttgaaagtgctatttttgtatgtactttcgtgaagctagtcctgtcttgtacctgtactgatggtactcagaagggtgtgcacggggtgtagatgatcaagaatctgcaaactgcctaacagaaataactgcctctgtaaggacacagtgaagatgtttcatgagagtcatagacacattcactgaattcgcttccgttatatgttcatatttttatataatatattgtgttatagttggatgcataaattacagttggagttaagtgaatctgattagggtggtctcaggaaagtctgaagtctttctgtgatcagctgtaacattttgtaaattaaaaccatctgcaatgatgcttaagtaaacacacctacagacccagggagattcccagacaattgctaatttactaagttttcatatatatatatatgaaaacttatatatatgtatatatatgtatataaaataggtatgctaagaggttagaagaagtgtgtgttaaatatggtcactatcttctgaaagtataaagcccggggatgagggtgataagagtgaaaaacaagtacatgtaatatattataggataatgatgttgtgatgagtaaaatacacaaacattgttctaggaattcagaatgaggaacgattactacaagggagataatgagggaggatgaatgaaagaattgagagcagagtttcctcagacttccttacacaatttggtggcttctcatacatactgccaaatgcttcttccaaaacggtggtaccaaaaaagtatagagagattccggtttaactcatcctctccagccctgtgggttacttatttataatctgtgccattattaaggaaagcaataggaattaaaaggaagccgggcacagtggctcatgcctgtaacccagcactttgggaagccaaggtgggtggatcacgaggtcaggagtttgagaccagcctggccaacatggcgaaaccccgtctctactaaaaatacaaaaattagttgggcatgatggcgtgtgcccgtaatcccagatactcaggaggctgaggcaggagaattgcttgaactcgggatgtggaggttgcatcactgcactccagcctgggcaacagagcgagaccccatgtcaaaaaaaaaaaaaaaaaagaaaggaaaggagcaccacttttttattcagagtgcttaatagtcacttagaattaggtgatttagcaaatgcaaagtgtgtaatactgggcctagcatcccatgtttattttccctccacaggttgacattttagaatgtgcatgtgtttattaactaagaatatataatgaagagggattttgttccatactgtatagctctaagaaacaatgcttctgaaaacaaaataaaatatgtttttgtttgccaacatttttggcaatacacagtatttctcttctccctgaggctacagaggtagcagttcagtagatttgaggagggctctcttgtctttactgtatcttgggcccagtgatactctttcaatttttaagatgcttatactttttcttacattgccaaggttggtttcattcctaagaaaaggaaatgaaagaaatatcttgcagttgtcacccattccctcctaaaataatctggggcactggtggcaggagagaaggtttctagaccaaagcttatcaaattggggataagaacccattgatgttgtgatgatatgaacatagtagtagtttatgtctagcatttttaaaagtaggataaagcacatcagatggaatagaatagagtagaatagaatataaaggaaaaaagttaacagtccagcatgcagtaaggattaatattatttgaagaaatctttttatcagttgtatgtttactttatcagttgtatgtttatcagttgtatgcttactgtgtctacaattaatcatgatgataattacatttttaattgtgaatcaattaaaaataagtttaacaaatgtaagcctaggcaactctaagacataccccaatctccgcaccccatagttccagatgcattttggggaaagttgttgtaatagtccattttcatactgctattaagaactgccagagactggtaatttataaagagaagaggcctaattgaatcacatggctgaggaggcctcaggaaacttacaatcatggcagaaggcaaagaagcagcaaggcatttcttcacacggtgtcaggaaggagaagagccgagcaaagggagaagagtctcttataaaaccttcagatctcatgagaactcactcactatcactagaacagcatggggaaactgtccgcataattcagttacctcaacacatggggattatggggattacaattcaagatgagatttgggtggagacacaaagcctactcatatcagttatcctttctgttctgcttccttagaccttcatatcttaccccacaacccaactcaatccctctcagtagtctggaagtataaaatcaggatcctcacttaagaaaagaaacagggaggccaggcgcggtggctcatgcctataatcctagcactttgggaggccgaggcgaatggattgcctgagctcaggagtttgagaccagcctgggcaacacagggaaacccagtctctactaaaatacagaaagttagccgggtgtggcagctggcacctataatcccagctactcaggaggctgaggcagaagaattgctagaagccgggaggcagaggttgcagtgagtcaagattgggccactgcactgcagcctgcgtgacagaacaagactctttcttaaaaaaaaaaaaaaaaaaaaaaagaaagaaagaaagaaaagaaaaagaaacagggagggagaagtagatggtgtttatacactcagacatttacaaacacagtgctggcttctgcttactatggtgggggcagtaatagagtatgctcttttctactttatgagattacagctgtaaaatactacaaaatacaatcactaagtcgtattagttcttttttttttttttcttagagatggggtctcactctgttgcccaggctggagtgcagtggtgtgttcatggctcactgcagttgcaaactcctgggcccaagtgatcctcccatctcagcctcttgagtaactgggactataggcatgcactactgcgccccactaattgttatttatttatagagatggagtcttgctatgtttcccaggcttgtcttgaactcttggcttcctatgatcctcctgccttggcctcccaaagtgctgtgattatagatgtgagccagcacaccaggcctagtattagttcttaatagcttctccattacaactaatttacaaaaggaattcttcattggataattatttgctcatagaaacagtgaccttgaactagtttgatatgaaacattctttctaagatacataaagggaattgtgtctggtcctaactggccttgacctgaaccctttgttaaagaatagaaactgttagaaataatgggttccataatagaaatgaaatcatctctattaaaacctttgaaagtaatgtgttaaagaaatattttaaaaagagttgattaatgcactcttttcatgtggtgagtgagaaccttgtgaatttgcacatttcaaaaatgtacaataagtataatagaaagagggaatgtaagtgttgtttttttttttttttcagataaatggaccattgactgtgttctcctggtgtattgtacacattgcatattgcatccaacaatggcattctaacttttttttttaatcatgtggggttgctattaagctgtctagcaagaaaggtataattatgttctgagaattatagaaggatgtcatggaggttcaaaaacattaaagctcacattcataaaaagaaaatagcatgaatttaaatacagaaagctatgaagtactttgaaaacattttaatctcccaagactccaacccatctcctcccaccctgtttttctgccaaaaacattatgtcctgcgctataactataaattaaccctttcattcaactataaagaacatttcaacaagcaaaaatatagccattggagttaaacagtatcaacataaaacactgggcacttttagaagtactctcaagtcctcttcttttatggaattatagtacagactaatgttaatcagtccagtgaaatagatcatacctttaaatcaaactctgcgattaatttatgaaagcaaagtgccaaaatcaagatacttaaccttaaacacaaaccattttgtacatatatttttatatgtgtggacatttttgtgtttccttaggcaggttgcaattagaggatgaatgcaattcctggtaaaatctccatgctttgaaagggctctgccattcctgcgagcagtattattttacttgaacatttatttctaggtcctgtgaagcttaaccagtccctctcagttccaattccctaattattgaatgccacttcccatgcaatgagaaaaatcatgtagtgaactattaatttctcaatttaaagggttttcatcacttttattggtgttattttgctatcatactccagctgcatgctatactctagcactttttcttttaacttaattgcttgctaacatttccagatgtggaaaacagacacattagttattcctaataagtattttattttcctttctgatctgaagtgtattatattacctttttctttttttctagagcattggttacagtatagcttttagctgcaggtgacaaaatgcattagaggtttatttttccaacacatgatgtttggaattatgtggttcatgttggttcaggaactcaaagatgtgagagctctgggttgccttttctgtaacatattgtgtgtatgtgtggtgtgtgtgtgtgtgtgtgtgtatttatgcacatatataaatatatattttatacacacacacacacacacacacacgtatagtgttctccctcatggtgtccacttggtcgcagtagttcccagcattctttcctcatatgaaaatttccatatcaaaaaggaagcaaagcaaggtcagcattttatttacttcaaaacaaaatcagagtagagacttttatctagaagttcttagcaggttaacccattgttaaaggttgaatcgtgctgctaccccaccctcatccccaattcacatgttggagtcttgaactccagtaccctattatttgaaaatagggtcattgctaatgtcattagttaagatgaggtcattagtgtgggccctcatccattatgactggtgcccatatgaaaaaaggggaaatttggacacagagacacacataaagggaagatgatatgaagagagatacagggagaagatagccatctacaagccaagcagagaggtctggaacagatccttctctcacaaccctcagaagaaatcaaccctgctaacaccttgatacagactttcagccccctgaactgtgagacaaaaaattctgttttggaagccacccagtctgtggtactttgttatagcaaccctagaaaatgaatacaccctcttgggcttttagtggtctcataagccaatctcccctggctacccttcttcccagccgagaatgacaaagagttgtggaaagtatctctggagctttcagtctccacagtgaaaggctgactctaagggctggaaagaagggccggtgatagctattgagtggactaccagcagcatctgccacagccagtttttcacatgtggcacatgtctggcattcagatatttgttaaagaaatgaaatattctaagatcgaatactttgtcttcctctgacattggaagcatataaatggaattttattttggtcttgtttctttggcattttccagctttaaactaccattgccaaaatagaagatatctcatttctaaaaaaagtttccatcttttaaaagttttttcctaaagaatagtgggacctagaatatagatcttatttcattggcggcatatgattttactttctttgacccaggctagagctcattctgtttgggattgatgccttgtaagtgcacggaatattcctttctaaatttatgtcctcttacattctgtctttaattgcattgcctacccttacaccctgttgtgatttaccctgtgttttgaaatgcactgctagtttttgttttccatgtagatatgacataaatcagtaaggaaaaacagtatgtgctttcctgttccctaggaatttcagataccatcattgtcttttaggaatctcatttcttttagtagagtgatgcagcttgcccagaatcccttgtctatgttttctttgtcagtcttcataaaaattgtatagagtatgaccattagaattgatcgtctgcggtttgatcttttacatgacattaccttaggagctcataaagcttgtacttacattcaaaggcagttattccttgttgcctgtaggtgttaggggggaaaaataacaccttaggattggatttttggacttattagtcctgttcggaagtctgatatgccccttattttaggatgtacatttaaaatggagctttggaaccaggctagcatgtcaaaaaaatgcccctgtcacaaaaagtaaagtttagcgtcaatccgaatgttacgttgaatccattagttaggcaaaaggcccccttctgttttcagacagggtgctttttactggttatgaatagctgtgtgaatagtcaaggctctgtctttttgaggatcaaaattcattttgaagaaaatgttggataatttcttttagattagcagagacttcagaatctcttccttttaagtttatattgctggcaagagactagaacatgaaacccagcatctctcatcacctatttcattcccgtgaagcaagattgagaggccttgtctcttttctgagtatgaagcatgcactgacctgtcacgtttgattattattttgtacttactttttaagaggcgtcagaggctcccaaatggctgctgatggcctgaaagcctttaggagccttaaatttcagagatggcagatatgtgcctcataggccattaactccagcgccatcaggaaatactgaagttgaaaaagcaggctgttggttaattttcacctctgaccatattgagaacagtgtggcttcatggaaagggaaacaaaccaagaatatgaggactagggttgatatcaggtctttcaccaagaaactctgttactatggtcaggtcatttaacctttctaggcctcacttctggggaggccaaaccacgtgcaaggtgagaagatgagctctgaaattaaaatcttagctttatcaatcactagctgtaaaatagtatctgcctcatatagagttattatgaggattgtttcattcatcttattcattctacagacagatattgaatatctactgtgttctaagagctgagtatacagcaatgaattcgatacaaataaataacaaacacatgcataaacatgcgtagtgtttatgtagaaagatctcgtaaggttgtgagatgtgctttgatatctgtgactggtggaaatgaagggtgtataatgactttggatgagggagaatgcggatggtcacatttaagctgagaaggtgacatttatgctaaattctgaatgacaaaaagaaaccagaacacaaggagaacaaatgtgtcagcccagaagtgacacgaagctcagcgtgtctgagaagcaggaacaagagcagtgtggctggacctcagagatcaggagctggggtcaggggagattgaaataggagaagcaaaggatgtaaatagctgcttagtgtgcctggcacatagttcatggtgcctggttcaataaatgttagcaaattagtagttattatccttctctcaaaaggatctcagaagaaaatgctcctagtagtttaacatttttatttaaaattaatagtgacctctggagaagccatgtagcatcgtttgggacatgacttttattagataatgataggatgggcatttgagtttttattgtgaccacttagaggaaattttttgaacacctctctttgcctttttcgtttaaaccactgctttcttatctctactaacctttcttcttttggtttatctccccaactttcctgttatttccaaatttataccattatgttaatgcattattgctttcaagctgtacaaacatcagaatttgtcagaaaaaaatgatgctatcccatctcataaataatgaaatatatgttatcagaagtaaatcagaagctattacactagaaaaatgttaggaaatgttcactatatttacaaatatttgtaaaaagacatcacaaatattttcgactttctaggacaataaattcaattaatagaacagaatggcatttttgtttttacttattatttctattcagtgaattggttgaggggcaaaaatgaagaaaatagcaatattgcctcttttaaattaggagtgttagtagcaattttaaaatccatttcttctggaagttgctctttcctaaaaagggaaacggaagctttttttttttcctttggcaatttcccctgatagatgaaagtaatgatcaggtaaagatcagagactaagggggatagcaagctgctttctcaaaggatggtggggattagtaagggctaattgtgtggtgatgtcgtggtgcaaagttgccccgagtcagctgagctgtgagcttgcccttacttctaacagtctttgagtttaagaagtttctaaactatcctcatttttgataatttgctaaaaggacttacaaacgttgctgaaaactgttatactcacagttatgttatttacagggaaaggatccatactaaaatcagctagaggaagacacacatggggcagagtctggaaggtttcaaacgcacagcttttattgaccacaggacatctgacccttccggtatcgatgtgtgacaatactcaaggagtatgatagccaaccaggaactcgttgagcctccgtgtctagagttatttattgagaccttattatgtaggtgtgactgactggttgcacatgtggttgagctcagtctccacgtcatttgataccacgtgacccaaatttctcacccttaatcacatggttagtctgtctgatgtggccagtttccaaggcaagactattgggtgtggctggccccaccctaagatctagtgtggccagtccccatcctaaacagacatttcaatcagctatggcacagatttcctcctggaagctgagggcaaagatcagacctagggtaaggccaaattccttacataaagagtgagagagtatccctgcacggactgtggaatccattattctagaatatgtgttttacattctgcaatgctgtgtgaacttgctcatgccgcctaaccactcttaggcacagcatttgtcttctgttgggaataattatggcatttacctcacagaatattctgaggattaatgaacacatttgggcatgcagaatttactttagaatttcagctttagcagctgctatttttatcatttcaatgattattttaatcatattgttactttattgttgttacacttatgataaatatttttattaatgtaaactgctattcgaagtagccaaaatgccagttcattgttttagggccttttttgctgcttcttgatctcgttttctttgtctgacttttcacggattctttgtctcttagtctgtttattcattctctgagttaatagaaactcctctgtaattttgctgagcattccaagcaaaataggaaagtaaagagcttttttttttttttgggcgaatttgtttgttttcagaaatgctatggcaaagattatacaactgcagtcccataagcatttggtggtggcattatcttgttcttttttaaacacgtagtacaatagagagatttgtttttttttctctatgtggaaattctcctcagagcatgttcaagttctcttagccaaagtagaaacatctttaaaaagacgcctgttcagtgctgtatctttctcttcaatttgctagtaataaaatggacatcccaccaaaatattgagtgtttttattccaactagaaaaataacattatcaagcttaaggtttgcatgccaagccgattttatgaaaatactcaggtgttgaattcattttgaattcagctttagtttggcaaaaaggctatgacaagaaagacttggtgtaatagtttattcaccaatctacacttagatgtagtttgttgtaataaaaagtaattgctgcggtatgaaatgatcttaatatggcaatatttttcataccaacgttagttctcatagaggtggtactatgctgttgagtgggttaattgatttcctttaacaaaacaatgtctacagagcattttgctttgtatgcaaatggagcagtactagaatttttagttccttgttttcttcaatactggaatgtaactttttacaatgccttttactgattattattttttggatgtctcccacccatataggtgagcttctcttacaaggccctgtatttatcaaagaacccagcaacagcattttccctgttggttcagaagataaaaaaataactttgcattgtgaagcaagaggcaatccatcacctcattacaggtacagtgaaaagtttgaaaattcaaataaaaaaaactaaacacacttatgtggtgattgtgaatttttttttgcttcaatatatttatgccatcagtaagaaaaaaatacgtgaagctatagttgtatgatatattcaacagatttaatatatgaagatttaaatctatatgtagcatatacttgattaattattgatcatggcagaatccctaaagtaaataatgtcttttcattgatgtatagtgcagtttaatttataaacttggatttacatgtacttgtcaagaacacattcattgtggggatgaaattgtgttttaaagttaatttgaaatcatagttaaacaaatacttctgtgtgccaccttttgtccgtttaccattttactggatatgtgcttggaggttcaataagtaaggaagaataaaatgtattcttaccaaagtcattttaatgatttttgaagagaaaacgtatttcatttgttagatgtatatcaagttaaagtctatatttttaagattatataaacaattgctcttcactgaaaactttcaaatatcatgcaaagtataaggaaaaaagaaaaaaaaatccatactcccaccaccttaagaaaaaaatattgatattttggggatgatgatggattatttggatcagatgggtatttgtattattaaataacccaggattaatcatttttactcttaggagtgcttgggagacccactttcatgaagagatgaattatttataaattacatgctgcattcttataagtggttgaaagaaagtattcaagacacctttaaaacaacacgctctttcatgcaatgtgaacatctactatgaaaaccccattcacactattagttttcttgacaaaaccttttctataatctgcagaacaagcaaacttcagccagtattaataaaattttaaatgtttagagttgtaatttagatcttattgagcctctattgttctcttaaactatataaataattgaagccaatagtcattggtaaactgggtcaagattggggtagaaggtaggttttgtatttttgcatctggaagtaatcaagatcagtctctttcaacaatatttaacaacatatttattggggccctattgtgtacttcaacaaaataagcattataattccaggttactgattagagttggcaaagatgagaaaaagtttttctctgcctctacctctttctatagaaataagaaagttatttaataaaatcatttataaaaggaagaaactatttcatgaactagttccattaatcagacataagcatatgcaacatctggaaatattttcttcttatggggaaagttgaacagatcagcttaacaatatttttttccagcatttttgtaaggcattctaacaccttttaaatgcatctgtttgtttctccctgaaatgaaagattattctcatagacatagctgtaaatatgataaagcagccatgtgaatgactcatgtgtgggctgtttttctgttgtcagtaaagttgtatttcctggtgtttatcttacgaataatttggtgataaatgtgttcacctgaaaagttgtcaagatacaagatttagtcatataggaatgtatttctaaatgaatagattaattatgtttgtatagttttatcaaatagccaaaggtcttgagcttagatatccaaaaataaccttgtgtagtaattatgtctttaaataacaggtgcctattgtaatgccatggagtctgtatttaaatatattgataacatgtaaaatgttgataaagaagtttcactgtttgcatagtgattcttgttttattatacgtcctgggatgtcatcctggcatttatatgttgcaattttaacaaaatctgttactgagactaggagatgtgtgatttgggctgatttattagttttaggtttgataaatgaagaaatttaacatgtttggtattgtttgatgatttttggtttgtagccaaatagagcagatactttccttataactttaaaaattttctaaaattaagatttctaaccaatataaaatttcacttaaactaaaagtttatgaccactagaaattgagacctagaaaacacaagagaagctcgtttcattctaagaaatatcagactctgttttaagaagaaacaaccccttgttattcatgttatctgagtaagaaatagattgtgccactgcagtaaatgggatatggaataatgtgggttgtaatgacaaatttgtctttttagatgacatctttatttttggcctatttttttcctaccttttaattttaatattcagctaggcaatatttcacattattctttaaaatggttcagaataaaatatgcttgcctattcctatttttttattgtccttcaaaaatcacaaataaatactctaaatatataatgacatcgaggacataaaaaggaagaatatggtggatctttttacatgaagtcagaaaaagtattttttaacatatataatcataaatataagcagatagagagacagccaaggaggaatattaaggagccatgtgaaaccacttgttaaaggcaatccaaacatgtttttaaggattcagaataaagttaaagaatcttgtaaaagaatgtcctttgaaagaccaaatcctgccttatagactgatgccaacttgtctgaagagtgatcttgtctttgtttttatcccatcaggtaaaaagaactcttaattggccatgttggaaatccaaaagttcagaaattctcaagagaaattactcgtcttagggtttaattgaggattttattctttcttttgcagttccctgcctgagccccaaagcctatatttaaaggttaattagtattcaatctcattgtaactgctgatagtgctgaaggaggttaccctgaggaagtattaatactttttctaaatgggaaatattttcttccactttttatggggttagaaatgtccaatcaactaatgctaagatgaaagaccacaaataggagaatccctggtcgctgctgctgatgccatttaaaggggccacttgtttcagtgagattggggtaaaataggtacatgccaacagggaccaggcaaataacaactttgaaagaggaaggcctgcctgaagaacatatagacatattgaataatgactggaaactgtctatcattcaaccctaagcctatcattatgtgatcataactgcttctcagcactggccaattgttaccatctaggaatcctggtccggtattaccaaagctttctaagagagttttacaatttagatattttcattttggaatctctaactttactgttaactctgtttttcttttaaaacataatgtagaccaaaaaaggtaagtcgtaagtctgaatgtggcccatgtgggccttgtgtttccaacttttagtctagctcaagacttagaggtttgctgtccaatatggtagccagtaatcacatgtggcccttgaaatttaaatcaattaagttaaattaaaaattcagttgttcagtcacagaagcttcatttcaagtgcttggtagccacgtgtggctagttgccactgtatttgacagtacagatgaatatgtccaggcttgcagaatgtttcaggtcgacccctgggcccacaactcttttctataaatgctttcatttttctctcttcacaaggaagtaaacagaacgttattctctttcagctctataggaacaggtaaacaattttaatagagtgtaaggaatcttggatacagaagttgtaagggctaaatatcattgcaaagtggaggtctttcctggccacagttgcccttaaacatggttgtctataatggagtcacatcctgcacatatttaatttactgatagtcaactgaatgcatttaatttactgatagtcaactaaatgcattcagtataagaaagaaagggaaaataaaataatgtgctaaattctgctaaccatttattcaaggagtggatgtaaggaagggaagtctgagtttatttcttgtctatatattgacacagtaatatatatctaggcacacagagtactatacatagtactgtatttggtgctatatgtatatatacacacactatgtgtatgctgtcaattctatatacatatagtgttccatttttagaatatatagtacatatatagtatatgtgctatatgctagtctatcataatatagcatatatatgacattttaagcataattttgattatatgcaatttgtcctttacatatttcttattgctatgtaagatctgatatcattgttattttacttttatgtgtcaagacgagttattgttcctctaaattattttggcacttaaagaaatgaaatcctttttgtcagatttataagtccagatctctgtgttcatgctcaagttcaactcctttccacatcctggcttctccagctggtgagctctggtccccacacccacaatcagccacatttgagagtaatcaaatagccacatggtggaatgaagacaaaacataaacacactaaagaatatctacagtgcctgaggcaaacagaggtagatacacctcttactgggcaacttaaacttggttgcactatcatctctcctaggaagcgttcttgacatccttagtgctggattctgtgctcaaacaatgtgcccaaccgttgcattgcattacctatatgataaagcttatcaaaatgaagtcagattgccctagtaggctgtaactcctttaaaagtgaagacacctttaacggtgaagtgtgtccttcattcttacattccaaatgcctagcaaaatagtgaatgcctaattagtggcatcaacaaagtggtataaaggtaaaaaggtggaaaacaaataatggaatttgggattgtattatatttcaggagtcaataatatcatgaaggatcacagggtcagaagttgttaatagttgattctgtaagatattcttaaatttgtactgagtcttattttttggctccatttaaagacaaattgccttgaggtgacaaagatggctgcctggaactccaggctactcatttcttctgcaaaatgtcaactggaagagtagagtatctttctaataaatgtcatcaaaaactccaaatggtgtcagaaaaatgtgaaataaaaatgaagctaatcctgtcagtagtcaatacccagcagagacataaaggttagattttagatattaaaggtgatagtataacaaaataaatcatatcctttttttgtttctctttcttgtgttttttcagtggggcaaggggaatggatgtacacgtattgatcaaacacaagctaaatcagttgggtcacattcacattcttaagcaatcggtaaggttgagccatggaatgttctgactggccaggccaggttcgtatgaggagggctgctttaaaggagaatagaggagctgctaccaggaaaagctaagatggctgcagggaaggcaataagggaaaacatctgtaacactccttgaaataattttaagagaatccctgattgatatgaaccaggttagaaccatggaaagtgaacagttgtttttaatcccaatgtggctctctaatctgttttatgtttttatgtatgttcaaaatttatcgatgagtgagaaatgggaatctatatcataaaacacattttaaacattcaattttttaaaaaaacagcatggcaactttaactcatttaggtctttagcaattattgctgaagtctaactagttatttttggataaagtattgaatatgcaaattcagacattcattctttcgaaggctgcaattattctcatcacttcagtaaacatattaacaaacattgcatttgaacacagacacatttgcttattaacttgaaagctgcatctaaaaccacaaattgcttctgtgattaaatttctaattttcctgtcaaaccccaaataaagtattgcctgttgatttaacaagtgtttagtgtgggcatatttcctaaacccaaatcccagacccccccaaattttcgtaagttattttgttcttttcgcgttggttcatgctgaagtttaaaatgcaacgtttgtttctctctagaatgttgtttgtatgtccattgtccagaccagatcttgtgtgacagagtagatattctgaaagacaatagctttatataatcaactgtgaggtgaattctatttggggtttattttttaaactacttaaagtcggttttgttagcttcaatttcaagttgtgatattgcctagccttattagcaagttcaaatggaagacacaatttagagcctgctgctttaaattatagcaatgacaacatagatctgtgtttatattcattattgttattccatatgctagtgtggttttgtgaaaaggttgccatttctgataatacctaatatgttaaataataataactagtaagataaaggaaaataatgatgtattaattccctctatctttaagattgtttattggcaatatggatgaccacagtccgtgaagactatgcggaggttagtaatggctagggtagaaaatagaattagattgctttattcaagaaacttctattagtccctgtcatgtacaaaatatgatgcctgatggtagaaattcaacagtgattgaaatagtcattatccagtggagtttacatactttgaaaagcaccttttgactcttagaatttaggcttttttactgatttaactcattattatacaaatttgtgtttacaggcacacacatacacacacacacacattcgttttctttctgtctctcaaacatagtttgttctttgtgttggaaggcagtgatttttataccctcagccactgatgttttagtttatttcctgaaagtgacaatgaaagtttttatcatttaggagtaataactaccagttttgaaataactcctatgtcaggtatattatgctttctattcaggaatcaaaaattgttggcctcagggcatgcagctgttttaaggaaattgtattcaaattcatttataggtggaaatctgctttagactccaccattatattttattaggcttggtccagttctctcagacactaccttttctagccagtgtccctgttgtgtgtagagaatgtaactaagatttaaaagaaggggattgatcaaagatacgctcccttaagtaggccagtaacccaggacttctaattccagtaccccaaatatttctctctgattattgactgagacacaagttcacatagaaccttcacacaaaccagtttaagaggatgaaagctcattgagaattactagatttgtgaaatatgagtaataaatcatttctcacttgtgattctaaaagcagattctaatttgtgtaaaatgagtgtttgaacactgaaggctgacactgaacttgtaggatcattcaagtgtgttacaacatgataattatgcaacagtgtttaatcttgtgacatttaccaccaagctgaagctacaaggctactctgcttctggagcacaatgtaaatgttatatgattgaaatgctggggtgtgtagccccaagagacacgaggttgtcttcttttgttccagatcactgcattaagccttttggaatgggatttgggtatacaaatatacttttatgaagttttacataattttcatatttcaaaaagatttcattctgatacttagagttcctggtgaacttttaaattccttggtaaaagtagaaatttgtaatttttacaaagaattatgaatatgcagaaccaaaaggcaatgtttactactaaaagcttcccaaatttatgacctgagtgtgccatttacctgtcacagcttactactgaatgtttgaatgttgtgttcatgaagcccagacagttggattacagtttcctgcaaagaaaatgagtctaatttgaagatttattggacacatactttgtaaaagaaggagctgaacctgcgtatcccttcaagttttttttgtttgtttgttttttgttttttgttttttgagacaggatctggttctgttgccaacactggagtgcagtggtgccatctcagctggcagcaacttccatcttccaggcttaagccctctcaccttagtctcccgagtagctgggactacaagcacatgccatcacacctggctaattttcacattttttttttgtaaagatggtttctccgtgttgcccaggctggtctcaaactactggctccaagagatcttcccagcttggcctcccaaagtactaggattacaggcatgagccactgtgcctggcccttattattcatttcttacatgaatgaaaatactagacatacttagaaatcagtcccaaatatgagtattttgcattgggaacttacatatactagtttgtttctcaggataaaatattaatatctgttggcagcttaggcccagagattacttgcacatttcagagtttaaacaaagacaccccttttgagctcacatattttcagcaagaggaaaaacaatcagtgtttaataagatattgagaaattttatataacctggggtgagttccatttaatgatgaatagtattaggcaggagaaaaataattatattgctttgttaaaagaaaattaacattcttctggttatggcaagtatattttagctctaaagagtttactaacgtgaatacactaatactttgggaacatatttaaaaatgcaggaacatattttaaaaataatagtctttgccttttcatatagtgaaataatctagagattgtgtctgtatgatgaagaccgaactaaaggaagtgagaagcgtttgtgtgtaatggaacaaatctttctccttttgattcttcagtcaaaacataaggatgatagttttacatcttggacacctaatgaaataaagtatattccagcatactttatggtttcttaaatctttccatctgttaaatatgtaagaataagtgcttctccatatttttttatctttaaaattttccatatagccactgtaccttgattattcttcagctaaacagaaaaacacaattttcaaatgaagccatcaggcatgcttagtcaggccataaacattctaagtcctgagctaaaaagtgttttttcctataaaaactgctcttcttagataagataaactcaagtgccctttgtcatgagagtctttccttcaaaagtgtttgaacttaactgcatcttttctgatttgggtttagaggagcttttcccgctgcaagcatttagtcacttagtaactgagaaatctcttacagcttaaaaattaaacccacccacttgtgatttactgtcagatgtattctttaaaagtcaatgtcagtatgtattctcatcccactttttgctgacatctcagggcaggtaccaatgtcatccagccataggtggaagacatagtctgttccatgtaaaaggagaggactaaaagcattcaatcgaacatagaaccaacatgtgcttgatgggaatggaacagaagagaagcaaaggggacagatgggtttgcagcctttgatgggacctcctcccatactaaccatgatatttgcccgtttgttgaatgccttccctgtggaagcactgagctgagagctttgcatacattgtctgaataaatttgaagagcaatcctatgggatagatggcattctctccattttatatgttaaaagcttaggttcaggggtgttaggtaattttccatggtcatgcagtgggtgtcaggtgagtccaactgataaaccaatgagcagttggtaccaaatcccatttcttttcattatgctgttggttgaaaggcatgactaaggcctggggattaggcggaggggtgggggtgggaacagaaactaggaaactaggggaaaaaatctaaaaaatgtgagcttcatgaagtcagggaccttttaccacaacttcagaacatagaaaattgcccagtatagacacttcataaatgtttttttactgattgggaagaagggagggagagaggaagggaggaagggaggaagggaaggaagaaaagaaagaagggagggagggaggaagggaaggggaggagggagggaagggctttctaatcggttgttgaatatgaaataggctaaattaaaagtgagcagttcttttctgcttgtgtctactgtaggcagtccatggttacttgttggggatggtctagatcagttcttctcaaacttgaatatgcatattagtcactgggaaatcttaagatgcagattctgactcagtagatatggtttagggccatagattctgcgtctccaacagactctcatggggtgataatgctggcctgcagaccatattgtgtttcagagtattcacaaggagtgtgaatggatactttttctttattttacttgcttttctgaatttctgtagttctaggacttgggatggaataagatgaaagaaggtttatgagtgctcccagttcaaattcaaaccttaagggtagacttaaaatcaaaatgagacatagtgacacaaatgttcatgagatatggacttgatttgggaaggataataagagagtttactttgcaaataaaccaaacaaaaaccaatagcagaaatctgccgtaaatgaaaaagatgttgcagatttttctttctaattttgttccagttcaaaagagaagagttggaatggaacctccagtttattctcttaatttcatttgggtcttcttattaaaaatgttgctttaagacctgaggaggtcatatgtgaaggaaaacagaaaaagtgagaaagccttgatttttaaaattagcaaatgataaaataaactttgagcagtaaggattaaacttataaactcacccattttctttactactcagtcattaaaacttcattatgcattatttcagatatagaaaatgatacagacatacaatagggcataatgataaacatccatataattacttcttaatttaagaactaaaaccaaaaaagctaaatttcctactctctctccatgagagctttaaaataccttaaagttgaagtttatggccgggtgcagtggctcactcctgtaatctcagcactttgggaggccgagctgggcggatcacgaggtcaggagatcgagaccatcctggctaacacggtgaaaccctgtctctactaaaaatacaaaaaaattagccaggcgtggtgtcgggcgcctgtagtcccagctactctggaggctgaggcaggagaatggcgtgagctcaggaggcagagcttgccgtgagctgagatcgcaccacctacactccagcctgggagacagagggagactctgtctcaaacaaaaaaaaagttgaggtttataattttcataccttttaaaatacacttagtacataattaataattatgtaatattgatgtattacactatataattatacagtataattatatataaatatataaaataattatgtataatgattatatattttaatgtattatacattataatgtaagtgtattttaaaagatctgaaaattataaacgtcaactgtattttaaaacttcacataaatggtatctaactgaattttttaatttacctttttatgcaccattgcttgagtcagccatgtttataaaagtggcccattttcacagttgtgtaatattccatttaactttatgcacttgtatttgagatgatgttcacatttcatctctttatatgttttctcaacatatgtgcaggttaaatattgtatatattaaagcaacaatttttagatggcccataacatcattgaagaactctgagctggaattcaagtaggtgccactcctgatcccaccaattaatagttttggggacagttgtcaactcacatggttgctttattaaaatcattatctataaaatgggcattatagttttcatttttggcaaattattataaaaataattgatatgaccattgttataatatgctacaatttacagaactgatggcagtgtaattttattataaaaattgggtcatctaggagctgggtgccctgttttttacggtaatgtgttcttgagattgtgggatatgaatgagtatttaaaggtgaagtactgtgatatgtcaagcatacttactgtttaaaaactttcagcttaaaacctcttatttaaaaaccagcttctctcttcatttatctttaggcttctcgttgataaatatggctctggggttagtgcctttaccttttccgaccccctaggtagtgtttatggtcatttaccacagtgtaccattttgtaaatagcactgtaatggcttaaaaaagtggagaatgcctcggggacaggtatttacccagacaaattgaaatggatagttgagcacttacccaattaatttattaaatgtgctcagtcaatctggataaatcaaagaaatgtgctgttttcttccttcattgtcagcaggaccttggcctaaagtatctgagataattatctcaactttctacttcatctttgcctatacagacctagcctaatttttccccagtgaacaaatgaaatcattcccacctcctaagaaacctttaaaaactttaactgctagatgctactctgttatactttctactgtgctttaacttttcgtttctgataaatacttgggcatatttgatcttcagttatgtaacacttgaataatatatgtatcactttttacttttgagggataatgtttaaagtagattttataatggagagccttcttttaagttaaaaatactaaggggggggaaccttgatatttgttttacagatggcagctgaatggaagtgatattgatatgagtatggaacatcgttataagttgaatggaggaaatcttgtggttattaatcccaacagaaattgggatacaggaacttaccaatgttttgcaacaaattcacttggaacaattgtcagcagagaagccaaacttcagtttgcctgtaagtttatgttcacatgtctagcaaatccaacattagaaaatatgtaacttaatttgtgtagtcgttttggatttcagaaataatacatgggttttattaattcagtaaatagactgagaaagcaattcagtatgatttttggacattttatagtgttcaaatcagagctttaaatgtgtgtgtgtgtgtatgtctgtgtgtatgctggtgtgcatgtgtgcatgtaggggtgtgtgtgtgtgtgtgtgtgtgctctattttagtatttcacaaggattctgtttagggaacagaaaagaatgcagttgaggatatttttattgagcagctactatgtgcattttactgtggaaaaaaatgcgaaagaattgtcagagatggtccttgcttttgaagaacttttagaaaattccatctgacaaacctgaaaatattaaggaagaaagactgtcagaacaagaagaagttaccatatgtggtgacatgttgttgactcctctggggtcttatcacagatgacctcacaaattaccctcagcacagctcccactgacgcctgggctctgggagccattttgtaccatgttatttggacctaggtgggcacatagcccaacctgagaaagtcacatgctttctctaggaaatttggacttggacccagaggctcaatttattttttatctttgcttattttctcttttttttttttctttttattagtctctctttattttagttgtgtattttgtacataatgcatatcatgattaccttggttctgagatttcttgtagttattcacacctcaataattctgaaattgcaatgcatgtgttcttataatgaggtagtattctttctgttttccccataaactttttattaaattaatgatgggtcatttaatgtctagcctattcttttgctttctattttaacaatggcaagggttggctttgcttgtgccattatattctgtgtgttctgtttttcatatttattttgttctttcctttgttttctctttatttctttctgtaggcaaaatattttttacttgtatcttctctgcatattttgaaagctatatgtgatgtttatattatacaactagttacccttaagttaactaaagtactttgtatatatttctctaatagacagaatttaagtttattttttcagagtttctctgttttaaacaaagagtttggtttcctttttcctcttgagctatattttgcaggtttagtgcaatttccatggttgatttaaattatgttattttaatgtatataggaatatatatatatgtttggatatgtataaatatatatgtaatagtcttctcatagataattgtgtatgtgcatatagttgttaactagaattttggcaaaatctatgatgtatccatgttttacctggcattactgccaactactagacctcttcttatttttatattcttatttcttaaaatttctcaataaattttaaaatatttgtaacatttactatgttacattaaaaaattcaagtatgtttcatgctttttcattttaaggaatgtcatcatattcccttgaaagtgaggacatcatttggttgataataaatgttgagtcttggagctgtttaacagagaattccgagtgttttgctctgttgtcttctggaactagtgctgctgaggagaggaaggtggccaggctaatttctggttttggggagttcaccaccaccccttgtattttggggttcgcttggttgtatattggaggattattttttcttcatctttctagtttaaaacatatagatttccagcatatagctaagtttaggttattttaatttactttgcttagaacttgaaaaattccttttttgtacttatacattttgtatacagttcaggagagtttccttttatatattttagttttatgttcaatttatattttcaaatggcatgatcatctatattggatttctttttttgtgtcccattctttgaaattcttttcatctcagcctgttctttcctatgacttcctgttcctgattcatatttttgtattctttttgtattcttttgaagatacagtcagttttctgaaatgctatttatgatcttagaggcagggtttcctccaccgcttccatttggtgtttctatttttatgcttaagtatgttcaataggttctaaaacaaatcttgtctaaactcagtctttgtctacaagatggtgttggtggactacccaggccctgcagtctttgccctgtgaagagtggcagatgagcaattcgcagcctaattccttgtttctaggagtcattcctcttataaagtgatacatacattcctctagtgatgtttttctactatggattcttaatttcatacctgataacatatgaagaaatataataaacttacaggtatttcctcagtcagcccctcctgaaaagtatgacttgtaagagaaaaaaagaatacgacatgtatgacaaaatacctctaaaattatctttcacctcttgcagtctgcccctagttcttggccagcactttatatgggcagagtggggtgaagttgttgaatgagggatgggattttaatctatttaggagctaacaagctagtcttactgtttcatggaggctggaagaagacatgaggctcccaggtcagtgactaaggactttattattcttagaacataaagcatcatgaggttcagcatgtttgattgagttccccttaactccaagtcccacagagaaatgcaaaaaggttagggtagatactgcacccatctatgggaaacactgggcttagataatccatctcttttacagcaaacagtaagcaagcctggtccttgtcccagagggagacattaccttatccccccaggttgctctctgcaaacacatccctgagatgagagcatggcaatgagcagttagaccattcattccttcttggcacacccagcaaaaacttgcaagagagcccagagcacgtggaagattgcctctcccaatagaaattattcattttctttgtttggtactgtccttgagtttctgagttggggtgcaccatatgaggatacataaggtgagtgaagtacatactattttcctacctttattataattctccctttcgtaaagcaaacctaagatgtaacattgaataccttaggtttccccccagtctgtccccctctgctttacaagttttatttattccctatatattgacatttgattgcttagctgtgttgctgtacagtgaaattatattttttgttttgttctgcatttttggtgtttttctaagtgttttatttggaagttacaagaagcaacattgggtattcttcacctgacaccacattggactggaaagataaaaaatgttgtttaatattcatgtggttgggacatagatttctgataaaaaaccaaagaagatgagaaaagaagtagaagataattactatatgagtaattccaaattattagctacagtagagcattgctttaacttcatagccttgaagaaaaagttatacgctaactgaaagaagggattagaatggagacccttgtattagtaggatgctcatgacttcagaggaatcttaactgtctttgctgcaggcaaatggatgttcaagtgctgtcattgaaaaatgttctctctaattgttcaatttagctgtgtctcttctcttgactatgttgtatatttatatgattagccataacttctttgtttctctcagctatggagaaagtacttctgtgtccttcatgggtaaatgagtaaatgaaaatatggttgatgctccacttttaacactagtgaaaaactaaagagattctatcttaatgttcgagtggcttgaaaatagtggttgtgataaaatgaaagtgaaaaggccatacatctgatatgtttaccctggattttatagattccctttatcacatatttatcagctagtttagtttttataatgaatgatttattattttaaattcccttcttagttttactgggatagtgatgccgtctttctttaatatgttaatatggtgaacatttactagtattaggtgaccttctattcctgggttagtttcaagttggagtttatgcagttttaaaaaaatacttggatgttagctgtttgctaatattttctgtagtacttttgcctatttatccttttctggctatccttttttggctttactttcaaagttattttcacctctaaaagtgacctggagattattccttattttttctgttcactagaaaatgtcgagaaatattggaattatcatttccttgaaaaaagtatgtaacttaggcttggagttttctttgaggaaatgttttacctactcattgaatgtattgagtattatttctttgtgataagttgtattttttccaggaattttatccatttcatttatgttttctaatatactagtaaaaaatgtttcaaaagttttaaaattatttttctcatttctgctttatctagacatatatttaattttctcttataaatattatcttggtacacttttaaaatataatttgttagaatttgatgttattattcctcactttcaaatttctacactctgtttcattcatttttctcttatctttattgttcttccaaagttgttgtattttttatagttcttttcaaattacttaacttgtatggttaacttattcttttctatactttattctcttctgatataaatttgtatggttttaaattttcctgaaagtacagttttagctgtattcaaagaattagacatatagcaaatttgttctgtttcagttcagtaaatgttataatttcattatgattttctttgatttgtgagttatcagacgtgacatgtattttaaatttccaaacatgtggagttttactagtcatcttttgatactgatttctaacctagtatcccattgaccagagaatggactgtaagatattaattcttggaaattgttgatatttttcctgtggcccaacatatgattagtttttttaataaatgattcatatgtccttaaaaaaatggatattctctaaatactgggtatggtgttctccatatgttcattgggttaaatttgttaattatgttgctcaaatcacctatatcattactgatgcctaatctatcatttttctctcacattgatgatggcttttttagtttctcctggtatttctatttaaactgtatgtatttagtcaattatttgtgtctaaaaatttagagtgactgtatttttttgtcaacaagtggtgacactatcttcaatagagcattttgccttctagtttatatggtaatatattaatattgttatattaatacggtctgatttttatgttcttttttttctttcttcctttcacgtggattggttgaactactttctccctgaaaagcactggatgttatacatcctacttattttcttatagtaacttccctagaaattttagtatctatgtttaacaaaatctaaagttaatcaatatctccaacaatgaggattataatgttttaaatagtatagcccacctagagaaccctatactatttttgctgaatatttttgctgaatttttaaccctgtgaattagacattagtgctaatgtttcgtttatcttctagatcagaaatagtgtgagcatgtacaaacatctatatttttttatttttaaggaaaacatcaagcttttgtccatattttctctatttttcctttttagaagaaactgctttcaacattttcactgtctcttttggtatttatctaaatttgtgtgaataacttgcctatattgccgcttactgatttttttttccagttttaagtattactgttgactgttaactatgccagctgatgctacaacactctcctaccaccaccttaccaccacagcaatatgatgttgcattattatgaggcttacaaaatccataaattttaagccataattcttacaaaatacgtaaagataaaaagtcaaatgcacactgcatttcactgaatgtgccacaactggatagagtccccagtgatcacaagacagtttctcaaaccagcccacatccaaaacttcacagaggatacaaattttggcctgcctgtgtttgaaactagaagatgggaagaatactgtagaggactggaaccagtttccagttgattcatatttgaataagcatcagcttaggccatgttattataggattttattgggccataatttcagctaggtcaatattcagtgtttacatcactatgactttgtaaaggatatccagagatgagttttgcagcaaacaataattctgaatatttttcctttcatgcatgatttttctttttctaatagtagtcttattacattattttacttattgatttttctatagtcttatacttaagtcaaccaaaattttggccaaatttttggatgtcctctcaggtattgagatgtaatcagatattctgttagttttatcttcttggagaattatatcctagagccatcagagtgctccagttggattggttttcctgtatatcaggaacaaaattgtctttctgggatctcccttcaccatcactcactctaatgatcccctacaaatctctgctgtgtccaccccccaacacccacattccacatcttcgtctttcttggtgttcattgttttagggtgtcatgtcctccatgtcctaaaaaaggatgcatcatattttttattgttctagaacatgtgttctaaaaattagtatgctggcatactcaatcgagagacttagcttaacttagtatgaataatatgttacaaatctttttctttcagaatgttgaagatacttcgccttgctaactagcttgctgtgctgttgtgaagtctgatgacattctgatttgtggtatcttgtatagagaggcctgtatttctctagggaggcttctaggtattctctttgcccctagttttctattatggcaaaaaacacagttacttttgcaccaacctaaccaaattccacaatgacttgatttgttatgggtcgaattttatttcacatcttggttactctgtgggtccttgtagtttcaaaacatgagtcctttaattatgggagattttatgatttcctgtctttagttttctctgtttcctatttcacacatattattacttgcatcttgaaccacctggaatagattgtttctctcaacccttcctccctcccccagacagtctcttcaaatttccttctctttgacttttatctctattcttgatagactactttagtcctttctttaaacacttctattgagtttttaatacctatcataatattttttacaatttaagagacttttatatttgaaatttcctttctataccatattctagtgtaatagttgtaatagcttctcatatccacatcaagatataaatgatggttagttgcttttatgttttcttccctcatatgaactgttttatccaggttgtttcattttagttttgtgttggtttgtttctctctttcaagtgggaaacctttttgcagctatctggttatatttggttgttggcacaaacttaggagtgtggaactaaaaacctaatggaaacttagatgtgcctgagcagagtttgtcttcaggagggtcgctatggtgtcgctcatctcactgggctcacctcattattacctctttctttttgagaaagtcagattccccagaggggaaagaaatccagttttcttccttgagggcagaaacctccactggctcctgggagctaagtagaaaagaggccttgggggattgcagaatccagtgtgcatacatgcatttaatataccttacaagaccctccacaaaacatcacctgcagttcagacagcctctccttacccttttttgagaataagcctcttctcttctagtgtgggggagggcactcacctggctatgtggacgggacagagaacctggattcctaaccacagcttcaaattcttaccttcccattgtcatattgcatttcctcttccagatgtgcctgctacccccagtcctaagccgttgaggattctgcgcacacatcaatcacttccatgcttggctcactaaaagcttaaaagtcatctttctccatgatgccaaaccatttaatatcatcacacctgttttctaacatttacatttgtactttgttcttctattgtcctgtctttgtgggtttatgcctttatagactatctcttacctactagtaagtcctagtttgggaatatttcaggactaagagagaaatgacttctgtgtttcccttagagccttattgttatttcacataactgatgtttgtttagctttactcctgtgtttactgtttcccttgcacccattcttgcatctggaagcatttccttctttgagatctgtgtttttttttaatttttttaaatttttaattgttgtggctacatagtaggtgtatatattcatggggtatatgagacattttgatacagacatacaatgtgtaataatcacatcatggagaatggggtattcccccaccccagcatttatccttcgtgttataaaccatccaattacactctcagttattttaaaatgtgcaattagcacatcttattctgtctaactctttttattttacccattaaccatctccacctccctaaccacccctaatcccccactacccttcccagcctctagtaaccatccttatttaagcccatgagtttttatttttagatcccacaaataatatgcagtgtttgtctttctgtgcctggcttacttcactcaacatgatgtcaggatctgtatcttttagaaatccttttactgagtccctcttgctggtcagtactgttttatttttcatctcttttcctctttggtcttaaagtgtgtttattttgccctcatttgccaaaaaataattttttagtaaagtgtattgctcaaggcacagacacagtagcttactttctgggtctgaagcttatgttcatcatttagcagccatgtgactttgggcagattctaaacctctaaggttcttcttctgtacagacaggataataaaatttatctcagtaggtgtgtggattaagtgagctaatatatgtcaagcacctggaacactgtctagcacataatgcatgcgattatcatttttatacaattctggagagtaattcttgggatgcatgtcttatggaaactctggaaaattcccagccatatatgtgtcttccacttttgcttatcccccatgcctattctttactcctcctggttttccttttgagtgtattttgaatcttctcgttatctattctatctctttttacctctctttcatattttccattctgtatctctttgtgttcttccatgttaactgcttagctctagcctatactatattaattcttccgtcatctctgcctaccttgttattaagctaccctttgaggttttaattttaatgaatatattttccatgtcgagacattctatctgattctttttcatgtgtttctgttctttattcagagtatcattattttctgattatttgacccctctctcattttcctttgttactttatttgtttaactctaaagtatttaggtattcattcatagtgttgttttgttagatcagaatattgcaaatgctaacctgcgatttgttgatctgctgactcttgttgtagtgaatatttttgtctttttaaatttttgatgcgaatttgatctttagcagagtttctacctacctggacaaacatttgattcttgttagcctctgtttaagtagtgtccttacctagcagctgttattgctgctgccaggaacctcagggctataccaaagtgagaactgtcttatgttagtatattcgcttgatgtagcccaccataaatagtcaatgttcattactcatggtagttaggttctataaagtcactgctaacactgaattaatgaatactgaactattgctcctaagggaaatacaagattaggttcctgtgcacctctcaacattttcctcaatcaaataatacctcaccttgttttgtgtgtgtttctctttaaagacaccttatatattgttgcttcattaacattgaactcatggccaacctcactataactcatacctgaatgaagcttagctaacacctatattttctccgtagggcatgtcacaaacttctttcacatggaaacactagactgcatttcagtactatacctgggggccattttaaacagcaagatcaccaaacacagtgcaaacatatgaaaaatgtggcacaaaatgtatggtgaaaaggatatttgtttataatgagagctgaaacaagaaggcagaatgtcactttggtcagcttcggctgggaatgtgcatatgaggaaaccccactgtttcaccactctgcacgtacctgtgaatgaccttgaaagtactgcacatactgattttggggtcacaaataaattttagtgagttggtgcattttcaagtatgaaatccatgaagaagaaaaattgactgtatattacataaatatgaaaccccaaaccatgtgaggtataggcccagcagatcgaatttttggttgaaataatactcatttccaccgttccttctatctatattacaccaacttcaatgagaaagagatgaacaaattaattttctagtcctttccccataagtacagccttgcagcgatgcaggatgtgtgcaaaacgtcttatttctaaatggcaattccctagcgttaagatctcatctcttctttccacatgggcaactgaacctaagctaccaggttaccaaactaatcctgtcatcctccatgccctaattacactgttccagcaaccacggtgtaagctgtagaatttataagtctgctttgtggctttctatttttgcttagatatgcatttgatttaattttgttgtattttaaccaacattgctgtgctatttgtggaactagaattctacgttttcttgaactcctttttattttttattcagttctgttgcttaggaaaataatgttagtgagtgaagcaggttttgtttaagcaataaggagtattagggtctgggatggaccagagaaggcacatgtattagtctgttctcacattgctataaagaaatacctgagactgggtaatttataagtaaaaaagttctgattggcttatggttctgcaggctgtacaggaagtatgatgctggcatctgcttacatggctgggcttctggggagatctcaggatacttagaatcatggcagaaggcgaagagggagcaggcatgtcacattgccagagcaggagcaagagaacggtggggaggaaccacacacttttaagatctctcagcaaaactcactcactgtctcaaggacaataccaagagggatgatcctaagccatttctgagaaaccacccccatgatctaatcacctcccaccaggccccacctccaacacttggcgttgcatttcaatatgagatttggggaaggacacacatccaaactgaatcagcttgctctttctaaaggggactctcagttgggcacggtggcttatgctggtagtcccagctacttgggaggctgagggaggaaaatcacttgaacttgggagatggaggttgcagtgagctgagttcgtaccactgcactccaacctgagtgactgagcgagacttgctgtcaaaaataataataaaagggactatcactactcagctccccattttgagtcattttattactcctaaatttatatttcccagcttgacctctgccctgaactccagtgtccacatctctgggtatcagtagacatctcaagcttatgttttcaaaccataattttgattttgcccataaacttggtcttttctgatgttctccaccttggtaagagggcacatttgttgtgttgttcagatccaaactgagagccatgtttcagctctgtctctctcgtattccacatctatttagcaataaatctgattgcatttatcttcaaaatatacccagaatctggccactgctcactcttcccaccagtaccacctgtgaatgagagtcagctcgcctctcacctcccccgtggcaatagcttctgacatatcctgtaactatcactctttctagtactgccccactgctgtaatttcctcatctccatccaacaactagaatgtttcctataatttcatgctgaacatatcgatacctccctggacaaaacctccaatggtttctcatagagactaagataaattttactcattacctttgttccaagggctctgtcctggttcccgtatgtgatctccttcctcttccctgcacttctctcacacttatcttgccttacttttaggtgctgtgaatgttttcacccagacccttcccccgggtctgtacagtttgctccatcatcaggtcactgcttcagtatcatttcctaaaaattgctttctaccctctgtattttcaccacagttttgattacctgacattttacatcttttctatttgtttatttttgtctctcttaaagattaaaagactatgttgttcactggtacattcctacaaactggcagttttcctggaatgtagtagatgctcattcaatatttgttcaataaatgaaatgatgaatgagcaaatgcaggaccgtattaccaaagctaatctcttttcaaaataaagcagaatctgttctttacttgaattgtcttgacattttaaatgttggggactaaatttaaattttataaaagcactaaataggccaatcctgtaagcataaaacaaaacaagtctgagggccagatatagcccatgggtcactggttaatgatctctgacctggaagttgagagcagatatactatgaaattaaaaggattttattagattacgaaggagtctaccccctcacataaccagatatataagatagcatctaatcagtctggaattggtttatttttgccttttctttccctgtttttttttttcgcttttctgtttattttgcaatctttttatagaaagcagaaattgaccacattgctcctatcagtagagggtagcacattattcacttttcttagattatatttttttaattttttaattattatagattataatatttagaagcacatttagacatggaaagagaagtttgaagaaagattaaacaaatgcaaacagttttaaggatgaatcccagagtggctggctatatctgaaaataaaaattaccgacaattagctaaaatggttgtgttaaaatccgtagaagcctaattttctctgagttataggctgtgttatttctcataactaactagtgtggctaaaaatgcaaatttcatctttgaacagaagtgactttgatcacatccaaagctgctttgctgtgatggtctaaaaccaagttaaatttaaagccaaatgctacaactcagtatgccattcacagtatatgaacttaaaacaaaacaaagctttttagtcaagcacaatgcttttcaacctggtctcattagaaagttgtgactttttaaaaccaagtttccgttgagattaacattttatcactaacttctcagcctgtgtattttatgtctttccatataaatgaaacatatttgttatttgccttttgaatcataaaatcttttagtttgtacaataactgaagatatcttaggatatccatggtctcacagtattatttcaggctctacattattggggggaatagttagctgagacgattccattgacaggtaacttaatctaaattttcactggacttgctatgtttacctacctattcttaggtttttaaggtgcatatatgtgaatgattggtacagagagggcaaagtatgctcaaattaactagaatgtttcctaatcaattttctcctaaaagcatattgagatgagtttccatctgttggacactctgttgtgttggaatatgggagagtagtgcattatttgaaccactgaggttgagttgaatttggaatcttcatcactgagatcttcattatatgagcatagaatgttcgtaattgaacaagtggcctaatcatagtagcatagccaccagacataaagaaaggattttcactgtggagttataatgatagcatgaacaaccaaaaaacatgagagagacttcaaagtttgagttcattcatttattcagtgagcaggaattgagccttttctgtgtgtcggactcttcacaaaaggctgagcatttaggaacgtccttgttttcatggaacttatggtctagttgggaatagaatgccatcagattaatgcacaaatacatacaaactgggacagataactataaaggaaaacactagctttccatttccccacgatccatcttcggtaactgaaattcaatctccattcttccaccttaaaggcagaagtgaaaaagagcccagaatgttctagacttgaatcacatgtatttcagtgtagccaacaagtcagagaatgacatgagatgagttggcagaagtggtcacagcctagacagttcaagtttatgtaaaccatcatattccaagcactttagaggcccataaacagtggcatattttgatgtataagataacgctaggtgttctgtggcagtgaggctagagaggatcaaggattcaaacaaggagaatagaaaactaggaaatggttacttttgtttatagagttcatgatttttaaggaagaaatcgattttaaaatcttgagataaaaatgataaaatgcagtaatggatggcatgtggggaatgtggagtatttttctttttttttattatactttaagttctgggttacctgtgaagaacatgcagtattgttacataggtatacacgtgccatggtggtttgctgtacccatcaacctgtcacctacattaggtatttctcctaatgttatctctcccccagcctcccaccctgcacaggccctggtgtgtgatgttcccctccctgtgtccatgtaatcccagcactttgggatcccgctgaggctggcggatcacaatgtcaagagatcaagaccatcctgaccaacatgatgaaaccccatctctactaaaaatacaaaaattagctaggcgtggtggcacgtgcctgtagtctcagctgcttgggaggctgaggcaggagaatcgcttgaacccgggaggcggaggttgcagtgagccgagatcacaccactgcactctagcttgggcaacagagcaagactccatctcagacaacaacaacaacaacaacaaaaaaccgaatatgttttggcatggagtatttttctcattgagttggatggatagtagtgcagttcacagcaacattggaagaccagtatattttttgagaggggtaacagggaggaggagttgagactggtttataaagatcatgagtttgttattaaacacattgatttaatgacatcctctgcaagtaacctgaaaagtttctattccacctagtttcgttatagagtggttaatcaggcagccttgtcattcatgtttgcccgggccatactctgcccaaatgctcctggatgaaatccacccaaggcttttttcttcacttagggagccgggcccaggtctgactgtgacagcatgtagggagaggtgactttctatctctttcccagagaaggcagctttttataattcctacacaggcactgtatgttctgactatggtcctgctgctagctggggatgtggtgagctggaatggagaaggacagattcagatactatttttaaataacagcttttgagatataatttacataccgtgtaattccctgtttagagtatacaattccgtgtttctagtatattcacagagttgtgcagccatcaccaccattaattttagagagttattatcataccccaaagaaaccatgcccattagccatctctccatttcccccaaaaccccccactccagcccctaaaaagcaggaatctactttctgtattatgggtttgcctattctggacattttatatacacggaatcatgcactgtgtgttctttgatgactgttgtaaggttcttcatatagtagcatgtgtcagtacttcgttcctgtttattgccgaataatattccactgattagctatatcacatgctgtttatcgatttattagttgatgattattagggttgtttctgctttttcattgctataaataatgctgctgtaagcatttgtttacatgtttgtatgcagaatatttttttattactgttagatatatacatacctaagagtgggattgctaggttttaggataactctacatttaacgtttttaagtaaacggcagactgttttctaaagtcaccgcaccgatttacattcctaccagcagtatttgagggttccatctcctccacattctagccaacatttgttattgtttgtctttttattataaccatcctagtgggtacgaaggggtatcgtattgtggttttcatttacatctccctgatgactaacgatgtgagcttgttttcatgtgtttactggccaactatatacctgcttttgagaaatatctatttagatcctttgcccatttttaaattgggttatttgtctttttattattgagttgttggaattctttatgacttctaaatacaagtcccttgtcagatacatgcaaatgtttcccaccattctgtgggtctgatgagtttttgagtcatctctttaaatctctggagtcagttgttaggaattttttgtacttagtagactgacaagggctgtcttcaatttgagagtcttctagcggggttaaaatgacatactctactaatcacatcagtggcttagcgtggacggaacccaagattaatcctggaagacctgggttgtagtcctgactccactactagatgggagcctcttgtcctctctgggcctcagtttctttatttgtaaagaaggatcagtcacattatttaaaatactcttctgttctacccttctgtgattctaagattagaatttatgctatgaaacaaatttaaattgtttctagattgtgaaacaactgagagcattggatgaaatattttttctcttcttttttttaattgagattttcccaagtatcacagtataacaatggcctttagaatatgcttgcctttttccctttaaagcagtacttgttgaaactaacaactaaatgacaggcttggaacctatttttgtaaaacgatgtaattcagtttggaaaataatgtttaaacccctcccaaatctgtcatctggaggagactcatctgtcacgtatataggtgttgatcactggaagtggcacttgtttgctataaccacaggtttgttatgctagagaatccagaaacctccctattcctgtgtcgaactgcagttgcattcatggaaatccaattgatagtttagtgtatttttttgttttgttctcagctgtgggtttgtcttatctaaatggttttagctgatgccattaataaaaaataatctgttaattcagataattcaattaagatatttaccccagtggtgctggtattagaatggggtcatctctatcaatatgggcccattgatggaaatgaaattcagtaagttagactctttggtaccgatgataatatgcctgggaactgagcatctaaaagatttctgatgtcctagtgacatgtacatttaattttttaaattgtatttcatttaaaaaaaatctagattttctttgatatgtagccttggctagctcccttcccttttctgtcagttaccagccgtaagaagcatctagactcaagattttgcttgagatatcaatagcattttaacatctgtaaatgttgtttttgaatacaaaacatgttatatgtatcattgcagggatcaaagggaaaatgttgattacctttctgtaaagctgattctgattcctttcaaattgagtatgattttataagacctaagtcctgtgaaatccattcttattggagtccagtatcccagagacttagatatttcccaaagctggagacattatcagcccatttggccctttgattaactggcattcttccatgggggttttcttttgttccgatataatgccattgcaatagaagtagattgaatgcttcttggcatagatcagttttattttcttgaacctcagaaagattcttgcttagaaatcatctgcctgttgttttgttttactttccctctttggccactgtaggagtgttcctttattaccgttctgttgggattttttctgtcacttctaaagaactctaaaaagcaatttcttgtctatagcagaacagttatggcttgtctgtgacagaaagggttgcctggtgaaggtagcagctgcttgggtggtatatataaagttaaaaccaaatggcttgtgaaaggctagaattgaactcaaccccttaatttcagataaagcgctattatgtgtgtggtgttttgtagtgtatcatgtaccataatttttaggctgttgtgttctcttgctgtaggatgctaaaaatattctgtaatttcttcttctgtgtgagcatctatttaattgagtcctggtttaatgcttatccattataccgctgtgattctattttgcaaatgttggaaaatgtctttaaaaccatacctgaaaccctgtaattttcagagtaatgatctcttttggaggatttttccttcccccatcccccaccatttttgttagatttggagttacgacttcaaatcaaatagctttgataagaatatttccctctacatcttttcataattctgcatttggtaaaataactcttattttttagtcattttaggatgatttaatttgcaaaagatatccaatatcatttttttcttttgtgacttgtctgccataatctttctgtgttaaagtgaagaatatgtgactcaagagtatagtataccttttttgaaaaaaattgtatttgtatcttttttgaaaaaaattatatttgctataaattgtacttcggaactttaatttcaaaatcccaaaagatatagttttaaaaaatggaatatatcatcactttggttatttaatttggtagagttattaataaaaatttcccatagagaacactaatcagttatcttctttatatgtgcagactgtgattaaaactgctgtctgtcaatttcccactaagtttttatttctttgcactcagtaatactaatacataatgacgtacaatcaataggtacattcatttcttttatgtatcttttttattcctaatatcttgattgtagcctcttgatgatcaagttgaaaatttttatgttaaatacagtctcaagttattaaatttgttttaatgcattcactgaaaatctcttctaaaaatctacatttagctccaggttgtccagtagacaacttgttaataaaatgtcacattcaacccacaatttttaggtacattttcctccatgacaactcatctcggccttaagttcccattagaataggtattaatgagaagacatataattatacattttccagtttttttctaacaccaaaacagttatgcctcttaatgcataatgatactttcagcataatagttggggaatcgatataaatttcattatcatactttcttccgtttttgactgtgaactatgaacatctttgttattgatattttatccatggtttttctaacactgtattttggtgttgtcagcagctcaaaatccttttgtcttcaataggccctgagtccgtgtgcaagaaagtgtccagcaagactaatgttatgccacttaacatgtttatctttctccttcatctgtaaattcttcctaagttttctctgctcttggtgtgactcacttgccctcccactaaactcacgtattttctccatgtttctctccttctgacagcatctttttgtgtctgctcaggttccacttgctttaatttggactctttcagtgacaagcaatagaaactcaatgcagaactggcttaagctctacagggaatttttggcatctgcagctgaaaagtcttgggtaaattggctatagtcctagctggatccaggggttcaaacggtgccttcaggccttggtatctctccatctctgcttttttctctattggcctcattctggggcagcctccacctcctggatgtcagccagcatctgaatttagcagtctcaggagacaggaacttgcttctccttcagggttcagacacaaatcccaggcataagcttgaaataggagccctgcctatccctggacagccctgcgacctggtgtcctcacacactggcagggtggggcaatggagggttctgaaagtaaatatgctgttgtcagatagaggggtggatgctgtaaaagcaaagacatgtattgtgctacagacttttctttgtatggagaaatgcatttttttgtgtgtacaatgacttctggatagatataagaagaaatggaaacaatcctcaatttatcattctttctagattcttccattagaagacaccagcagagaaaaatcatttcagtgctgtttaattaattgaaggctgtagttggatcctttccattattttctgtttttaccttttatggtctaggttttttgtttatttgtttttgttttaaatcatgtaccaatccccacactctttgactgagtcgtgagtgtaatagtaacgataaagacctttttgttgttgttgttgcttctacctgtccgcacgatacttaatactccttgggggatcatttggtattctttgtatccccggaatggaacacaaagtctggtgaaaaataattttggaagttagcttacaggcctgctgtgtaccagccacttttataagttaagatccagttagttttaataggaaactgacattgtcagaaggttcttagggaatgtttatttacaaatttgaacaggatcaatggtaatagaaatattaaagcaaggtacatatactcttggctagaaatcaccatgacttttccctgtggattttgttttcaaattcaacagttgtgtcatgtggacatccaaatttaggtgcctcttgatttgatgccatagaaagtgtgtagcaccaactatgaatgattgttaatataaatcaattaatgaataataacttgactctaattaaacctctaggtctaactgcccatttaggggatagaagtacaagttaaagacattttaaaaagagatgccattaacctattttatattgtaattaatttaacagcacaaatgactgattttctgcaatagataaatggcatgagcaaaggaggaggaggagaaggagtgcaaaactgctacagatttttaaaatattatgccacaaactcataactatataatatggattttttttctgtgtagtcacttttcagatgccacctactggatttagtagctcctaattaaatatttgtgactaatgtcctctggaccaggatgtaagcactctggggcttggcagctggattttaagctgtaagcatatccttccactgacattctttcctttaaatccttctgcccatctcatgccagaccactgtcattatacatttctgcttttatatctgtatataccatcaagtatttcaacaaaaaagaaatcagaatatattagcttgggttctataaccaagtttattcagggagtaacagatgatacattcagttgagaattatgggggctgcttaataaatgtagattttatgattttttgcatatgtatttttgagctattgtaattataaattatacttgagcaattattatggaccaagcacagtactaatgaaagcttttatatagttatctcattgtatccttataacaactctatgaggtaacacagattgtaggaggggagctgtattgaaagcctactatttttccttctaaagttcatgctttaactactgcatagatttttgactctgttgaaaaagtactatggagagcatttaaggcccagctaagtttagtaggcaactgacattgtcaaagggttcctgaggaatgcctgtttacaaatttcaactgcattaaatataatagaaacagtaaaaacagatacatatgctcttggctactaaccaccatttattttccctgtggattttgtttttaaattcaacaattgtgtaatatgaattgatttaaagctgctggtggacaacacggaagactttagacaacagcgtcatttcattagagaggaagtgaagggtttgaataagacatgccgactctccaggagacgttgacctgggaacaaaacaacaataacagaaaacatgtttttcaggtttgcttaaatgattgaccaagaaaccaggtagaacagtgttaaactggaaacatgtaaggtttctaagatagtcttgtccctgctgtgagatatgtctgcatgaggtgcaaactcatttgacatcttgtgtaggaaatccagaatccagaaaaccaattagttcctcatagtggcattcacgaagggggtcggcatcataatgagagaaagaaccatggattctaacagcaggaggcagggataggtgtacttcactctctctcctagctgctaggaattctgttacttacatacccagcttttaatcttctttcacttttactaacagaaattcatgtctattcgtattgaagttatctatcagccattttcagatattcatagatactaaactctatgggagagacaaaaagacatgccaaaaactcataaggtttccacacttacttcagaaaagagacatacacaacatacaaattagcaaagtctagacactgtagaaagcaaacgcttaatggctcagtgttgttacagatcttcattgaaccaacgattagattactgagctcagtttgatgttgtgttatttaaattaataatcctttaatgagcaagttctaagtgccagtaactatgctaaatgtgagggacataaagacatgcttcttgcccttaatcgacccatagtttatcgggaatgacacatggatctacaaggaagaatttgaagaaattgtggaagcacagagtaggaagagattaacagggcatggaagaatatgaaaagtttcagattagagatgctgattgtttctgcatttcaaaaacatgtaggtctttaaataatgtgaggacaggctttatcctaaggagaataaggggatcaaaggtgaatcagagagcttataacctcaggaagtttacaaactagaaggggaaataacataggatataaccattgaaaaggaaatgatgtgatccttactttaatatcaatagaggacaacaggagtctggggggagtcaatcaatatattatggaggaagtggcctagtaagtagcttcctaaagaacagtggggctacggagcaggactggttggcatccatcagtgggatttactggctgatatccaatctaatttgttggtgcccatgttacacaggccattaaaaactttgaatattgacactgctttagatttttggagtggtattctaggcagtagcccattttaaaacaaaggcatagacatgaaagttcctatggatactagggagtagttttatttgagtaaattttgcacaaaggagagtagattaagattaaatgacattaggtcttctatgtctttgtatggaatttgagccttatttcacattgctataaggaaatacctgagacagtaatttataaagaaaagatgtttaattggcttatggttctgtgggctgtacaggaagcatagcagcttctgaggaggcctcaggaaacttacaatcatggcggaaagtgaaggggaaacaggcacatcttaagtagctggagcaggatgaagagagagtgagaggggatgttccccacatgtttaaacaactagatctaagaactctgtcatgagaacagcaccaaagagatggtgctaaactattcatgagggatcgatcctcataatatagtcaactcccaccaggccccacctccaatccccaatggcattacaagtcaacatgagatttgggtggggacacagatccaaaccatatcaggaggcatagtttgcttaatatccatgtggtcagtattgcttgtagttatgttgaagaattgagaaacataagtggtcttgacaagaaaatattcattaataaactgaccacttataaaatcatcccattgaaatatcctacttatttaacactagtgtctatcattccagttcctcaattttttgtcaaaccattttagttattgtctgatactgtaactatctaacaatatgatgcaaagtagatacaaaaggattgaaataaaattgcagattttactaatgatgtcaatggatctagtttgggaaacaaatgcatgaacctacttatcaattttaacattgccaaaagaaggacatccaaatttagatgcctcttgatttgatgccctagaaagtatgtagcaccaactattattgatccttaatataaatcaatcagtaaataataacttgactctaatcaagcctctaggtctaattaccaatttaggggatagaagaacaagttaaaagacattacagagatgcaattaacctattttatattgcaattaatttaacagcacaaatgactgattttctgcaatagataaatggcatgaacaaaggaagaggaggaggagtgcaaaactgctacagatttttaaaatattagcaacttaaattctacaaaatattaaaagatttatacatcatgaccaaattgttcaaatagggtttatcccaagaatgcaagtttggtctaacatttgaaaattcagtcaatataacacatcatatcagcgagggaaagaaaagtaattgtatgatcatgtcgattggcacagtaaaaagcctttgataaaattcaatacctatacatgataacatttctcatgaaatcagaggaattcaaggtaattattttaacttcataaaaagcatcttcaaaaatcctacagctaacataatatttaatggtaggaaactgaatggtttcctaataagactggaaataaggcagagatatccatattcacttctcttcttcaagatagtactggaaattctaggcactgcaataaggcaaaaaaaaaagaaagaaatgaaaggcatatatatatatatatatatatatatatatatatatatatatatatgaaaataagaaataaaactatctctacttttagatggtaactgtaaaaattatctctacttttagaggataactgtaaaatcccaaggaatctacaaaagtatcctaaaactaagtgaattcagcaaggtcacaggatacaagatcagcacacaaaaaccagtggtattttaatatgataatgaactgatggaaaccaaagttaccaacacaatatcaattacaaatttctttaaggaaattaaatacataggtatacacttaaccaaacatgtacaggatctttatgctgaacattgtataaagctgacaaaagaaatcaaagaagacctaaatataataaatggagagacataccatgttcatagattaaaatattcaatacagtaaatatgttaattctcctcaaattgatatgtagttttaatacagttcctatcaaaatcccagggaggtctttgtgtttgctagttagttttgatttgttattggatataaaaaacttattctaaaatttatatagaaaggctcagactgtaaggtaaagcagtctcaacaaagaagatcaaaatgtgaagaatcacttgagcagatattaaggattactatttagctacagttatcaagactgtgttgtgttggtagagaagacacatggatcaaggaacaaaatagagaatctgaaagtagacccacacatatattctcaactaattttttgacaaagatgcagagacatttcattggaggaagggtacccttttcaacaaatggttctggagcaattgtacagtaagacttggagaaaatatttgaaaccactgtgtgcaataaaggtaaactattatgttaactgaaaaaagttacagatgttataaataattctgaagtatttacagtaaaataacaagctgttgttagaatgttttgaagtgctccagaaaagtataatagcccgagtttatgaaagtgaattaaaggtgttatgggagaataataaaaggcatacccttgtttgtgggtatttgggcacactaccttaaaggttaaagacagattttaactgataactactgggtgagtaggaggtgaggaggaaaataaaaaggtagaggaaaagagtttcagcagagggcacagcatgtacaaagccttagtgataggaaactcagcaagcataggacatgcagagttctgaaagaagtttaatgtttgaaccctagaatttacagagattagtggagagacctgagacttcgaagataggcgggtcagagatcttgcaccccttcagaagtcagtagaaagccattgggcataaattaagcaggtcagtaggagcgtgagctttgcacttggaagattgtctgggctctttgctattaatagaatgaattcatgatggtggccttgataaggatcttagcttggagatgaagaggaaaggatcaggaaatacgcagaggaagaagtgacagaggttggcgatagattgattcggcatgaggaagagtgagtgaaggatgatagtgaggtccctctgggtcttgaaaaacatgtaggaagaggcaacatggggaaaagagagaaagctccatagaggaaaattatcacaaacaccttgatacaaggcagagataagaggattcagggactgacccctgaggagtccagtcagtctggaatatatgtggaacactcagtcagtaaagtcaagacagccaaacttcacatgaagcaggtaattctagcagtctttcattgaataaaaatatagctctagtatttagggatgcctaaattgagactaagaatctgcagttggtctgcaacttccagctggaagagagcatacatggaaagaaaactatgtttctgttgagtctctagggctatgggctttggaaccgaacagaccagtttttgtttttgttttcttaattttatatgtaaacattcacaccatttagtgtatagatctatgagtgttgacaaatataccagtgacaaaatcaagctacagaatagttccatcatcccataatgttttctcctgctgttcctttgtagtgaaacctctcctatcccttacctttaataacctctgatctcttctccatctctgtagttctgttatttccagaaggtcatataaatagaatcatacagtacatagcttttagagtctgactcctttgtgggccatatggtctcatagctactgagttctgcctttgtactatggaagccacaatatgtagacaaatgggggtggcttgtgttccaataaaactatactcatgggcactgaaatttttgtttcatataattttcacatgtcatgaaaagttattcctttgattttttttccagcaacttaaaatatacaagccatttttagctctcagaccagacaaaaacatgtggcagcctggatctggccctccagctgtagtttgccaactcctgaaaccattagccccaggtatattgtaagtcctgaaaaagataaactacttttattattaatgactttataagttttttgattttcaattggtaattccagatatttcttcagcagagagctgtgttcctagacctcttcctagacctcatcaaattgccagctattcccttcttcagtctctatagaattacttttgctgatagattgactgagggtgacagtttgtctccatttgtctggaacactcttagttttcacctatttaccctgcttcatgcctagtcttatttttattttcaaaggtgtcttagtatacatgataaattgtatggtcaagccagggtaaactcatcagagactacagaagatgccttggtggatgtgggtgtgggtggtgctatttataacagaattctcttcatggggcatgtagaactcttgttctgatcttgatgtcaggtgtggttgtgtttcatttaaaatttcttagatcctttcaatttgtttgttgtcctgtattaatttatctctcctctgagccatgcaacattttttttcttaaggaaaggtgttaaaaatttaatggattttatattctctctgacttcatttatagatgctgaatttaaaatattttaatagtgagtatgcatgtggcacacgtgatgaatcacagtaaaccctttttcactggtttattttgaaagtgtagtagaaatgactccatagcgtctcctctccgctatactacaaataacattttatatttgaatattgggtttattttttggggggcggctcttgttcaacctggctgaggtcaatgatattattatataatatctattctacagatgagattattaagtctcaaagagtttaggtaattttccttaggcacatagttgatgataaagtataaaaagttttgaccagttacttgtaaatcagtggctgttaacccctatgcatacatgacctctaaaattttatcattttttgatggcaagttatttgctgaaaactgtttcccattaggagtaaattagacttttggaaacaatcaaaacactttttcattgctcttacactaaatggtgatttctttttttccaacaaagacaattttataatcttgtttatcaaaggattctacaaaatatcaggtgttaataatattaaaacaaaatagaccattaatgggaatctgaattttgttttttcatagaactttataaaatatgacattttaataatcttaaaataaatttgaccattaacagactgttgcatatttgtgaaagaacttttagaattttgtgtttattggccgtttgaattatttcatttgctttatttttatagtatgtggagtgtacataaaaaaaacttattggtaaatagattttattttgcctttgagtgtaatctcagtaatttgatctttcaacataaaaagaacatttcaaactctgtgctacatgaaatgagcagcacattttcatgtgccaaaaaagttttgagctaagtcataacaaggaaaaatcacagcaattttttattgaaaatatgaatcagctacaatgaagtttcataccagtcattggcttcctatttaaagaaatgttcaacaatccaaatgttttgttttaggcagtttgctttccacacctgccacctgtgcgaatgtcgggtactttcaccagcacatacctcctaatggtaaatgaacagatgatctttttgtgttttcatccattcctccatgctgacattgttagtattttaacattgtactttgctgctccaaaataaacacatcatttttcatatctattcccctcctgttgagatcattaatgcaacataatcctaatgtgttgccaaaaaatatatacagagagctgtctttaggattccctagatttcacatttcatgctactgcaataaatttggagtcagatgctcctggcctaggaagatgataggggttttgtaaagcagtttaaaagtaactaactaaacatgaatattcttaaattgcttttttctttttttttcagtagatagctcttcatttaaaaataatatatacacatgtaaaacattaaagttatacaataaagaggatgtcttcccaccccatttcctaagtctccaagcagcaattgctatatgcctgttcaagcctatgtaagtataggacattttacagtagtaatacaaagaagagtgctcagcaccttacagttttggagattattctgttttagggcatctggctctaattttttacacatatgtgtaataatctatggcataaaccagttagatttcaatgtggttctccagactagcagcatcagcttcactggggaatttattacaaatgcagattttcaggccccatctcagacttgttgcttcagaccctcctgggtggggcagggccacaggtattttaacaagacctccaggtggttttgatgcacagtgaagcttgaaaaccagggcttccaggcaaacagggtctggagtggacctctagcaaactccaacagacctgcagctgagagtcctgtctgttagaaggaaaactaacgaacagaaaggacatccacaccaaaaaaaacatctgtacatcaccatcatcaaagaccaaaagtagataaaaccacaaagatggggaaaaaacagagcagaaaaactggaaactctaaaaaggagagcacctctcctcctccaaaggatcgcagttcctcaccagcaatggaacaaagctggacggagaatgactttgacgagtcgagagaagaaggcttcagacgatcaaactacgagctacaggaggaaattcaaaccaaaggcaaagaagttaaaaactttgaaaaaaatttagacgaatgtataactagaataaccaatacagagaagtgcttaaaggagctgatggagctgaaagccaaggctcgagaactacgtgaaaaattcagaagcctcaggagccgatgcgatcaactggaagaaagggtatcagcgatggaagatgaaatgaatgaaatgaagcgagaagggaagtttagagaaaaaaaaatagaaatgaacaaagcctccaagaaatatgggactatgtgaaaagaccaaatctacgtctgattggtatacctgaaagtgacggggagaatggaaccaagttggaaaacactctgcaggatattatccaggagaacttccccaatctagcaaggcaggccaacattcagattcaggaaataaagagaacacgacaaagatactctttgagaagagcaactccaagacacataattgtcagagtcaccaaagttgaaatgaggaaaaaatgttaagggcagccagagagaaaggtcgggttacccacaaagggaagcccatcagactaactgtggatctctcggcagaaactctacaagccagaagagagtgggggccaatattcaacattcttaaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcactagacatggaaaggaacaaccggtaccagctgctgcaaaatcatgccaaaatgtaaagaccactgagactaggaagaaactgcatcaactaacgagcaaaataaccagctaacatcataatgacaggatcaaattcacacataacaatattaactttaaaagtaaatggactaaattctccaattaaaagacacagactggcaaattggataaagagtcaagacccatcagtgtgttgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaacatacatttttttcagcaccacaccacacctattccaaaattgaccacatatttggaagtaaagctctcctcagcaaatgtaaaagaatagaaattaaactctctctcagaccacagtgcaatcaaactagaactcaagattaagaaactcactcaaaactgcccaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaagatgagagcagaactgaaggaaatagagacacaaaaaacccttcaaaaaatgaatgaatccaggagctggtattttgaaaagataacaaaattgatagactggtagcaagactaataaagaaaaaaagagagaagaatcaaatagacgcaataaaaaatgataaaggggatatcaccaccgatcccacagaaatacaaactaccatcagagaatactacaaacacctcttcgcaagtaaactagaaaatctagaagaaatggataaattcctcgacacatacactcttccaagactaaaccaggaagaagttgaatctctgaatagaccaataacaggagctgaaattgtggcaataatcaacagcttaccaaccaaaaagagtccaggaccagatggattcacagccgaattctgccagaggtacaaggaggaactggtaccattccttctgaaactattccaatcaatagaaaaagagggaaacctccctaactcattttatgaggctagcatcatcctgataccaaagctgggcagagacacaaccaaaaaagagaattttagaccaatatccttgatgaacattgctgcaaaaatcctcaataaaatactggcaaaccgaatccagcagcacatcaaaaagcttatccaccatgatcaagtgggcttcatccctgggatgcaaggctggttcagtatacgcaaatcagtaaatgtaatccagcatataaacagaaccaaagacaaaaaccacatgattatctcaatagatgcagaaaaggcctttgacaaaattcaacaactcttcatgctaaaaactctcaataaattaggtattgatgggacgtatctcaaaataatgagagctatctgtgacaaacccacagccaatatcatactgaatgggcaaaaactggaagcattccctttgaaaactggcagaagacagggatgccctctctcaccactcctattcaacatagtgttggaagttctggccagggcaattaggcaggagaaggaaataaagggtattcggttaggaaaagaggaagtcaaattgtccctgtttgcagatgacatgattgtatatctagaaaaccccatcgtctcagcccaaaatctccttaagctgataagcaacttcagcaaagtctcaggatacaaaatcaatgtgcgaaaatcacaagcattcttatacaccaataacagacaaacagagagccaaatcatgagtgaactcccattcacaattgcttcaaagagaataaaatacctaggaatccaccttacaagggacgtgaaggacctcttcaaggagaactacaaaccactgctcaatgaaataaaagaggatacaaacaaatggaagaacattccatgctcatgggtaggaagaatcaatatcatgaaaatggccatactgcccaaggtaatttatagattcaatgccatccccatcgagctaccaatgactttcttcacagaattggaaaaaactactttaaagttcatatggaaccaaaaaagagcctgcatcgccaagtcaatcctaagccaaaagaacaaagctggaggcctcacgctacctgacttcaaactatactacaaggctacagtaaccaaaacagcatggtactggtaccaaaacagagatatagatcaatggaacagaacagagccctcagaaataatgccgcatatctacaactatctgatctttgacaaatctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacataaaaccataaaaaccatagaagaaaacctaggcgttaccattcaggacataggcacgggcaaggacttcatgtctaaaacaccaaaagcaatggcaacaaaagccaaaattgacaaatgggatctaattaaactaaagagcttctgcacggcaaaagaaactaccatcagagtgaacaggcaacccacaaaatgggagaaaattttcacaacctactcatctgacaaagggctaatatccagaatctacaatgaactgaaacaaatttacaagaaaaaaacaaacaaccccatcaaaaagggggcaatggacatgaacagacacttctccaaagaagacatttatgcagccaaaaaacacatgaaaaaatgctcaccatcactggccatcagagaaatgcaaatcaaaaccgcaatgggataccatctcacaccagttagaatggcaatcattaaaaagtcaggaaacaacaggtgctggagaggatgtggagaaataggaacactttgacactgttggtgggactgtaaactagttcaaccattgtggaagtcagtgtggcgattcctcagggatctagaactagaaataccatttgacccagccatcccaatgctgggtatatacccaaaggactataaatcatgctgctataaagacacatgcacatgtatgtttattgcagcactattcacagtagcaaagacttggaaccaacccaaatgtccaacaatgatagactggattaagaaaatatggcacagataacaccatggaatactacgcagccataaaaaatgatgagttcatgtcctttgtagggacatggatgaaattgggaatcgtcattctcagtaaactatcacaagaacaaaaaaccaaacactgcatattctcactcataggtgggaattgagcaatgagaacacatggacacaggaaggggaacatcacactctggggagtgttgtggggtggggggaggggggagggatagcattgggagatatacctaatgctagatgacgagttagtgggtgcagcgcaccagcatgtcacatgtatacatatgtaactaacctgcacattgtgcacatgtaccctaaaacttaaagtataataataattaaaaaaaaaaaaaaacagggcttcagataaaccatattctttcaagaatcatttaggttgtttgcagcctttttcttttgtaaatagcactgcagagaagatctttgtacatagacctttatagggagagtcatagaaatttatcaaactttccaaagttacaccaatttacattttcaccaacaataatgtatgagatttttcttagtatttctgagaccatttttcttagatttccttctatgttttataactgcaagattaaaaaaatttgttttgtttcgactttatataaaaaacacatgtattttttaaatgtttcaaatatttacaatgcagaatataaattctttcctactaaagaaatatagctaccatttattgaaagcctactgtgttttataaacttaattcatttcattttcattagcctcccagcaaaggacaattcttgtttcttaggtaagggctattgggaggataggctcagtttgattcattatcttgctattaaatgattatgtaactacatatgatcataacaaattattataaaaataagaaatgtactttaacatgctttttgagaaatatatcattaaattgccttatggtccagaacattaaaatacttcttttgcttcatgctaaggttcccacaatattcctgtgaatgcaaagtttctgtgtagatatttttgaattactgtataacaaagtattcagctattcattctgagtatttgatagaaaaccaattaatgccaagtggcttttggtaaatgtctggattgaaatgacttcagccaacccaggcttacaatttaatgaaagctgaggtgcatcagaaggttttcttgcataatatataaattaccgctttctgcagtttcaaaaggtgtggtcctcagatcactggtctgacttatctgtttcttatttttatatgtgctttatatttaatagatccaaaaccccttccctaactacagaatcagaatttttaggactggggcctggaaatttgcacttgaaacatgtttcccagctgattattataaataaaagtggatttcattcttctctttatcaaaaacaattgccattttttttgattcagcagagatgactacagagattagtgttgtaaaagagtacataaataattcagatttaaactctgtactgcagtggtatgatttacttaagactcagaacctcctctaaaaatgattaatttaatttttatttcttttcttttactttgtcttccttgtggcaggatgtcagttggcaatgaaatggccccagagcaggcacaataagaagccacaaaaaattacattaatttttattatataatacttagatatttctttatgatttatactcaagggcttctgtaaagacctgagttggcttacagaaggaaattaatataaaataggacaagcacagatcaaaatagaaggagactatttaaaaggatttgaggcacctgggagacattaattctagcagctgggaagtgtcctgatcgctgaaaccaaaatggaaacatgttggtttataaatttttcatcttggatatagaaagtatatacaattatcagaagaggcaaactttttcctacaactaggtaaagtatgaatgtgtggtatatagtgatagatcttgtataacagagaaaacaaaaactgtttttcaaaggatatagaaaaatagttatgaaatggaccattctggtagactctgagggcattttattaaacatagccataaaagacctttttgtttgagctgatactttataataatagcaaatatttattctgcctctgtgtatgttattttgttatcttcacaacccaataaatgtatgcaacgttgttctccttgttttatagttggaaacctgaggtgtgtgtaggcaagctaaataatttataagttcctcaggttagcaggtgtcattctgtctttagagctagtgttattacactctacatgctacatacttgtcagatatttctgagttgtttgctttgtaataacatgaactaaaataatacaatacacattttggagaataaggatgaagagtgagttcatgtttacatcatcatagtctcttttattttctaggccaagacaagtgtcttaatcacattatctacatagtgtcatgagataaagcccctagtgtccagtagttctgcttttactctatgttgttggttaaaagaaacttatctacttgtttgtcttgtttggcaacatacacaacataaaatttgtgttcagaatggatgtaaacaccaaaaagatgaaattatagtcctgctctcaactagacactgggctcccctacccatgggaaatccatgaatcatattgagtaagtgtatgcatacttggttaaaaaccttagaattctgctgcacatagcatagaagacaaagctttaacctggaaaatcttaaagcaggtgttcgcagctgagtgtctcatccataaaatgacatcaggcaacggtctacatggatcatccaattttaagctgggctgcatcctgatgggtctgccagaatgagttattcccctagtagctgaaaaacattgacctattaagattgtttttatctgcttatttaaaaatggttcatgtttttacatagagcaattttaacctggggtccaggtgagtcctgcccttactcttagcaacttagaacagagcgggcccttatgaactctccacctcagggatgataacatctgcatattatgtcatttgtcctgtgtgagagagttaatggtaaatcttaaacttgaaaataggacaggtggtgagggtatcatcatgccatcactgaaatcagaaagaaaatctcagacctgttaactaaattcaacttgacatgttttggagagcatcttagtaggtcttattttccatgcaattgctctttcccttcgttcacttaattgacaagagccatcttttcaaccaatgaaaaatgcatattgggctagatgtcttccttctatttcttccagatccaccttccactctgccatatgtcccaggggacccatatggattacatctcttgccttctggcttttgggtggttttagctaatgggaggcaatagcaggaaattggagagtgggaagagaaaaggtcaggatatttgttcccctggcttcctccctgctggatcaccatatgttgttcagtagtcctcctactggaggccacagctcctaacagtattcctttctgtacagctgccctctctgagttctgggaacctcacttctccttactgttcaagcctaagtatggtgatggttccccactgtcaccagccttgcaatactacatcattctttttggcttctttatatctttctcattgtcaggcgctcctcatttaccacattgaagtgtgccatctgtacactgctaggagactgatgaatacacatctgtgaaatagtcgtaaatgaaacaaagaaaaacgtctttgaaacttttcaactattttgtattacatccatatataataagacctcatatggaacatttgtacagaacatattagggagaaatttattgccatgacctagaatgcaaatctgtcagtctgactcaaaaaaacttataccctatgaccctgatctctgggaatgcatgtaggagtattttggcttccagaagtaaaatactctagggtagcactgtccaatagaaatataatgtggggccacatatgtaacttgaaattttccagtagtcacattcaaaaaagcaaaaaaaaaaaaaacaagtaaaattaacttgaataatatattttatttaactcagtattattttaacatataatcaatataaaaattattcacagaattttttttctgtactaagtctttgaaatccattttgtgttttacagttaaagcacatctcaatccagactgctacatgtcactggcttagtaggcacatgtggctagtggctgctttactggacagcacagctctaaggtttatgatatcaacatttagtaaaagagtttctcctttctacacacacacacacgaattatattgtaagctattcccctgtcaatctcaataaacctaaagacttgcctatctgcatatctaaatgcatctcttttttctgccacaattaatgcatgcaagtcacttagaacagtgtccagtgcataataaaatttcacatatgctatttttgttgttgcttcttaaaaacctcctgaggtagttcaggtacgtattactaccatcttacatatgaggaaactgagtcacagatcaagtaagcaactggtccagagttacacaactattaagcatcagatcatggactcaaggccagttcttctgactctgcagccagaagaatgaatgtaataaaagtcaggcagctgagctttatgggttcgactagtgatcaggaggacaaagatgtggcctttaaacagtgctatcatgtatggttgtgacaatgaagtgccgcacaagtgccattcacattactgtttctgtgaatgataccctcttgagttgtgcagtgcacaacctgtgaagtcctacgtggcagccccaatttcaggtttatttctgccaaaaactgagtttagacaaattgtgaaaccttcccatctgttttctttaaacaccaatgaagaatgtttgctgatgctaccacagcaatcctgtcttgtcctgtgattcttaatgatagtgcacattcttttctactagcattcttcatttttgttccatttgatttggcagtgcacattaagaggctatatgaaatgcattactttccaacttcatgccttagtaatgctatgtttgcttactgtcatagttaaataaatatcttattaaagcatttctacttaatttcattgattctggtagaaggctttcataaaacaagagcattttgggaggccgtggtacatggatcatttgaggtcaggagttcaagatcagcctggccaacatggtgaaaccccgtctctactaaaaaatacaaaaattagccaggcatggtggcaggcacctgtaatcccagctgctcgagaggctgaggcaggagaattggttgatcctgggaggtggaggttgcagtgggcggagatcccaccactgcactccagtttgggcatcagagggagaccctgtctaaaaaaaaaccaaaaacaaaaaatcaaaacaaaaaagtagttacaatgtttctatatgttattgtcagaagactatgaaattttagaaagtgttgcattgcaaacatcgtgtaacctcctaactaaaatatatcattagtgcattaaatattgtgaatgccattagtggcatcaatcatactgaaagacagatattcagtggagcaataccgcagtagttgtctagacactacatactttactgaagtgattctctttgctgacttcaggaaaaatagctgtatttaatcccttcaagtctaggaatttttaccatcttttcatattaggatgtgtggcattgtggggaagagattttggtgctacataaaaatattcataattatttatatttcctattttctaatcttattcatttgtggattttaattaagattaatatttttatggttgataatgtcctttaattgaacagtgaagaaagcccatattcagctagtacctgatagggttataattgagaaaatttaagtttttgctgaaaatgcctcaattaaaatgattttcgtaggagtagaccaaaccttcattaaactgacaattagaaataaagctatcccacatttagtttaaagtaccagtttgggtagggaaaggggacaccaaggcaaagcatctttgcttgaaacaagaaagttagcattgttggacattaaaaaaaaattatgtcatgacctagaaacttataagtaaacaaggaaggtctattgtcaggtagatgaaaagttctgggaagaaatacggaaagcctttcccatagctttctggaaaatatctactgctcaggccctctgaaatataaatagcttgtgtgagaggtgctgaagactttattagtaagcaccccttctaccctagacataacattttcacttgttttatttattcataatattattcaccacttgttatgagttgaattgtgcccccaacccccccaataagagacatgatgaagtcctcccccaatgcctcagaatgggatgttgtttgaaaatagggttgttgcagatataagtagttaagatgagccatactagagtggggtgggccactaatccaatgtgattggtgtcattataagaagacatccatgtaaaccggagacacacagggagaatgctacgtgacaatggaggcggagattatagtgatgcatctacaagtcaaggaacaccaaagtttgccagcaactaccagaagctagaaaaaggcaaggaagaatccctcttctggtttcagagggagcatgatcctgccaacaccatgattttagagttccagcctccagaattgtgagacaatacatttctgtttttttttaagccacgctgtttatggtactttgctgtggcagccctggaaaactgatgcaccacccactaagtattgtgtcttgaccaagagtttcttgtcctcatgaagctcacaaagtacttaaaaatgctatgctctgttaaggaatctattaataacgacctcctaggggaaacaacacctaagttgagacttgagggattaatagtagttagccaggtggaaagagtagaggaaggaaggcctgagaaacagaaaagagtgtgtcctgtgccatagagggaaaggacttccatctgactgaagtgcagatgtgccacaggggatggagagatggtgcagagagaaagatgggactcagatcattctaaaccacatcagccatgcgaaagagtttgggttcatcttaaggctggtgggcagccactgaaggaggggaggggcaggattggacaagtgtgtaagaaagatgaatctggccacagttggtagactggatgggaggaatatgagactggtcaggaggacaggttttcatttgtgcataagcagcatgtttggacttgaatactcatcactggaatgaagcaggaagtaggtggtgagatggaaaggatccaagggcccagaaggaagaatagagccagacaggctagggactgcccagggcttcccactgtcaagctctggaattacagctgtctctggtggatgaactgcttggtctgtgcctttctttactcctccaaacccaggaccttctccttaaagctgctactgtcctccttagggttgaaattctttccttctcctccaccccaaggccttcccacttgcctttctgattaaacctgaatgcaaataagtatagaatccaggggaactgaatgcagggatcttgttttgtaacttcttcattggaggcagatattgaatctataagcatattgtttaaggacatgggctgtggagccatgctgtatgggcttaagtcccagatctgtcacttactgtgtgaccttggacaagtcacctgatgtgattatgcaacagtttcatctccaaaacagagaaaaataaaagtacctcctaccaggattgctgtgagagtcatgctgtgaattaacttatgcaaagaacttaaagaagtacttagcacttagtaagatccaattaaatgtgagctattattatagttgctgaatctttgcaccacccatggagctactggggaactcacctacaggcttgtatgttagccagtccctatagatgggttatgcatctgaattaagattgtggaaataaggtaaagaggaagacaaggattttagaaatacatgtaagagaaaattaggtacttgattttatgcatgaaaaatttataaggaagaaacaaaaaacgtgctagaccttaaaaggtaataattatttttcttagggtggaaagcagaggaagaagaccatcatgaaacagaatttttaaagtgtgaataaaataggctattattcgataaaaatgaggaaggaagggtgttatcggcagcagccacagtatgtacaaatgcaagcagagctgacatgtttagtgatagaccttagcctagaaaaagagaaagatactggaggtatttagccagaggagaagagactgatttatggtggtaggccaccataagtataaataactcttagcacatgggatataaaaataatctctctctctctgtgtgtgtgtgtgtgtgtgtgtgtgtgtgtacttgcatgcacttacctgtttgtttacaaggttaccttgtcatctaacaattagatttctgtgtatcaaggggaggtttcagaaggcagacttaggttaaatggagaaccccattttcaatctattttactgtaaaagccttctacctcagtatgtaatagttatgcaaaaaatgaaattgaatggaataggaacatagagacctttatgtgtagaaagtcaagcttatggaatatatacttgtatagaaatattttctatgagaatggtaacctaatttgtcatgttagctaaatgcaaaagataatttattttataggcagcgattttatacataggattgatggagtgcatttctcctgccagtattgagatttctggcattttcaataaacaaacagggccaaaggataataccacccatttaataagttggtacatttattccaacagacatatgtttagatttgtcccattttcatctcattttatcctccacatcagcacagttgccctaattgctttctaatttgtatacatttttgcacttaaaaaatttaaactaagaaatctttttcaagggcttcttaagtaccaaagggtggggttctactaaactaatgtatccatgtgtcaaccagcatcctgtgtaatgcatttctgaagtacaaaattgcactcattgctctcttgctgttggcttattctggatctcagataaaacttataaagaaaacaagtagtatggatttatgcttgtttacttagccagagaaacaaaggcaaatgcatattcagaggtatactgatagcgatgtttccatggaaacaaggatgctatcataatatttatttccatctattatgctttagtgtattttggggtatagtgttaaaatgataaaatatatgactttcttttctcaaaaaactgtatattaggttgatgggttttttctgggttagatgtttttaaaggcctatgtcatgaaaactatcaagagtcacattaaaacatataattttaattattccccataagttataaattacattcatttgcttgcttataaaattttgaaattcagatacatgacacagtaagtctcacccaatgttaaagttaggggtaaatacagtcatccttaggtgtccatgggggattgtttccaggactctcatggataccaaactccagggatgctcatgtccctgacataatggcatggtatttacatataacataggcacatcatcctgtatactttaaagcatttctacattacttataatatctaataaatgtaatgctttataaattgttgttatgctgtattgtttaaagacaaatgacctaatgcatatgaggcttaaaacctagatgacgggttgataggggcagcaaaccaccatggcacatgtatacctttgtaacaaacctgcatgttctgcacatgtatcccagtacttaaagtaaaaaaaaataaataacaacaggaaaaaaagtatacatgttcagtacagacaaattttttccaaatatttttgatccacaattggttcaatccaccaatggggaacctatggatacagaaggctaactgtacatgcatttctctacattccacagttatattttatgggagacttttttttttttttgctatttgctttttaagctttaagttggcgattcaagagatctgtagcaggagaacagaaatcaactatgcaaggtagggatctaagatattattaatctcccaccaatggacatatattacttgtctcatgtaagattaatataggggtataagagagtgagatctcttattggaatcacttaatacatctatttatgtactaatatataatatgtgcgaagcagtgttttctgtgctcaggatgtaagaatgatctggaaaactgtccatggttttgtgaagcttacattctagttagtgggggagatgggtactaaacagacaaaaaatgcaccacagaatattatacaaaatttgaaaaaacttacaggaacatagggttataggaagtgataactaatggaagccagttatacccaaatatggtgttgtcatatacattttaaaagctttgtctcatttatcattgccttgggtctttatatcaaacctcagggggttcctgggtaggtgttattcctagttgctgagaaagagaaaccaaggaactgcatggttaaggaaccagttggccagattcagaaggtcacaacacaggcctttttcactcagctttgtaggcacttaattagagttgttgaataaatgggtgaatgattgaaagaatgaacatacctaaatacgactttcaaattggacatattatctttttcaccttttgtaggtgaagtttctatggactgaaaaggaatcaggagcttaagctttaatttggttgtgttgtttctctgttttctccctgttagaaagagaatgtgccatcagcctgcctctgacacttaaccagcagtgtgattttaggcaaaacctaatctctcttgtccttggtttgcttatgtaaatattgggaataacaatatcagtattgcccatttcacagatttttttagtatcatataagatgaaatatatgcaactttagatgatcatacttttttattttttggagtgcagtggctcaatctcagctcactgcaacctctgccttccaggctcaagagactctcctgcctcagcctcctgagtagctgggattacaggcatgtgccaccacgcctggctaatttttgtatttttagtagaggtggggttttgccatgttggccagggtggtctcgaactcctggcctcaagtgatctgcctaccttggcctcccaaagtgctaggactacaggcatgagccaccacacccagcctaattgtacatattgaagtcatcattgatcctttaaaaagtaatcttcatttcacttgaattagagaagcattttttccagatagttcataaaataatctttgatgtccctctcttattttgatgaaaatcaaattaagctaattaacctaattagcttctttttatataagaagggtactctttgaatgccagatcacaggagttctcaccacctgtgaactatgctattactctggaactaagttgttgcagggtgaagtgttaacaaatgaactattttgtaagtaagggtaaggattctgtgttcaatatttttgtgttgagttaggagaattattgcatgtgctaatttatttatatttttcaatattgctataattgatagaagtcaacttgtaccatcttatgtgcattgcaaaaatcacacgtgtcttaaaagcaactattttatgaaatttctaaacagcctcaatgactaatatatttagccaaacacagatgctaaatatcaagagctttaagactctcgtgttgaattcaacaactattattaaataactactctactaactagggggaaggaagagaaattatggtgttcctggagagacagacatgcctataaaaagcaagaggataaatacaggtaaactagagtagttgttgaaggcctcaaaggagaaagcaataatttagctggacttggatgacaaataagtctggatagatgtggctaggaaaagacacagggtttatctttgcctagagaaagggagcaacatgctaacacttattgagcacctaccgtattccaaaaactttgcatttattttctcatataatcctctcagctggcctctaacacgttatgttatcttcatttttcagactaagatcctaagtatcaaagtgtctaagaaatttgtgcaaaatcacagagagattcaatcacagagtggtggatattaccactgaagtctaactgcaaattctttgctgaagaaaccactgagacattttaatctacactattaaaaagttcttaaaaatgtttgagtacataattaagataactgcattgaagtggtataatttgttcccatattcagaataatgtcattttatatgatctctttgtttccacattggaaaggagatgttactaagtgagaagaccaagtacatctttgtataactaatggttaaaactcctctatggcatacccagtacagtggtaagttttttaaatatgatattgtgtaatagtcttgaaaatacagctttctttatttgataatgttttatgtgagaacattggctttttctgttgccccattgaaatccttttaacatgtactttgcacagagattttctaaattatctccaaactcagatataccacctggaggtcttcatttcaaaacaaagaatgtgattcatgctcttgccacaaaaatgggaaaaaaaagtgtagttttgatggaaaaattctagggctatatatatgtatatatacacacacacacacatatataaacacttgaagtataagaaactcttttaagaaagcaaagatttagttgactcttcagtttgtagtaattgttcgtgttttaaactttagtattgtaaaattaacatccataatcaaatagggagagtttttgttgttgttatgtgtttttcctagaatagatactttagaagagcaaaactgtcagtagcagaaacatgggtttttttttatttttatttttttgagacagagtctcgcgctgtcacccaggttggagtgcagtggtgcgatctcggctcactgcaagctctgcctcccggattcacgccattctcctgcctcagcctcccgagtagctgggactacaggtgtccgccaccacacccggctaattttttgtatttttagtagagacggggcttcattcaccatgataaccaggacggtctcaatctcctgacctcgtgatccgcccaccttggtctcccaaagtgctgggattacaggcgtgagccaccgtgcctggccagaaacatggtttttaattttatttgtttgatttagcaaatgagcattttgttttttactttttgctaagtacagaaggggttttcttatttgatatagtcagaggcagtactctgttatatgaaaaattgttttaaaacaggtaatcatttttaaaaggtatatagataccataaacaagtaattttgctttgagtatgcaactgtgtgtgttttttgttttgtaatgtgccaagcgttcttctttgagaaagggttggacagtaggagttcactttattatttatataagccacactcattatgaattttctttgatttccaattgctgttttactttgcaattgagttatttaaaaaatatttctgaaacaatctgggtacagaaatagaataaacagaatgaagatttttgttttgtatttccagcttttatggttgtcttgcccaatctcttttatctaatttggcactggttttggggagaggaagggtgactctcctttattgagcttttcaaaagcctttatatttgtttttatataaacaacatattccttttttcatattcatatttcatcacttttttggtatttttctaataatttcagtgaaattgttactagcgtaattagttttgttagcaaatacatctaattgaaatgatgaaagcagaagggcttgctagagagcagctaccaggcacaagcattctgtttgccctggacaactgagagtgccatggagggagtggatcgtactgcttagattgaggccatctgtactgggtaggtgtggtgtgaggtctgtggaaggcgacaaagggagctggagaaggatcatgccctcagccttagccttactgagcagacagacctaaaatgcagtttccgtaaacatccaaaatgttcagagaaggtatctttcacataggaggggtatttttagttagaccttgaagattattagtaaatgtaagttgaaaggggaaggatagagcataagcaaagagttagaatcagaaatactctaagtgacagagtacgctcgcttgtccaaataccctgaacctaggcataaacttcatgtacacatgtatatgcatacacatctgttgaataattgaatgaatgttaggacagagaatgtggactttatcatcttggcagtgggaaatatgtgtataggcgttttagcaggtgttagaaactgagagtgtgttttataaagaaaactgaactctgtgtgtagaggatagatggattggatgggaggagagaggctgcaggcggggagaccagcgtgagggttggatggacctattgcataatacaaagacaaaaagaactggacttgaaatcaatgggactggatgtgatctcagctttatcagttattgcatcatgttagtcacattccaaaatagctttcagccacagttttctagaaaatgcaaagttaatacttttaaaatagaaattttgtgaaaaataaatgtgttaaattcaagaaaatctctatcacagtgtctagcaaagccatccatctattaattccttcatatccccatttactcagtgtggatgaagcatactcttatgacttcataagagtgtaatctaaggtgtaaaagccaaacaagtatatgggcccatatgcctcatatgtgacagctgaatctgcattacaaaatagttccaggctcagtgtggtggctcatgcctgtaatcctagcatttcaagaggctgagacaggtggattgcttgagcccaagagtttgtgactggcctgggcaacatggtaaaactccatctctacaaaataatacaaaaaactagctggggatgttggcacacaactttggacccagctacttgggaggctgaggcataagaatctctggagcctggaagggagaggttacagtgagctgagatggtgccactgcactccagcctagacaacagagcaagaccctgtttcaaaaattaatttaatttaaatcgttccagtaaaattaatatgatggtaatgcaaaatcagagataaatgggaagagaaagactgggttttgcggaacaattaacttgatcaaatttaatgtattgagcaaatgtaggaaaagaaagagccaaactggttgtgggagtctttgagagaataacaacagggaagttggaagaggaactgtattagaggaaacaccaagaacataggaaaatgcagtgtcaaatatgagatggcaattggacatccaaaaaatatctgaaatgcatgcagaaaatgaatgttttgaatcaaaatttgatggacatatcattgatatatacacagtggtaggatcttgagacttggtgagtttcctgaaagaatgtgaagaaaagtgatagtacctatcatttatttaacatttataaattaagcagtgttttaagtaatttacacgagttatcttatttcttccttgcaacaatagcagaggtaattgctgtcttatccttaatttactgatggggaacctgtggatcaacaaatgaagtaatatgccctgttcaaatagctagagagaatcagccaagggattgcacctaggtttgtctgactccacaggacaaagacttgacttcaacccaagttaaaaattgaaaggaaacagatgttcatggacctctgggggtgggcagtagagcgagtgttcagaaaagttgggcatgagatcattggaagatgtgttttatttttaagatggggtgaactgtgcatgtttgaaaaactgtaaggaagacaaaagagagatggaaacaggaatcgttatgaaaccagagactcaaaaggaaaaatgaaaccttgtacttgtataattgttttcatttttcaaaaggcttacagatctgggatgctaaggttcctctcttgaaaagccctgtgaggttcaaagagtggatattgtacccactttacaaatagaatgtgtgaagacacagggcaatcaagtgacacacctatagatctgcaggcctggattatggtcagaatatcctgatgttctaattcctgtgttctcttcctaaatttcactagtagaaagttaggaactctgcaatgcagacaccaataatttaactttggtgggaagacccatgatggagatcctaaggaaaatgagatgatggatgcttatttcagacattctttgatgacctacacaatgccaagaaatatgtgacagtctagagatagaaagatgaaaatgacaaggctctaatcctggcagagcccccagaatagaagaacaaggtgggaaaatataaaagtatagaaaataagaaagaacagcaataatttcaaaggtttcaaaaaagagatgtggccaaagctggtttggaagataaataaaagtcttctgtgtcagtggaggagtgggagccttatgtgcatggcatgggctagcatttttgtgcttggggaaaaggaaaagtttgttgttgcttagtgtatgtggctgggagttgacagtgttggagcaatgtatgggaggcagatgaagctgaactatgaaatacctatgtggaaaggtcttgtagagtatacttaggtgcttagggtccaccctgtgcctgcattttccaggttgtgtttcagaacaaaacaacagatcctgaggctgttatgatcttattagatgctttgctacatttcctaaatagtgttagaaaaatacgaaatacttcagtctctgcttggagacttacaatgcacacctgttttaaaatctcgcaaaaggctcaggcttaaggaaaaaatctgtttgtggtagacattttttgatgccctgtatcacacctctgattcccacctcccaaagcatttgcagagcgggtagacagtttcttgcaggttcatagtagaagctctgatggagatgagggagttgttgctcccagggaaattcctccactattggggttgggagcctgtgtatacccccgactcccatctttcaaatggatgattctggatgacattttgtatggttgtcagaggttcatttgaaatcaagttctcattgactgcagtagcaatttcgataatgtacccagatgttgaattttcctccatctctcccctttccttccccactgcctctaagatcaccccccataaactatgtcacccaagtctttttggaggctctggcttgggagaaacaaaactaaaacactattgaacttttgttgaataagctattatttttcataaggataaagttttgttttcctaagacacactttgccatgggagagttttcccttagggggtttatacataattaaatgttttgagaattggaccagcaagaaagggaacaaaaaaggaggagacactttgaatttgggtgttgggaaatagagcaagaaataacgaaaataatgattgagttttgaacatgctgataccgaagataactaagagtcagttgtttatgtctaatattccgatttaggagatcttctaagtgcttctgcatgtgccataaggcaggaagaaaggtgtggtcattcactgagctgggatttttttatttttgtagtgggcatgctttaatgagatttatcaactacttgaaactttaccacttgattgtgaaactgaatcgttgcatgggattcttttttatagcaagcttgtccaacctgtggcctatggtggcttcgaatgcagcccaacacaaatttgtaaacttttgtaaaacattatgagatttttttgtgattttttttttttttttagctcattggctcttgttagtgttaatgtattttatgtgtggcccaagacaattcttcttccaatgtggcctagggaagccaaaagattggacaagcctgacttacagtaagggtgaaaaccataactgaattgcagtcttgattttgattgcttttctgggtatgttcattgggtttcttcttagcttttgcatggcagtgcacaaatttcttttattggcagcgacctgattctttcaaaggcaatcttgtcatttacactgttcatgtaatgatgtaatttgataactaccaatcactaagcatttcaacattaaacattaaagacgtttaagatattatgtatggaagactattgcattgcctgtgtctgtgttcctggtacaaattatcactactggatagtatttttcattttaattgaagaggtaacacttcacctcatagcatcaaatagcattgtgttatacaagtagtaaggctcacatccagttttcaatgacaatgatttcattcgctcttcatgctgtgatcacaagtagatataaagcattttgaggcagagctcttcagtttttaaatgttgagaccatttagtcagctggccaccatttcagatatattgccactattatgttacattttagttcttttagagggaaaatggcttgttttactttgcagtctcttattgacatcttttttaatatttatgtgcccaattgcacatgtggccttttcagcatttcccataaaattgtctacatagaattatttggtcaaatacatttagaatactctataatatccattccactttagtagatattatttgtccatagtttatattaaggtccctgacttattctgcaaaaagaaactcatttaacttggcttgacacaagtttactcaaatttacttgttgggaaatggtagtcattcttctggttgattttaagtcgtacagagacagacttgtgcactatacccctgcagttataccaagtggtatttcacatactctgcttgatagttcactacctaggtcaattcaggtgagaaaccaacaccaacaatatgtaggaaggggaaaaagattgagcacagaatatcagaaaaaaagtcagagtgaccccagtttcttttctccatatgcattgatggtttcctggagttttccttgctactgcatgggaagatcaacctgaagtgcagagcttggataggcaatagaaaacctggcccaatatagaaaattaacagacgtgtatcaaagtgaagacttttatacaccagaaatggtccatgtgaatttttacaaaaagctagtcacaagaaggagtgttcttccctaagggctctgcacacctttctttgatgttgacttcggagatactggccccatgttgtggctggagctatgggctctggtagagtagcacacacagctgatggccagaagcggggtcagcaagccacttctatcctgtaggtaacgtgggggaagagaaaataaaaggaaataaggaaatatgaggaactggactttatctttgcttgcttgcttattattttttaattcatatttccctggtttatacatactcattgtgtatgtgtatttagttctaattttatcacatggatgtacatgtgttgaccaacacagtcaagaaagaggacagttcaggtcccacaaggatccctcatagtaccctttgataacgacactcccctatctccctccactttccctaaacattggcaaccactagtttactcccattttgtttttattttaattttttaagagatggggtctcactattgcccaggctggtctctaactcctggtctcaagcaaccctcctacctcagcctctggagttgctgggattacagttgtaaaacaccatgcccagcactaaaccctatttctaaatttgaattttttaaagttttacataaatggaatcatatagtaagtaaccttttggaattggcatatttcagtcagcataatttcctgaagatttaccaaaggggttgggtgtataaagatttcattgctttgagttgcagggtagcattccatggtatggatgtagcactgtgcatttagccattcacacattgaaggaacttgggttgtttccagtttagggctgttagacataaaactctgcgaacttttatgtacagatttttgtatgaacaagtgttttcatttctctaggataaatgcccaaaagtgcaattgctggtcatatggtagttacgtgtggttcgttttacaggaaactaaaaaacatgttttccatattggctttgacattttacacttaagaagacaatgtctgaatcatccagcctccttacatcctctccaagatttagtgctgtcactgttttgttttttgtttttaggtattttggtaggtgtggagtgacagctcattgtagttttaatttgcatttccccgatgtctaatgatgttgaacatcttttcaggtccttattttccatctgtttttcctcttcagtgaactgtttgtgtcttcttcccattttctaatggaatcgtatgttttatactattgaattttgggcagtcttacttattctagatactctttctttagtggataagtggttttcaagtatatcctcccagtctgtagcttttctttacatcctctttgcttgagctttcatggagcagaagttttaaatgttgatgcagtctggtttattggtccttccttttaaagaccattcaattggtgtcaagtctaaaagctctttgcctatccttacatcacaaagatggtttccaatattttttaaataaaagttctatagttttatgttttacatttacgtttgtggtctagtttgagttgatttttaaactgagtaaagtttaggtcgatttttttttttctctccttccattgaattgcattttttcaaaaatcagctgagcccatttttgtgagtctatttctgtgttctctgttttgctgtatggatctatgtgtctctccctgtgccactaccacatggtcttgatcattgtagctatattataagcctcaatgttaggtagagtgattcttcctgctttgtttttagtctagatagttttacacattctaagtcctgtgcctttacatataaattttagaataagcttgtctttatctacaaaaaaaaaagaacaaacccaaaaccatgctgatatttcgatcagaattatattaaaattatacactcatgtgtcacttaatgacagggatatgttctgagaaatgcatcattaggtgatttcatcaaacatcatagtatgtacttattatacccagatggtataacctactacacacctaggctgtatagtatagcctattgctgctaggctataaacctgtacagcagatcactttacttaatactgtaggcaattgtgacacaatggtgagtatttgtgtttctgaaaatatctaagcatagaaaatgtacagtacaatataaaagataggaaacggtatatctatactgaacacttaccatgaatggagcttgcgggactggaggctgttgtgggtgaactggtgagtgagcggtgagtgaatgtgaaggcctaggacgttactgtacattactgtagacttcataaacactgtacacttaggctacactgaatttataaaaatatgtttcagtgataaattaatcttggcttactataatatttgtatttataaacttttaatgttttatgaattttgacccataataacacttagcttaaaacacacattgtggagctttactaaactattttcttgtacacttattcaataagcttttttattttgttttctttttaagtgtttttgccaaaagcatttaaaaacacacgttaacctaggcctacacagggtcaggatcatcagtatcactgtcttccacctccacatcttatgccactggaagatcttcaggggcaataacatgcatggaactgtcatctgttataatgacaatgcctccttctgaaaaactcctgaaggacctacctcaggctgttttatggttaaccttttttttttcaatttatagaagtaatatattctaaaataacaataaaattatagcatagtaaatacataaacccgtaacagttatttagtatcattctcaagcattatatgctatacataattttatatgcaaaacttttatatgactggcagcatagtaggttttttacacaatcaccacaaactcaggagtaatatatttcactactatgtcatgatgcctatgatatcactgttgtaaatatggtctggccatatatgtggtccagcatttaccgaaacattgttctacagcatatgacagtgtattaatttgggaagaacagcaattatgttgaatctaacaatccatgtacatagtatgtgtctccatttatttatgcctctgcattttttttctttttcattagcattctgtaattttcattatacagatcttctgcatgttttgttatgtgtaatttacctgggtattttattttatttggaacaattgtgagtagttttgagtttttaatttcaatttttgcatgtttattattagtatgtagaaattgtatcctgtgacctgcttaactccctcgaatttctgatgttggggagggggaaagcactcggtctttcaccattaaatatgatgatagctgtagttacttgtaggtgttctttatcatcttagtttgtttttaaagtccaaaattggactatatatagcttgacttacatttgggtggcacatataatcttccactagatattttaatgatctgaagctttttagacattgacactactcttttctcatagttcctagtgttgcaaaaaaggagaaaagtctcgctataccttgactgtaacatgtatgttcttatgcatctatgttgctccatctgcctcagaaaaatgcccaccctggccctctgactgctactactactgtccgtctacttggccaggttctgcttgttaaagccttggttacacctgtagattaactatgcagtcctctgtgtacttaccaccttttcagcaaagtgccacttacaatgtgccattacaattaagttatttttctttgcttcctgatgctacgtccatgaaccggccatatcagatatccagaacaatattccttgcactcgtgcactgcagaaagagtagccatgcttgtctctagaccaatgggcagatctgtgccagctatatttgtgcttaggcaaaagagattttacctttggaggagacattactggtttccgtagaactattctatacatttttgcatattctagctaaaatcagtgatagaaaacatccacactgtgaaattgtatggcagaagataacaaggaattagacaggaaggcagcaatgatgacacatacttgatcatcaagaaataatctttggaaattccatgtataagctacattctgatatgaggtactgcctcatttagccattgggaaacatttggatggtctagttttgcagttctaactcagttagttacattccaagagacttaatgttttgagaatgttgcattttagttagatttaaggtgatacaacgctatgttattgtatcatttctgttggatagcgtgtggttaaaataagtccatcaactgttttttcttcttttctgggcacacacaagagagttttgctgaatcactttactccatatttataacctagcaatttaatactatttttcagtaacaataacgtgaggcacataggccctcttatttctctctgatatactgctatatgatccttagagtatccctaagtgtctacaggttctggttttatcaatttgaagataattattttgctttttatatttttcaaagaaaagttgaaaatatccaagttgtattctaaaatacatatactgcttcactgtgtatagacaccacttaggtaatttatatcagcccttaagagctatgaagtgagtatattctttcagaaattgacagtacaattgttctgatacagaaagtgacaccatagagtatattaacggtgtaattcttcacaggcattttttataagtcagagtttaaagaaacagatctttcttcctctttccctatgaactaaagcatttttaaaaatgaagtcaacggaattttctctctcctttaatttaacttggaaagaatgaatcagtatttgctgtactggattgtcattggaagaaattaaatgttctctaaaaataaccgttggtaatcaaaatagtatttgcacttgattgctatttttttaacttttttaaacacttgaaaaaatctttggatgcttataaaaataattatttttagccgctataaataaaagggaatatgctgatttaaattactgttatcctttgaattctatgtacttggtaattttcagtgacaatatatcttccacaaagcccttcagaatatgggaaaaataggacttatactcagaaactgaatattatcaaatatttttgtaaataaaaataattataggtagaataaaatctatttaggctatgataaaatgttttaggagggaaattcatgaatagttggtcattattacaagttgaagctaaaagtattcatgatatggtgaatcactggtgaatgtgaaagtcatatttatgtttatttttgatttaggatatttcatttccttttttgaattatattgtctggttagttcattctgatacacgctttgtctttggatagttcatgccattttagacactatttcagcaacatgggatcagtgggtatatatttatattgtattgctgaatttctagaagctttaataaagaaatcagaatccagcttttctacctcaaagcaaatggttttctctctaggttctgggaaagagattttaaaattgttttccatgcaggaacagaaaaccaaatactgtatgttctcacttataagcagaagataaatgttaggtacttatgaccataaagatgacaaaagtggaccctggggacgactacagtggggaggaagggagaggggtaaggattagaaaactacctacctgttgggttctgtactcactacctgggtgatgagatcaaccaaaccccaaacctcagcattacacagtataaccacataacaaacctgtacgtgtacctcctgaatctaaaataaagggtgaaattctaagtaaataaaaataaaaatttttaaagaaaaaagcaaaaactaaaattgttttctaaaagaaaggaaggtcttggtgtaaaatttgtgatttaattggtctttctaaaattcagttttgttttgttttcaaatcagatcttgaaaattttaaaaccaaaatgaggagtacagtgtctgtgcgtgaaggccagggagttgtgctgctctgcggccccccaccacactctggaggtaagtcatgctctgtttctgcttttcatatttattaaggttcagggcaaggcctgcagcgcatgtactgttattgcatctgtaaattactctgagaaacttgataacctgagcattagattttgtctgctgagttggaatatgaggaacactacaaaaaatagtccatccagagaggtttctaaacaatcgactcattgactttttggtttataaagacaagagagatcacatttgcttcagtcacctaacggtgctaaacaatgctttgtcattacaccattatcatttggtttttagttttatgccatgtcaaactggatctttgctgtttgtctgcctctctttctctctctctctctctctctctgtcacacacacacacacacaagcttattagtatgtgccaataagcctctttatatatgtattttatatatatatatatatatttatacacatagaaatgatatgtgtgtatatccacatcatttacattggggcgttggaattgcaaattttatgctatattggtataaattgaaatattactagaaattcagaaccttaccaagatagtgacccagagtaaaaatgaacttcagcacatatgaaaataattttattatctccccagtatgagcctggggtgctggtttgattttcctatcgtgctctctattgcaaacttggccacttgcaggaacaaagagggcattattaatgaataaatcactgttctcagagaaacacgtattttgttattgagaggatgagaattattgggagataaacaagttagagtggatctttctgaccagaagtgaaactgagaagtctgcttctcattacagtaaaacttattcaaaggaaaacatgctggactttatttgttctgtgacatacaaattacagtcctttccacccaaagagttgtcagttttgatcacaaaccctcagcccaataaaacagatatctcccatcttcaggatctggccacttgaaattcgtgaaccatctggagactgcagacttggagcttgattaaaaaataggattgccatcatgtggtctgctgtgggtttaaattgtgttctccagtttatttcaagggtgttcataattgctggaatcttgatgtttcagaagaactttaagtttgaagggaagcatagagcctcttgattgcaaacaaagtaacagaagtcaaaccgtattgacaaaaaattgggagtttgctggctcacataactgggatgatcaagtggcttctggtagcactgtgaggttttacgaagagatacaccacccagaaggacgtgctgcctcgccacggggtgtggggttagtggatggcctccagctctcactccttcctggtctgccccagctgcagagagacacttgcccacagtcacacccctcctgaggaagcccacatctagtgactgagcaaggctcggatatgaagggtcaaccatttctgaccaacactgggcaattctgatttaatccataacttcctgtcaggatgaccatgtttttgttggaccacatcacaattcagtttctttctcttcccagttgaatcctagttttttcctttcatgagttttgatcattgattaaaagcttttattccaaactctatttaggggtccgctccctgaaaactcaatccgttggattcagggattgaatcaattccataaacaatccatttttctctgtatttcttgactgcacttctctccatattgcctccattctcatgtatcttccttgtggaggcaaaggtgacctctgacagctctaagttctgtgatccttaatgctaaatatcctaatgaagcagacaccctgtttctctatggctcctgattcttttagaatcagccttttttatgggagccctgaagctgagggcttgaatcagtccaccagctgacaagcactggaatgagaaagaagcagtttccaaaagaagtgttgtattatgagtaaaaagagggagatatattagatagaaataaataattgctaaaactacatctaggaaggaagtatcaaaataatttaaatttatattgtctcaaatgaacataacataatagctgggtagtcttggttgtgatcagttttataggtgttgacccaatttaaaattccgactgagtgattttgtttaagtattattatgattagatacattcattgatcggaaaggaggaactttttggttgcctaagtatgcacagagtgaacatgtcttagtaagctgttggaggaaacatgtcccaaaagatgaatctattcaaatgttataaaattggagaactgttagcccatcacacctgtcctaaataatgatatcctgatttttctctgcctttggtgacttcaggtagtcctttcatttttaaaacactcggttgggatgacagtgtaagtcaaataggattgtaggtgaagacgggaagaaatcttcccagatgtcagacatgaacccataagaacccagagcatgcataggagagcaaataacattcaccaaaagcatacttccctcagttccagattgtacagatttagatgctaaaaagtgtgatgctcgttgatccaagtgtctgtaatgcggaggtattcacaattcacgtccactgtcttaacacattggcttatgagcttcttgagggcaggcctatgttggtgttcgtctgcacccaagagcctagtacaaggctggtttgtaacaaacagtaaatattggttgaagaaatgaacacattcatgtaaggaatacatttttaaaaatttggccagttatacatgctttttgagagttcactggaaactttgtgaagatataagcttttaacagccaaaatgacctgggtgccaaccagacaggtgaggggattgacagatcagagtaaactctgtccacagcagctggtatcagccccgcttcatcacctttttgacttatggcctttaattcagtagagggtatgagccaggtcagagagcagctgaagctgtaactccggggtatatcagtacaactgatgaaggattaatcagagagctcatggcctgcactgtggtccatttggttttcttcccacagagtcgcacagtccctgcaggacatgtgcttgcccttctctgtctcccatactttgtgttagctatattcacttcacatttcttcatttcttcttggttccctctctgtggttagaaatgtttaaatttgttatttttctgattactgaagatacaatcatattttatttatctgttgtatttcctcttatatcagcctaacagagtaagcaaagaaaggcagtaatagtaataataatagtaaccagctgggcacaatggctcatgcctgtaatccagcactttgggaggccgaggcaggcagattgcttgagctcaggagttcaagaccagcctgggcaacacggtaaaaccccacctctacccaaaatacaaaaaattagctgagcatggcggtgcacacctgtagtcccagctactcgggaggctgaggtgggaggattgcttgagctcgggaggtggaggttgcagtgagctgatcataccactgcactccagcctgggcaacagagcgagactctgtctcaaaaaaaataaaataaataaaataaaaataatcatagtagtgttagcctctgtctattgagtgttgcttagatgccaagcagtgttctagtcctttgtggaaattacctgctagtgagattctttttgggtaaaagtatggggaggaagatgtgtgataatgtacattagagtctggaagctgagcctgcagatgctaagagcgtgggctcttaaccagccaatgcctagtgccttgagcccagacttcctgcttagaaatggcacatgaggcaggaggccagaaactaagcttcagcacaaaaccctccagcttttatttagggctacacttcgggagtttgcaaagtgtgcctcagagaggaggcagccaacctaaaatcacagagctgtgaagaagtaaaactagaacctggatgctctgactcatgaccagggctctttctagtatggcatgctctaaaccagcaccctgttgccattctccaaatgagaagtcacagagtcctcagcagaagtgacactgtcctaagccaaaagcttctgacatttcaaaattggagacagcacagttcatggttttgttttaattttccagcccattgtttaacacatcagcaatgcttaaaatcacattagcagaaatatctccagagttaactaaatgttttgactcatagtaaaattgtgttaaaatctccttttagtgcagtaagtttataactttcttttgtttatttgggataaaacccagaaatgttctccataactagattgggaagatagatgtggaaaaggcctaaataaggatcccaaagtgtggaaactgcatatgttaatcatatttccttaattaatcaatgtaatttacaagatagtatcagcaacttggggcagctctgcataagagcatttgccatctatttgatactataataataaaaaattgttttatggtgggagacaatgaagaattttcctaggaatccctgtaacctcgcagcaacagactgctgtcatctgagagggttcttatctccccatcattctgtgtcattttctgccacctcccagtcattgctttctctgcagagcaatccagcacctctatgaagcaagaggaattaacctcccaaagtttgtcagaaaactaggaaatcaaaagccagaaatagaagactggacatgcatcacctgtagcataattattaatctagttatcagtcatgtgaaaagctgggagttcgtgttaattaccattcacttgctgatatcaccacacaatcattagacattgaaatacacgagaaaaattaccctgttttcagtaaggtcataagactagttcatgggcaccttatgataaatactaattactcaggaattcataggttaatcaagttattacatacatgcatgttaataaagagatgagttctgttcaacaatggctgatagaaatttattctgagtagaaaacaggcttgagtctgtcccagtgtttaatcagcaagtgactttggtgtcttgattcagctttccatatctctgctatgcacatattcttgaaatggaagtcttgtatactgccattcacatattataacaacatagcccttgggatggaaaaacgagaatgtgagatgccaaacagcaggtaatggaggctgaagtgacattatggtaaaaattgccttgtaaaccctggtgtgacaaaggtgagaactgttagcaacatgcccagatggcatgggatttacaacttctgtatcagcatctttatttttttttctttacccaagatggatagactgaaaaacagaagtcagctcaggtagcttagctgacagaacctgaagaaaacgcactgaataggagttttcatctctaggaagacttgtccagttgctagagtctccgtcaaggcagggagacacatgactagtgtttttggatgtgattatgtctcaaaacaacaatttccttaaacagtttaatctgtaagtataatacagcttcatcttaggcacacagttttccttgaacaacactttgctactgttctgcaggtaataaagttaaactttaaaacaggccaggtgcggtggctcatgcctgtaatcctagcactttgggaggccgaggagggtggattgcctgaactcaggagttcaagaccagcctgggcaacatggcgaaactgccccgctactaaaatacaaaaaaaaaaaattatccaggcatggtggtgcgtgcacctatagtcctagctacttgggaggctgaggcaagagaattgcttcaaccctggaggcagaggtgttagtaagccgagatcgcaccattgcactccagcctgggcaacagagtgagattctgtctccaaaaaaaaagataaaaaaaatttaaaataaaataaactttaaaacattagcatttttcaaaatcttgaagtcaagaatgtatgtataggtagtgtcaaaataaaaaaatatagagatgaatctctaaatttgatgttttatttgggaagaaagaatatgctttctagctgggcacggtggctcatgcctgtaatcctaacattttgggaagccaaggtgggcgggttgcctgaggttgggagatggagaccagcctggccagcaaggtgaaaccccgtctcactaaaaatacaaaaattagctgggcatggtggcaggtgcctgtaatcccagctatttgggaatctgaggcaggagaattgcttgaacccgggaggcagaggttgcagtgagccaaggtcgcgccattgcactccagcctgggcaacagagtgagactctgactcaaaaaaaaaaaaaaaaaggaatatgttttctgcagtggacatggtggctcatgtttgtaatcccagcactttgggaagccaagatgggaggatcccttgaggccaggagtttgaaaccagactaggcaacatagcaatactttgtctctttagggggaaaaaacagaattaagaatatgctttctggctcccatcacatttgcatcagaggtcaatgtgtgtagactgcttctccaataacccagtagtttccaccttccctaaaggagcaggtgcaaaagttgcattacagcagcacttatgtcaccacaaactgcaagatcaagactaggaagcagatgattgataggctaatgagaaattggcatctgtacaatagaatattactgcttatttattgctcctatcctggggataggttagaatgtcatggcaaacagttaggtaatccatctgtagactgaatgaatctcaaaattgtaaactattttttgaatatgtcaatactgatgtgactattgacattttcaggagttcagaatattaacagattcatagtcgcattaagacaagtatgttctgaatcaattgacatataaaccttagctgcttttatatggataactataaaatattttgatctctaaaggaaacatttgttgtactctatagaccattttgtagttggaaatggagatgaaaatcctgaagttctccaaagtgcctgaatgtggaagctgtgaatttaaaatattaattgagcctgccttcaactttccttttttctttctaagtctgtccatccaggcatattccatccatccatccatccattgtattcattcattgatttactcaagtatccatcaaacagctatttatttgtggaagatgtgatatgtcttataataataaggttttactataataaatatgtgtcttcacttgaataagattgatattaaataagagaaaaactgagcgtattgctcttgaagttgatagaaatatatccaaattgatacttgtcgaatactgcccgaaaccactccccaagagaaaagtactgagttcagtttgcaggaaataggaagatagataggaattctgtcctcaggtacatatgggcccacagggaatgaaaatgatgagtttgctagtgactagttaaccctagaatgacaataataggtgccattattattggccagacacagcttattgctcctaacagaacttcaaggaagagagtatcactctcattctgcactgacaagccaaggctcagagcagttaggtgatttgtccaaagccatgtcatggtagatttgggcacctaggtctgttgctttctttccttttttttttttttattttagaatgtccctctgtcacccaggctggagtgcagtggcacaatcttggctcactgcaacctccacctcccgggttcaagcaattctcatgcctcaacctcccgagtagctgggactatagccacacgccaccatgcccggctaatttttgtgtttttaaaagagatggggttttgccatgttgaccagcctgttctcgatctcctgacctcaagtgatccaaccgcttcggcctcctaaagtgctgggattacaggtgtgagccactgcgcccagctggtcagttgctttctgatggaaaattttcctgtgctcacaaacattataggcttcaatttttttttacttatacattttccaccttctaaaacagtgtttttcagactcctttaatgggtactctgtaacaatgaaaacctttttaagcaccaccctgctacaatcacactcacacatatacacatatgaaggaagcagagagggtacaaactgggcacctagagctagactgcttgagttccaattctaacactttcattacaagctatggaatttggaacaggttgcctaacctctgtatctcttatttcttatctatacatggggaataatcacagaacctatccttataggatcattgtgagtatttaagaaggcaatccatgtgaattgtttgaaatgtctgatttatttatacacatacaaatatactaccatcttaatatgtttatggaaaaatgtaaaaatttaaaatatctaaataaaagtaaatctatgaaggggattaactatactttctttctgtaccctgggggattgtctggctgggaatatctgaaccccactttagaaaacatggttctagaaaatgtttgggttttgttcctcattggattatctgtggttgaggaggaaaaagttaaaacaattatgtttagagaaaaggaatggagatggctttgagatgcccatcctgtactagcatcagtgaccccaggggcccagccagcacattccaactgacttcaaccgattggcccagggagaacacctgccacaagatgagccaatcagatgctgtctcctgggagtttgatatttgacctgtaagcctacaagtctgaatttgagagtttggaacagagcctttctatcatgtagattaggcagccaagaaagctgatgcctcaggagctgagatgtagcccgacagaaacaagaagagaccaggggcagagattaaggacgaaagactgcctggcctgcaggctccccagctctcatttctgtagctgttttctagcccttgggttctatgaaacagcttgtgtctgtatatcattctgatccttacttaggctgactgtgataggtttttgtttctgacaaacaaactcataactaatgcaatggacatcattttaggatgatatgtgtgtatgtatgtagtaatgaaactgatgcaaggagaataggaaatttaatttaaaaataaagaaacagaagctttattttttgacagctgtccctggggctgtcacggcatcccttttggattaaagtcagcatggaacataccacaaagagctctggaaagagtcagggtcatggaaacaacttcgagaaactggattcattcattcattacaacttacactttcagtctacaggtgaatttcccccaagcttcagaaatgcccctgaccatttcttacattgttctcacagcagcatggcttcacacttccgccttccagtttattcccagatcccctaactggtctgcagtggtaggatgagaaaatcattctttctcactctaaagacgtacgagtcttcttgctctgattccatccaccaacagacagaggagcctgaagcccatcaaaaaattacatgtggaaactcaggggtttaaatctactgttcgagagatagtgcttcaacagaatttattttaatatggcagagtcctgaccgatgttttctgctttaagtaaaaaattagctataagtcaagaatggtaaaggctttgtctcctatcccaaaaagaaacagaaagaccattagttgatgcttttggtcaaaaaaaaaaaaaaaaaaaagactataggaaacaccaggtgagatccaagaattgatctgtgcactagcaagtgggggcaataaaacattggttgcttccattacagcgcatttgtgtgtacctgtgttttaattaatattacacatgctgctgttacaaagaaacctgacaatgtattagatcaaactgagggatatttcttacacagataaagtccaaatcaagtgtttttggtcatagggcagtgttttgtaaactctagtggctcatttagggggcttgtttaaaatgtagattccacagtcccactcccagagattctgaccccatagggtggggtctttcctggagacctgcattctttatcagtgacccaggagagtcttgattcagatggtttttaagccatactttgaaacacattgtcttcaagtcatacaaatgtaaatgctttcaaaaaccatttaaaggaatagagaaatatttatgccagagcaagtacaagagttgaagtatttttgtgggtgaattttattaggtaggacattttaaactctaaaacagaagtgaactttgtggcttacatggaactttgatactcatttatttataagctaggtaatttccatctcagcagatttttttccctgaactttagctgtcttggagagacaaaagtatgaggataattttaaaaaaacttttacaaaaatgctgtcttggagagcaaagttgctagtctgcctagttgtgtaactgaaatttcctgactttcatccatccacatgcccaggtgtggagtagctggtgggtgcttcgcagtcaactgcactgatgctcacagagattgagcacctctcttaccacttggttaaggttttatagcttttgatcctcacaggcactgcttggcacctcaccccagagtagtttggatttgtttttgttgttattgttgttattgtgtgtctgtgcctgtgactgttgctctgtctgaaggaaaacccagattggtcttgtggggagggaatttcagaattgatccccttccttttgagattcggcttttatttaaaacctgtttttcctcattaaattgagcaagttggactttgaaatggtaccagggttaaaggtaagagtggaatgaatcatgcatgaagttttcagtaagaattcattcacagaaactccacagtgatcacctttccctattcccacaggtctgcagcatgcagccaagtaattcaaacgaaaggagggctaggatttgaggcttgggcaattattttcctggtaacagctaaatctctaaacagcatcaattactttatttgcattttttaaaatatagaaaatgcagttcttttttgagtttattgaggatttggcacatgcatttcccatttgctggttacagttcttaccatggctttttttcctaaccgtggctaagttaaattcattagacacagacacattttgtatatgtatatgaaacacatggagatatttttcactattcgtatgaaatttgctctgcatccgtcagctttcaataggttatgttgcagcaacaaacaactccaaagtctcagaggcatctaagaataaagattgatttcctatccatgtaccctctaagcagtgggttggctgaatctgtattccatgtgattttgtcgttttgagaaagagtggtccctacctgggacgtgtcattttcatgacacagagaaaataaaactgtctgaactatgcaagctgttcacaggtggtatagacatcatttttgctcattccattttccaaagtaactgttaatggccagtgctgaccaaatgggccagaactttcctgccacagagaggagcagcaaataataataacgtaattcaccatatgctctcttattttttctttagttatttgacctttgtggtcttcctttcagtttttccatatttgacagagatctgcatatgatagccagtctacattattccaactctactataaagaaaacaatgtataatgaaaaatggtataaaattcagtatagaagggattgtggtaaactgaatgttccacctggagggttcatgggctactcagctccagtggattattgccatggagaaagtaaatttttaaagaaaagccagaaactgtatgctggtaaaattttccaatattttttaaatggtatggatgaaacactacatggtttgaaggtgccttcagcctacaggacacagctgaaagtctcctcctttaaggatattctttacagataataaaaaaatgaataagcctcattcacttagcaatctgagggattacaaatatgagagacagtcaaggggatggtttataaagtctttaaaaatccacttttcattagattcaggggtacataaaataattccaaacgaagctaattaaagcagctaattataggcccttggaggcctgtagtatctgaaagtagcatctcagtcctggaaatagttttccaaatttgttttacatactttttctgaagtaattaaacattctccccttccagtctagtttgcatcattacttttcttagcaaatgttttatgcccccaaagtgaggataaatcagtcagctaagcacaacagagtaggggaaatctaaagagtgagattctattacacataaatacaaactctgtaatatttcagatcgattttacctggaagaaggtgaatttgaaagatcagttgacagatgtcagctaaagctcagttccagtgaggacacatcatgttccccaaagtaaacaccataactaagcagaactatacctaattctattgtagctataagtaaattgcttgtttcttctaatgtaaattttatgtaaattcagaaatttaaggacttttccgttttttctaacatatgcaatgttttcagtgacattattatatctgaaagtattaggtgttttgcagcccactcctgttacttcttctaaattctgatttggtttttatacagcctgccacattctgtctttactactaccatttactgatcaccttccacagctaagtaacattgttagcactgccttcctggcaagactatctaattgatgggttgataacgtgaaatacagttggtaaagtctgtgttcccagcagagactccttattttctctcatggttttatacttctgtcagcatatgttatgcttagacatcatttgggtgacattgagcagcattttcagactgtattcttgcagaatggtaataggccccatggaaaagtatgaggacaattaaaaaagaaaactttttcaaaaatgctagggaaacaagaatgcatctttcttttatttctcagagcttttaatgggataatattgattttacctatcaaagaggaataatccagcatgcaacatttcctaaacttacttgagaagaaaactctttgtttatggagcatcttgcaggaccggatgttctgagcagcacacttcaggaagcgctgacctagcttaaagatagggttcaccagtaattttcaaaatatcctctgccgagtgctctaaaggtttgtgaaaatactcaagggggcagctttgtgtacaaacgctaattttcataactttctcttcaaatagagtgactttttttttacctattttaaatgttattcttccatatgaatatttttaaagataggacactgggctgaccaattataaagaaagaggataggacactgggatgacaaattataaagaaagagaaagaaacaacaaaagaaagaaagggatggatggaggaagcaaggtaggaagaaggaagggagggagggaggaaaggatagagaggggagtctctcctcttattttatcagtgagtaagtagagtcagttgcctgaatttattcagattcagcttgactgttcacttattgatacgttagtgggtcatttctttactatatcattatgaaatctggaggagaaaattaagggatgctttcactagttaatgtacttctggcatttgtaaattcagttaattatgtatggatcacattgcatctgttctagtaataacaggctggtgttttctggtggggaaactagtccatcaatcatctgtaatcattgatcttcagataaggggacccattctggcaggcttacggtaaccatagtgtgttttcaactctactgccaaaacatattgtatcccacaaatctcttaagaaggcctattctgtttccacttgagacatgaaatgacatctgaagtggtgatacatgtagacttaaagcaatctttttcaatcattataacctttaagcaccactaacatcccccaggattctttgaccttttctctctgtattatgctttttgacaactcagagagagaagcagtacacctgacatctggtataaacatgacatgttaattctcagcacacacttattattgccaaccatttacagatactcacatgatgtgttttgtttttcctgtggctctcacatgaaatctatatgggttttcttaatccagtgctagtaagcagtaaaagttatttttttattttcatagctgtggttctgagtctcagattcacaggttaggcagagggcaggggttggacagtcctgagccatacaatgggaggattctgttctctgcagtacaagagtagagagtaagaagaatttatgggctattagaacaagatatggatacataaagagaattgtaacatccacagggtgcagtcaaggcattctgaatctttctatgagtggagtgtaggagaagcaaaattccgtatttccaaaatgcattgattcacacttcatctcataaaaggtgttaaagaattcatgacttctttctgatccttggtgaagtatgttggaagtagtattccaagctgagaaacatcaagtatcttcaacaaaattgaaagaaatgctgttttgctaaaaccaagtcatcacaattagaaaatcataatgcaatgaaggcattttccgggaagtaaaatgagtgaaaaaatccaaattgaatggatattccaataactctaagttgcaagagcttcaaaataagctaaaaattgacttcttagtcaaagaaaatggcattaaacagataacctgtgagtctcagttgaagtgtcatgtagagaaaagttaaaacaaaaaatatgagacagttctgtccaaagaatagtttctaggtaaatttttgtgaacttccagttcttgtacacatgcttagggacagacttctaagataaattgtaatagtatggaacaaccaacagttggattaatagtactgttaaaaaaaaaaaactttagacaaaataaatgtaagagagtttatttgagcaaagaaatgattcatggatcaggcagcacaaaaaactggaagaggttcagagagctctgcaacaaaagtaaaagaattttatatgctgatcatgaaaacaaatagagaagttacctgattggtgacagctaggtgtttgcctaatttgggtacagtgtgatcaggcattcaccttacttatctggatatgattcagtgggagattcctatctgtgtaaccagttgtgtgcttggctgttcatgattggctaagtcttgctttgtttggttttagtcagttaaaaaaatgtttccaagataagttccagtttgtttacctaagagctctggtctcagagacagcctcaggtgaatggccttcttatttactttaacatgacccaagaccatggtaagacatcctgataaagggcataacatatagcccttatatatatgcaaggctcttcgtggaagactgcttcttctaagctgtgtgtagtgcattggccaaagaaatagagaacctttacacttgaaataaaaaataatataatagagtgaagaactgtatagacaattttactgtatgttagttccagaaggatactagttaagactttggggaaacaacctccagttgctctttatgaaacaatgatgtgacttcgttagaagacaaaggagagatgaatgatatgaaattcttctaagatcagagaatgcaagagcacctcctgtagggtaattactctgaagaaggcagaggagattcttacaaagctgcatagaagattccaaatgaaaagtctagaacataaataccctgtctaattacaaaggtttaatacaatctctgccgtaaattgggagatgagatgtgaatgcatatagttgagaatggccctcgagatctggccgcattaggaaatgcattgacaaggatccaaaaagcaagccagttttaggcctcaattatgtcccctctaaagacagggataacttccaaatctcagttaaaagaattaacacatgcactgcctcctgagtgagcatgccgtatctttgactttctttttctgtgatacctttgaaaaaccgaccactgttactgttcctgggagataatccaggataagacttactcaatgcaaatcttttattaaaggcctacaacattatgttctggagaattttgttttccttttttttaaacattagttagatcagattttcaaaagcatctcagaaatattcctagtcttaaatccagggatttatgtaacacaaacttgcaagaccagtgggaaattaatttcctttgaagcacattagcttgaagtttgcaccgtcccacagtggagcagaatttattccaatgttgttgatgacctctcaaggtcctaccttccctgagctataagctgactgcagaaagccaatgattgtctgggccattctggctaagctggaaaacatcaggtcaaagaaaggttaactggagactcaccatgctgctcacaaccaccaacaaccattggggaacctattgtgcatatggcctctgtgatatgtttcctatcatacaggagagagaacacagttcctttaaatgtcaacaagttctgatactttatcaaaatgagatacctttcaatggatgccctgaggagtgctaccatcaagtatgtatttgtcagtctttttctttttttatttatatatatttgtggggtacaagtgcaattttgctacattgatatattgcattgtggtgaagtcaggatgttcaatgcatctgtcactgtactcaccaagcaactgctcatcgtccactccccagtgttttccaaacttgctattttaagaagcaagtttcgaggtcttttgctagacctaggtcttccgctaaggatatttggcttggccgggcgcggtggctcacacttgtaatcccagcactttgagaggccgaggtgggcagatcacctgaggtcaggagtttgagaccagcctgaccaacatggagaaaccctgtctctactaaaaaaaaaaaaaaaaattagccaggcgtggtggcacatgcctgtaatcccagctacttcagaggctgaggcaggagaatcgcttgaacccaggaggtggaggttatggtgagctgagattgcgccattgaactccagcctgggcaacaagagtgagactccgtctcaaaaaaaaaaaaaaaaaaaaatagaatatttggcctggctatactttacccacatcttcatattctctccattgtaatgcttctagcacccacacaatatatgtgttcctaaagttccacatttctttatcttagcattacatagaaaaatagaacaaattccagtttaaattctaaaacttaacatccaacatcctattgtaagagagaatgaaagatcccttccattctgccacattattctatacatcctcggttttgagattatgcttcttagcaggaaaatttatacttttcttttattcctttttatacttttcaagattcagcataatagacaaggtagagttatcattttagtcctgaaaagaattagtaagtacatgtcctctgctgaagtctcctatatgtctttttattattggtttcttcctctagcagaaacaaaataattactagcaatgagaggtaatgtgctgttatttatattttagccatttccctttgtatgtgtgtgtgcatatatgtgcatacctacacatacatagtttcttttccttttggtgaaattgtagatttgctaaagaagtaaagtatctggatgaaggaaaattacacatagaaaaaaataagcaatttactggtgtacagttgccattgcatacagttaaactaaggaatctaaaaaaagtaagattttagaatgaaccgaagcctttctcttgaagataatttaaaaaaaaaaacacatagttcagtgtgatttttttcaaataagaaaagcaacgatgcttattatggaacatttagaaaatttagcatgtttaaataacaaaggtaaaatcatattaccacaatgtcaagataaccctcattttggtctatttattctcagtcttatttttttccttacacattttccccataattgaaaactgtaaagacaaatttgtacttttaaaattatcgttgtagtttaagcacttcacaatgttagtataaacaccttagaaacaatctttgttgtaaaaagaaataactttaaaataatatcttctgatcattgcttatcttttaaggcaattagcattttgtttgtcttgtatgatacatttttccctaatttgtcacctttcaacattatattttgcggattttattttgatttgctattttgccttggaatactcaaaagacactcatagcattataacggcaaaagactaaatattctaaatgaccaacaatagaaaaatgaagaatgagaggctactgcccctaaagtggatcaagattatctatcagaacaacagaaagcagtatccttactaataaaagagcaatgggatgatcttcctggataattcaaaaatggctcttgtcattgtatcttctgagaactcatgaacgtcacccacgaatctattgaaactaaaatagtgtcccacacatttacaaataaatatggaaaactggatagtcttcttggatactagccatagtcattataaaaacaatatgtaaatggctatataggcaatacatgtttaaaaaggtatgtgtcgtttatgcagaaagaaacagcagtttactggaaaacattacaattttaatgctggagatagaaaccatatttgtgaatatgaaatctcattattgtaaagataacaatttttcccaaagtgatatacaaataagaggtgattgtaatcaaaatcttaaaatttttggaataatgatattgataatgtatttagaagaatgaatttatttgaaagatgctattttgcaaattcagttgtttaatatgggaacttgccctatgaattactaaaacaatgtggaactaaaataaatatagcactgaaatattatagttattctgtaggaacaaggcagtaacacaaaatgatgaatcaaaaaattgatccatgtatgtgtgtatgtatatacgtatctgcaaatgtatctatatgatattgttttatgattaagggggcatttcaaagaagtgagagaaagagtagattatcgatgagtgtggaaataactgtctattcatttggcataaatgatgtcaaatccctttctttacatttaaatttaaaaatattattcaggtactaagataaaaatatagataaatacatttttagtgtaaggataagacacactttaccaactatgactccaaagacagaaaccgtatataaatctaagagacataatgatagaaaatgtttaatagagtagtttgcctaaatactgactttttcttcttttcttctttcttttcattttggtctatggagatttttttagagtaggggaaaagaagtgaaaaatgtgatggattcgactagagtggttttccttctagctatggaaattggattacctgtccctaccactggtgctcttgaaggacagttcacatgaaaaaatcacaataatccaaactagagactgaattttaaatagactatttttttttataactgctttagtattcagcagtatcatggtgggcatgaaacacacagtagaaaaatcttgtctggtttccttatttttcagatgaggaaactgagacctctgtgggtctcagtttgacttaagcaatgtcatatggtgtatggcagacccatactaaaacttagctttcctgataactctaattttttttccaatacagcatgctgtctcctgagttatattaagaacatgttgatgtctacaaggaaaaatcatttctgaacttttctgagaaggaaatagacttcattctctgttgggaggaaaagatggagttgtagtcaaagagagataagcatagaagtgatttggtatgttcaaagtgcccgaattagataaaccagagtaacagacattgagaagatttaacaactatcttcctttccttttatttatacaatgtgtatgacatccctgacacattgcaaaagtaattagttgctgaatttaaaaaaatgtttgtaagttcccctttcaaccaaattgaattaagaaagaaaattcctgatctcttggcacttgctccacagaataaagaactcctcataaagataaatttagcccagcagttgaggtaattgcttattttgtgtgtatttattttgatcctaccgtattcaaagtattgtattgggggagagggtgctatcaaaaagataaatcagaaatggtttatgatgtgtaggagaaagatttagacctagatttaaataggaaaagacagagaatagcgagtcttgtaagagcagaatagatgaaagtattacgagtttgggaagaaggaagacatcagggaggaggggggcgagtagaaaattgttttacaagataaggggtttcctgattcaaaaaaataaaaaaaaggaaagagaagagtagacagagcagggagtctcagtcaatccagagacaaaacagaaaaaaagaaccagagagagaattaaacttttctattttaatgaatttacacacaaataagaataaggagatcagaatatttctaaaggcccaataactttcttttggtttcatgatcactttgaataggctcctatttcttataatattttaataaaaggatgagctcttaaaaatttaaaactgaaaatttaaaatactgaacacaaattgctttgtggtaagtggatgttgtagaggaagtttaaacaccagatcaggttgataggattagatctcacattcctttctgattgctgtttctgctttcctatcacagaattagagagagcttctgaactgaagtttctgggtcgagtctgagttctggtttcattcctaactcaaccacctagtgctttgtgacttttctcaagggataaccatcaacctcctaactcccaaagttgctatgatgattaattcagaaaatgagtgtgaagcaccttcggaatgtaaatatcacatgagctctattcttctcttttactcctaccttatattctgtcagcaattcctcttaacaaaatattgcacagttttgttgaaactgtccatctcttttacttgaggagtcccctatttgatttcctgtttccaccctggtttccttatgcagtcatcctccataccatcgtcagagttagggctttaagatgtaaattcaatcacattactcccttgcttgcaacacttcagcagctgcttttcacaggtaaagtcaggtctaaattccttactgttcccacaaggcccaaaacatctggactcaacctacctcacaatgcctctcatttcactatcctaacccttcagaatacctagaattattgtcctcttgctcctcccagaactcagagcaccatgcccagtgttagggcccttgcattagctgttccctctgccgtgaaagtacactctcgaatctttgcatggctgactcctccttgccattgcaggctgaacaaagaggtccactttcctgaattgcatctaaagtaacctttcttcccagtcgctctttattgtatcacctgggtttattttcttcatagcagtaatcattttcttccattatattgtatttatttcgtgtattttaaaaagtgttacctcttgactaccttcaattggaatccacctccataaaaattagggctttgctaaagttttcagcccttattctcaaagccaaaaataatgcttagtatatagaaggcactctattaacagatgcaggtatctgctggaatgctaacaatgtcatttgccacctactttattcaaggtcatgtgttacaggaggtttctgttataaagatgaatcagatatagtttgtgatatagtagaagaagaaaaaggaatgcttctaaataaggtagaaattgatgagttccaaggaagatttacattttgtaagattagatgatatttaatttggtgggctactaggaagagaaaaaaatggcccatcgttaaatcccaaactaaacaccattcattcatggcatagtttcatatccatcccttaaacagtgctcctatatttttcactggaaagaggagagaaaaacacaaaccttgggggttttgggacgtagccgtaagacagcaaccaaaaagcttgtttcctttggggtttcatgccttactttgaagatttatgcagtttttgcattctaccctataatatatccacatggtaaaattgaagccctgggaacacatgtggagtgaaccccagggcctaacatttcacaggcctctgttcctggggagcatcccctctaatctaagaaacaaagaagaccttgtatcttttacagagcttattcttaaaagatgggctttactcttcagtgtttcccagccaaagcctattgctttaactataaagtgattacagatacaaaggttgggttattggagaaagatgagagtggttacaagaatggttattctggaaaaatgatgcactgagtagcagaggtgagagtgggggaaatgtgaggactggggagcagttatcaaaatattctcaacttcctgtcaccatagctccctttagctttctctggcgtgagtttaatagcccacattacattatgttgcttaataattatgctctaaaaggtagttatgttcctcagacccaatttactaagagaaagaagtgtctcatacattgtagcattattcttatgactgttatttttaaatgtttcattagtcccttaaatcagcttgtttcagacaactctgtgtgtgtgtgtgtgcgtgcgcgcgtgtgtggtgtgtgcactagagaaagagaggagagagtgaatatgagtggagaatgtgtaaattcaactagagctattaaagccctgtgacttggagctgaattgctttcaaacattttctataaataatgtttttcaattctcttttttatcttgagtgcatgcttttatgaaaactagttttgttacagtagggacagtttgaatctcttttttagtatgaacatttaaaaatcttggttaaaaaatctcatcttgtgagtgattgagtttcaagagtaaattaagttggctcttcctaagctgtggaactagaatgcattaaaccttttttggggacattttcattaataactgagtttatttcatagtagccaggcacatataacctgtcagttgagaagcatttctccattacaaggccacgagtttatccctcttgagtttttcttccctcctcttcttacacaagcattaatagctttaatagaagcagtaaaaattatgaatcttttcttattttgaaattgaagatatagggaatccttctttgctttgatcttataactagtattaaacactgacccacaaactcacgcaaacataaataccatattaaagtttcctttggtgtgcaaatcaatccttaaagtcttgtagttattgctggagtcttacaaatgtttcccaagagttgaaatgtttatataaatacctttgtaactcaaggtagttaccagcactgctttataaagctgaatgcccagagctttaattttatgctttgtacagatcacttggtatggcaaatatggtaatattaatccataaatagccctctaatttttaaaaaataaacaactagaaagggctttgtcatggtgccatagttgcagagaattgttgatcacaattacactcttaaacctaagatggcccaatgattttcataatggcctgcaagtgcacgttcgtataaaactttctgaaatacacctttctcaaatggaagttttccacactggagccctacaaaggattattattttgcaggctaaagaaaatgtgttaatgactagagattctaattgaaagagtaatggaagatgcaagacttctatcacgaccccaactgggacggtgccgttcctcgagaaagcaatttaacaacagctctgaactttggtgttcccatctgttaaatggagattattaagaacactgcctgtttgaagataaacaaatgagaaagttaaaagaaaaagtaatgggatctttgaaggagaagaaagagccttatgttaatttggagattttttttctttgtgtaaagtttactgacaaattttaattagacacatcattcagaaatttattttttaatgattttataacccagttataaaactctatccaaaacagcttaaccatttgatttgtgtacactaataatgactttttaaaagattccttcagtgtaactaggtcattgaattcaccaagcatttactttacacttactctgtgctggacacaaaggataaaaacatcagtaagacaccatggttgccttcatgttgctcatagtctaggaagcgcaagagacatataatagaaacacttttcagccatgtgagtaaaaagtagaatagagaataccagaggctgggaagggcaggaggaagggggttgttgtggagagatttgttgaaggatacaaaattacagctagacaaacttacactcccaccaacagtgtacttacttagttcagctattgtggaagatagagtggcaattcctcaaagacctaaagacaggaataccattcgacccagcaattccatcactgggtatatacccaaaggaatataaatcattctgttataaagacacatgcatgcataagttcatcagcactattcacaatagcaaagacagggaatcaactggaatgcccatcaatgatagactggataaagaaaatgtggtacatatacaccatggaatactatgcagccattaaaaacatgagatcatgtcatttacagggacatggatgcagctggaggccattatccttagcaaactagcacaggaacagataactagttaccacatgttctcatgcataagtggtagctaaatgagaacaaatgatcacatggatggggggaacaacacacactggggcctgtcagaaagtggagggtgggaggaaggggaggatcaggaaaaataactaatgggtactaggcttaatacctgggtgatgaaataatctgtacaacacacccacatgacacaagtttacctatgtcacaaacttgtacttggatccctgaacttaaaataaaagttaaaaataataaaagattaaaaaaaaacttacagttagataggagaataaattccagttctctatagcattgtaggatgactatagtcaataataatatgttatataatttcaaataactagaaggaggattttgaaagaaatgataaatgtttgagttggtagatatgctaactatcttgatccgatcactaaacattgtatgtattgcaatatcactgcatatcccataaatatgtacaattattatgtgtcaattaaacagtttttcttaattaaaaaattaaccacgtgataagtgatcaatcaaagcttatataaattgcaatagggataaacaggtgggaaccacaggttaaacaatctactcatttttcacccttacctaagtgtctttaaggcctggctaatagtatgacttctcatcattgaaactcactataccaaaagtaaattattttagaacactgtttgacacacattttaaaagttgatctaaatgaatttttaaaatttagacaaaaaacatggggaaaaagaagtacagacatatctcagatatattgtggtctgggacccatctacaccacctcaataaagcaaatatggcaacaaagcaagtcacataaatattttggcttcctaatgcatataaaagctgtgtttgcttattaaatgtacaattgcattatgactaaaaaacaatgtacataccttaatttaaaaatacttcattgctgaaaaatgccaacaatcatctgagctttcagcaagttgtaaactttttgctagtagagggtcttgcttcagtgttaatggctgctgactgatcagggtggtgatcacggaaggttggggtgattgtggcagtttcttaaaataagacgacagtgaagtgtgccacatcaattgactcttcctttcacaaaagatttatccatagcatgcaatactatttgataacattttgtccagaggaaaacttgtttcaaaactaaaatcagtcctctcaaaccctgtcactgctttatctactaagtttaattaatattctaaatccttttgtgtcatgtcagcagtgtccaacaggatattcactaggaattgatttcatctcaagaaaccactttctttgcttatctacaagaagcaactccttatccattgaagttttatcatgaaattgtagcaattcagtcacatctttggactctaattctaattttgttttacttgttatttccaccacatctcagttacttcctccattgaagtcttgaactcaaagtcatacatgaaagttagaatccactttttccagactcctgttaatgttgatgttttgacctcttctcatgaatcatgagtgtttctaatggcatctgggatgatgagtccttcccagaaggttttcaatttactttgcacagatcaatcagaggaatcaccatctacggcacctacaatcttgaaaaatgtgtttcttaaatattataacttcaaaatcaaatttattcttcctttcacttgaacacttagaggccattgtaggattattaattggcctattttcaatattatttgcctcagggaatagggaggcccaatgagacagagagagagagagagagagagagagaacaccagttggcaaagtaatcagaacacatagaacatttattgatcaagtttgccgtcttatatgagcacagtttgtggagccccaaaacaattacagtagtaacacgggctgcagaatagatgtatttgcaggcatgtaaacagcatttatctctttgtatgtcatcagagcttgtgggtgcatcattagtgaacagtaatatttgtaaaggaatattttctctgagcagtaggtctcaacaatggacttaaaatatttggtaaaccattgctgtaaacaaatactctcacccatgttttgttcttccatttatagaccacagacagagtagatttagtggaattcttagtaaccctaggatttttggaatggtcaatgagcattggcttcaacttaaagtcatcagctacattagttcctaacaagagagtcagcctcttctttgaagctttgaagcctggcttgatttctcatctctggctataaaagtcctagatcacatcttcttccaagagaaggctatttcatctacattgaaagtctgctgtctgctgtttagtgtagccatcttcatcaatgatcttcgctggctgtcctggaaaatgtgctgcagcttctacatcagcacttgctgtttcaccttgcacttgtatgttatggagatgacttctttccttaaacctcataaacctctgctagcttccaacttctcttctacagctccctcacttttctcagccttttttttttttttttttttctgaggcggaatctcgctctgtcgccaggctggagtgcagtggtgtgatctcagctcactgcaagctccgcctcccgggttctcgccattctcctgcctcagcctccccagtagctgggactacaggtgcccaccatgacgcccagttaattttttgtatttttagtagagatggtgtttcaccgtgttagccagggtggtctcgatctcctgacctgatgatccacccgcctcggcctcccaaagtactgggttttcccagcttttataaagttgaagaaagttagggccttgttctggattaggctttggcttaagggaatgttgtcactggtttgatcttcactcaaattttctctaaatcagcaaaaggctgtattgctttcttatcattcatgtgcttactggagtagcacctttaattttcttcaagaacttttcttctgcattcactacttagttaagcatttggtgcatgaggcctagctttcagcctttcctggcttttgacataacctctcttccctactacacttaatcattgctggcttttgatttaaagtactcttcttttcacttgaacacttagaggccattgtaggataattaattggcctaatttcaatactgttatgtctcggcaaatagggaggcccaacaagagagagaggagaaaagagagagagacaggggaaacaccagttagtagagtaatcagaacacatagaacatttattaatcaagtttgccatcttacatgagcagggttcatggagctccccaaaaattacaatagtaacatcaaagatcactgataacagattatcatgacagatgtaataataatgaaaacgttttaaatatgcaagaagtatcaaagtgtgacacagagacatgtagtgagcacacgctgtagggaaaatggtgccaatggacttagtctacacagggctgccacacaccttcaatttaaaaaaacacacacacacaatatctgcaaagcacaataagcaaagcacaataaaacaaagtaagcctgtaatgtcctgaaaacctctctgctaaatactttttattttcacattttactcctggcaataaccctgtgaaataaggagtattatcccacttttcagagataagaaaactcaggctcagggcaataaaataactttttcagagttgactaatagccagcatggcctgggttgtatttttctaaattaggcacttatataacctttactaaatactagccactatcgtaaattctttataaataggtacccattggaagccagactcctgtctgtcttgctgttttgctctaatctcagcatatttccagtcgtgtgtgtgtgtgtgtgtatgtgtgtgtgtataaagatataacaggcagtgtggatgttttaacattttttcagattacctgaatcaagtcagtcttggttatgttcttcaaagcatgtatgatgcccttagctgttgattgggtagagtggtttgattacatgaattctgttcccaagctcttgtatcatcctgtactctgggaacacagagaggaagatgatgttcctgtcctgtgatgctgagggtctagtaggagaaacagcaaaagacattgtagggaagcaataaatactctagtcatgtgcatgcaaatatctaatctagacttctcaagccactttgtttattacaatttaaaaaaaatcattagattaatttatattatttgcattttatcttattaatttgttcatatatatttcatttgcattgcacaggaaacattttccatatattaatgtacaataaaagagtcatatttacagaatcttttttctatgaattcagagcacttccacgcacatcattttacttatcttcacagcataataacaaagaataattaaaatcctatcttctaagattaaaagtcattaataatgagttgaaagaaagcagtggttttcttgtttgtaaaggttgtttcaacttttgttgcaaaggcttataagcctttctctaactttgttagtttcacaccatcttttttaatcaaatgactttacagagagattaactttcatttcaacatttgaaaaattctatgtatctctagataaacaaatacacttctcttagtgtttacttttctttgcttctttcttttcatggaaaatttagataacaatgatcatcttcatagtgagtttttactgtcaaccagagagacaaattgagattggatgtcatctcccaataaaatgtacacccttgatgtcactggaatgatagatcttttgccattttgctctataatggatttaaaaattaagtcagctatttctgttctctaatagcgttataatacactgcttcaaaatcacatcattttgctatgactgtatggttaattaacatctagagagggtatgtcctttattgagactcactatatattatttccactaatcagatgcagttttttccttcagttttatagttattaacttactaccctttgagttttcaccttaataaacaagaagaacagttttgtccataaatttaagtctcaaaatccctaaccttgtgtaaactcatttctagattaatttgagttgagcatctccacagacttctctaattagataagtttattattcttcttctttttggcttttcccatgaggaacaagcaattttctgagtgtttcttattctgctgcacaatatctcctctacctaatatctcatcttttacctttttgttattgagatttttatagaatgtacttttatgatgctctaagtgctttgaatcacaagtgttgatctatctttattgctattaaactttcagagatatatcagctacaattgtgcttgtcattctgtgttcattgatgggtagtgaaaggtcaggttcaacattaaaagattctgcaaatggaacagggaaacttggcacactgtggtggatttggaatcacagatctctttctggccctcgcttcctctctgacctcagtcctacttttcccatttccctctgtgtttcagccatactgactgtcttgtgtgttccttctacctggcagcctcagtcctgcctgagggcatttgtccgagatatttgcacagcctggaactcccttatcttttcaaggtcggctcctccctgataattacattttggtttaagtgttagctccctaataacactccctctgcaaatcatcaagaaagggaaggtcacatgcttcaaaaaatataccagggaaggaaaagtgaatttaagaggaggaaattaaaaagttttagaattgtgtgaacagattttcaaaattatgagatagcagcacatacacatttaaacaccaacaatcagatctgcactgtggtttgggagttcatagtgacatgcattctggcttgcagtcatacattggttagtcaaatgcgtgttctcagacacagacctcctgctcctagtcatgtattaagaaaaaaaatatctcacatagctcaggatggattcatgtttgaagatgtttctttcagtcgaatttggactgttgaagtaatggaagcaagcttggagtccattactgggatagaagataagttaaatatggcagatgcacttcatggagtgttgtacccaagttagaaaccacaataaaaggtacaatgtggatagatcttaaaatagcaccttttgaaaagaattaagataggtaattagatatataacacagtaccatttatgaaaaaaaatacccaaaccaaattgctgggaatgttctagaccttgatctgggtgatacttgcacaggtgaatacatatgtaaaaactcaccaagctgtccacttaacatggtgcactctactgtatgaatgttaaacctaaattcaaaaataaaaaaaaaataagctctgtccctgactaccctgctcaaagtacttctcccaagtccatttctattgcatcaatcttttaatactctttttgtagcaccaatcatcacttggtatctttctaatatatgtttgtgtgtgttcattaatggactacctcccactactagaatgtaagctccctaggacagggaactcctctaacgtgtatgctactatatgctcattagcaccaagttctctctgtcttgttctgctgtacaatattctctcgacctaatatctcatcttttggcttttagatattgacatttttataaatattcttttatgatgttctaaagccttagcgattgctgaatagatgtttatttgttgaatgaaaggaaggaagaaagaaaaagaagaagcagggtggaagggagggagggagggaaaaggaaagacaaaagtaaagaagaatggcaaaaagaaagaaagaaaacaggaaagggagggaggatatgtaagcagaccaaatatagccattgtcttgtcagctctaatttacttcatcagtaactcccttgcctcagcaggccctttctctgttggagtaacactctttaattaatgtccttgaattaaatacttcacattcttggaacctagtttatatgttctctcactgttgtttttttctcctctgtctccttccttcacttcccccttcttcttagttcctcttcttccctttttgcatcacttctcatatttttcccccatctcagggcctatctctagttatctaagcaaagtcacatcacaattctcatagaaattagaagacaatgtcttacttaagactctaagtgtgggagtctgggtgctgtggctcacacctgtaatcccagcactttgggagaccgaggtgggctgatcacttgaggttaggagttcaagaccagcctgaccaacatggtgaaaccccaactctactaaaatacaaaaaattagccgggcgtggtggcacgcgaacgtagtcccagctactccagaggctaaggcaggagaatcgcttgagccccggaggtggaggttatagtgagccaagatggtggcacacgaatgtagtcccagctactccggaggctgagacaggagaatcacttgaaccccgggggtggaggttatagtgagccaagaacatgcagctgcactccagcctgggggacagagcaagactcctctgtctcaaaaaaaaaaaaaaaaaaaaaaaagaaactatgggagtacaaaatactaataagtaacatttattgagcatttaatttcatatgggccacagagatgtactttacatatattaagttattttatcttctccacagccccattattttccccatgttacagttgggaacataagctcagaatgtgtagcttgctcaaggtcatgtaattggtaagcagtagagctggatcagagcccatacacctgagcactacttcctatactgtcccccagcatagtaaacaaacatttactagtaaccaaatctacacattgttagcagtgctatgtctttatggtagtataatattccatatcttctttaatctgaaaaactcccattttaaggaggaagcatgcagtaagagaaagcatagatgatcctgggggagcctgtttgcatcaaacaaggctgctaccttccatgtaaatctcgagatggtcatcatgttttatggggctgccaaatccaaagttattaaaaccctttcattcatattacaagctattatgtgtttaattcctccggtaagacacatctctggtaattcatgactaaaaatgagttcatattatcatatgataaatagagtagcggcagaaaaacgaataaatgtaaaaggaaatactttcacagtacacagtgcctttttaatgtctttaatatctttttgcctgtattaacctctgtatcataattctgattgcccagtgacactcgcccatttatctgaacactgctaaatcttttattatcccattaccacgtttataatggtgtaatttgtgttggggaagcatctgctaagtgttaagtaggcatttgaagaacatatgggtgggtggatactgtcaactaggaaaggtttagggctgacccgatttgcctgacaggctatggctgccttgccaatattgatggtaacagtgtacaattccaagtaaggactgcttaccttctgtgacttctgctttcccttcccatgcctacctctcagagtgtattgtagtttccaaatgggttaactctgtttcttgattttttttttcccccaaagcagctcaaagctttctggggcctgatggaaggaagaacactgacatagagaactgtggaagcagagccaattattctgtcatcaaatagccttttctaaaaaaaaaaaaaaaaaaagcatactctcagcagactggtaaagtaaaaacagcatgctgttagggctgtttaacatttttcttctatttagtcaaacccttgaacaaaagcccacattccacattccgggcctcagtcccacccaggtgaaatactgcaggatttgggaatctaggtctattagagccctaagtcaactgttggagtaatgcttcttaatgagatcagttggctaagagatgacatttttgttcttgttagttcatagagtatcttttgaaggtcattgcatataattcctcgtaccatttcactagaaggagaggtgatggaggcatctgaatgggcggtcagtttaaaagaacagatctgaagaaaggcaaaggtttagtgttgtctcctacaaattatcaccatgcttcttcccaagaatcctaattatgtctttcaggagccccttatttatttcagagagagtaagaaggcttccttccaagtcattaggtttgggatctaaattgtagtttcatttctctcttttttctttggcatatggaatagagcttggatttaggaaggagaaggggacaataatggccagtctgagttagtttgtgcagaactgcttagatttgaggagcagggacttaggaattacgctgggttcagaccctgcttcccccacttattatgcctgagatctgtcacctttatgggcctcaatgctctcatcagtaaaatggggataatacctactacctgatgggatggtgtgaagattaaaagagatgtcggtgtgcagtaagataacacatgacacggtcaattctcatgaagtattagctattactgtcactactgtaactattagtatagttattattacaactataaaatacttttctcagtatatgtaagagttttcaaagcataggatgtaatacacaaaaataatgctacaggccttttgggacttatttttatttatcatgtttgtttctgtaaaatggcttttaaatagaggtttatgagagtcagacataatcttcccgtgaaaaaaggagaatacctgttttcccttatgtaactagaaagctcttacctattgagcaatgtgttaaaatgacttccagaattaatccaatttattaattcagttaccacataaaggtgatttgatttaattgtctttaaatactaatataaaagccagtataattccataaagtttgcctataaatatctactcatatacagtatttgagagataaagatcagtagtttttaataattaaaattctatttttaaacacctcaatttctcctctcagtaacttgcacacaaagttggttgaagctgcatgttgacggtatgaatccaaactgaaaaattaatcagtcgtgtaagacgaatggccagagtacgtgtatcgatctctaatacagaaaactgcagggattaactttaataatcaaatgaaaatgtggtaactaacataagaaatgaaaaaaggaagtggtggactagctgttttttaagtaaatataagtaattgatgaatccttataaaatatgatttctctgattttatccaggacttcctgtggtatcaaatacaagggctttctttgttgaagttgtaaaggccagtccgttttatcttgcctgtatgcttgtaggcaattttgtgggatgccctgtgaagaaaaaagggtagggtatattgtgtattcaaagactatttttgctgtttcttaggatataatttatcaggaaatgcatattagactaaatataattactgggatttattttatagatttttgggggtagagaagttttttataaaaataaatctattactggattttaagagctattttctatgtttgtgtttttcctttttttaacagctatggaaacctctgtgtactcacttgttataatttttcttaaactgaatttttgagtcacacttaaaatacttgaaattctaaaatcagtgattcgaaagccactcagtttgagtgtatctgattatcagaattacataattaatattctggggatactttatatactcaataaacttctaatatattagattctcaataaatatttacagtgtagactttttatttaaattcatgtacatttttatatttatcattgttaactggtttttgctgtatgttaggtgctcactttttgagaaacactaggatgattttaattcagtgaaattacatgtatcagacactctcctggcagtgtgatggactaatgactggctattccaagagccagtgctagaccatctgcctcagccatcagccgggagggctactatgggtccaccatccacctttaaacatttcccctttaacctaggatgcaaatttatcaactacaggagagaaaagaacatttttaattaccaggtcccattttatagatgagttagaatgttaaatataaattaagtttcttttcctaccttgttgtatgtcgtcattaagcttcaaaagttaagtagaatggagacctttctttcattttcaattaatatctggataccacccaaaacaatggcatggggatgagcatttaatgaacagctgttctgattttaaagtcaaagcaagttctctctagccccatagggaggtgatgagatatttccacgacttaagattagagacagtctagtgacacttaggaataattattcccatttggaaatagcaagttagaaatagaactccaaatcactgctagcttttgacacttttcaggcccatagaccaactcccagctcattctgcaccacctgtactgtgaacccctgccttcatggcaaacttagctctgtccgattaatttagcagaaaacatgctgtgttttggcatttctgcattttgagtatttctcagaatcaaagctcagtcctattaactttctattcaagggagaccagatgagtttttttggaacattttcattggcttatattctgttgaaagtaacattttaatcctcttttatttcctgcatagttcttttattttgctctgtctataaatatatacaatttagtcagttgttttgatgaaggtttattcttgccatgttccccatctgtttttaatatataatagtatttatgcatccaggagtgtttatctctgtgtctccaaaaattgcagcaaaatactattaaaaagcagcttccaccattcaatctgattggccataggagtcacatctccacacatcatcactttggagtttcttactgtcaacaaagcacagtaaacttgtttgacacctgcttgcatcgctttccactgccagtatcttaagctcctccagttgtttttgtctgccgcctcagacaccattttctcacttcttgaatcagaaagggctggttcactgcagtatatgtggtatccagccctggctctctgcttctcccacagaacctacattttgatcctcctttgcaggataccctctgaggacaatcaagcaagaccaaaatgacaacaaaaataagaacactaaccacaaacatttattgaacactcatcatttgttatgcattcctgtatggacttggtatgcattatcttatttaatccacatggcacacctataaggttatcattttaattttacaaacaaggaaactgaagaatagagaggaaaggaatctttccctggcttacagagctcgcagataccagaaccagggttggaacttagtcatgtgttttaattgttgcttttaatttgctttgtttgttttctgtgtatgtgttttctgttttgttttgtttttgtgacagggtctcactttgtcatccatgctggagtgcagtggtgcaattatggttcactgcagccttgccctcccagctaatttttgtagagacaaatttttcaccatgttgcccaggctggtctcgaactctgggatcaagccatccaccttcttcaacttcccagtgtgctgggattacaggcgtgagccaccgcccagccatatactcatgtttgtaatcactaccctagacattcttttatacaaaatgaaagctgtagaggggatttaagattttaaggattagaagagatcttaaacacctgcattccccaacccttttgaattcttggatacattttaactgtcaaaatgttactgttgctaacatgattgagcacctacatagagaggacagctttgtgtagtggttcaggctctgactcacactccctggattcagatccttccaactatattatgtggggcttcctccattatcttagttaccttatctgtaaaacaggatgataatagtactttcctcctatacttttttgaggaaaaaataagttaatatgtgcaagttgccaagatcagttatttggctcacagtgagaagtcaacttagctgcttttattggttttcatatttttgaaagagaaactacgtgatacccaaaagttatgatgaattcaggaacactatttggctgaagtatatttttgttaatcacagtattgctcacacattttaaaaagcaggacctgcatacatattttataatatagaattagttcagtctctccatcaaccacagcatgcatatggattacctaatccttgtggaaattccacagaccccaaagaattcacatcccacaggttggcaaccagagctgtctcgtgcaaccctctcatttttcaggtaagagaaaaagctgagaccagagagtttaaatgaatttatcaaagggcacacacctagaggacaaagacaagtgtaaacctcaaatcctatgactccaatgcagaggtctgtcctctttccaaaattacgcaaaaagctcatttcaggttactttaacgatcagagatagcaatagtcaaaacacttttgtgtccttaaacagtattttgtactctgaatttctgttctctacattagctttgttgtttctccttgttaagtgacagagaaacttcccttcatatattcatatataagaggacaaaaggaaatttggagagatgttctatgttctgtctactagccaccattaaaggtcatccagcaccctaggggatgatggccaaatccttgttcctaagactgttctcattgccttttttcacatttcctctggggaccaaatggtgcaaaagaaaattcgctaatttgaatttgaaaaatccttctctaacaagaagtgataaaatttattatttttatcagagcccaagtaagataagtgtctacgagtgacagaaataaaatatagctatgaggttgcttgatctaaaacatggcactctaaatagcctgtgatttcacacattcaaatcagaacctagaaaggcccttcagtacatgccagcggaagatcaactaattgaattaatgaaataaagggatgaaagaaataaacatacttataaatatcccagaagatatgttgttgagataaaatttggtacaaaacaaatatgagcagttcagtaattcccagagccctatacagcatatggtctcagaaaagacagaaaaagtgtctagaaacagaggactcaagtcccacagagtaaccaaaatagatgtgtttcttttacttgtaacagaatatgaactgccaaagtgtaaatgacagaaaagatctttatattacctcagttaatattaagaaaaagaattgtcaaaaaccaaggtaaatcatcaggacaacttgtttaataggaatttatttggaaaatagggagaataaatggaaaatgtaatattgaatcactagttgaagaaataaagttcaatatttctccatttgaaagagaatcaatgagcatttgtatcaaacagattagaattcctaggtaagtttattctggactttgatcaaggcagaatctaatgctcttttactgcagttctacatatttgcttcttggaaagaaaagcgttttatcatgttggcggaagaatactcacatgattgctgctttttcttttcacaaggagatctgtttcctttattagaattgctttatacaagaatgcgtggaagagggagcaggtggttgccctgcatttccttgtattgtttgtttccggtaaatatagttggaactaaaaaatgtcaggggacagtgctcttataacttctattatagttgtttcttttttgaaaaatataaacagaaagaaaattatttaagtagtaaatgtaaactttactacagcctagggataactgtaaatagaaccatcatatttagattatattaaatattcagtttggcttgaaaggccaatgccctttctaccaattgaggactatggcatgagctttgaaagctttctgcctcaggcaaaaatgagctgagccactgctttgaagtcgaattaggacacatttgcttttatttctgtaactctatctgcctcagtgaactgttctgtaatttcgaaaatcacaatgaagccaatattcaatcaattcagtatttttatattagagcaagaatcagattagaataactgtctccttaaaaatgaaaagggccaggtgtggtggctcatacctataatcccagcactttgggaggctgaagtgagtggatcgcttgtgctaaggagtttgagaccagcctgggcaatacaatgagacgctgtctctacagaaaattagaaaattagccaggcgtcatggcatgcactgtggtcccagctactcaggtggctgcagtgggaggatcacctgagccctggaggccaagactgcagtgagccatgatcttgccatcacactcctgcctgggcaacagagtgagaccctgtctcaaaaaacaaaagaaaagaaaaaaatctgagatctgcatagccctgaaatatagtattatagaattccttggttaaaattttgcctttgacatgtggtacatcaggatgcctctcattcattcttacatctttacctttattgacccattcaacacgcatctattacttaaaatggtgtgctggtaactagataggtggagtgttgaaaaatataatagggagaaagaaaacccatttaaataacaagaatatggctactactagaaattatttttagaatgaagtgtctttatatcatttaaatgacataaacagcatcatttccaggaggctcataagaacagggtatgagtagaataaaggcaagtttcatgtttttgctaattttcacttcccactgtctaactgttccttattcccaagtagtggaaattgtgaaagagactctgaattagactctgaatcagctatttcttcaggggtaaatctttaattgatcagaaattatttattgcattgatgtatactgtaaagaaggggcaattgataggaaagtatcaaatataaaataatgacaatggaggatttgataaaaaggccaattggtcaacgtaaaaactactttcaatcaaagatcagaaagagaccatttctgaagagatatctgcactcccattttcattgcagcactgttcacaacagccaagatgtggactcagcctaagtgtccatcaattggtgaatggataaagaaaatgttgtatatatacatggtggaatattcttaagcctttacaaaggaggaaattctgtcatttgtgacagtgtggatgaacctggaagacattacgctaagtgaaataaagccaggcacagaaagacaaatatcacatgacctcacttacacttggcatctagaaaagtcaagcttttagaaacagagagtagaatggtggttaccataggctggtggtgggggagttggggaggagggaattgaaaggtgtaggtcaaagggtccaaaatttcggttagataggagggacgtgtttttgagatctatggaactgtatggtgaccgtagttagtgacaatgtattatgtaattcaaaattgctaagagtatatttcactacaaaataaggataagtatgtgagctagttgatatgttaattaacttgatttaagcattttgcattgtatacatataccaaaacatcacacagtaccccataaaaatatataattataatttttcaattatagataaacattgctattattagtttttttttaggcggaattttgctcttcttgtccaggctggagttcaaaggtgcgatctcagctcacctcaacctccaccttctgggttcaagtgattctcctgcctcagactctcaagtagctgggattacaggcgtgtgccaccatgcctggctaattttgtatttttagtagaaacgtggtttctccatgttggttggcctgatctcaaactcccgaccacaggtgatccacccgcctcggcctcccaaagtgctggtattacaggagtgagccaccactcccagccaataaatattattttaaagttttttaagactcaaacattaaacaaatgagaattttcactgaaatctgaatttgagcagtaaccttgtatttcttcatgcatatttctctgtaacatcaggagggcttttttttagctaaattattaaaattgcataaaggctgttgcaattattttttcaggctttgaaagacttttctacagagtcatagagtgatagatatttttcctggacatatctccatagccaagatagacaaggattggaaagatagtgtaggggggtaggaataaatgtatgtataaacatatatatttattactgaggtagtacaaacactatttttattactcttttctatcacttttctcaaagcctataaaactactatctgtatttgacttgaacctgaagcagctatgaagtctccagcatatcctttaatgcctaaagaaattagcatttatagagacctactggtttgaagggcagactgggattacttttgattattgatttctaggggcatttttttgtcatgtttattttgcatatccagacataattgcatatcctttcataatcatgtacttatatagccactatttcttaaatgtcaggttgctctgatatattttaattgtgcaatttataatgaagccatcacttattattttaaccgattcagaaaagttatcattcagaaaaaataaaagattccttttaagataagggttttttttaatggtgtttaactctgatgaatagtttgatgtgctactaatggacaaaagtactgtgcgtgcgtgtgtgtttatgtgtgcgtgtgtgtgtgtgtgagagagagagagagagagagagaaaaaaaaaaacaatttctccagctttctaaggagtcgttcattgtccctggtaagaagacccttgtaatttggcagggcaacttcatcttctgctaatgacctcatttctgtttaccagtgaaaatggacattttattaagcttttaaaaatcacccgtaatgcaagatgagaacaatgaagcccccatgacattccttaaaggaaagagtttaaattttgataaaagaaaatgagatgtaatgtggaatggacagtgttattgtgacgcagcacctttattcactagcccttaattatttcagatattttattgcacattttccctgtctgtatggttcttttgtatcacttgcaaactgatgaagcccctctctggagttaggttctgagagttggtgtgggaatgataaaccagaagcactacgtttggattcattaaaggatgggctttccatagttaggttgtactaaagaaaatttccattttgcaagggcagtgtaaattttgcatgccattttaatagcaaggcaggtcaatcaaatcataattgtctacaattagcactcccatgagatgtaagcttctttatcttctccaggactgaactgaaaaagaaattgttatttactgtcactgaagtcatagaaaatgcttgctattcaatataagcgatgaggaaagtgccagtctggcaaaagggtttggcgtaaatttaagatctgcacaccaaaatgcacattgtatcaagcgtggctatgtgcaaaatgtgctattacaaagcactttctttcagcacacaaagcaggtcttggcagtgaaatgtccagtgttgacagcattttggtttggagctaatcttaagattgctttctagcattttcaaggactctgaactcttttgaaaaggtacattttgatactgaaaatgaggaagtagagaagaaatgcattgtatttcccagttcgttctatctgaagtgccagtgctgtcgttttgggaatcttttcttgagtctcatcactgtaccagaaagtccaggtacaagctggaggttgcaggaactgcaagcttgaggctgtggcatgagggaattgtctaagtttcataaaatattacaataactctatccagctctcactatgtcgcattctctgctgtgaaaatttaaactcctttctttagcaatgccatgcctctttagcagccttgccaaaggaaggaggtcaataaatgtcttgccaatgctgttgctagtcctcttcagtccccccaagccattgctgggcatcctgttttgagtgtctttgaatttggtcccatcattacacttcttcatcttgagatgtctttggagcaaggagtgaagggtagtcagtcccaccgaaagaacttcaactggagataggagaggagatgttctctttaaaataattcctcatgagaaaaagaaaggatacagaatgcaagcaaaaatacaaactagcttccagagttgctcttcacattttttgcatttacagatatgaaggtaagcacttcagttgggtacgtgaaggacattgctatatcaatagcagcagccgtggcaccaggaaagagacatttgttaggaaagacgcttccctggaagaagcattaaaaatgaagacaatgaggcaggtggatcacctgaggtcaggagttcaagaccagcctgaccaacatggcgaaaccccgtctctactaaaaatacaaaaattagccagacatggtggcggacacctgtaatgccagctacttgggaggctgaggcaggagaatcacttgaacccacgaggcagaggctgtagtgagctgagatcatgccactgcactccagcctgggcaacagaccaagactctgtctcaaagaaaaacaaaagtgaagataaggggtgacaatatattgtagagtcacaatgtggtgaaagatgctagtacccactggtgtcagttcctgaaagaaaatggtagaactgaatatagtggaatagtatctcaggaaactgttgtctcttggataagtgttatctctgttacctagtagaaatagctcatatatgctcaactaaaagcagagactaaaacaagagagagaaaaaggaaatagtgagtaccaaagtcttaggggcctagcatgagctttgtgaagcttcgtgtaggagttaggacaccatggtagccctacaaaagcaagaagggaaaaaataaaataagacagttaagggaatgttaagctcataacttgatctctagatatcactggcctaggacaaggttcaacaaaccttttcttaaaagaccagataaacattttaagctttacgaaccatgcagtctcttttacatctgcttaactctttattagcataaaagcagccacagacaatagtaattgaatgagtgtgattgtgttccaatatatttagttaacaaagcaggcaagtcttagttcactaacctgtggcctagaaccagccctaaaatatgaggtgagaaaggaaatagcatttttaatgtttttcctccttggtcattgttctccttatcttaggaccctcgcaagtcagacttggtagtatcctaaatcagaatggattagtagacatttatagtcaaaacaaagaaacatacaatatataatagtgtcatccacaaagcaacaacttacaatacagcttttaaaagataatgcaacgaaatgttaaacatgctgatagatgtctttcggtttacagtgcggactcttcaatcctaaccattgactatgtgttatttgaaccttaaattatccttagttttctacattgttttagatcattgagtacatactgcatcccagactttccaccaaagtggtgtgatttgtaagcatcagagcaaaattctcttcctgattgtatgaatcggtgataaaaatcttgaatgacatcaagcaagctttcacacacttttaaatatgctttgttttaaagtaggtcagacttcccagttggcatcacagaaaatggcccaagttacttttaaattttgcctaactgcaattttgtttgacagaatttcttctggaaagtggccatagaaggattaaatctccttcataatataattttacaatggaactacagataaaaacttgaatgtcagtattatatgtattagtgtatctccagataaacaccagagtgacatatttcatgttaaattgactggtcttatacttaagtgaccagggaaggaatatagctagaggcagaatgccattcatcacatattactttttagaaagcagtttcaggacctcattttttaaatttatagctttgattggcaaaactttttgacttttgaattaaaaaaattcatattcctagtattcacatagcattgttaatagaaagcccactggccaaatcgtttggcataatgtgcttgtgatttacacaggaggttgtgaaaggttttgtaaagactagcttgtttgagtatatcaaattatcatttttattacagctttttatttatcgtagtacataaaatgattttgagaaatctccaaagaatgctgatttgatacagattttgctgtgatacaattaacatttattgcaaatgcagatttttatgataagtaaattctgatatgatagtattaccgtagacttttttactatattcataatgcataaatcacattattctcaaatattttcagtcagaatgatatatatgtacatatatatataaacatagtcatagaggcaataaatgaaaagttagtgcagctcttctctctaagacataaaagttatgtttcattttatctcaaagagtctataaacaaagataggtgctacaaatttctccatacctctcatgacagtgtacaactctattcaatgcaaatttgatttttttctatgtctttaagggtgtgaatctttgaaaaaagtaatcaatcactatttgtttgggggttgtagtttgatatctcttttggaatacctcaacattatattgatcttataatcatattaaataaaatctgattcttcttgaggctttccaattacagcctttctttaattttttttttttttgtctctgttcatctgttttttttgtttgtttgtttttttgaaaattctagccaaagcacttagcactatacctggcatttaacaaacacttgatcattgttagctatcatcattatttgtgtgaatttcctattgccaatataacaaattactacaaacttagtggctttaagtcagcagtccccaaactttttggcacctgggatctgttttgtggatgaatttttttccatggactggggtgggtgtcagggagagtttggggattattcaagcacattacatttatctatggtgtactttatttctgttattattacattgtaatatataataattatacaactcactgtaatgtagaatcactgggagccctgagcttgttttcctgcaactggatggccccatctaggggtgatgggagacagtgacagatcagcaggcattagattttcataaggagcacacaacctagatccctcacatgttcggttcacagtagggtttgtgctcctatgagaatctaatgctgctgctgatctgacaggaggcagagctcaggaggtaacgtgagcaatggggagcagctgtaaatacagatgaagctttgcttgcttgctcactgctcacctcctgctgtgtggcctggttcctaacaggccacagaccagtactggtccatgaaccagggggattgggcacccctgctttaaacaacacacatttgttcccttacagttctgtggattagaagtccaacgcaagtctcaatgggctcacatcaaggtgtcagcagggctttgttccttggggctccaggggagaatccatttccttcccttttgcagtttctagaggctgcccgtgttcctttgctcttggccaccagcaagtgattgtatggcttagacctctgctggtgtagtcatacctccttctttgactctcctgcccctctctttcccttctaaggaccctggtgattacagtgggcctaccagaattcacagcgagatggctaacttaatcacctttgccatgtacattacttccctattgctcttgaaacaaattactacaacacaaatttattctcttacagttctggaggtccaaagtccaaaatcagtttcacttggctaaaaatcaagaaattggcaggcctatgttgcttatggagtttcaaggaggcaatctgtttttctgcctttctggcttccagtggccacctgcactccttaggtcatggtctctttctccatcttcaaaccaagagcacagcatcttgaaatgtcattctctgactaccatacctggttctgtggtcacgtttccttttcccttactgtgaccctcctgcctctctcttataaggactcttgggtttacattaggcccatctggaacccaagattgttcccctcaaatgatctttaacttaatcgtgtctgtggattaccccttgtcatgtcaagtaacatattttcaggtttcaggcattagaatgtcgactttttctggggacatttattctgcctaccccaccaatattaggcccagactctctcttaagcttacatttgaatctcccagccactcactgaacatttgtgtctagatcctctgtctgagtctcaaaaactatttttactatacctttttccagccccagagtggctcctcctacttttcctgtttcttccatttatccaagctgaaaaccttagagttagtttttctttgttgttcgtcaaggatctttactctcttgattttctggggttgtgtttgggagaatcggtagaggaagatcattggattattcagttacatatcatttcaataggtagaccatattattgtgcttttaatataaaattatgcttactgtgctgctgagatacaaagagaaagggagtgtttataaaaccattttttaaaatggctttcaatactatgaagtatataggatgtgtattttctggacagttttatatggatcactgaaattttgcattgaatggttgttcaagaatgtaagtccagtgtaattcaagggatattagtataccactctgagatagacctcctaatttgcctgattacactaattcctaaatgaaggatgcagaaatcctaacttctacaaagcagaagcttctttccatttgttttcaaattttatatgaaggtttagggctggacagcaatttggcccatggagatggtgaaatattttcttctttggtggtgaaatctgtaaatggtgaattttttcttcttccttcagtgggaatctcagagtagcctcacactgtttttctctgggttgctgtcttgccttcacttgtctgcagggcaggtaccaagaatcaatcaggagtcagtttgcgtatttaaagaatgggagtgacatgaggggattgtctcagtggaaactggggagagggacagttactcctaggaaaggaagtcaatgaaaatgggcattctttcagaattcaacagggaggagaaattttaaatacagaggagagtctgttactcaatttcagaaaccccatgttgagattccctgagacacatacaccaagatgggactaaaggatcagacttataaaaagaaactggagaagtttttttattaaaaaaaaaaaactggaaaaaaggtgaaggagcagaaatgggcagagagcctcagactgcgagtcaggtcccatgttggtgaacaaagagtggggaggaaaacttgcttaggaagaatgtcagactgcagcacagttctgaggatgctgtagctgtaaaaatggggagttgccgagccaaaattgcccgttagagaaatccttcatggggcaggaacgagccagcattagcacctccattcagttcagtactaggagcagcgcagggaggtgtgtggccacagtgctcctggggtagcaggtagaggccatcagtcaactgtgttctgtgctttaggttctcttgaagtgaaacctaagggggaacctccatgtctgcaccagtctgcaccttgatttgtacatatccacttcatgttcattttgggagcagccttaaaatgattttaattttggcttccttccttcttctaccagtcagtcatttcctgtgtcatataggcaaagccaccacagtatctctataactacataataatgttttaagtatcaataatgttaacctttggattaaaataaacattataaagggagttatgcaaacattttgagttgaacattttcaatcagaattatatttgtgatatttattccaagtgttgcatggagttattgttcatatattcttattactgtataatattatcttgcatgaattcaccagattttaggttttctgactctgagtcagagttctttttctcaaccattctttttggtataaactgggttaataggattgactttttattcctaatgccctgctaaggcctgctatattggagaacagtagatatctggctgggtaaaagggagaaggacaaccttgttagtttcatgtgtggaacactttggaaagcagagaaagattgctttccctcctttactgcaaagtgaggttgccggagcagcaggaagaccctgaagggctcttgctacaacagctgccagttttaacaactgcagaacaaactcaacctaccttgctagtattattttcctctatggtttattcaatactattgcaagagaaaagcatcatcaggataggcctgagaataaccataatgtttgagatgcatttgtttcatacaacccgataagtgactttagagctcacaacttatcacatgactgactgaaatttcatgaaacattataccaatatgacagcatgatttaaagatcagtttgaggttaaaaccaatgtttctggatgtctgtataatttgcaattggcttgctaatttttggaaacatcaagcatttgcatttgcatcgtgaatgggaattagtcatcatgttttatttcttctaggtccttagcatgttctcttctctgctggccttttctcatgttcttcactctacttggagtgcttttatccctgcttgttggggtgttctcctgtcctttaaggcctgttcttcagccatgaaagaatggcacctgtccttcctctaaaactcatgggagctctcatctaacccttctccttatctcattgttatttgcatattgatttactgttccctttaccaaaaagaaagaccttcaccataggaattatctcttaaatatatttaaacttgttattcattaaatttattttgattccatgttttccaaaagtttttttttttttaaactctattgggaaagcactacagtaatgaatcaatacagtagagttaatgcaactaagagaaaatagggctcaggaaagcaggaagccaataagccaaccacagtaaccgtgcttaaatctcaacttggcactgaacaacctgggcctccagaacaaagtggcatattattatctagccctcattatcataaaagagaagaacaatggttcctttgcagaaaactgattcaccttggccataaagttcaagaaaactctcatactgtactttacatagatgttagtcagtagcataattgtatccttaactaactccatgaatctttattgaggccctactaagtgcctttgagtgtttcattttgctaatttggaggagggggaagggcaggtgaaataaaaactaacatcgcttgtttaacaagtgataggaggacagacaagtaagcagaatgttacatactgataagcgttttagttgaaataagcttagaattactctgtataggagcatcaacccagagaaggaggattaaaggagagttcacttgaggaggtgattcctgatgttggaaccaagctttgaaaaccatttgaaggttatctcaaagaatgtggttggtgttgaaagtagagaaagccaaagacaggacagagacaacaggagttgtaggccccagaagcagcacgtgcaaaagactcagggacaaaagagagcatggggcttctccgaggctaaggttttgagcaggaccttaaccatgaagggcctcatattcaggttaagcaattttgcatgatgcctgagaggttaaagaacttcgccaagtttgatgtcaggaattgacatgattagattgttaattttgaaatatcatggtagaggcaggatggagatatgaactaaaactgagcaagaccagagaagcttgttagaaggtgtctgaagcagagatattatgacagtaataatattgctcccaccaggatgctaatcaacggtgtcctctataataataaagaataaattgagagttatttcacttaactgcttctcttcatggcctgcaacaaaaacactcagcactacttggaagtaaagttgatgtttgtatagatacattaaggacacaatggaaaactgtccttaatgatggaatttctttctctcttcaacaattttattagaactgtcatatgcttggatcttcaatgaatacccatcgtttgttgaagaagatagtcggagatttgtctcccaggagacagggcacctctacatatctaaggtggagccgtctgatgtgggaaattacacatgtgtggtgacaagtatggtgacaaatgcccgagtgctgggctctccaactcctttggtgctacgttctgatggtaatgaaacttctccaagtgcacttctgagcgtaaatggtgctgaggctgcaaacaaaagcaattgggaaaatgtaaaaagtacatctagaagaattgtcacttcatgttttttggcacagactattttatgagtacaatgacaaaaatgatttgataactcatagtccttatgcataattcttaccccgggcaagcttcataatttgcagggaccagtgcaaagtaaaaatgagtggcccctttttcaaaaatcattaagaattttaagacagcaatggcaaagacttataccaagcatgagacccttctgagcccggggctcgggttgcactcccatgaagtcacctgtcctgacttttgccagcttgaggtttttaaagctctggatattttgttataggctaaaaatcatcactaaagaaaccattaaagaaaaatatctgtttcatcaacaccttgatggctgtttaaggggagtctatgagctgccgaggaagcagatccgtaagcctgggtagttgacccatttacacaaaaccatatctgatacagcataatgctatgaccacaaagcattgaagcacttttttccagtcagttataattgaatttgacctttcccatttattaagtcattgtttcttaactccagggagccatttaataagtttaagattggtatctctgctactagggtatcattaagtaaattccctgccataatttttgttctttagggaaatttcaggaagcaataatatattatatatttcagtttgactagcaatgtcaaaattgaatacacaatttcaaagcctcccattttgtgtaatgtaaaggctcagtggttttcttggaactgctctgtacgtggtaacctatgaatcagcaaatccaaagttcttaaatgtttattaatattgcatgtttgacccaagttagttcaggttttttaaagctctggatgttttgttagaggctaaaaagcaccactaaaaaaattattaaagaaaaaatctgtttcatcaacaacttgatggctgttaaaagggaatctgagctgcatagactaaattttatttaattgaaatcactagaagagctggttcaaaatgggagcaaaagaaagttttatttaagaaaaacgaggcaattctaaaggaaatattgaaacgattaactttatattgtggatttataggtgtgatgggtgaatatgaacctaaaatagaagttcagtttccagaaactcttccagcagctaaaggttcgactgtgaaattggaatgttttgcccttggaaagtaagttttataacatttactcctatgtgctgaaatattaggttgctataagaaatcaggatggtttttgagagactcttcttttttattttctaaaatttactttcattttgaggcaaaggaaaaacaaaatgcaggggaaatgcacatataaaattgagtttgaaactttaatattcaaagtcgatttgaagaaaattactctgcctgccgaatttcataaaataaattggtgggtttttttttttcttgttcatttgctgtaatctaatatggtgggtctgtattaggcttttttctcgaaatcatgtcaagaaaaatgcagtttattttattaaaatatcaacttaaagagttaagttaaatcttttttatcaggtttatataattgaccattgaaagtggttttctgcatttaaaatcctgtgccttcttgttcaatcttaaaagctttattttctcaagttgaaaaggcttccagacaatagcagacaacttgacgattttcttcttagtcccatacctcagattaattggagaagaagtgatgggctgccattttccagcaaaattaaattaaggaagttcagtggtgtgcttgaaatccccaacttccaacaggaagatgcaggttcctatgaatgcattgctgagaattcacgaggaaaaaatgttgccagagggcgtctcacttactatggtgagcatctgctttgggcaaattggagttttagcttttactttctcatctataaaatatggttgttatttaggggtgagagattatagcagaatcccaatgttcaacttgttggttaaacattttgttaagtgatgataaacattgatcatagggggaattaaaaagaaataaatttttgtaatgaagttggcgacataatatattcattttgcattttaaaatgattcatgcaaagataaaatatttcatatttttttcctaagaataacctctcacacacttaaacacattagagagagatctcttttctgtctgtcttctcctctagaaaacaggttttgtatctttctttgttacctctactaaagagaaaaaaaaaaaactgccttttgggaaaagttgcaattactgtattaaacaaaccacgtgaactctggctcttgttgagttcttcagtgttattctatcccttccaataatgtatctgtactctgtttgctgcctttaatttgcaatcacttttatttgatgtactgctcaatttgggtaaggaaggaataataatgtcacctttatttagagtctatttgtaggaaaattagattgcctttttttgaaatttttttcaaacctcttattttaagaaaactaggtttttgatgaaaacatgacttagaataaatatataatttttcaaaacggatttataaaatatatggagacgtatatattcagctcagtgaatatatatttgcactttaatcattagaaacatcgcaaaactagtgggaattgaccactcttgtcaaaggtaaattgcattatattctatttattttagaatttggaaattgaaacatcttgcaacacgtccttggatagcatatgtgcatgttgcaaggaagaaaagtttgcaaaggcaaatactaaaattgtaggtcttatgacaccccgccttgaaaaatatgaagtctaccagtgcattacttctggcacgattaacacttgttattatattgtaagattttaggatctgtcagaaacaaaatggaggcattgtttggtagcatgagtcattctgttttgtaactctcccatcttgttgcttgattagtttagaatgtatatagcacagaacttacccaggtttcaaggtctttgggttcctaggattctatggaaatagggggtgagggagcaagcacttaacccatgtggctgtccagctctaaggccccaacaaagcaagtaaccttttctcatactctagcttagttccttctttctgcgcaaccactacttgatctaggataagaagtgaccattatgggaacacaccggatattccaactgtattaatgttttagtagaaatatttttagctctatataacagaaaccctgtatacataataaacaattgtatgcttcatatgatgaggaaatccaaagctaaattgtcatttaattaccttatcatcaggccacgacccagtttctttgtgattactttttctgcccttgtctattttttttttccttttctgcatgttagtttccattatgatcacaaaatggctgccagcagtgactagcacatcagttgttactcatccttcctttctccaaaacatctagaagtcctctcctcaaacctcactggctacatggttcattcctaaaccaatcagtggcaaggagaaattagattagacaattaagtgcttcactttggaacagagaataatgtcatgtttctatagacaatgtgaggtgatggaagagtggacaactgaattaaaaattggtgttattttaggaataaggaagagaggaaatgaatgcacaatagaaaaccaacagtgtctgctctacttagtaaaagaggtagactattgctttagtccattgtgtaggtaatatgatacatacctaaaaaataaatcagaaattaatggcataaagcatttcatgaaagttgccttacaatttctatttaacatcaatatattaagtagaggccatgcagttctctggttatctgctctaatatttcatgtaaaaaatagtctatagaatatttgcatctcatatgatggaataaagggagaaatcagaattgatgtggcagttatgatttcaggattttttagtccagcgaattatcctcccatttggagaagaagagtattactatgggaagcttgtgggattttttttttttttttagaaactcgggtctctataagaggctgatgtgtgagtctattcacagtcatgttccatctcaggctgatcattcctgaaagaagaagaaaatgtgttttaatatagagagaagtgatttggtactgaactacacttcatactgagcaagttatatatatatatatatatatatatatacacacacacacacacacacacgcacacacacataaaagagaaaacttagatgaatacattatctgtaaaagctaaataaccatagtttcttttcagtttcatttataaaaaagtaattttatgagctagaaatggaaagacaaatcttcccatggttgcagttaaatagaaatagataaactgtttctccatatggaggatgcaaatgtgaatcccacagtacacatcacatgcataatgcaatgtgaaaccagtaaggcatctcacctcccagttttggatttaaaacacaagctgagacttggctggatatactgtatatagtaagtgactttcattgtaagtggtacgatgctttcatctgtaaaatgaattttccaaataccctctaaagcataagttgaaaatgataaatccatttgattgaacttatttgcatacataatttaaagttgcatcagttacttctttttctggcaaaaaatcacatgattcaagttgaaccaacttatccatcttttcctgctttgatcttaattcactcagaggttcttaagatgctcactggtttgtatttaattaagttatttctaacttgtggaaaatattttttcctcggctgtagcagtttctctcctatggatgttaatttttagttcataattaagaacaatatatgctgtcattcacttattaagtcatcatcagttgtgatctcatgattcaaaaatacacttggaaaacaaaatcagttttgtgtacctgtattactgtctactaatagatatctaaataatatagtacagtgctcagaattttgaaaatagagagagcataattaatttgccttaggaaataacagattgcaacttccatcctcaaatgtagaaacgtttcatacagccaatgagtagatacttagtgaataaaatataattctagcctctgttctcacttcaatctgttactcattatcatgtccatttctattaatccaggtaagataataaaataataaatacattttatttgctgggtggtttaaatttcttttctttttccttttctttcattgaagcaaagccccattgggttcaactcataaaggatgtggaaatagccgtggaggacagtctttattgggaatgcagggcaagcggcaagcccaagccttcctaccgatggctgaaaaatggagcagccctggtgctagaggtaaggtaacatggacctaaaatgggtttagaggcctggtaaatccaccctttcctcacttggtgtttagcaaatgctttctttagtccctagtcccaaaataaactgttgagtttgcacactttcctttacttctaagcagtggtacaggaggaaaaatatcaaatcaagtacccagtctgccagtgaggagagcttttcagcatggcatttcactgggaagaagtcatggtgtgaatttagtctgtaaaataatctaccgtttttttggtattgaaattagagaaggccttactttaatcaaatttaggatataatttccttttcctgtttaacaacttggtgtggcctctggggaatgaatgtatctattacttggttaccttgttatgtaagtacttattttctccatcactctccttctcaagccatgtaatttttgccctttttttgtatactaagtcaattgtgttctttcagtttccatacctaacctttcatactacctagaaactctggtaaatatatgtgtttcccagaaacctttctaatccacagatttgataatgtttttaacttgcatgatttgaaaagacatagtgaaaacatttccaactgatgggataaaaatcaacctcataaaacatgttttaaagtcacggtacctttttaagaaactttaactgtaggggaaaaagtgaaatggttgcatattttacctctgctttgttatctattttatgatatacttttggattgaaggatgctaattcatatttctaatgtgtagctattgtgtaaattagtctttcacatttaaaataaggaaaaggttaaatttcaggccatcctgtctaatactctcagaaaaatgcagaaagtttctgtgtgagtgaaatgatagtcagttcatttttattctaaagtggtatgtttgtttatatgaaagatatttttattatcatctaggagagaacacagatagaaaatggtgcccttacaatatcaaacctaagtgtgactgattctggcatgttccaatgcatagcagaaaacaaacatggccttgtttattccagtgctgagctcaaagttgttggtaaggctgattttctctgctcttctcttaattttttgtcttaaatccttcattgtttccagaagcagtaatatttacttttcacattaggttcctacatctaataatatctacagtattacaacacgatcattcagtttctaatcaaggcataccttttaacagtttctaaggaaaaacagcaattatggccagaattgaggaccaagggttaagttaatcgacagtaggaatcaaatattggcaaaagatatccttatccacctccaatattaccaactaagcaaagccttttaggagaataagtgattttggtgttccccgttgctggtccgtaatagcaaataccaaaatttgaatcaatcgtatttgattcaaaagagttgcctttgcctttagtggctctgttagaagcttgacacattggataccttgaggctttcattgtccaaggctccactgcttgaaattatagatgatcttcttcttgtactttaggtataggagaaaaagaagatgttctatcatgtttaaagcaattgtccagaagaatatttacattacaaatgattgaaaatccaagcaaaacaccatggcatagtgtagcatagcacaaatgaatggaaggaaaggaggaagggaagaggagcaggagggcttgctcatcagtccatgttattaaaatggagaatttggatttcagcataatttggtccagtgttcaaatatcatcactattatcaggttctatatgatgtttcccaacaaaatgaatgtattaccacagtcattccagtggaagaaagacggctgtcttaattgctcaaagggaagtcaaagtgttgcatgccattggccccatatagcctgatttgggttaatacttgtttctgaaccaatccatatggtcagcaagtgataaggccctgcatgatttaagtcagtgtttctcaaccagggacaattttgccctgagggaaatttagaaatgtctggagatatttttggttggtgtggagaggtagaggaccagtgtgtggtattagcatattgtgggtgaaggacagagaggctgctaaatatcctacagtgcacaaaatagcttctcacaaaagataattatccaccccaaaatgttatatgtcaagagtgattgaaaaaaccctgctttaatgggctctctcatctctagtgcctggcagttagaaatgcatcatctgtaccaggaggaatgatgcctggagggatgatcaactgaaaatctggctgctgttatccatgacagagaagtagcatattatgacaaaaagagggaggagtttgcatataagtcttaacttgaaagactgtaattatattgcaataaattaagctgatgagccatagtttatccatctttaaaatgggtggagtcctactcaatgtatggtgtgggattgttgtgtatgaagaaatacgaggtgcgtaaacaaaagattgtattcaaatataaacaagtttttgttttaacaaaaatcactcttttatgatttttaatttttaaggccaacaacctctggataccatgttttctttaccacaatcacatgtataattacgtaatatgattcactctaagatttccactaatcaaataaataaattgtattcacttggatttgccataagacacagcattagctatttgggaaatgcagtaggtttttaatgtttttcacatttgcagcaaaaggaagagtgattttttttttattaacataccctttcattccaatgatacaatattatgtatcttaaatgttcaagtgttgtttcaggattaacatcccatgtattattagcaaatgtaatattttctacacattattatacttcatgcaatattatagcatttaaaataatatgtgcgtaatattatttttccccagtttggaagttcaacctaacaatttaaacattttatcgtggaacttgatacatgcatatgtatgagaatattaattcagtgcttagcctctgttctcaaagttttgctgagctttgttgaatgctaggcactgtaccaagtgctatgtcctaaaggttagcaagagagacaaccctattcctgtcttcgtggagctaacatttaaaaacgttctataccaaatgttttcctttcatttaataaacacatgattgagctactttgaatcttcaccataaactaaacatttctgtataaagtaattgtctcacgatttagacttgctagaaaacataataacatgaattatcctgtgtgtggcacacaataagccaagtaaatcaagcactgacaccctgaatgtaaagaaaacttttaaaactgtaaaagtggacctttgaaattgacaagaagttttgtaaatgatccacttctccttctctcctttcttgcctttcagcttctgctccagatttttcaaagaatccaatgaagaagttggttcaggtgcaggtgggcagcctggtcagcttggattgtaaacccagagcctccccaagggcactctcttcctggaagaagggggatgtgagcgtgcaggagcatgaaaggtattttgatgtccagaaaagtggtcatttactttcctctcactttccatactgatgtcaacataggttttaaatatgaaatgaaacaaaatagcatttcagtagcatgtgagatctttaagaactaaaatagtagtatttttgttctttaatacctttgtaagagtattcagttttttgaaatctaaacacagaaaatatatccaaggtcttcccacatagagtactttctcttaacaaggattttcttcctgaatcgctgggaagactcaaccagaatgatgaaggaatgttgatcccagaagcagatccacatcccaggacaaagaagagaaggatgtataataacagcacatgccaaagaaatacaaatattgctgttatcctatactcaaataatttagcatgactggtatttagtttaagcaaaggcatccctgatttcctggctgtaattataacactgagatgaagaagcaggatggtcttagtgaaaagcacagactctggagctagaccacctggattcaaatcttcatttttgcctttacttgctcagtgctgtgacctaatctttctgtgcctcattcccttatttgttagtgggagtgataatagttcacacctaatgtcaagaattgttatgtggatgaagtacataaatattaataaagcacttaggtaaacacctgccagaaagtaagcgtaagtattggctgttactgctgcttatctattataaatttactatatatttattatttattattacagtttattgagtgtttattgccagggattatgctcagagcttgtgataagcagaataattggccccaaagcatccctctccttatcctagaaacctgttactgtgttatattacatggcaaaaggtaattaaatttgaaggtagaattaaggatggaactaaagtcttagcagttgactttaaaataaggaggttatcctggagtatctgggtgggcccaaagtaatcatctgagcccttaagagaggaagagggaggcagaaggattggtcagagagctgtgataatcacagaagaggcaggagagacctgaagcctgagaaagaccctgatgagtgttgctggctgtgaagatgagggaaggggccagcagtaaagaaaacagggaccttggttccatgaccacaagaggctgaattccaccaacaacctgaatgagtacaaaatgattccagattcagaaggaatgcaacccttctgaatgttgattttagcacagtgagacctatactgaacttctgacctccagaactgtaagagaacaaattgatgttgttttaggtcatcaggtttgtggtcatttataacagcaataggaaacttaacacagaacactaagtgaattatcacttttaaatatttctgcagctaatgaaaaaacagaaacttagtggaattaatttgcctgaagtcacatagccaggattgggagccattctgtttgactctaggatataaccactaagctttatcagtgccacattttgtacagggagcccagaatctttgaggtggtctcagccattgaagtcatagagtccaaattattactttggaaatgaaaggaatacaaacaaacaataaaaccttaggccaagaaatgtggatttgcttttctaaaatatcacagcatcagattgcacatgaccaggttgaacggcttttagattttagccccaaaggtatatttagacaagttggttacaacagcacaatctgcagttcctccagtatttagccgaagatgccttcattaaaaggcagacacagcaggatgacaagataaaattgtgaattgagtggttcaccataatccaaccaaatgctaggctgcacagaatagatttctggaacaggaggttaattagtgatttgcagtttgattttgtaagccagtttaaacaactacaggcttgtggcacaaactagttaattttggctatgctagaagttaactcttcatatggaactcatgacatttttgtgttcaaaaatttttaattgattcaataatatacatgaattaaatagagattatttcccatggatatcaatgctttgtacaatgctaaatcaacttgtcctcatagtagcaaatatagtaggtagaggcttttaatcttaatttttaaaggggataaaaagattaagagatttagctagtgatacacaaggagatatttatatccacattgtatagcgatggtgctggtaaaagtgtgtaagttccaggatctaacctggaatttctgatttagccagttaatactttaatctatacttaatacaagtatagattcgtggcacaaactatttaattttgactatgctggaagttaactcttcctttagaactgctgacatttttgtgttcgaagatttttgaacacaaaaatttagtgtcattagatcagctatgtaatacctctgaacctccgtttcctcttccataatatagagataatatatccttccttacatagtcgctgcaaaatcaggatttagcctgatatttgtacatatacatatactgatctataagaatgagatcatgttataaataaaattttgaaagtaaaagtggctgaaaaagaatttttttgtttgttggttggccgttcattggttggttggtcactgtgaaggctgacagtcaaggctacctggactctccattcagcagggatgcaggccctgctgtcttgctgtcccaccactctcaactcatgaaccaaaaccactgtttttgtgcctgcctcccagtgacatcccaggcaacagcaaggaggaaggtagaaataagaatacacaacccaaatgtccaacaatgatagactggattaagaaaatgtggcacatacacaccatggaatactatgcagccataaaaaatgatgagttcatgtcctctgtagggacatggatgaaattggaaatcatcattctcagtaaactatcgcaagaacaaaaaaccaaacaccgcatattctcactcataggtgggaattgaacaatgagatcacatggacacagaaaggggaatatcacactctggggactgttgtggggtggggggaggggggagggatagcattgggagatatacctaatgctagatgacgagttagtgggtgcagcgcaccagcatgtcacatgtatacatatgtaactaacttgcacaatgtgcacatgtaccctaaaacttaaagtacaataaaaataaataaataaataaataaatcaaaaaaaaaaaaaagaatacacttccttccctttaagagtcttcccagaagtcccatacaacactcttccttataccatactaatcagaaattcattccctggccacatttaactgcaagagaaactgggaaatacagaatttttttttttttttatggacgggaatgcacccaataaacaaaattgagattgtgtttttaaggagagagaggaaaataattgctaacccagcagtgtctcgtggtaataaaagttagttctctatccctttcaagccttctgacactctgctttgtatgatatatttctaatatctcccctactgatcataagctttcatatatgaagatatccttaaaaagagggaacatatttaagagaggtccatggtgttccaatcctccttagatctgtggtttgaattttgtttttatctttttggacagcaaaaaacactgacgagccagggccttgatgcttagggagaagcctgctagaagcaattatcgaacaagttgcggacttgaaccttctccaagtccacgggaaatcagagtggccgcagtcatcacttggcaacgaaagccccatatccatccctcttaacttggtctgcaggcttcagccaaatcagaaaaacacattaaatggtagatttattgtggttgttagatcatggattgttacaactttaaaaatgcagattcaatcttatttgaaggagaaatgaattcattggtgcattaaagaatagaagacaattttttaatgggatatttatgacaaaatttgaagtgtatttgattttttagtttttttaagtggttaatttggacttgtcggcgaataagaaacttatgataaagatgaaagctttctctagcctaacatagaggccactggcagcaaatacattttgattaagccaatattctatatatgtatcattcaaggtctaaatcagaaaacaatcaaaggattaaatacttttcttaagcactgaataaactgaggccgagtgcagtgggtcacgcctgtaatcccagcactttgggaggccaaggcgggtggatcacctgaggtcaggagttcaagaccagcccaaccaacatggagaaaccctgtctctactaaaaatacaaaattagctgggtgtggtgctgcatgactgtaatcccagctacttgggaggctgaagcaggagaatcacttgaacttgggaggcagaggttgcgttgagccgagattgcaccactgcactccagcctgggcaacaagagggaaactccttctattaaaaaaataataataattggataaactgataaatgtgccttctatgtaaatcgtataatagatttgaataatcggccaggcacggtggctcacacctgtaatcccagcactttggaaggccgaggcaggcggatcacgaggtcaggagatcgagaccattctggctaacacggtgaaaccctgtctgtactaaaaaatacaaaaataattagctgggtatggtggcatgtgcctgtagtcccagctactcaggaggctgaggcaggagaatggcgtgaaactgagaggcggagcttgcagtgagccgagatcatgccactgcactccagcctgggcgacagagcgagactcctactcaaaataaataaataagtaaataatcataatccacctggtttataaagttttatagcagcacaataacagctttgcaattatgaatcagccgtgatcatgtggatctcagtcagtgaggcacctaaattatagaatcactttgaagaaatgagagttgtttctttcaagtatggagagcatttcaagctagagtagtaaatggattactgcccaacagaggtcttcaaaaagctgctatgagtagataacaaaggcttatcctgcaaaaagtgattcctgggctcttacatttaagttcacacttgaaaataccttgagtacctactatatgctaggcactaggtatttattatttatcagatacatcgatgccattgtttgtagcttttcagggtatacagacaggtaacaggacaggtacaataaaactcaattggcaaagtacaggatgttcagggaatcacctaggaaggctcttatctccaaattagggatcaggacaagctctctagagaaggtgatgtctgcagcaggacttgaaagatgaccagggtttttgttggagaagagtattccaggaagaaagaatagcacgtgcaaaggtacagaggccagtcatggtttgggtactgccttagttcatttgggctactataacaaaatactagattgggtaatttataaataatggaagtttattgttcacagttctggaggctgggaagtctaagaacaaggcaccagtctggtgagggctcactctctgatgcatagatggggccttgttgctgcatcctcacatggtagaaggggcaaggcagctccattcaatctcttttgtaagggcactgaccttatacccctatgtcttaataacttcccaaaggccccccttctttataccatcacaatgagcatgaggtttcaccatggattttggagggacatattcagagcatagcaggtacttgagtaactgattgttcaatgggcctccattttaaggtgccatggaggggagtgttcagagagaattgggcagtagaggtaagcaggggtcttattgtcaatgacagtgtataccgaattaaggaatttgggctttattccacaagcactgggatgcaacagaataaaatcaaagtagaagatgtacaggattaaatttctgtttaaaaaagaggaccagcagggtgcggtggctcatgcttgtaatccctgcactttgggaggccgaggcacgtcgatcatttgaggccaggaatttgaaaccagcctggccaacatggtgaaaccccatctctactaaaaatacaaaaattagctaggcatggtggcacacttctgtaatcacagctactggggagactgaggcatgagaattgcttgaacccaggagttggaggttgcagtgtaccgagaccttgccactgcactccagcctgggcaacagagtgagaacctgtctcaaaacaaaacaaaacaaaacaaaaacactggtaccagcagatgggttgaagtggtaccaggactgaaagcaagatccctcattagcagcaatccacctgtctgagcaaaacagtattacagcctgaactaaagaaatgacagtgggaatgaagtgaagccttgaggagtttgagaaaatgttatatcaacaagacctgttgattagaggcatgatttgaagagaagacaggagtcgaggataaatcctagatttccaggttaggattcagggagcatggcagacccattcagagtgacagggaaccttatagaaatggcagaaatgagggcaaataggataagttcagtttgggattggttgagtttgaagtacctactgaaaaaccaactggatatatccgtgcatacaaaggttgactgaatctggaacttaggagaaagactcaggctatagaaacagagatttatgtgtcatgagcttggagatggtagctgagccattgtagtggatacaactttctaggaagggtagatgtctttaaatggtagaggctgtacagcttacctctgaaactctcgtacatacaagttatcagtagagagaactgtgttacagcctcatttaatgatttagtgattgatttattaaataaatgccaagtcacctggtgctcaactattctaaacgtcataattactggcattcagtattgagtaaaggtttttctttttcttattttggctttttttgtttgtttgttttatattggtattatacagtccaatattgggtaaagttattgtgctttttttctccctgcagcaagaaacattttggaataaacaaaaatgtactgcctttttcagtattccatagtatttcaccaggtgtcaatgtttttgtgctatttcattcattcattcacttaaatccacctatttccaaaagagacaaatcaaaactgtatgttttgtctcttttaaggaaactaacattgaaaaagacccttgagaatgagaacagacgtggtttgtgagaaagagccagttggtgtattttaaagattatttaacttatctctatcacttagtggtacttgaaacatagtagctaattatttttttaaatgggatccttcatttgaatgctattgcttataatagtaaatattttattgcaataacctcagtcagaagaaagtaaaagaatggctcattgcttctaattaacacattaaaattatttcaaatgttttatgcaacatttaatactattgaaaattaaatgccttttaaagaaagagtgaatttttttccaaatatgaataactataatccaggcaatgtttttaaaagatattacccaatcttaatgtatttcctgcacatagataaaagctggcattaaaatgcagtaagcattatatgctgtattattggatttatatgacatttttgaaaaaggagcagttttagggaaaaaaatagtgatcactgcttgccagaggctgggagtgggtgtagaggttgactgtcagggacacagaaggatttttggggtgagggacctgctgtagcccatgattgtgagagatgacatgactgcattcatctgttaaagtgcacagaactgtgcatcagaaaaaggtgtattatactgtatttaaattatgccttaattttattttatttaattaattaattaattttttttttgagacggagtctcgctctgtcccccaggctggagtgcagtggcgcaatctcggctcactgcaagctccgcctcccgggttcacgccattctcctgcctcggcctcccgagtagctgggactacaggcgcctgccaccacgcccggctaattttttgtatttttagtagagacggggtttcaccgtgttagccgggatggtctcgatctcctgacctcgtgatccacccgtctcggcctcccaaagtgctgggattacaggcgtgagccacggcacccggcctatgccttaattttaaaagttacatgcagttttacattcatctccaccctgatcaagtagttccataaaggagtttaaaagctcaagaaatgctcctaactggccacttttgccatttgtgaagcactgagtaatgtgatgatggtacttacaagcagaatctaaacttttgcaaataaccaggatgattctatcagagccaagaccacttagcatttctgtcattgcccctcctagtggccacagcctcgctttgataaagatgtgtctagaaactctgtcactatcaaacaaatctgttttaggtggcacttccccttgactcaagcttttaaatgaagaacagagattcctttgccaaaggaatgtgtctctctccatctctttccccttcccttacactacctggctcctctcctcacagtggagtccacttttcttcatactgttcaaaatgccactcccatctctctcagccttccactgcccccttcatccaaaaagcttgactttattttaatcttcttctacatccgtggtctacccatcaaaacagttgttccctcgcaactgtcaggtaggcgtgcaagctcagtgagtttcagtgaatctaccctcagatacgtagctgagatctcagtgagtcttttgcttttgtatcttacttgaatttctaactgttgaaccttgaagcacagggagaattttatttcatatgtggatgccatcacttttaaaaaccagattgattgatgtccctgccttctgcctagaaggaaggtactccatgttgttttctaatttatcatattgttatttttcactgggtattatgtccggctctgggaatacatagatgaataagagacatcaaggagccgtcaaaaagcccacagtctgtttagaatgtggataactaaaccatcaattacagtggaatagactatacgattaaggtgaccatggaagttattcaacaaactgggacattttagaagggaaagggggcactgttagtaattacctccaagacaacacatgtaaactaggactggctgagcacactggacattccatcctgcctctagtgaaggtgtttatagagactgttgccacatggtcttttaaaccagtaagaagcagagagaagaaatgctgtctcagccttgggaagcaggagagcagctccatgagggcagaaatctcaaaggaagggatgtaaaatgcagcaaagcaagagagtagggaacatgctgtctaaacagaaaggattacacaggtaagaagcaaaactgggtatttattcttttattccagttgtgtcagtggcaaagttcacatatgatcgtgaaaataagaaagcctggcttgagttcttccacagatagaaaaccatttgtcttcttcaaaggaggtgaacattggaggcagaactcttctcttaaagagatgattgagatgcctgggtaaataagcaagagttctagagagtagagcacagcttccttcctgacctggcttccccaacccatacctctatttctcttctgctttcagctggaaaaagaaaaggaatgaggtcctttgccaataactcccatactctatgagaagattaagctgatttaagagtgaagataatcaggagaagagtcaatgaaatcccagagtttgggtttgggatggggctcatggtgtgataatcacctcctctctctaataccctaccctccaccaccagcatatacttacaaatcttcccctattagccaccagacagcttcagtttctgtgtgggtatttgtatcattatttacatgaattattaatgcctaactggcatgcagtataggaattgcgatgcacattattcactgtgtcagatgaagttaaacatacgttttacttgcttctttaattttagcatatggaaagggcaaagcatggaaatcagaaagatgtgggtcagatcttggctgtgtcacttgccacctatggggtgttagacaagttacataattcctgagccttggcttccttactggaaaatgaggccaggaatccttaaacagagttagtcagcctcgtgggtggcatttgtgtggcacacactcttagtgagggatgagttaaagagattggtttccctgataggcagataaacccaaggtttcctgtggacaaattatttccaactttgtcgctgccccgtttctctcacattctgtgggacccccgcctttttaaaactcagtggattgcaaagatcagaataatgtgtgtaaagtatctgctataatgacttctctgtagatgctcagcaaaaggtttctgatgctgttaatatggctttcatgtatttatttatctacttatgtctttacttacttaattgtaggttcagagggcaaatgtgcaggtttgttacaagggcatattgtatagtgctggagtttgggcctctattgaacccatcacccaaatatagtgaacatggtaccctatgaaaacatggtttttcaatcctggtctccctgctttcctccccgcttttggagtccccaaagtctgttgtttccatatttatgtccatgtgtacccattgtttagctcccactttataagggagaatgtgcttttttttttattttgtgtttctacattaatttaattacaataatgacctccatctgcatccttgtggctgccaataacatgatttcattctgttttatggctgtatagtattccatgctgtatatgtaccatattttctttatccaatacactgttcatgggcaactaggttgatcccatgactttactcttgggaatagtgctgtgataaacataggagtacaggtactttttcactagaatgatttattttccattgggtagatacccagtagtgggattgctgagttggatggtagttatgttcttagttctttgaaaaatctccatgctgttctccataaggattgaactaatttacattcccactagcagtatatgtgttcccttttctgtgtaccctcaccaacatctgttatgtcttgactttctaatatagccattctgactggtgtgagatggtatctcattgtggttttaatttgaatttctctgataattagtgatgttgagcattttttcatgtttgttggctgctagtatgtcttttttattattacttaactgtttccatcatgttgctcagatgccttaagagtaataagtctgggctgaaaagaaaggtaagtacagacctttcttttttagaacaatcaactgaattgcacattatttcaaccttcttaagtaaattccacccaaatgttattttaaacagattgctgacacatggtctctaaaatcatatcaactaaattttgcagctaaccatgcagttcttagatccatatttcaaatttggttttatggatcatagaagttaaggccaccttaaaatatatttcgtcagtgttgtgattttccttggggaatgcaggttaatgaatctgaatgtgctggggatttgaatctacttcaagccagttcgttgttagaactggataaataattcatatctttgcccagtataaatgttttatttacagggagtaactacccataccatattcttttggtcatacagcatttctcactcaggcccaaaaatcccacatgcatttaaccatagaccaatccctgttctgtttccctgctctcacttgaaattcaaagaaaaaaatattaacgcaatcatagaaacgcccaatatcattacatgctacttttgcatttttttcttctaatatttttaagatgggggaaaaggagctttctctagaagtaagaaaattgactgttttaacaaaatcaagttgcagtacaagagttcatatatcattaccttttgaataagtttgaaaagaaaggagaagagaaagaagcagaattctccttgcattctgtatttgtagtcttgtggttttctctggctggaatgtcttttcttctcaacctagaaaacccttacatatcagtcaaggtccagctttattgttacttgctatgggaagccttcctggagctgaataggcaagattaattgctctttcttatgttttaccactttggtttctttatatattcagtagtatcatttaacacagtgtattatgtctgtttgtgtagaagaccatctcacctgtattcttgcaaagccttcaccttatccctgtttgtactctaagcctctgctctgtacatgtttgttcatttcaacattgatttattcttcaaatatttatttaacatctactgttcccattaacttttgctgcataacaaatcactctaaaactttttttttttttttaagagacagggtctcgctgtgtcacccagactggagtacaatgacatgatcataactcattgcagtctccaattcctaggctcacatgtgtctcctgcctcagcctccagagtggctgggactacagccatatgctaccacaccttggtaatttttatattttttttttatagagatggggtctcagtgtgttgcccaggctggtctcaaactcctggcctcaagcagtcctcctacttctgcctccaaaagttctaggattacaggcatgagccaccatgtgccctgctaaaacaatgtaatggtgtaaagcaacaatcattttatcatctctcaaggtttccatgggtcaggcattccggcagagattgattgacaaggcagtatttgctcagtgtgtctcctgtggctgcagtgggatgggggctggagacagcagctggaagataggtgtccattacagtctctcctctcatgaagcccaaggcctctgcttatggtctctccgcatgggtgagtgtaggcttcctatgctatcatggcctcagcaagagtcataatgcctacctagggcagctaaaggcattaagaatgaatgttcaagctagcaaggtggaagctgaattccctaggctctgaagacaccatcactttccctgcattccactggtgaccagtgagtcacaagctatccaaattcaaagggagagaagttagactttactttctccccctcagttttagtaaggtatacttgacaagtaaaaattacatatatttaaggagcagaaggtaatattttgatatatgtatacattgtgaagtcaataccacaatcaagctaattatcatatcatatctatcaccgcacatagttaccattttgtgtgtgtgtgtgtgttgagaacacttaagatcagctctcttagcaatttcaagtacataatacagtgcaattaactataattcccatgctgtatactagagctccagagcttactcagtctgcataacagaacctttgtcctttgaccagcatttctccatctcccccatcctccagctccaggcaatcaccattctactttttttttccaactgtaaaacattccacatataagtgagatcaaacctatgtctggtttacttcatttcacataatgtcctctaggttcatccatgttgtgacaaatagcaggatcttcttttttaaggctgaataatattctgtttacatatgtaccacattttctttagtcatccatcaatgaaccttttaatgggagagtggcaaggatttagtggggcaagagggttgagaaatactgtgttcaccttttggaaatgcaatctggaacacctaccacgtgctctgccatgtgtaaggctctgaggataccacagtgaataagacagacatggtctcttcttcatggagcttgcataaggaacagaaaaaatataaataagtggaaaagataaaatttttttagccataaagaaaaagaaactatcattatatggtacatttcaagaaaggccttgtggggtggacttagtggctcacacctataatcctagcactttgggaggccaaggcaggaggatcacttgaggccaggagttcaagaccagcttgggcaacagagggaggctcattttgcaagaagtgtaaaaaattacccaggcatgttggtgcacaccggtcgtttcagctatttgggaagctgaggcagaaggatggcttgaacccatgaattggaggttgcagtgagctgtgatcatgctgctgcactccaacctggatgacagagcgagatggagatttggtttagggtcacagtagtggcagctgagaaaaagagactgtgtattcttgaggtagagctggctgaattcatgcttatgacataatatttcctacctaatgatcacattttatgtttgttgtgcatgaattatacagctcccaacttggcctttagactgtgtcctgtgtgggaataattcttactcatacttgtattttccaaaacacttactgcattttaagtactcaacaaatatttgttgaagtgcatttcactctttcttggacagcttcccatgtcttaaaagtacgtataattttccagtttaatttattgcgactatttcttagaaatctaaaaaattgatttttgtatagatttctacttgaggctttctattaaaaaatatggagtgtgctatattttagtatgttcttccccctccctgaagcccttcatggaaacaggtcaggtgagtggatgcatggatggatggatggatggatggatggatggatggatggatggatggatggatggatgtcaaatgagatgtcgagtgaagtgccgtttccattgcacttctgtggaaaatacagattggtaatgatgatttctgcctcctatattgtgatccctggagaggacttactcataatttatgatctgttatacaaagtctatagaattgttacactgaggtaaatttctcactgcctcactccaaacaattcattttgtactatgacccattttccactttgtgatcttatttgtgtattttacaattctgtcctaatgcagatttcattgctcgagtagcatttatgggaagatgagagtatctgaccctttttgagtctgaaattctaaaaatatatatatataattgagaaggaatatataaaaatctatcctgttttggaaaagaagagagattattttctaaccttttacattcaaatactaaaaaagagacacctttaactttagcttaaagattattttaaacacttattttttcttagcatttatgaatttacttaagaaaatagtagtatttcaaagtttaataaaatcttgttttcttagtttagataattttataaacttatactttattgtatttatttctttgttactctagcctacttttaataactttatatcttctattctatttcatttacttatatcgtgtcgtatttcacaaagaattggagacagtttatcaaataatacacaaagtgaacactgaggagaaaaaatatgccagtgttccagttgcctagaatgtaagtttctttagaacagcataaatcctcaccatggaatctttattgtttatgacagagcaaggtccatgttaataaatatttgtggaatgaatgtatgaagttagtttacaaaatatataccaacttagttgagatccacaattttggctgagagctttgtggtaacaaatgaacagagaaaaatactgtgaattaacaatccacagcatctgtaagatgaaatgaaacaatgtgataaggagatacacaactcctcctggccaagaaatgttatgtgtgtgtccaaatccagtggatgcccacagagagaacagtgagtaatgtactacttatactcctcatacttaaagtaaaatacaatcaattttaaaggttacttcttttaccgctcacaacttaagggtaactgaatattaacactcaagactcttgaggaatacataggccacatttcttttagctaacttaccatgaatattatttctcaccatttctcattatttctcacgtatgtttttagaagccttggagtagatgttatttcaaggttatgctcagaatcaaaaacctgagatacagagaaggtgctgcagtgcaaatgaagagtcagatgcttaaacgagtccattgaactagcactaaagttttattaccttatgaaaggtgtgttggcccaccagaacctgcgcttgactagttggtgataaactctctgcttggaggagggacaagaatgttcaggttgtcaggactgagatgttactgggaaagcaaattgaagccctctatattgtatgaagaaatgtgtgactcaagacccagcttcttgagcaacattaccattttgtttcactgcaagataatttgtaaggaacccatcatcaaatgtacacagtcatcataaaagaaaatgtcaatgaagcacttctagaaaggctagcactgaagcagctaagacaaaggggttgcaaacctacttctgcgtcattggatgaatggaattgctagcagaggttcttaacctgaggcccatatatcttagatgatctgatcccctcctcagttgtatgaaaactgttattgtttgtgtgtgtgtgtgtgtgtgtgtgtatacgtatacatatgtgcacacacacatttgttctacagagagatttcccagatttttcaagtactcaaagaaccttgtgtcctagaaaggttaaaaacactgcgtaatggccgggcgcggtgtctcaacgcctgtaatcccagcactttgggaggccgaggcgggcggatcacgaggtcaggaaattgcgaccatcctagctaacacggtgaaacctcgtctatactaaaaatacaaaagaaattagctgggcgtggtgtcggccgcctgtagtcccagctactcgggaggccgaggcaggagaatggcgtgaacccgggaggctgaagcaggagaatggcgtgaactcgggaggcggagcttgcagtgagcccagatcgcgccactgtactccagcctgggggacagagtgagactccgtctcaaaaaaaaaaaaaaaaaaaaaaaaaaaaaaaaaaaaaaaaaaaaaaccactgtgtaaggttgtaaatgaactacttaaatattgatggatattaataaaagcggatgactttagaattggaataaaagggcaaaactattctatcttgcaagaactcaacagcagggcagggtgttagttggtccactgttgatctgtgataaaaccttgtcctctctacatagaagattatttctgaactcttcatatttgttgagacaacaaatatttattgaaaaaaactactatgtacaaagcaccaacatttcataatctgtatcctttaagggtttgtgaactctagctgagaattaaggatattacaaacaattattagctaagaaacaacctaacttaagaatgtataggaaactggctccagaaatcttggcagcaggcattgtaccatgttgttggagcaagtgctgggatgagtgaagtaatgattattttggtctttttgttgtaaatcagagtctgaagagggagagtccaatggacatagcttagaacattttctctcaaagcgcagtccctgtatcagcagcaccagtatcacctgagaatgtgataaaaatgcaaatccttatgccccatcccagacctaatctgatggtgggcccggcagtgggcattttgaagaatccgctaggtaactggtacacagtcaagtttcaaaaataccaacttatatgtctagcccatggctaggatacgacaagacaccgtgattcatagccctaccaagactgcattcaataggggcaaagaattcctcaaggaagatcaatgttagttgccaaagaatgaggaatcaattctggacagccaaaaaatattcagcatcctctacataccttgaggtgatgaaattccccttatgcataaaatgcaggtatcttgcactttgacattagtgtggaatgacttccattccagggcttctagtctctaagtagaaggacaatcactggagtaacatttggatatttctctaatgactccccagagaaagagtctgtctcctaaatttctgtagaagaccctgacactctagctcaacttttccccttctttctctttggtgtttgctgcacatagagagtggacgtattttgctgttctctttaccacgcaataatggggcttgcccttatggggagggcctgaggtggtctgcctgtgccaggaaggctaagcctgcctaattctggagtgaaatgtcaggaaaccattgtcgctcatctaagcagttttgcatcacctttatctgtaatacaactaataaagccgacatttttattttccctggttagactcatataactctctctgaggcatagaagaatagtagtgtcaagtatgaggggcctgtgaaccttaataatatcccctttgaagttttcttttaatatataagacatcagagaattatttgtctcatttgtctgttttcctttgtttgtgttactacttcgtgcgtctgagtatttataatttttccaaagactcctttgtataagaatgcaaatgtttcagatgagagtattgcctgggccttatgagttacttagatgatagttgtatataatcatttagactggaaatccccttataggggtcttttcttctattgatttgagtccattttagtaggaaaaactattcagtcattgtcataaaagtgattttggctctaaatatatttgtcatgttaatatgcgtttagcaacattttatagaagtgaaaatgttcctttattgttgacttttaacttatgaatatgtggacctgttaaatgatatgaattcattatctttccctaggttatagagtagagccaaggtccatcttctctaggtgtctgttccatagaatgtgtatgttcaacagaatcacagagctgcttgttattagcctggtacttactcaaagttaggttaattaactgctgatctcctccattctgcttttcctttccttggagatttactaaccaataaatcactatactaacactgctgaatttataacatgaaagcccaaaataggataggtagaagaataaaaacgctaatactattttcctaaatactgtttgcaggttatctttgaactcaaggagaagcagttatttcaccaataacgtgggggtgagagcagttgtaaatgagaacatatacagttgtaaatgagaacatatactctatggtctttttctctcatgtttattttctcatacattttcatcaatgtatatttgcttttcttaactgtcattatttatcctgtaatatatgcattgtgagtacttttgtcttacatgtaatgtaagcatccatctcttagaatatgtactcagaaagtaccatctaaaagagccttgttattttctacacagcagtttaatcattacgatctcatgtgattgcaactccactgagatatgcttcctgagaaaatgtagagttgcagtgtgtttgttaaaattcaagttgaataaattaccgtaatgatcagaagaatataggcagggaaaaacaatattttcagaaatcctgctttgccatccgtaatgctttagactttttccattctaaaacacactgcattattatagatgcttaaatgtcatcataaagtacaggtcaatgttgtctagacaacagtatactttatgaacaaacaaagttttttaacagtcataaatttaatgccatcactataattacaacatgagccattagagcagcttagagcaattacatttacttatcccaaactaaccatagactgcacaaagttaagtgaaataattaacctcctactacaaaaggaagtaccaataaaaaggtacaaataaaagtatattataaaactgatcaaggagttaaaatgccacagtgatttaaattgcacatttccctaagcaaactggagcactgaatgttaatttcataaattgttttttaacgttttgtgccaagacaggagtcactcatcgttatctacattttcagctctacgcatttgcagataaacctgttctcagaaagcttagaaagcaaattcgtttatagtgaagtggtataaaattttcactttgaatctctgtagggaagcgtgggttattgaaggttttctgttgagaaacaattactccattcatttactgaatattgtttatttttatgttgtgcaaatgccctgtgggcctcttagaacttactggaagaaccaatttaggaagaaaatatccaagtagttcaaatttttacaatatacatagagtttgcattctttgagagtcaatatgtttgctttgaagtctttgtgtgattctgaaggtgttaggttttgtctcatttcaacatgggcatgatttgcttgacttgaagtttgcttaattaaagttactaaacctaatacaccaaaggatttgtagttcttcctctattcctagcacttctgtatttgtagtggaaacttagctgttacactaattcattgcatagaagatacctgaaattacctacctctgttttgtagtttccaaatcagaaaatatcaatttaagttcaataatgttcagtcaacaagaggcatttttactttgttttaaggcttactaatcatagaagtggtagatccccagcttcttgaagcttcccattctatctctaacctataatttagggcagattaatttgccttattatttaagtatcttcccaaacttctgatataatctgccatcttctggtctttgcatattaaaattctccatcacatctgcattttctttttaataacaatgataggtaaaatttccggagcaacactataaatcaagtgtcattctctttgggtgtcatggccccaaaattttactgatgggattagcgatcagatgggttgggagcatggctcttaatcatgctctctctttcctccaagacttctctgacagtttcctctctcactctttttttccatcccattatcttcagtctctccctctctgtttacttattctctaacaagtacaagcatattctcagttctcttatcctgggaaaggcatttctaaattctctttattcagtcttctattgccttatctttttgctacatatatgtaaacaacatagctacatatgtgtacatagtatttccttgatatccaccagacccccatggatgctcaagcccttacacaaaatagcttggcttttgcatacaacctatgcatatcctcccatatactttaaatagtctctacttacaatacctactaatatgtaagtgctgtgtaaacagttgttataccatattgttctgtcacttgtacttttttattgctgtattgttattatctgtttattttaaaatatattctatctatggttggttgaatctacagaatctgcagatgcagaaaccgcagatatggagggctggctatctatctatctatctatctatctatctatctatctatctatctatctgtatccaattagttcacacatatatgtgtgtgtgtttgtattagtctgcacactttctgaatctatttgcttattatttataaggtgtcagtgccttgcaacccagcttcactagccccaactcctttacagtgactctctaaaggcataccgtcatttactcattcaacaagttttatttttgaatgtctactctgtaccagacacttttcaagggtctaaaaatttagtggtgagtgagctagatattgtcctttcctccagagagcctacagtgtactggaggagaaaaatattagtcaaataagaacacaaatatgtaattggacactcgatgggtgctatgaagaaagcacagagaatgttttgatcaaatacaggaaaatcgaatctaactcatggtttcaggaaagtaagtaaagtctgaaggatgaatacaggtcaaccagagagaggaaatagtttttataaaggccctgagacaaaaagaagcaaaaaagtcattaaaagaaggcttgtgtgattggagaaaagcaagcaaggaaaagaattcatgaagtcatatgaagttagagagaggcagaggtcctgatgtgaggatatggttcaggcttaggatatagtctgtatctcccaggcaatgtgacaccaaagaggaggttctaagcaaggtttgcctggacagctggagggaggagggcaggatcacgtgatcagattgacatgtctaagttttttctccatgttccttaaaacttccagtctccatatcctaaatttttatttatttttacttctctgcagggtttcttctttaagttattattacatgctcattaggaaaatctttgttgtcagataggctaaggtataaagagatttttttaagttatttgattatcttttccagtaaagttatgggaggcatttcacactcaacaaaatgcattacaaccttcagggtcccacgagaagaatcaggtatgtccctttttgttttgttttgtttttaattcctaggaaagttcttggaatttttgacctttctctgtagttcctcaagttggcatgcagtgccatggttccctgatgagctttctaggtcattgctctcaaacctttttattttaaatataccttaacacagttttaaaaaaatcatatgcataacaaaccgtaatagatagctgtacccaggatcatgaacctgtgtgctagctctaattccaccatgattttctcactgaaggaagtgtaaccaggatgcaaatgaaagtgagtaatggactataaagtaatacatatataaagtgatgggtggcagtctcctatagtctactggaggagaaaaatatggagagagatatatacacacatatgtgtatacacacacacacgcacgtgtgtacacatacgcacatatgtgtatacacatatgtgcacgtgtgtatatatgtgtatatacacatatatgtatacacatatgtatatatatacacacatacacatatgcatatataaataaaacaaaatctatcttatacatttttatacagaaacccttgtagtaacatttttgaaacacacctaaaaattttgcaataaacatttttacagattgagatccttcattctagtctaatgtcctcagtatttttcctatttattctactgaatggcccagaatttggaggcatttagttaccatagttggcatatatgacgccatgctgatactggggttgcaaatatttttaagaagtttaccatccattttcactcactcatgtgtcaaaaataggagccataaaagataaagacactcaagtgttaaatgcattatgtggatagtaattattttaggaattcaaagaaagagaacataattatgagtagacaaattagagcaataaagatacagtgatcagattaatgacaggttaatcccatctcatttttttttcgtaattcaaatgacaccacttctaagaggcttttctgatgcaccctatcctagaaacccttcctcctaaagtaattactctctattgtatcaccctgtctatctccttctgagtacttctcaaaaatcagaacttcttacttttacttatttatttgttgttgatatggtttggctgtgtccccacccaaatctcatcttaaattgtagcttccataattcccacatgttgtgggagggacctggtgggacatgatttaatcacgggggcggtttccccatactgttcttgtggtagtgaataagtctcatgagaattgatggttttataaggggaacccctttcacttggttctcgtttcctctttgcctgccaccatgtaagacatgcatttcaccttttaccatgattgtgaggcctccccagccacgtggaactgcaagtctgttaaatctcctttttcttataaattacccagtcttgggtatatctttagcagcagcatgaaaacagagtactacgttgtctatgctactcactggaatattattccatgaaggtggagactttttgtgttgctcaccccataattccaggttctcttatagtgctaagtgtatgtaaagcactcagttatatttccttaattaattagtcagatgccaaagctttgagtactctaagtgtatactaagaaactctaaggtaaggtttattggatttgcctaggctcttttcatgagctcacaggggaccacccaaatgttcttttggaaaattacagtttttattggggcgatgtgactctcttagttcatagtaaaagacatgcagcttctcgtttctcatatactgtttcaaatttaagagacatagtgttctgcctactttgcatttctttaaaattgattaggctaactccatgaataatctaccacaacatatattaatatttttggaaaacatttgacacttatttgataagtgcatcctctcaactttggtgtaataagtaatgctgagtaaaaatactgaacaaagttcaaattggtggagcatcttttgtcatccaatgctgtgcgtgtgtttatgtatgtgagtgaggggtgaattttctttttttttttttgtattcccaaaaagctaaggactggttgatcatgccttaaaaatactagcttaaggcaacatgttctgtaaaaatatgtatattcatttggaaaaaaaatggctattatatatttatttatcttatttgtctttgctttagaatttctttgttaaacgatggaggactcaaaatagccaatgtgactaaagctgatgctggaacttacacctgcatggcagaaaaccagtttgggaaagcaaatggcacaacacatttggttgttacgggtaggtccatttctaaaatattgctttacatacggattcactgtaagatgtattattatgaggaaagtaactatgtgtttcacaatgttcagtacactatgaaggtagaacctgtatttgcacttatgttatttttaacaggtgaaagtcaagggaacaatatttccttagcacagcacagtgtgcaccagggagcacattagttactgtgctgggttgataggcaataagagttacaaatagcatatgttgatgatctcattctatttttttttaaataaaattctattatgtcaggtctttaggatacactttgtttttttcattatagttgattttttctggagatgttcaagtccaggaaataacaggatataaataagaattgcttaaagttgtggatatattttattcatttatccattcatgaaaaaattggagcacctactctgtgccagttgcttgggctgtatccttgagcacattgtcactaatactgtcctcatgaatcttaccttctataaaaggagaaagaaaataacagtaggaataagaaagaagaaaattattagaaggcaaaaattgtaaacaagaaagaggtgcatagtggcagaggtaagttagagcattagcaacaggatgatcagaataaacctcactgagaaggagagatttggaaaaagatttcatggacatgaaggtgtcagttaacagatttcttagtgataattatgcaagcagtttgtagacctcctgaggaattatttcagttggattgaaaagtggagtggctgcaaggttttgagcagagaagtgcatgatgttaaataccttttgatatatcagcaggatggttatgaggaccttggtgaggacgggggttgggaggaccaaaatctggctagactgagttaaagagggaattgactagcataattgtagacaacatgcataaatgactcttttgaagactttggtccaacgtagtgcaaagtaatgtggagtagcagtgggaaaatggggtcaagagaattttaattcatgatagacaaatggaaggaggtggtgatgacagggagaaagaaatgtgcatgtggacatttgcgttggggaaaaacagacattaattagcattttaacatagtacccctcctttttgtacctattctagcatcttttgtattatatctttcaaatccaggctaccattaaatgtctgtttagattttgatggtgatgtaatttctagtcaaagttggtgaaaacacagtattttctatttctacccctacatttcaaaaaacaataaaactaagttgaaattgattttgttaataataatataactgttgtttacacgactttaatttttaaacttacatgtcctacaagttcaaatatcctaatttctttaacaagaatttgtggatccagtgaaatgtagctctgcatcaaaatgcctcttttaatgttgaatacttttaattatatagatgtatgtatatttatgtatatgcatctacagacatacacagtataagttagatgaacagtctgcctgtgcaaatgtcttttatcacaataaaatgctgtttttctgaaaaattatttccccaatagaaccaacaagaataactttggcaccatctaacatggatgtttctgttggtgaaagcgtcatattgccctgccaggtacaacatgacccgctgttagacatcatctttacctggtatttcaatggggcccttgcagattttaagaaagatggatctcactttgagaaagttggtggggtaagttgtggcactttcctcatactttttatattgcatgtgtctctggcacattgcttctgaaaactgtctgacatatagacaatgctctagaaatgttttctaaataagtggttttggttgagtggttctcagttctgttttgatctaattttatttttgtaattaccagaaattgaacacatttacttcaatgtataattacaattacaattgatggatgttgtatttatagtaaatgttacttttcattactttgttttgttaatgtcttatggaaacgaagattttcttttacgggtgtttgttttcaacatgacacatatgtgatgaactgggagaaagctgcacttactaagtgtctcctccaggtgcttgatcccaattaatgtgtcaggccagggtacatcatcactgttaatcctcacaattgcaccagacattagcagtaagacgcttcattgtacaggtgcacaaactgaggactggaagtctatcaacttgcccagagtcactcagctagttagtggtggaacttcaagtccagatcggtgtgtttccacaacacaaatgctttctaatgtttccattctgtctcttcttttgtgatgattccacattagaaagatttacagattttaaggaaaaattgtcactttgaggggaatggtcaagaagtggcttaatgctggtgagccacccaggctaatggtaagcctcacagcatgtttatgaatctggaattgcaaagctagcttcccttgtaggactgtttgcactgactcaaggacagcttcattcttttggtaaagaggtccatggtggacagtcaagtctggttttgtcaattatggacttcacatacaggcctcagtaaagtagaaagccatatgatggtcaactcaactgtgttcatttgacaaagacttcttattaaatgtatgtatttgtatacatcggcatgttaacatattaaaatcatatgcaacttaaaggatggcgttttgagttgaattgtgtcctcccaaaaatatattcttaatgtccaatacctcagaatgtgaccttatttggaaattgccttatcgtggaagccattagttaaattaagatgaggtcatcctggattaaaatgggcccttattcagtataactgttgtccttataaaaagaaggccatttggacatagacacacaaagaggagaatgccatgtgaagcacagacacagaggagagatggaccaattaggatgaaggcccagaacagaggtgtgctgccacaagccaaggaatgcctggagccaccagaagctggaagaggcaaggaagaatttccccttagagattttgcagggagcctggctctgccagcaccttgatttcagacttccagccatcagaactgtgagaggatacatttctgttaagccaccaagtttttggtactgccttacggcaaccttaggaagctagtacagaaaaaagaaagtttttaaaaggaaaagagaaattgagacgtttagatacctaactacaattaagtgtaattttaggaccctttctattttctgtcatttattccgttttggaattactgcttttctaattgttctgactgattcacagcctttgagaacttcaccaattgctaaaatcttttagctttacttttactattgttgtaaatgtctatttatttttaaattgtcactgcttttttctgtcatgataggaaaaggcataggccatattctgagctagctctctactccatactcaggctgtcttacaagttaacaatttcttcttccttgggcctcaagaagaagcctaaaatgttactttcataaagaccctttacccaatctgggaaaggcttctctaatccagctcttctactacttttaattattgaagaattccatttgaaacattagtcacctttgccattataatgaagataattatgtttgtgattgatttctcagctggattgtgagctgttgataatagtttatccaatacggttcctctgtcttagctactgctaaataaatgtgtaatgaaagactgaaaaatccaaagtagtttgactgtaatatgcatcaaacagttacaaagaaacactaagactgagccagattgcagctatctttcagaaaagcttggagttaaaaacattcgagtttataatgtaatttaactatcttgatttacatagcactgataggttctaaagaaggcattaagtcatctctgtacaagtcaggtgtctgcaacatgaaatttcataaattaatgctaccgcttgccaattctgttctttctctaccatgctagttcatggcctaagaattttttgtgccattagtaacttaatattctcccatcagtataaaacagtaagccatacaagatgacattacccttaagcacaggcaattaagtaaatcagttttctgttgcatgagaagggaatcatgtaacaagtcttgtcctctgattgtgtattcattgcagcatgcacattaatacaaagatagtctgcttgcctttttccccagtgggttcatagatatatcccgtttccaaaagcagcaaaatgtgaacaaggaggctgataagtgggaaagttgcctagaaaggtggatagtaagaactatgttttaaaaataggttaggggtagttcaggttatagaaaatacaactcatagctttgaactgaatcagccaattattggaactatgctaagtagtcaacagccattcatttgttttaaaaaacacaggccttttggaaaaaatccataagctcagaaagctccaataatttaaaccagatctactgtatagatttgaaattgtgccaaaggagcatgatgacaccagtcacagatttttgcacaattggaataatacattcagaaaagctttatgaaactaagtgtctaaaacaaattggcacatcacaaaggaggagtaggtttcagtccatgatcatggggcgaatcaaaaagtcgtatcattaaatcagcaggaaaagacttccacataagttcctgtttgccaagaaaagttcaatcataggcacgatgtggttcagtttcggaagaggtggatttgtattcagatacacaagagttctgggtgctgttgtttgctggttgatgcccatgggtgagtgagtcacgtaattttttggtcttattttcggatctcttttcacatcagtttttagtacagtcacatgttgcttaacgatggggatacattctgagaaatgtgttactaggcaattccgtccttatgtggacatcgtagggtgcacttacacaaacctaatgatacagcctactacacacccaggctgtgtggtatagcctattcctcctgccctgcaaacttgcacaacatgccactgccctgaatgctgtgggcagtttaacagaatggcaagtatttgtgtgtctaaacattgaaatggtacagtaaaaatacggcataaaggattttcaaaaaggtgcacctgtatagggcacttactgtgaatggagtttgcaggactggaacttgctctgggtgtcagtgagtgagtggtgagtgaaggtgaaggctaggacattgctgtacactactgaaaacattagaaacactgtacacttaggatacactcaatttataagaagtattttctttcttcaataataaattaaccgtagcttaccataacttttttactttataaacttttaacctttttagactttttgactgttttgtcattaacacccagcttaaaacacacattgtacagctatacaaaaatattttatttatatccttagtcaataaggataagctttttttctgtttttaattttttttttcattttgaacatttttgtcaaaaatgaatacacaaaggcacaggttaccctaggcctacgcagggtcaggatcgtcaatatcactgtcttgtgcctccacagcatgtctcactgggaggtctgcaggggcaataacatgcatggtgctgtcatctcataggacagcaatgccttcttctggaattcctcctgaaggacctatatgagactcttttatagttaacttttttaatttgtagaagaagtacactataaaatgacaatataaagtatggtatagtaaatggtataaactattaacatggtcatttatcatgattatcaagtattatgtactgtacataattgtatgtgctagactattatatgacaggcagcacagtaggtttgtttacctcagcatcatcacaaatgcatcagtaaggcattgtgctgtaatattatgatggctacagtgtcactagtcaatagaaactttttttttttttttgagacagggtctcactgtgtcactcaggctggagtgcagtggcacgatcttgactcactgcaacctctgcctcccaggttcaaatgatcctcaaggctcagcctccctactagctgggactaccggcatgcaccaccgtgtccggctaatttttgtatttttagtagggatggggtttcaccatgctggccaggctggtcttgaactcctgacctcaggtgatctgcccgtcttggcctcccaaagtgctgggattacaggcatgaggcactaggcccaggcagctccattataatcttatgggaccactgtcatatatgtggtccatccttgaccaaaaagtccttatgtggtgacacgtaactgtatttatcccattctctcctgccatgagatctcttcctggaacacagttttctctctttttttgcctgtatctagatatcttcatatatgatggtgtgaatgtaaataagaatgtgtacactatttcacatatgcagaatcacaagaagagatacaggcctagctatatgtttatggtagtgttctattatacctatatttaagcaatgaattttactccattatttacccctgtagaacatctttgtttccttacttttaaatagagcttagcatccatcgataggaaaagggaggtaatattccaaagttcaagagaaaccaaagaacactgttgactggtatgtgaagacctagggcctggtaatttaagtatgattttacaaatgttgagggataattttgacttgctcagtaagctaacttttggacttacatgcattatatgccagaggctccctacagagagaaacttttggacgtaaacacactagttcaccctgtattgtaaggatgtttaaatatatatgctttgataaaccctatgtggtgcagttactttagaaataaagaatgtctagagccaaggtgtacagctttcccaacactttgtggaattggatctatgataaattagaatgtttgtggataaaagtcactggaagtaataaaaacttgagcagtgacaaccaatctgccattcatttaaatggctcacttcaatatgatttatttcccacaagccacaatttcactctagttacagcagctacacatgagcttgagatttgatgtatttttcagctctcagtggtagaaaagaatatctttgaaattgatcctttgtgtgataatacaagtggccactttgacttgatttatttcatagaattatttgtgtgtgaagactaaaattttgaaaacagcagctctttataactatgtaaacaattttatgtaaaggaaagcactcattccccaaacaacttctgggggtattctgagtttttaagcatatccccgttggactatattatacattttgtatcttgtccaaattcaaagcatcagctgacttgaaataactattaagagaatgtacccagaaacaaattcacaaaagtggggaacagaccagaggaattattatttatcttgaacccacgtcgttgaagcatgactcttcccataatgttatttgctggtaaagaaacaagaattccccaattccagctggaaaagggggtaatacacaaaactgttgatgtgtagttatttgcctgactcatcatttattcaaccaggcaaataaaggctcagttcctgcttaaagtgtgattgatgtccaagggctgtatttatcaagtacaatatttatgaagatgaatagtccaaagccatccccagtggaaatcctgtaaggtagacttaaatttacaagaataagtcaaaacaagcaacatgtgacttcttgtactaaagcccataaaaacagcagagttaaaacaaaccaaggctataaatgaaatgacataaaggaaaatatatgcaaatatttattatgtaaatacaacagaaggagagtgcaacaaatgttaatttccatcaaagaataattcatggcaaaccttaaaagcaaaaaggataaattttttttggaaaaatttccttttgtcatgaaaataaaataatacctcaaataatgtatgattaaaacttatcaggtcaagaacaaagaactagtaagaaataagactgtgtagactttgagagcccttctttcaactatcagtagatcaatttgctaaatattagacagattattttgatactgtaattaattgaagtaacagaaatatatgaaaaaaataatcctacagataaaaaatacacactcctttttattctttctatatctttgcaaaatttggttaataaaaataacaaaacatatgtacatgaaggagaaagaacaaataaaattcatataatatcaaaaagcaattgataatctacagaatataccaatgaagaataaagagaaaagaaaaactaaaattagacattagaaaaagaatataagagataaaaaagaaatgtaaaaacacaaaagattccatattcaggtcatatgtatgaaattctagttaaatggaccatttctgcagaaatataaattatcaaaatttaaatttaattaatttaaaataaaaatgaaattaaaattgtctacttaggtagattcattattatgaaaacttgcaaatcaattttccacctccaccaataataaggattttagggctagataattttactggtaatttttgtttctcaaattttaaggaaatagataaatattttgtgttatgtaaactatttgacaacattaaaagtgtgaaatatttttaacttattttgttagtctagcatagtcctatgaacaaaacctaccaagatagtaaatacttagtaaatacaaactgatcacatgaatacagtaagaaaacttaagggaaattttagcaaaccagattgaacattatattcaaagattaacccttccaggcatggtggctcatgcctgtaatacgagcactttgagaggccaagacaggtggatcactgaggtcaggagttcgagaccagcctgaccaacatggtgaaaccctgtctctactaaaaatacaaaaattagccaggcgtggtggcacatgcctgtaatcacagctactcgagaggctgagccaggacaatggcttgaactcaggagggagaggttgcagtgagctgagattgcgccattgcactccagcctgggcaaccagagaaattctgtctcaaacaaacaaacaaacaaaaaaaaaaaaaaaaaaaaaaaaaggattaacccttcataagctactttaggatatcccaggaaatgtacatacatcatatcaatagacctaataaaacaaaccacaatattctcgattgatactaagatgacattcaataaaaataatgaccaattactgacttttaaattcatactaaaataggaacacaaagatacttcttccacatcccaaaagtgtctttaaaggaaaaataccagaaatattgttatttaaatcatcaacaaggtgaggctacacacaaatatcatttggacatatttgggtcaatgcaataaagtatgaaacaaataaaaggtgactatgaaaataaggaaacaaacattatttgaggacaaaattatattagggctactcaaaacccaatagtatcaactctaaaattttttatattagggctactcaaaacccaatagtatcaactctaaatttttttttaattaatgacttcagtcaactgcttggatgccaggtaaattgcaaaaaataatagcttccttacagctagataggaggatattcatagctttcttacaactagttgtctatagcactgtaaggtgactataataataatttgttgtatgttttcaaatagctagaatacaggattctgaatgttcccaacacaaataaatgctttgaggtgacagatgcgctaattattctattttgattattatatatctcatacatatatctaaatattacactgtaatgcataaatatgtacaattaatatgtgtctacttaaaatatgtattaacatttttaagtaatagttttcctttgtatcaacaataaccaatgagaaaatataacaggacaaaacctccctgaaaagatagataaattcatgttaataatttgtacaagaagtgtgtgaggcctacataaaagcacctacaatactctctaaatttggccagagatagaaagagagatataatgacagacagagagggggaaagaaacatgaaatagtcaatatttctagatgaaataaagcaggcacacattacaagattttaatttttcccaggtttctccaaaactttaaaatactaccaatcagatctcagtttaaacaattctgagagtgcttagagtaagaaatcaagtagggataagaatagttaatagcactttgaaagacaagtaatgatgcctcgtcattaatttccagagaatattctgggggtattagctcagataggaaattagtagatcagattggtgtgacacacatatagtttcatcattccaaaatctgaaacagaatgtcagcgtttgaaacctatgcctttctcttatatactgttgatctttatctctgtctcagttacatcatctgcaaaattgagatgttgataatactttacttagaggtatttgtaaagtgccaaggacaacagaagttagctcttttgggtcattactactgccagcagtagtggtagtattatttctaaattgttccccaggaaagctgcagctatttatattcctatcagtactagtaaaggggtcctgcttccccatattcttttctgcacgagtttttccttcatttttttaaaatttttgccaacagatggctgagaagccatatctcattacccccaacctctcatttctcagattaatgagattgaaaatctctccatttgcttattaggaatttggatactgaggaaagattgggaattataactgactcttccaaatcaagaaaattgggagttgatactatctcttgtgaaatacaagtttacttctgcagagaagagcaagaaaaaactaccttttatttctagctagagaaattcacaacaaaacctagttgcctggattattgtataggatattaatttaaaagaaaatctagcatagagtaacattcaaaagttataaaacaaaatgcaaactgcttcaagacaactctcagctacataagattttttttttttgccaaagacaaagtaatgaaatttacatgtgcatatcagattttgcttttatttttaatagacatgcaacaattgtacatatttatggggtacaaactgatatttcaatacatgtattaatgtgcatgtatcagattgttacctccttcatgtgtcctttgaagagaattctttggagcacagcaggaaatctttcacttacacacaaattcccgatatatatactagttttctctcacagtacaggctccacctttcacagaggacaaattttatgtcacttttctgttaactttgtctattacatctttcagaattttttttttcatttttgagtaatcaaacaagtctaccttcttctttggctaagaattttcattagttttcttggattgagtgggatataaagctaggagaatttgaggagagacaggcagattttagaaccaatgttcgtaaaggttacagaagactattttgggatgttagagaagttatgactctgggagaaaaactttgaaagaaatacagatatttaaagaaaacttctggcagattttgctgtgaacttcatcttgtttcaccacaagccttcaataaaattacatcacttgacaattcttagaagagttgcctttggccgagcgtggtggctcagcctgtaattccagcactttgggaggctgaggccaaccagcctggccatcatggcaaaactccgtctctaccaaaaattaaaaattacctgggcgaggtggcacacacctgtattcccagctactcgggaggctgagacaggagaatcgcttgaacccgggaggcagaggttgcagtgagcggagattgaaccactgcattccagactgcaagacagagcaaaactctgtctcaaaaaaaaaaaaagaagaagaagagttagtttgagagggtgtgggttatctgtgttattaatatcttaggacatactggagttccactattggaattcatattgaaaaatataagataccaccaaagaattacactgtatatgtttatgtacatgtgagtatatttgtgtatataccagcatacaaaaatccaaatacagtaatatatggttttttttaaatctctgaaagttctaagagagtcagtagtaattcatttgatattgtttataattccttcagttcctccaaattttaaatatcttaacagatatttacctacagctgtgacttgaaaatttaaaaaaaatctcatctctgggaggctgacgctgatgttgactggtggaaagagctgcagtttataattttggcttattttgtttgacaaaggctgacaggattaaggttcatgagtacatcttgcaaaaggagcctgaagtcaaaaaaaggggaaatgcaataaattccataaataaacaaataaatcatatcaaatgaggagaaaaatggtatctgctgatgatagctttacctttactcatgctggcttaggtagttttttaatggctttattgagatgtgattcccataccatgcaatgtatccacttaaagtataagatgcagtggcttctaacatattcacagagctgtactttcattgcaatagttagttttagagtatctttgttatctcaaaaagaaagctcatatcccttaaccagaactttcgaaatccccaaccttcaccctcaggcagaggcaaccaccgatctactttctctatatacctatttgcatattctggacatttcatataaatggaaacataatatgtggtcatttgagatggaccccttttaaaaaataaactttatttattacacagttgctaaggttcatagtaaaattgaactgaaagtacagaaagtacccatgtgcccccatcctcccacacacacaccctcctcaactatcagcatcccataccagagtggcacattttttataatctatgaacctacattgacacatcattattaccccaagttaatagtttacattggagttcattcttcatcttgtgcattctattggtgcaagtgtataatggcatgtatccactgttgtagtatctcgcagaatagcttcaccgccctaaaaatcctctgtaccctgcctgttcatttcttccagccctcctaacttctggcaaccactaatctttttattgtctcaatagttttgccttttccagaatgtcatattgttggactcatatagtatatagccttttcaaatgggcctctttcacttagtaatatacttttaagttcctccatgtcttttcatggcttgatatctcagctcattttagtgctgaataatatcccagtatctggatgtatcaccgtttatttatccactcatctactaaaggatatattggttgcttccatgttttggcaattatgaataaagctgctatatacatctgtgtgcagttttttattggacataagttttcagttcattttggtaagtaccaaagagcatgattgctggatcttatggtaggagtatgtttaattttgtaagaaactgctggactgtcttgcagaatggctataacattttgcatccccaccagtgataaatgagagttcctgctactctacatcctcgccagaattttatgttgtcagtgtctggattttggccaatctaatagatatgtagtggtatctcgttttaatttgcaattccctagtgaaatatgatgttgaacatatttttgtattcttacttgccatctgcatatagtctttgatgaagtgttggttcaggtcttttgcccactttttcatcagggtgttcatttttgtattgggaagttttaagagatttttctatattttgtctaacagccctttgtcagatttgtcttttgcaaatatgttctccaagtctatggctcatcttctcattctgttaacatctttttttttttttttttttgagtcacccaggctggagtgcaatgtcacaatctcagctaactgcacctgctgcctcctgggttcaagcaattctcctgcctcagctccccaagtagctgggactacaactgtgtaccaccacacctggctaatttttgtatttttagtggagacggggtttcaccatgttggccagtctgatttcgaacttctgacctcaggtgatctgcccacctcggattcaccattgaacccatctggacctggtgctttctgtttgggaaaattattaatcattgattcaatgtatctattatatgtaagactatttgtgttatctacttatttttgtataacttttggcagattatatctttcaaggaattgatccatttcatctaggttctcaaatttgtagacatagcattgttcataatttttttattatcttttaatatacatagggtctgtaatgatgtttcctttttaatttctgatactagttatttgtgtcttctctttttttcttaagtagcctagctagagatgattgattttattgctcttttcaaagaatcagcttttgctgatttcctttgttgacttgcagttttcaagtttattcattttcactgttgattttttttattccttttatttggatctgatttgctctatttttccagttttctgaagcaaaaagcttagattattggttttggctccttctttttgcttttatatgcactcaatgacataaattttcctctaggcgtagctttgactatattctacaaattatgatgttgtatttctgtttttgtttagttcaaaatctttttttaatttaaaaccaccttttattgagataaaatcatataatatatacaaattttatttttgtttaagtattattttaggatcagtgggcacacatacaggtttgttaaaggtatattgcatgatgccaaggtttggagtatttgaatccatcacccaggtactgagcatagtacccaatagtcttcaattcttgtgcccccagtcctcctccctcttgtattctccagtgtttattgttcttatatgtatgttcatgtatacccagtgtttagctcccacttataactgagaacatttggtatttggttttctgttgctgttagttcacttaagatggtggtttccagctgcatccatgttgctgcaaaagccatgatttcattcttttttttttttcaattcaacatatatttattgaatatgtgctgaatttcaagcactgtgcccagttgaggatatagacatagacaagacataatcctgattctgaagagcttactattatcagaggaggctggcatacatgaaaaattgcatatgtccacaataaaagtgtgctctaaaggttgtgcactggagggagtggttagttctaaccatgagttctaaccatgaggctcagggacgtcttcatgaagttggatctgtctgaattttttgttgttgttgtttttgtttacttttttgaaaagctgcatttttttattttattgttattatactttaagttttagggcatgtgccatgttggtgtgctgcacccattaactcgtcatttagccttaggtatatctcctaatgctatccctcccacgtccccccaccccacaacagtccctggagtgtgatgttccccttcctgtgtccatgtgttctcattgttcaattcccacctatgagtgagaacatgcggtgcttggttttttgtccttgcgatagtttgctgagagtgatggtttccagcttcatccatgtccctacaaaggacatgagttcttcattttttatggctgcatagtattccatgatgtatatgtgccacattttcttaatccagtctatcgttgttggacatttgggttggttccaagtctttactattgtgaatagtgctgcaataaacacacgtgtgcatgtgtctttatagcagcatgatttatactcctttgggtatatacccagtaatgggatggctgggtcaaatggtatttctagttctagatccctgaggaatcgccacactgacttccacaatggttgaactaggttacagtcccaccaacagtgtcaaagtgttcctatttctccacatcgtctccagcacctgttctttcctgactttttaatgatcgccattctaactggtgtgagatggtatctcattgtggtattgatttgcatttctccgatggccagtgatggtgagcattttttcatgtgttttttggctgcataaatgtcttcttttgagaagtgtctgttcatctccttcacctgcttattgatggggttgtttgtttttttttttgtaaatttgtttgagttcattgtagattctggatattagccctttgtcagatgagtaggttgcgaaaattttttcccattttgtagggtgcctgttcactctgatggtagtttcttttgctgtgcagaagctctttagtttaattggatcccatttgtcaattttggcttttgttgccattgtttttggtgttttagacatgaagtccttgcccatgcctatgtcctgaatggtattgcctaggttctcttctagggtttttatggttttaggtctaacatgtaagtctttaatccatcttgaattaatttttgtataaggtgtaaggaagggatccagtttcagctttctacatattgctagccagttttcccagcaccatttattaaatagggaatcctttccccatttcttgtttttgtcaggtttgtcaaagatcagatggttgtagatatgcggcattatttctgagggctctgttctattccattgatctatatctctgttttggtaccagtagcatgctgttttggttactgtagccttgtagtatagtttgaagtcaggtagcgtgatgcctctggctttgttcttttgggttaggattgacttggcgacgccggctcttttttggttccatatgaactttaaagtagttttttccaattctgtgaagaaagtcgttggtagcttggtggggatggcattgaatctataaattaccttgggcagtatggccatttaaacgatattgattcttcctacccatgagcaaggaatgttcttccatttgtttgtattctcttttatttcattgagcagtggtttgtagttttctttgaagaggtccttcatatcccttgtaagttggattcctaggtattttatataaagacagcagtaacctctgaagacttaaatttccctgtctgacagctttgaagagactagtggttctcccagcatgcagctggaaatctgagaacgggcagattgcctcctcaagtgagtccttgacccccgagcagcctaactgggaggcaccccccagtaggggcagactgacacctcacatggccaggtactcctctgagacaaaacttccagaggaacgatcaggcagcagcatttgcagttcaccaagatccactgttctacagccaccgctgttctgcagccaccgctgctgatacccaggcaaacagggtctggagtggacctctagcaaactccaactccaacagacctgcagctgagggtcctgtccgttagaaggaaaactaacagaaaggacatccacaccaaaaacccctctgtacgtgaccatcatcaaagacgacaagtagataaaaccacaaagatggcaaaaaaacagagcagaaaaactggaaactctaaaaatcagagcgcctctcctcctccaaaggaacgcagctcctcaccagcaacggaacaaagctagatggagaatgactttgacgagctgagagaagaagacttcagacgatcaaactactctgagctacaggaggaaattcaaaccaatggcaaagaagttaaaaactgtgaaaaaaaaatagacaaatggataactgaataacaaacgcagagaagtccttaaaggagctgatggagctgaaagccaaggcttgagaactacgtgaagaatgcagaaacctcaggagctgatgcgatcaactggaagaaagggtatcagtgatggaagatgaaatgaatgaaatgaagcaagaagggaagtttagagaaaaaagaatagaaagaaacgaacaaagcctccaagaaatacgggactatgtgaaaataccaaatctacgtctgattggtgtacatgaaagtgacagggagaatggaaccaagttggaaaacactctgcaggatattatccagaagaacttccccaatctagcaaggcaagccaacattcagattcaggaaatacagagaacggcacaaagatactcctcgagaagagcaactccaagacacataattgtcagagtcaccaaagttgaaatgaaggaaaaaatgttaagggcagccagagagaaaggtcgggttacccacaaagggaagcccatcagactaacagctgatctctccacagaaactctacaagccagaagatagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcactaaacatggaaaggaacaactggtaccagccactgcaaaaacatgctaaaatgtaaagaccatcagggctaggaagaaactgcatcaactaacgagcaaaataaccagctaacatcataatgacaggaccaaatacacacataacaatattaactttaaatgtaaatgggctaaatgctccaattaaaagacacagactggcaagttggataaagagtcaagacccatcagtgtgctgtattcaggaaacccatctcacatgcagagacacacataggctcaaaataaagggatggaggaagatctaccaagcaaatggaaaacaaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttttttttttttttgagatggagtctcactctgtcacccaggctggagtgcagtggtgcggtctcggctgattgcaagctctgcctcccaggttcacgccattctcctgcctcagcctcccgagtagctgggactacaggcacccgccaccacggccagctaatttttttttgtattttttgtagagacagggtttcaccgtgttagccagtatggtctcgatctcctgacctcgtgatctgcccacctcggcctcccaaagtgcaccatgatttcatctttttcatggttgcagagtatttcatggtatatatgtaccacattttctttacccagtctcccattaatgggcacctgggtggacttcatatctttgctattgtgaataatactgtggtgaacatatgggtgcatatgtgtttttggcagaatgctttattttcctctggttatgtacctagtaatgggattgctgggttaaatggagttcagcttttccttctttgggaaatctccaaaatgcttttcacaatgcctgtactaatttacattcccaccaacagtgtatacctgtttcctttactccacaaccttgccatcatctgttatttttttactttttaacaaaagccattcttactggtgtgagatggtatctcattgtggttttgatttgcatttctctggtgattagtgatgatgagcattttttcatatgttttttggccactcgtatatcttcttttgaaaagtgtctgttcatgtcatttgcccacttcctatcagggttatgtttttgattgttgatttaagttccttatagattctgaatcttagacatttattggatacttactttgcaagtattttctcccattctgtaagtttatgcccttgatcatttatcttgctgtgcagaagctctttagtttaattaggtcccacttgtcaatttttgattacgttgcaattgcctttgaggacatagtaataaattatttgccaaggccagtattaaaaagagtatttcctatgtttttatggggtatttccatataaaatattttcatagggtgtttcctaggatttttattgtttcatgtcttacatttaagtctttaatccgtcgtgacttaatttttgtgtatggtgatagggaagggtccagcttcattcttctgcatatgaataaccaattatcccagcaccacaagatctttttcaatttcacttgagattttttctttgatccatgtgttatttagaagagtgtaatttaatatccaagtatttgaggattttctagctactgttattgatttttagtttaattctattacggtctgagaggagacattgtacgaattttttatacatttacatttttaaggtatgttttctagcccagtatgtggtctttcttggtgaacattccatatgagcttgagaaaaatgtgtaacctgctgttgttactggaaaggaatcccaatccagaccccaagagagggttcttaattcttgtgcaagaaaagaatttagggtgagtccacagagtaaagagaaaacaagtttatcagggaagtaaagaaacaaagaatggctactccataggcagagcagcctcgagatctgctggataactatttttatggttgtttattgattatatgctaaacaagggatggattattcatgagatttccaggaaagggacagcaactcctcagaacttagggttcctcttccttttagaccacatatggtaacctctagatgttgccatggcatatgtgaactgtcatggcactggcaggagtgtcttttagcatgctaatgcattataattagggtataacaagcagcaaggatgaccaaaggtcacttttattggcatcttgattttgataggtttcagctggcttctttactacatttttgttttaccaatgggatctttgtgacccgtatcttgtgtcaacctcctgtctcaccctgtgaataagaatggctgacctcctgggaatgcagtacagaaggtctcagcctcattttactatggctgtgactcaaggtggagtcactctgattcaaacgcctctgacactgctgttggataaagtagtctatagatgtccattatatacaattgattgaaggtactgttgaggtcaactaagtctttacttgttttctgcctgttggatctgttcattcttgatagagaggtgttgaagtctccaaatatgatactggattcctctgtttctccttgaagttctatctgtatttgccttatgtattttgatgctctgttgttaggtaaatacacgtaaagaattgttacatcctcttggagtgtccctttattatgtaatgcccctcattagccctgacaactttccttaatctgaattctgctatatttgaaattaatatagctactcctgctgtcttttgattagtacaatcatagtatatatttcgctatcccttttaatctatgtgtgtcttcatatataacataggtttttgtagacaacatgtaattgggtctaggctttttgatacattctggcaatttctatcttttaattgatgcatttagattatagatattcaagtagtaattgagatatctgcattaatttctatcatatttcttacagttttctattttttaatcttgttctttgttccttttttgccttcctcacttgctgccatttgtggtttaattgagaattttatatgattgctttttttctcatttcatagcatgttgctatgtctaaatatttgtgtcttctcaaaatttgcatgttgaaatcctaactcccacagtagtggtcttagaaggtggagacttttagaagtgaatagggcattggggtaaagccctcatgaatggggttggagttgaaggaaattaaaatattttccccaacatatatttatttgacatattttgaaatgggtactgcttggccatctccacaaaactgctttgcaaagctgttgtagtaaatggggaaaatttggatctctagataatccccattaatgcagccatgcccctttccctttctatgtctttccccagatccaggagagattgagggtctgacacatttagaagtctgaaatgaaacatgtatcatctattctctctgagggaggcttcatgtacatacaaggccagctttgccatccagacacttctcccaccttccataacctgttttactaagccatcattctttccgtaacctcaaaatggtgtataaatttctgtgacccatttggaaattgggtcttcatacagaagactcccacgtatgcacagaaaataaatttgtatgtcttttctctattaatcaactgcctcatgtcagtgatttctaagcaagcatttagggagccaagagtctatggcttccacacctctctatggaaaaagtgttttttaaaattttcactttttacaaaattttttttttaatctttcattttctgtggtatgccaaggtgttttatttcttgggttttgtttgcttgttttagtttttgtgactttctgttttcttgggggcatatattctacttggtgttctctgtgctccctagatctgtgattttgtatctgacattattagagtgaaactcttagtcaccattgcttcaaaaattgcttttttccctttctccctttcttctctttctgatatttcccttatgtgtatgttatacccttggtagttgttccattgttcttgcatattctgttctgtttttttcagtctgtttttctctgttttgtaagattctatttttgtatcattgagctcagaaattttttctcaaccatgcccagtctattaataagccaatccaagtcgttccttatatctgttaaagtgttttcaatctctaacctttttttttttgtttttggttcttagaatgtctatctctctgcttgccttatccatcttttcttacatgtttgtttattttttcactaaaccccttaatacattaatcatagaattttaaaattcctggtctcataattccagcattcctgctatatcttactcttgttctgatgcttgttcagtctcttcaaactatgtatttttgccttttagtatgccttgtaattttttgttgaaaggcagatgtgatatactgggtaaaagggactgccacaaataagcctctagtaatgtaatggtaaggtgtgagggtgagggaaagaatgttgtagtcctatgagtaggtctcagtcgtctaatgaacttatgcccctagactgtgaacttcaccagtgcttctcagtctttgtcccttcttacgtggaacaggatggcttaaggggcctggagttggctatttttctcccctcctagactcttagaaaaccccagcagattaggctgtagctgctgagggcagagcattttttttttttttttttttttttttgagatggagtctcactctgtcacccaggctggagtgcagtggtgcaatctcagctcactgcaagctccgcctcccgggttcatgccattctcctgcctcagcctcccgagtagctgggactacaggcacccgccaccacgcctggctagttttttgtattttttttagtagagacatggtttcaccatgtttgccaggatggtctcgatctcctgacctcgtgatctgcccgcctcggcctcccaaagtgctgggattacaggcgtgagccaccacgtccggcctgaggtcagagctttttaagaacagaatgttctaatgtatctcaaaatggtctgttttccccccacaactaccagaaacatgaggggattttttttttccaatattcactgtgaggacccagtagaactctctgaggcaaaattaacacaagtgtgcagcaccccctatgattggctcttcgtggagtttttaactcacggaattgtccacactgaacttccagcaattactcaattatagttcatgttttcctgcccagcactggttcctggggatgtttttactccaagttgtgattatctgtatccacctgtctgtctgattaaggggaagccgtttgtcctatgacctcacttctctgccagatctaagaattagttgttgatttttcagtttgttcagctctttatttgttgttaggagagagtgacatcttctaagttccttacctgcccatcagaaaccaaaagtcaggttagctggcccattttttaattgggttacttgtctctttattgagatggaactgttcatgctgacttagatggtttgctctaatttcagaaagaaaatcattctactttgcaaggcatgacatttaattataacatttaactgatctgaacatgattaagaaagtgaataataaatggttcatttggggttattgaaaagtttagactcagagactcaggaattttaggtggattgggttttctaaattatttttatgtaaaacattctgattttataaaccttttttttcttatcctaactttaaaattttagatcatgcactttaccaggaaaatagtctatcgatagttacagctgatatcaaacctagtctttccttctttatctttttcaatatgactttgagatgaaaaattcacacttctgaagtatcaagagaattgccagactacataggtctgtgattgtaataaaaatagtgtgatctctttgggagcaactctcctgggagaggtataaatttattctctctgagccattgggagttctttctctggtttacacacaggctactgacacaaattgaagggtgtctagtccagagttttgctttaaataaataaataacctatcttggattcttggcacagtcagctcaaaagagcctgcaaggatgaatcttggcgaataaataccctaaactcactgtcctctctccctcagatcttgtaagaggatcccaagaaactggtagagtataagggaacctttctctttggtccatataggtcagctgcccaaggcggaggcagtatggcaggtgcaaaatggatctggaaggctgtggcagattgtgttttccaaagatggctgtagcaacatatcttatccaacatgctcttactgcagcatgactttaacactgctccctaccaagtagtaaaatctatccctctcctcctgaaatttagtatacttttgtgaatgtcttgaccaataaaaaacaataggagtgatgcagtatgattcctgaagctagtttctaaaaatgtatccacttctaccttgttccactagcacaattactcttggtatccagccactatagtattaagaaccctatgcagctgtggacaggtccttctcaataagaaccaaggtcccagcccactggtcctgctgaactcccaacagccaataccaacttgctggtcaaataaacaagcttgccagtttccaatcaagccccccacctagtgaagtgtccaatggagatgagtcctcgatgatgcctgttcaacttacacattactgaacagaaaaaaaaatgataattttctaatccactaaggtttggggtaatttgttatatagcaatagtaattgaaactcaaagtaaattgaaactcaaatggcatttggcataacatgatcaagtttctatgaaacaatggctctttattccttcatatcagtatgttttttttctcttatgtaacattcatatcattctacaagaggcagatctactctctatacttgcaatataaaggtaagacaaaaataatgagatttgatccacaagttaaactttactcaaagtaagctcttttgacttgaaatattttaattcaatgcaagaattgtcacatcaatcaagagtaatcctagaatgactgaggttgattagcagtaaatttatgtatgtatctatagcaatttatcaccatgttgaattatgtcaatgactgttgcttttaaaattatgatgagcacaccaaggcaatgtcatgtcaaggaaatgagccttgtgcttgacacatagtgtctgtttcacaaatactagttttcttgcccatctctcaaggtgaaaatagagtattgctttcggcttatgagttcagcagtatacagcctacacagcctacctagattattagagttaggagaaatcagagcaattatctgaagccttttataccttcaagaagagtaaagatgaggaatgcaatatcccaggaggtttaataatttttttaccctaactgctcattggaatcacctagagagtctcctctttctagtccattttaatttctaattgttctggatgtgacctaggtgtttctggtattttcttaaaaagatttcccaggtgaatttacagtacagccagcactgagaactaatgggtttagcaaactggatagcacagtgtttttcaaaacacagactctgtactcaacaggtagcattaaataatataatatagaatgagagagtcattctattttcaattttacttcaatcatttagattaaatcaaggagaatggccaaggcgggtggatcacttgaggtcaggagttcaagaccagcctggccaatatggtgaaaccccatctctactaaaaatacaaaaattagctgggcatggtggcacatgcctgtcatcccagctacccagaaagctgacgtggaaggatcacatgaacccaggagatggaggttgcagggtgctaagatcatgccacagcactccagcctgggtgacagagtgaaactccatctcaaaaataaataaataaataataaataataaataaataaatggctaaacatgatattaggcctgtcattagctattttctaatacgtgctaatctttaattaacagagcaaacgtctccggctcagggactttgacagtgtccagcttagtgagcatttaaattattttggacagtgtctatttatataattttctactcattatattaattttgctaggtaactattattttggtgagcagatttccatttaggataaaaatatacattttatatgtcaattcccacattaagttgaagaaagttaatcagtttaagaaaaattaagtaataatagaacatttggtaccaggatatggcaaaaacaattgtgaagacgtgactctaatgatttaagtgtagaaaacactgggttaagattgctgggacagcagactaggcatcctgagatcaccaattcttactccatcaaaatcaacacatcgcactggccagaaaaaaaaaaaattcccaagttgttaatatgaacttgatgttgaaattaaaaagcagatacctttgaggcaccgtggcacttgacacaacctaaaataggcatgaagtgccttcaaccaagtttttgtgatctttgatgtgtcactcttttaaaacacttatgatggaacaagctgggactcaaaatcctgtaatggagcaattattccagtttattggtacccaagaaagtcaagcaaattttgatattaactgattgcatcttacctgtcttaaatatcacctgttcagacaaccatgtgacagttgaaactggtaatcagtcagaaaaattaaaactgtttacaatgttagggcctgttttcatgtttcagtgactgccaattctttctgctttttggatgagcagcgtacattagtaatgaaggtgaacttgatgcagccatttggcattggtgggggcaaggtttaatctgtgtagtcaaaaatgcagaggtgggccgtgtcaccacctgttccttccgggagtcttacagaggaaaacgccaaccaggttccagaaggaacttacaggttcgactgttttcaaggcacctggagatgatttacatgtaatgtcagggtttggaaggcaacccagtgaaggaatgaatgattaatattggaagcactgcaataacaggctgtgtaaagtcataaaaaaagaggactgcttactcaacctcggttccaaatagccatcaaaatgtaattttttttcttaaactggaaaattatgcttcttttacattgagattgcttactagcgaattcattatttgcttataatttattatactgaaagtttgtacaatatttgcaaggttcaagaggttcccctaattccgaagtttattttaaaccttgattttagcatgtggtagatatcacaatgtattttcagcctacctgtaattagtgatgatctttctgcttgtttatttttatctggtatgggttatcaaatcaggtagtgttttctttctttagtgcagagtggtttttaaattacatcaaaaattccattagtgtcatcatctaagaaaatacaggggaaaagttaatcatatcctctcctatttcatttgatacacactggcttttcccttagcatttatttcaaggatgctttggcttacaaatccatttactgttaatacttgtaacatattatggaaatatgatttgttttttcctaagacaaacctgtgtgattagatggacaaataattgactaataaagtaatcctagctaagtttagtagatattgtaaaactacaaaaaagaaaaaatattactgtcattaagatgtaaatatgaacttgaagtcagctacagtgaactttttattttctggggacagattaactatttgtggattaactctacccctgacatccctatcccctgtccaccccattcagctctccttcttgagttactcaaataaaccgtgttcttacctaccttaggtctttgcacatgcctaagtaccctagtgtagtttatttttttacccacttttcctggacaacttctgctcatatgttaaatcttagctcaaatgagcagttcactgaaaccccaaaaagttctagattcccccaatgtactttgggtttacattacattataattttacattgatttgtgtagtcatttcattaatgcctgtcttccaactctatgccctatgaacataaggactgtttcttttttcttgccttcagcatcgtattcccagcaactaaagtagaatagttactttataaacagtttttaaatgaatgatcttatttttaataagtggtgctttgaaaaaggaactcaatttgtatgacttagaggatcatatcctacttcttacactcctacgtaagatactggaatagacttctctcacttccaaaaactcctttcctgagtaaattgtggacagcagcatagaaaaaaagatgtgctttctggaaaacagaattacactagtgggctttgaggggaagttttgagcaaaatagagatatgaggagaagaaaataaagctatgaatttgcaccttctcaattctggtcccttcctgcttgaggaggtggggaaaaaggaagtttaggaaaataatgcaaacaaagacaaactaatttaacagataagctattttttattcaaagtattattagtgtttctaagaatttgtccaaagatggttagtgttgtgttacttgaattattttatactctaaagaatggcaaatatgtttcttattatttctaaatattagatgcaagtttatttataaatatggtaaataatccatctaggactatttcatcccatttcaactaattttaccgagtttcttttttttttttttttggacatttctctctcacatcctttatcacatttaattcatgactaactatattctctaacaatgacaaattgatgggggaaagaattagtttgacataagtgaaacttccttttggagtttcttttaccttttttttcttaaatgcctgggaatactcaattgcatcttgataagaaatgttaagatatgctaataacattttaatttaattactattattaaatgtttaattcccatgaaagaagttggagtttggaattacagtcatgttacttgacttctcccatctatgaccctattgaaagctgagcatttaggggtatagttgtgcataatcataactgcattttggtaagcattgcattctaccaagaaatgaacaagtcataagaggatagcccaattcattttcacaaaatgagcacattcaagtgaccagcactgaaaacagaaacagaagatgacccgcatcctagatgtcctcatggtgcttcatcccaaaactaccatacctccaaaggtagccacaatccagccttctcatatgatcggtcatgatcaaatactcctttccatctggttcatatccttcacgcttttgaaactcaaccatgttgatctgtgtagttgcagttcattcatttttgtggcctaatagcattttgttaaatgattattccactacctgtttgtccattctactgttacagggttgtttctatttttagctattatggataataattataaacattcttgtaaaaaatgtcttttggtagacagctgcatgccattctgtagggcatatacttaggaatggaattgatgggtcataaattatatgtatgtcctgccttcgtagatgcttctaaacaattgtccagagtaattgtaccaatctacactcctttcagcaataagagttccagttccacatcttcagcagaacttggaagtgtctgtctctttcattttgccgtcgtctacacatggcatatgccatgtgattttatttaacctttgtggattacactttctaaatttgtaaacataacttgtttcacatgtttacaccaccttttaccctgacttgagtttacatcctagaaagcatgggccatgtgttaaacacttctgtgtccttgaatgaatctaacatagcaagcaatggatgcgcttttgttaagataaatcttgtctctatgtagtactcccttaaaagatcatagagtgggagagagatagcattagaagaggaataatacaaatatattttattaatggagacaaaaaataaggagaggatctctcttattctctgtcaaattgtgttctccttttatgtattcatacactcaattccatgttggggctgaaaaaaaatcatttccaattctacttgttttagttaattgcttcctttttctactgtgcagtgtaaaaggataattaaaaattatatttcccctgactacatttctttaggaagatggcttcattttttatgatgcagctatttgtcttcacctgtcagtgccaagagtgaacagaagtcaaaagtccaccaccaaacttttccttactccttcaagaaacaaagccagccattgtgcctaaaaggtgtatccagatatgtgaggacataaaatcctgacacagttctcttttacccagatgccttcaaaataagcaaataaaggttggcaagaataacaaccttaccccaatgccttagatggcatttaatagtaacagtttttcaccgaaaatgagagatttccatagaagtgataatcaacctcctatgaatatatgaagctcgtaagacctaagagtttctaaaggtcagcaagcattaaaggtttttgtcctggggatacatttctaaataaccctaggagaaggagagggagagagggaaagaaaaaagttttaacttgatgaaagtaaaacatgcaagcttaacagtttctggattatcatttaattacaactatcaatcatttcccatctgtcttcttccagttctcacaaatttcatgtaaaactatgcaatacaactaacagagaacatgcaacccattaagaatcctaaagatgggaagcaatatttaagaaattaccctatggaagattttaggaaattacctaaaaataggatagtagaattcatcttacaatatatactacaaaaattcaagactaaaacttttcttttaattaagataaacgctacttattgcttctttctctttaccagttctgacatgaactgatgatcattttccaagggctttggtttcgaaatcatatgacttattacaagtcatatttttactaatgtgtgaaactggcttgcagttagtcattttattaacacaattttacatgctcttaaaatgaggtccatttaacattgagcttttagaaatataattgctctgttaattagctcttgggaatgccagcaaatgtctttaaggacagctgttattattatttattttttggaggcggagacagagtcttgcctgtcagccaagctggagtgcagtggtgtgatcttgatctcggctcactgcaacctccacctcccaagttcaagtgattctcgtgccttggcctcccaaataggtgagattacaggggcacgccaccacacccagctaatttttgtatttttagtagagatggggtttcaccatattggccgggctggtctcaaactcctgacctcaaatgatctacccacctcagcctcccaaaatgctgggattacagacttgagccaccgtgcccggctagctgttatttttaaggtttaaaatgttttaatttcttcttattgaggggttcatgctttcatgcttactgtccctaacttctgcagccaaggaattaaacagctttaggctttttaagctccagtgtgttcagaaaagtgtttcaaccatggtaatccgcttgtcatgctgcatttatctcccactagatacccacatgtgtccctcttcttctcaggcagataattgcaaaggggttggaaccagagaaaagagttgagctggtgctgagcagtggatataaaaagaagtgtcaccctggtgcaagtaaatagactctgagactgtaatctctgcccttatttatttttgaaaccataaatgcccaggaggaagcttgttgtttatttggctacagaaatctttgactgcagtcatgtatggtttttaacttgtttatatttccatacattccattgtagcaatctactctcttataccaccttggtttgctccctaaatatagttttcattgcaatgttgttgtttttggccatagacttcaaacttctttgtgttttttaaaaaaataacagtgtattcattacctgttttcccaacagagttcatctggtgatttaatgatcagaaacattcagctgaaacacagtgggaaatatgtttgtatggtgcaaacgggggtggacagtgtttcatctgctgctgacctcatagtaagaggtaaaacatttatgcccccttgagtttgtcacttcacatcttaacagcattccttactggaggaaaaaccatgatgagatagtatgtgagcatacgagttataatattgatttcatcccccctcatagaccacagaatatgacaataggggtgagtgctaattcaaagaaataaaaatctcaactctgcccttcaaatagctctcactgtaattggcattccacagctgctgccaagctgatgtgttcttgagcatgtcattaattcagtgattgtatttaatttgagagagaatattgtgcagtgtgtttgcttccaaaataatcaggatttgggaataattgtatgcaggacatttttctaaaaatacaaaaaaagtatcaggattattcagaatgactgagaaaatttgccaacctgagctgctgcccaggatactgatttgctactgggctgaaaaatgaccagagtgtgtcataaaataaaacacatctagatatcagattgggaactacagagatacaccagtggattaaagggaaaggcatcacaccaggagcagaggacattgaatttagaaaggtacaggaatcctgctgaacagaggcttttaaaagtgaatatcatctgcaatcagagagtattatggtttgggaattactgcctcacatccaaatttaagatctaacaacagaaatgcggggagggagagtagagggaagtagttgttctattaccaggtaaatggccttttccctaagtgcttctgaaattgggaaaagtcagagatattgaagtggtcatgtgacattctcttctctttgataggagaggatgacatttatggaactgctactcaatgtttccatttgtgccttccttaggttcacctggaccaccagaaaatgtgaaggtagatgaaattacagacacaacagcccaactctcttggaaagaaggtaaagacaaccatagcccagttatatcctattctatccaggctcggacacctttctccgtgggttggcaaaccgtcacaacaggtaaagcaggagaggcagatgtcatctgcacacatataaatggatttcaagtcaatgctaaagcaggcagactcttacctctgaaatattcctttgtagtgcctgaggtcatcgatgggaagacgcacacagccactgtagttgagttaaacccatgggtggaatatgaatttcgggttgtagccagtaacaaaattggaggtggagaaccaagtttaccctcagaaaaagtaagaactgaagaggcaggttagtgtttttttttctgagtaatggattaatagatttctgtgtacttccatttcccttggccctgaactccaggccagcagggggtcagcctcaataatccattgttgcagttatctaacctttctaatggcagaactggccatatggcatttgtcaaaagaaacacatgtaagtgactctgatgtagtatgacatttccaagagttcagtccattgtaaatgatcattagtgcatgtgagtgaatatgcttttgtcacttaaggttataattactgtctgacatagttaccctgttaacaagggaagtgctgttttcatttataacaagcattggcaaattggtaggataatgacatttgggagttctgctgctaggaaatctcattttgccaccaagcttagtgaaggagcttaagcaattgatgaataggtatattttgtcacttcaagtgttgaattaagaaaaaatcattgataggaatttccatgtgagacaactattcacatagaccataagactgcttttattattctagaaatatcctagcattaaaactcaaactagaaagtgtacatagcatcacattatagggacaattgagacctaaagattgccttttcagaatctgtaatattatttaatattaactaaaatgaagtttgaaatagagctggtgtatcactttaggaactcagctaagatggaagtcatcaaatatgtttcagtaattttcatgatgctgtttcactcagaacaatgcacataatgtttatgctaggaaatatgagaaatagaggaactgtgcttgccctggtgttctggtcatttgttcacacaacacatattttagggagcatcctctctgtgctcagcactttctagacattgcaagtacagctgtgaccataccaaagacccaccttcatgggacttctattctagctgtgtcatggggttcactaagcctagagttctcagtgtgagaatctgatgcccctgtgaagtttataaataatacctcaaaacaagattcgagggtttgagtctgggtcatccttacatatagccaatgttgttctcagaattatattctacttggaatagtcacaagctaaacattcatgctggattgatttcccatcatctccagtgaatcactttttcttgttttaagtctcatactagcaaagtatcttccaacttggtcatgtttttattactgtttgagagattttgaatttttttatgatttcatgtaaatatgttgtttgatgatctcataaaaatatataaatgcatataatatataagtatatgtacataaacacccatatgtatgaatcatgtgccaatgatgaaattattttaaatattaaaaaaacattgcattatcttttagataaatattactaaatgcaagtaccatttcatctctgtttctctgacctgtatagttccagaagtgcctccttctgaagtcaatggaggaggcggaagccggtctgaacttgtgataacctgggatgtaagtgtttgggcagcatcttccccatcagggtcttgctgttcccatgatcattatggcttcccaggtggtggtgccaatggtgcaggtggtggtggtagtgctgggggtgtggctggtgggtgctgctgctgctggtggtaatataggtggtgatggtgggattagtggtagtggggctggtggtggtggttgtagccctagtagctaatattttttgatactttctctgagccatccactattcccagcatttagcatgtattttcctcatgtcatccttgcaacaatttacagatgaaaatactcaggctcagatataagaaataatttgctcagggtcacctggttggtagacatagagatgagttatgttgcggctgttgcccctcaagctccccttatgactttccaagcagctgtgcagcccccactggtgaagtcacctattccaacaggtgcttgagtttgtttctttcctggccattctcccagccattggtttacatcatcagtaggaaaaaggttaataggtttgaagtcaaaaagtactagaattacctgcattttttgaagatgctgatgatgtgtcaacaaaatttttgacacgactcaagtatagctttgagtttaattcgttaatatttttttcctttttttttgagacagtcttgctctgttgcccagtctggagtgcagtggtgcaatcttggctcactgcaacctccacctcctgggttcaagtgattctcccacctcaacctccccaaatagctagaattacaggcatgcgccaccatgcgtgggtaatttttgtatttttagtagagacggagttttgctatgttggccaggctgctctcaaactcctaacctcaaatgatcgaggtgccttggcctcccaaagtgctagagttacagggatgtaattcattaatttataaattagtatttacttccctttttttttttttttttccttgatggagtctctctctgtcacccaggagtggcgtgatatcggctcattgcaatctccacctcacagattcaagcaattctcctgcctcagcctcccgagtagctgggactacaggcgcatgccaccacgcccggctaatttttgtatttttagtagagacaaggtttcaccatattggacagactggtctcaaactcctgacctcgtgatggccacttgccttggcctcccaaagtgctgggattacaggcgtgagccaccgtaccaggcctttttttttttttccagttttacttaattgttcttaatcaccattttaatatttcttctcataaagtcaacattaagaattagataatttttatttggcttaagagatcagatattttcaactgaaagtatatcttcctattagaaactcagacttgagccataagatgatcagctaactgaataatcacagaaaattccagttcattatctggatggctatgaaatggtgacatatgtctgtttaaaagcagctgacatgactctcctgctgatgtttttctccttttttcatgcaactgcttaatacaatgtagatgattatttgatgacttttacaaataaatgcctgtggattacagctgcattcatttttgccttgcccttatgtgtaagggtgattcagtatgtctttcctttatagccagtccctgaagaactacagaatggtgaaggttttgggtatgttgttgctttccgccctcttggggttaccacctggatccagacagtggtgacatcccctgacaccccaagatatgtctttaggaatgaaagcatcgtgccatattcaccatatgaagttaaagtgggtgtttataataacaaaggtgaaggaccatttagcccagtgacaacagtgttctctgcagaagaaggtatggaaaacatgactgtatatcagttccgcctaataataattatttgtgctccaaaaactgatttggagtctcgttttgacttcaaatatatttattccaaagaacaatcatccaggtagtagttagattcccagtgcaagtcataaagatcaatcataaatgacttgaagtataagacttaatggatagttagaggatgtaaccgtgaaaggaaaataaaacctcaggaccccaattcactaggccaaaaggaagaaattaagctgaaagccaagtcatgcaagaaaatgcctttccttttgttcctaaccagatagctacagataaaaggttaaatctctctacaggtagctactccatgttcgccttgccttatgtaaagtgctgatttactgagcaggagacctaattgattagcctcctatctgctccttttcccttgcaacatgcggattaccatacccttcctctttccactccagcccactctaaatattaaagccctcagattcacctttggaaatggacacagaccatgtttctgtacacccgtgttttgttttttttttcttctgggcatgtccttaacaccttgataaaataaatcccaaaattgattgagacctgtctcagatcataaccatcaatttaaaaatctgtttatgaggaacacttcctacgttccagcttgtgaagcaaggaaaatcacagccttaccttggggtaataaaaatataccccttggagctaccctagtcctaagttgtatagtggttcccatggcctgagaaaaggatgttactggatgaagagtcaggagcagcggtatctcattcaacagacatgcaatgtgcaggtttgagggatatgaacctgctggtggagatacagacatacttcactctggacccgttctgtttctttgcctttcttttatacctgtctcagatattgagacatctacattttgtctcatgaccgctttagaaaataatcaaggtaaaagaattatgcaaaattgccatttcatagatcagcaacaactgttggctatctcatgtagttctacaaaaaaaaaaaaaaatggcagaaactaacatgtattgaagttttactacttgcccgacattacctaatttgatatttcaaataaaaaatataggcactattatttcccatttacaaatgagaaaatggaagccttgtgaaagagagtaataaatttgccaaaattcctaatagtaagtggtacagccagtattttaaccaagggcctttgcccttaaccattctgagctcacgaaatatatcagtgtctcccctaccctccagacctgacagtaagttgcaaaaagtggcctgcagttgtcattcctaagaatagtaagtagagttgatttttcttcggctccccgcccctattcttgtgttctcacttttggttgagttctgagagggattttttttttaagggttatacaagtctttgcagaagagtcttaaattcatagccagacctcatttctaaaagctgccagggattgcaagggcaagtcaggggtctggggagtgatggccattatccagggagttttcggacactgtttacctgtgcatccaggacctaggtgctggcaactggaaaagaggggcagccacagcctcttacgcattgttgcctccctcatttttcttctcctcttatcatttttgctcctgctgcagagttagctaaaagtctttctgttcaaacatgaaaaatgaatcgggcttacctaagaaagaagcaaaagacttctgtgaaatctactagggtgtctctgtgaatccaagggagagttatgcagcaaacctcacaaagatcttcaatcagagaagccctggaacctcagaaaatggttctgctcttctagagcacctgcactggatcagtgggctccaagtactcctcgactctccaaaccaagtttcaaattctcaggagagaaaatctaaggggcccagccttagaccaggaattcgtcttagcatcaagcaagatccttgtctgagaagcaggatcatttgacagagaaatgcacctgagggaggggagattcctgctcagagctgggccctgagaagggagaaccactgtgaaccccatagaatctcaacagtgctttttacaaaggggaatcttcttgctatatgataagccacctgcatttctatctactccttcaaaagagcatgccatccaccacatttcagttgtctctgtaggcctctctagacagggtactcactcagtgtttattgtgtaaatgagctttacttaacctagacctttgtttggcaaaatgaaaactaagtagcgtctgtgggcagagaagttcccaagcagtaggaatgagatgaagggaaggaaataaggacaaggtgaggagaagacaggcaaagaaaaaggaagataaggaagatgccaagaaagaggtgcaagggaggaaagtataggttgccacagctgtttagcaaagaaaagcctttggctatgatgccatcttttcctaagaaacggaaatggaccagtgtctctattttcaacatatggtgccagaatatttcatacaattttcaaatacgttaaaatgcttttataaaaataagaacattaatctgtgttttaaactaactgccaaaattatcatcatatttcaatttctgtttccgaacagagcctacagtggccccatctcaagtctctgcaaatagcctatcttcctcagaaattgaggtttcatggaacaccattccttggaagttgagcaatggacatttactgggctatgaggtaatttcttttccgattaaattgtgtatgtgtgttaccgtgccactttgtctccttgaatttaaaacccttaacaatgacctcttatttgaagtctgtctttggccgaaatttttttatcaacacattgtttcatctgatgttccatgtatactgaatttaaccagttgaatgaaaataacattagttggagtagaaaaggaataaaaaaagaatatgaaaggaaatcacgtatcacgtgggccaaatattttagatgagttgactaaaaaataagggtgagattgaactgcagtatcaagttcatagagtactttcatcaacaggaagtcactgtcctccagctctttgtcttactttcttggtggctttgttacattgtggggttcttttataggctctagagaagccagctgtctgtaagatattttgagccttcaaagacctctctgtttagtgaaataggacgaaacatctgaaacagaggataatgtaagaccaaatataatgaaggtctgactaggtcacccaaaacaggaaatgtttgtgttgtcaagaaggatgggacatactgaaagtcttcataagggtagtaaggcttaacaggactttcaaggcaaagtaagtaaaggtggaaggagtggaaaacattctggattaggcaaggcatgatagaaaagcagaggagtagaggcccacctgccaaaggttcctgtttggaaaggtgacttcaaataggcatgggaggaccaggtcacaggtggctttaaaggctaagaagaaccatttgaactgggtcccctatttagtagtgagcagttagaggaaactgggagtagtagagctgagaactggcaagataaatacaattcaaagattttgccagcaatgacattgtgggattcatagttgtgatttcatcctacccacagctgtcttcttatgaagcttccctccaagcttccctgaggaagcatgtaactcctgattcagtggcaggcttacacaggcaggtttgcatcacagggccacatacccctccacttgccaacacaccttcaaatgagggttccagggtggtctcttgatcaaatgtaaatgctctgtggactgtgaagcctagcaagtcagattcttgtttgagatatttatataagaaattatagagattatagttagtgagtgtaatgcagtagtgtgtcaaatttagggctcagttcagacttctcaaactaaggccatggacaggcaggacaaagctaatctgcagagatgagatacactgtcatgcatccctaaagaatggaggagacaagggcccatggaacctgcaagagggcagaataagccaggtgtggtggcttgcgcctgtaatcccaatactttgggaggcaaatgcaggaggattgcttgagcccaggatttcacgactggcctgggcaacttagtgagaccccatctcaacaaaatatacaaaaattagccaggcatggtgacacatgcctgtagtcctagttacttgggaggctgagatgggagaattgcttgagcccaggaggtcgaggcttcagtgagccgtcatcctgccattgcactgtagcctggatgacagactgagattctatctcaaaaaaagtgggggcagccagaataaagtagctctttgacagtcattcagttatcatatgacttggctttattctttttcataatgtaaccttgcccttctttttaatagattctccttatatttgaactgccttgaaagagtttctgttccttgcaaccaaacaagcatcgacttgaattaatattaaaaaattaagaaaagaaaggatagggaatagagcaatgatgctcaaagtatgggctgtgaaccccctacagcagaattacctgaaggtgttgttaaaattgagctcccacagctctcccaggacccactcaatccaaacatttaggactaggtcttgttagtgtatatttttagtaactatctgtaaggaaacatcttcctgcacagttaaacataataaacactggtcttgacagagaagcctgatcagagacagaatagtctggacttaaggaagagagagtatgaagaagtaaaacaccacataaatacaggagaacaacttaatgcacatcttttaaaggaagccaggaacagctggatggaagattcctttaattccatgacaatagatgaaagcaatgaaagatgatggggagccaacagtagctcccttgtggttaaagaactggcagtggcattggcaatggaggtaaagatataggggctggaaggagcacagctgtaagggattgtggctctgaggccagtcccatagcaaatcccaattctaccacttgccagctgtgtttggaaaattacataaactctgtgatcctcgttttcctcacctgtagaatggggacaataataggcctaacctcattaggatattgggaggattggataagattaggtatgtaatgagattctcataatttctggctctttatttatttatctatctatttatttttgagacggagttttcgctcttgttgcccaggctggagtgcagtggcatgatctcagctcaccacaacctccccctcctgggttcaagcaactctcctgcctcagcctctctagtagctgggattacaggtgcacgccaccacgcccagctaacttttgtattttttagtagagatggggtttctccatgttggtcaggctagtctctaactctcaacctcaggtgatctgcctgccttggcctcccaaagtgctgggattacaggcgtaagccactgcacctggccagtttctggctcatcataataaacagtcagtaggtgtgagacatccctcagaagaatttttgagatattaatgtatctatttctctccagtaaatattctgtagcaaataattgacagtaatctcccttaactcaagggattatgccaaaagctatcaaaaggagttgcctgcaagacacttcccttcctagctttgtttcaaaacttcaggccattaggcagattgttccgtgtttcttggagggtcacaggaggaaaattgcaactgaggaaaacatagaagagaaatttccaatgacattggcagacataaatgtctgaagcttacaaagcctcctgggggctacatctttctaaagcagtgcccaggttgacggcaagattgaacaactgtgtttcccacactcggcagtgatttctcactcaccaaacatggcccccagctgctagaattaaagggctcaaatcaaacacaaaagtaagtgatcttgggggctttgggaagggagccacaggaatgactgtggctgaatctcccattagctgagcaggatatggaattcaatgtttgatcaaatttatttaaagaaaataaatgaacactgctgggcgcggtggctcacacctgtaatcccagcactttgggaggccgaggcaagcagatcatgaggtcaggagatcgagaccatcctggctaacacagtgaaaccctgtctctacaaatatacaaaaaatttttagtagagaggaacacttttacactgttggtgggactgtaaactagttcaaccattgtggaagacagtgtggcaattcctcaaggatctagaactagaaataccatttgacccagcaatcccattactgggtatatacccaaaggattacaagttatgctgctataaagacacatgcacatgtatgtttattgtggcactattcacaatagcaaagacttggaaccaacccaaatgtccatcaatgatagactggattaagaaaatgtggcacatatacaccatggaatactatgcagccataaaaaaggatgagttcatgtcctttgtagggacatggatgaagctggaaaccatcattctcagcaaacatattgcaaggacagaaaatcaaacaccacatgttctcactcacaggtgggaactgaacgacgagaacacttggacacagggtggggaacatcacacactggggcctgtcatgaggtgggggaaggggggagggatagcatttggagatatacctaatgtaaatgatgagttaatgggtgcagcacaccaacatggcacatgtatacatatgtaacaaacctgcacattgttcacatgtaccctcgaacttaaagtataaaaaaaataaaaaagtaaaaaagtaaaaataaataaataaataaaaatacaaaaaattagccgggcgtagtggcaggtgcctgtagtcccatctactcaggaggctgaggcaggagaatggcatgaaccagggaggcagagcttgcagtgagccgagatcacgccactgcactccagcctgggcaacacagcgagactccgtctcaaaaaagaaaaaaagaaaataaatgaacacatatggcagtcctcagatgagagactgacatgcacactcaccatgaacaatgttgtcctttacagaaatcatgacaggatcataattcttgacctagtcgtaacttgtaaaatagttaagaaaaataaatggaagaatatacatgaatggcttgtgggattccaaaccgaacagagtgctagcagtcactggtggttgttgaacagcttaaggcaggtagatgttgattttttaatatagtcatgcactacataatgatatttcagtttaggacagatgacacatacaacagtggtcccctaagattacaataccacaattttactttaccttttctatgtttatgtatgtttgaatatacaaaaatgtacaattgtgttacacttgcctacagtattcagtacagtaacatgctgtacaggtttatagcctaggagcactacgctacaccatctaacataggtgtgtagtaagttataccatgcaggttcgcataattgcactctacgatgttcacacaatgcaacaaccatctaatgatacatttctcagaatgtatccctgtcatcgtaacacataactgtatataaatttaggtcaataagaagtcatccagataaggatattttataagaaaggagaattacaccattattggtcacaccaagaaagagagtttcactgaaagacagaaaatttaaaaatcctcatagaaccgtcacagtgtctagttaagtccacaccattttagaattagacaaacctgtgttcagatctgctagtttgaatacaaactctacaaggagaaggtaactcagcctttttcctcattgatctatcccaagtgcctggagtagtatctgacatacaggaggcatgcaaaaaatatatgttgattgaataactgcagtttgggctctgctaccctgttgctgtatggccttgagcaagttgttcgagctctccaaggctcagttaaaatagagataataataactcacagcattgtttgcaaattaaatgagataaagcagctattgtcaaaatggccgaaagagacttagggctgtcacttttctctgttttgaatattgggctttgggatgagattgtactgaagaaaaaaaaagcaaaccagtgaagtaatatatagtgatgtagcacaatcccagtgtgggacccagtggccaccatttctaatgcatgctgatattgccatcaaagtggggcacagaaagatgagaagagctatgggaaaatgggactttcttgaaattaattacaggttgaaatgcattgccgcttgcctgtttgtgtaaagagtagcaaatagaatgtccaaatgtagcatgaatacagtattgaaaggaaacaacgattaaacatttcttccccaaatgcttggtaagtataaagaaaaaggaaacaagctgaaagaagtactaattgggaaaatcttacaaaataatttatgtaattacaccaagataaaaatatgtcttttcttagtttcagtaatgatttaaaaattaaccttggttgggggagaaggacttggcagagtatttaattatcagtcgtgtggctaacttttctgggttgcagtttccccagtttggctttaaaattgttaatagctccttcctttctctcatctcagtgagggttgatcatgtgccatgtggcatgctgagcacacatcatcattagcatctagactaattttctttctgatttgaccaagcagtagttgagaagctcatttccctgggctccaatttatttcatcagctaagccgttacactcaggctcagatcttttctggtgcccttttgggttggaacaagagatacagacatgatgaagagaggcagaaggctttaagttcatggatcctgggtgcctgaggaatgaaagctcccacgttctagtgcagtatctacagtccatttttttaaagtccttctctgttttgaaagaaccaaatttgggagaatgaccttgataaatgattaaaacaagtctacgcttgtgaaatgatacagattagcatattttggaggaatcagtcttttttttaagtttggcagaagaatgtaattaatgtgccataatagaatgccaaacttaaacttcattgatgccttcttccagcctcctgttccaaacagctgtacggaatgtgttcctgatatttgaattagaatgaaaaaagatgtaggccaggcgtggtggctcacacctgtaatcccagcactttgggaggccgaggagggtggatcaccttaggtcaggagttcgagtccaggatggccaacatggtgagaccctgtctctactaaaaatacaaaaattagccaggcatagtggcaggcacctataatccctgctactcagaaggttgaggcaggagaattgcttgaacccaggaggtggagattgcagtgagccaagatcgtgccactatattccagcctgggcaacacagtgagactctgtctcaaaaaaaaaaaaaaaaagaaaagaaaagaaaagaaaaaagatgtcaaatatgtgagtactttttttgagactatgaaaatgtcactggaaaaaaaagacttatgcattaggtctaattccctgcaatcgggcaaagaattcactgtagcacaagttgaatgcacatgggaaaataagatacagacaattgaggcatactgaaataaatatgacaggcaaaaatgcattcaagtgagtataatgcagacttttgaagagggtcaaagggttggttttactggagagagccatagcagtagccttttgtgagtgagggttgcctaaatggtgctgtattctttattaggcaaagatattccataccaaatggtggctcagcattggggaatgcagggtaataaatatcccagcctctctttccttccaccctcccatcaccagcatcctattacctacacccagcgagaagccacagggcaaaggagccagactgacaatagttcataccagtcagctctcctagggactgagagcagagtgaagaagagtggaagacagatctggagttgtcttcctaaaagacctttaatgcatttttacctgctttttatttatttaaatgtgtctggtctaactgctaagttaaaatatttgtctttgaaaatctattagtatgaacataattctttttgtctattaaaagagtatttctgatataatacctattctttaatggctgaacaatgccattttaatagattatttttataagctgcatttcatttttaaatttaaattaagtgaaatctctgctgcagtggtattaaggactcttcacaataggaacattctttatggaaaaatcaaattactggaactaatagggatatttttaattctgatatttctcaactgtgtttctgtttacttacccaaataaaaatatattggtttgtgaaatggttttatgattctgaaggaaaaaattgtattgcctcatcaagaaattggagttttgatgtctcatggatgaatacagtattgagacttgaatacgaagcctggcgaatctctgccataggaaggagggaggcatttttaaactatgttcaggtcattcaacaattcaacagcagttaatggttagtatgtacaggctttgctgcgaacagttaaagatatggtgataaccaagacagacaagcccctgcctcaggtgtgtgaatccaccttaacatcctttccctcctgctgtctgctgggtgaggaaatgcagttaattcctgtcccaggtgcacatcctcactggcaaaccaaggcatagtcactcacgactgctcaagaagatagcctgtatctctcaggtgtctggcaatgaaaaatgattgagaaccacaattcagtcttaacaaccctctcccctggagtggatttgccttttatttttcctactctaaactcagagtgaatttgcaataggaaaattgctgcgtttcttcagttctggaaaattatcagcctttttccctttgaatattggtttttcctcagtctctccttctggaactccagttagaacttttcattctaccctcagtgtcccttaactttgcttttgtaatgtttatttctctatacaggctctgttctgggttaattagttcccttttccaccataagtcttcagcttaattctatcattgattttatttttttaataattgtaattttttaggtctataagccctgcatattatttttcaaatctgattttttttaaatcttctgtcattgcatagtagattcagtttcttctttagtaaatctagacatgttaaacagttattttaaaatttgtttcagatcagcgtattccagctcatcttccactggttgggtctgctgacattttcttgctagcagggttcctcgtatgctttgtaatacttgtctctctgcttatcttctgtagatgctaccttcatgttctgtcaaccttacgttcactcttttctgaacaattacatttccaaatttggttccttcagactagacactttttcttctccatccctgtactgtagttgtgcctatcaaatccaaattagcatagagatagtctgttctttcagttgtagtactttgactatttaaatccaaaacacaactaagaaagaaaatgatgtcatcttttttatttctttcttgacttttccacatttttaaaaaatgatctggccttatgtaaacatttttgagcaaaattgtatagaacacagcaatacttacagaaaattggcaatattaatggtaacactttgttcctatttttaattttatatatatatatatatatatatatatatatatatatatatatatatatctccccttcattctcccacttataatctcatagtctggcttgctcagcatttgttctgtttgaatttatctggttcatatatttatttgttcattatttttctcctcctagagtcccttttctctatcttcactgctgtgacacacagcctaatgcagcacctagcacatagtaggtcttcagtaaatattggttgaacaaatcaggaaataagtcagtgcccattttaatgaaaatcacttaatggaaagggcagaattttttaagccttcacatgtttggtgtcttccgcccaccaggtgcggtactggaatgggggtggaaaggaggaatcatccagtaagatgaaagtggcaggaaatgagacatcagccagactacggggcctgaagagcaacctggcctattacacggctgtccgggcttacaacagtgccggcgctgggccttttagcgccacagttaatgtaaccaccaagaaaacgcgtaagtatattctgatttctttgaatggtacggaaaatagtttgcattaaaaaggatagccttctctattatttgaaatggacaacccaagtcattaatctcactagattatataaacctaactccaaaacctaactccaaaacccaactccaaaacccttgtcctcatgatatccctaaatctttaggtagagtgtgaaaatgaacgtgcaccttctgaaaaaatcttagtgtggggtgttaggttaaatctatccccttttcttttaaaatatgataagcttagttgggtttactttcatgtatttttagtttcccaaagcttgaggatttctgataagcatgaataagttaaaattaatgccgaagaatcaggagtgatttttccttctttatctttctttcctccatcatacaaaaaatggcaatgtgcattaaatggttatcagcaaaagatgatggtcctgtgaatgtgttgatactttaaaaaatctaaccagagttgtcagtgttgctttcaaagctgagtttttgttagctgtgtattcacaggtaaattcgccagctgcaatcatgagttacaattatattagtctacaagaaagtcagtgatttacaatttgctaatgttccacacatatttcagttaatctaatagcatagtatacatttaatcattgtgttttattgttttattggtacttacaatgcaaatgtttaagttactattgtcattgccctcatcttagctaatagtgattgaaaacattctgtatcccaagtaatttatgctcattcccacatttaatcctcataactactcccaagaggtaggtgccattattatctctattttaaaggtgatagaagtatggcttgaaaggattaggtaacttacgcgcagtgataccatacttttacttgcagaaaattgttttcttaatttatttttcaaatttcttaatttaataaaaatgtttgcttaactaactttatgtaagaatgagacaatttttatgcttggttgctaatttcattgacgcatttctgtttccatatcatttccaatttttttgaaaacatacttttttgtctaaaattgcaaagaacttcaataatataaagttgaatatgattggctagcattttttatggttaacttaaagtaatgtaagacagttctgctactttagatgttaattagcacgtgtaaatttgattaaagaagtttgtgtgtttatctttgtattaggtatagaaaaaagagtgtggctaacaattggctagtacaatgagcattgcagagcacaaatttagcaagaaaccatttgaatttctatagcaagacccatttgtaagcaaccgactaatgtaacaatttaacatgatccttatctaattattataggaagtctaatctacctgtttttcataccacttggttgctgttagaccaaagagcacatgggtttggaaatacagatacaaaaaaactctgtatttacaactctttactaaatatgtttggttttctcaacaattcttactgaatcaatatggtctaaatatacatcattatttatatattccaaacacagcatcaatcaaagattctgattgcaaaaatatatgcaaacaaatttgtctggctcttttctctgacttaataattgatgtgattacttgctaggaaattatgatagtaaaagacagtgtaacatcatggtggaatcagtgaagaacttagtggattagtaagacagaaggaagagactgattagaaatcaatagaaatgtcatgataatgtacaatgaatgaatgaaaattttaaaaagaagccaaatccctttacaatttagggatagcatataaacgcccaatccgaagtagaaatttgcacaaaacagtgatgctgataattatggttgacacttactgagcaatttccggtcatggttctaagtaattttcatgtattgattcttaattcccacagcaatgtcatgacttgaaggtattagcatgcttactttagagaggaggaagctgaggcatatggaggttatataatggtactgacattgcagagtaagtaacaggatgggcatccaaatccatagtcttaaccactatggtatcctctctttcagccatattgttagaatttcatcactcatttaatacctttatttattgtgattttgctctgtgcttaggaactgggtaagatgatcacaggtggtcatggcttctctgctcatggagctttagtttgatgggaaatccagcaactgaatgaaatctctcaaaaacaatgttctgctattattcaactggagttcatctagagtctttaggttgatctgtagatgttattaaggacaatttcctacgttgggtgggaaattcatatagatcattaaaatccccagtcatcctaaaatggcatataaagaacatatgttaatttttaaattttatgttaataatttttaaatatgtaccaaaatttcaagtaaaacagaatctcttagagccattaataatattgttactggtagctctaaatagtcttcctaagctttgacatggtttaactgcaaatcctatttaaaattttggtaaggctcttgtgattatcactatgaagagaattacttgtctgccttggcataaagagcaaaaataacatttttgattacctgcttgctatcgctcttcccctatggattctaaactttacagggaaagagtccttctgtgtcttatttacccagccacagtgcccagcacaaacccagcacataggagcagcatattaaatgttgaatggatgaatgaaacttagagaagcaagccaaacctcaagtactattattaatcaaatgtacttcctcttgactgcacattgcaaattcaaaacatgctacagttctttaccatctcacttaaaatgtgcaagtttcatgtactcatcattatggaattttgtatgcaaggctttaaatcagtacagattttagatgatatttctgattaatgtaaaataacacaaggattctcaagtactgtagcttccattaaacacttaatttttgatatccaaatacttgtgttttttagaagcatttttaagttaaacactaattagcctctttaagtaatctaagatgggtttctgtcatttgccaccaaagagagcaaactcttaacagcatctttcatctcaagggactgatgaataaaatttgcagatggcttaaaaatgataagttgcattagtttctaaaaagaaacattgagaattttatgttgagtttgcaagagataatctgtaggataaatattctgctttgtataatcaaaaagtcaagtggtgattctgacattcagtatgaatggatccagacactcaaacaacattcaccacaatcatgtaataagatctcaaatttaataaaactgaattattggttctccttccaacccatttaaatcctctctcttctgtgatagtccccatttccataaattccactccaatgtttcagtttctcaagccaaaaatctcagagtcaccctcgagtcattttctctcataccctacgctagatccagaatcttacttttagatttatcaagaatttaccacttctggccaggcacgaggactcacgcctataatcccagcactttgggaagccaaggtgggatgattgcttgagctcaggagttcgagaccagcctgggcaacatagtgacactgtctcactatgctgagacagagaaaaatataagagaattaaccaggtgtggtggtgtgtgcctgtactcccagctactcaggaggctgaggtgggaggattccttgagcctaggagatcgatcagagctgcactgaaccgtaattgtgccactgcacttcagcgtgggcaacagagtaaaaccctgtctcaaaaaataataataaaaataaagaaataaaatataccacatcttacactgctgacacatcaaggcaagctgcctccaactctctcctgtagatcagggcaatggcctctcactgttcatcctgtttctgcctttgccttgacatcctgataatgtcacttccctgctcagaacctttttgtcacttcccatcccactccaggtaaatgctaaatccttaaaatgcccaatgaggccttatacaatccactccccaatctctgctctgacttatttcctattcttttccaccttgctcattccactttacttcaggacctctgcatgtactgtttcctgtatctcgaaagctcttcctccagatacccacataatgcactcccccatctcttccacgttgtcactcagatatcacctgggtgccacctgactgcagctccaccttttctgatgctcttgtctccttccctgttttatccttgtgcatagcctcagagccaccacatgtactgtatctcatggctactcacttcatcactgtgtccccaggacatcgttgtgtcctgccttagccggagtgtcagccccttcagggcagagctatggcctggtttgatcattgctctcttcccagagctctactccagtgcttaagtaatcacagtcagtgcccaataagtatttgttgaacaatgactctctccatcactgtctctgctccatggcagcatcactctaaccaagttctctcttcgtggcagaaagattgccaccagcacctcaagagaactgttgtctcttggccagtcacactgggaaaggtgggcagtttctttctgattattctacccagagctaagtaggcttctcattgattcatcttgggcaaacaaccaactgttgtttccagttgtgagaaaaactggaccagcctggcctgaaacacatgcccagactcccctggaacaaggggattctatatttttatgcctttgctaattattatatgtgtgagtatacttggggaaaaagaagaatgccaaatgatacaatcacttttgcatttgagtctttgcttttctaaatgaaatgctcatccatgtaagtggagccaaaatcagttacctgaatgtaaggaaatcaagtaggtatgctttttttttaattcaactttttttatttgttttttaatttttgtgggtacattgtaggtgtatatatttaaggagtacatgagatcttttgatacagatatgcaatgtgaaataagcacatcaggaagaatgaagtatccatcccctcaaacatttagccattgaattgcaaacaatataattaaactctttaagttatataaaaatgtacagttattattgactatagtcaccctgttatgctatcaaatagtaggtcttagtcattctatttttttgtccctgttaatctccacttatccccctcaccccaaacccctcactacccttcccagcccctagtaatcatccttctactctctatgtccatgagttcaattgtttgacttttattttattattatttttccataggttagtggggtacaggtggtttttggttatatgagtaagttttttagtggtgatttgtgagattttggtgcacccatcccccaagtggtatacactgcacccaatttgtagtcttctgtcccttgcccccctcccaaccttccccccaagtcccgaaagtccattgtatcattcttacgcctttgcgtcctcatagctagctcccacatatcaatgagaacatacgatgtttggttttccattcctgaggtacttcatttagaataatagtctactatctcatccaggtcactgtgaatgccgttaattcattcctttttatagctgggtaatattccatcatatgtgtgtgtgtttgtatgtgtatgtatatgtatatatatatcacagtttctttatccactcgttgattgatggacatttgggtggattccacatttttgcaattgtgaattgtgctgctataaacatgcatgtgcaagtatctttttcgtataatgactttttttcctctaggtagatacccagtagtgggattgctggatcaaatagtggtgctacttttgttcattaaggaatctccacactgttttccacagtggttgtactagtttgcatttccaccagcagtgtagaagtgttccctgatcaccgcatccacaccaacgtgtactgttttttgattttttattgatggccattcttacaggagtaaggtgatattgcattgtggttttgatttgcattccttgatcattagtggtgttgagcattttttcatatgttggttggccatttgtatattttcttcagagaattgtctgttcatgtccttcacccacttttgtatgggattttttgtttgtttttttttcccgctgatttgagttcgttgtagattctggatattagtcctttgtcagatgaatagattgtgaagattttctcctactctttaggttgtctgtttactctgctgactgttgctttgccatgcaaaagctctttagtttaattaagttccagctgtttatccttgtttttattgcatttgcttttgggttcttggtcatgaaattcttgcctaagctaatgttgagaagcgtttttccaatgttatcttctagaatttttgtagtttcaggtgttagatttaagtccttcatccatcttgggttgatttttgtataaggtgagagatgaggatccagtttcattctcctacatgtggctagccaattatatcagcaccatttgttgaaaagggggtcctttccccactttatgattttgtttcctttgttggagatcagttggctgtaagtatttgggtttacttctgggttgtctattctgctccattggtctatgctcctacttttgtaccagtaccatgctgttttggtgactatggccttatagtatagtttgaaatcaggtaatgtgatgcctctagatttgttctttttgcttagtcttgctttctgggctcttttttgattctatatgaattttagagttttttttataatcctttgaagaatatggtggtattttgatgggatttgcattgaatttgtagattgtttttggtagtatgatcattttcacaatattaattctacccatccgtgagcatgggatgtgtttccatttgtttgcaccatctatgatttcttgcagcagtgttttgtagttttccttgtagaggtctttcatctcctggttaggtatattcataagtggttttttttttttggcagctattgtaaaaggggttgagtttttgaattgattctctgcttggtcactgttggtgtgtagaagagctactgatttgtgtaccttaatcttgtatctggaaactgctgaattattttatcagttctaggagttttctggatgattctttagagtttttgaggtaaaccatcatatcatcagcaaacagtgacagtttgacttcttctttactgatctggatgccctttatttctttttcttgtctgattgctctggctaggacttccagtactaagttgaagaggagtggtgagagtaggcatccttgtctttttccagttctcagagggaatactttcaacttttccctattcagtataatttggctgtggggttgtcatagatggcttttattacattgaggtatgtcccttgtatgctgattttgctgagggttttaatcataaagggatgctggattttgttgaatgctttttctgtatctattgagataatcatgtgatttttgtttttaattctgtttatgtggtgtttcacatttattgacttgtgtattttaaaacatccctgcatccctgaagtgaaacctacttgatcatggtgggttatctttttgttatgttgttggattcagttagctagtgttttgttaaggattttagcatctatgttcatcagggatatcggtctgtagttttcttgtttggttatgtcttttcctggtgttagtattagggtgatgctggcttcatagaatgaattagggagggttcagtctttatcttgctgaatagtgtaaacaggattggttccaatggtctggtagaattctgctgtgaatccttctgctcctgaacttttttagtcggtaattttttaattaccatttcagtctcactgcttgttattggtctgttcagggtatctaattcttcctgatttaagctaggagagttgtatctttccaggaatttacccatcccttctagattttctagtttatgtgagaaaaggtattcctagttgtcttgaatgatcttttgtatttgtgtggtgtcagttgtaatatctcccgtatcatttcttagtgaagttatttggattttctctcctctcttctttgttaatcttgccaatgatctatcaattttatttatctttttgaagacccagatttttgtttcattaatcttttgtatttttctattgtttaaatttcatttagttctgctctgattttgcttatttcctttcttctgctgagtttgggtttggtctgttcttgtttctctagttccttgaggtgtgaccttagattgtcagtttgtgctctttaagtcttttttatgtcggtttttagagctatgaacttttctgttagcattgcctttgctgtatcccagaggttttgataggttgtgtcagtattgttcaattcgaataattctttaatttccatcttgatttcatttttgactcaatgatcactcaggagcaggttacttttcatgtatttgcatggttttaaaggttccttttggaattgatttccagttttattccactgtggtctgagagagtgcttgatataatttcaattttttaaaatttattgaagctcatttcatagcctatcatttggtctatcttgaagaaagttcccttcactgttgaatagaatgtgtattctgtggttgttggatggaatgttccgtatatatctgttaaggccatttgttccaaagtatagtttaaaaccattgtttctttgttaactttatgtcttgatgactgtctagtgctgtcatggagtattgaagtcccccactattattgtgtggctgtctcatttcttaggtctattaataattgttttataaatttgggagctccagtgttaggtgcatatatgtttaggattgtgatattttcctgttggacaaggccttttaccattatataatgtccctctttatcttttttaactgcagtttcattaaagtttgttttgtttgatataagagtagctactctttcttgctttttgtgtccatttgcatgaaatgcctttttccagccctttactttaagttttcatgtgagtccctatgtgttaggtgagtctcctgaaggcagcagatatttgtttggtgaattcttacccattctgcagttctgtatcttttaagtggagcatttagcccatttaaattcaatgttagtattgaggtgtgaggtaccattccactcattgtgctatttgttgcctgtgtaccttggtttttgggttttgctttttatgttttaaattgtattttttttttataggtcctttgagatttatgctttaaagaggttctgttttgatgcgtttccaggatttgcttcaagatttagagctccttttagcagttcttgtcgtggcgatttgtctgaaaaaagactgtatctttcttttatatgatgcttagtttcgctggatacaaaattattggctgataattgttttgtttgaggaggctgaagattgggccacaatcccttctagcttgtagggtttctgctgagaaatctgatgttaatctgataggttttcatttataggttacctggtgcttttgtctcacagctcttaagattctttccttccccttaactttagatagcctgatgacaaagtgcctaggcaatgatctttttgtgatgaattttccaggtgttgtttctggttcttgtatttggatatctaggtctcttgcaaggctgggcaagttttccttgattattcccccaaatatgttttccaaacttttagatttctcttcttaggaatgccgattattcttaagtttggttgtttaatataatcccagacttcttggagacaatcatattttcttattcttttttctttgtgtttgttggattgggttaaattgaggaccttgtcttcacgctctgaatttctttcttctacttgttcaattctattgctgagactttccagagcattttgcatttctatatatgtgtccagtgtttctggaagttttaattttttgtatttatgctatctatttcattgaatatttcttccttcacttcttgtttcattttttggatttccttgtattgggcttcacttttctctggtgcctccttgattagcttaataactaacttcctgaattctttttccagtaaatcagggatttcttctttgtttggatccattgctggtgagctagtatgatttttgggggttgttaaagagccttgttttgtcatattaccagagttgtttttctgattcctcctcatttgggtaggctctgtcagagggaaggtgtagggctgaaggctgttgttcagattcttttgtcccatagtgtgttcccttgatgtagtactctcccccttttcctatggatgtggctttctgagagccaagctgtagtgattgtttatgtctcttctgggtctagtcacccagcatgtctaccaggctcgggcttgtactgggggttgtctgcatagagtcctatgatgtaaaccatctatgagtttctcagccatggataccagcacctgttccagtggaggtggcggggctgtgaaatggactctgtaaggcccttagctttagtggtttaatgctctatttttgtgctggttggcctcctgctgggaggtggcgctttccagagagcatcagctgtggtagtatggagaggaacagttggtgggccgggccctagaactcccaagagtatatgccttttgtgttcagctaccagggtgggtagggaaggaccatgaggtgggggcaggactaagtgtgtctgacctcctcctacagcaggtcttgccgtagctgctggggggatgggcgtgaggttcccaggtcaatagagttatgtacctaggaggattatggctgcctctgcagagtcatgcagattgtcagagaagtgaaggaaagccagcagtcacaggccttactcagctcccacgcaatccaaagggccagtctcactcccactgtgcccccactgacagcaaaaaagtccgtttccaggcagtgggcaggcagggctgagaagtttccccaggctacccacctcccagctgggaaagaaaagggctctaattcttcctccacctataaagtctgcacgccagattcactctctcccccaggttctggccaggaagcttctcaaccagttaaaatagttacaaagttcagctggagatttccttcttgtggtggtttcctcgtgcctctggccaccctcccgaaggatccctgtgatgccaggcaggagtggcctgcttggggacccagcgaactcacagggcctttcccgctgcttcttctacccctgtatttcactcagctcctaaattgactcagctctcagctccaggtaaggtcggaatcttctcccataaattagaccttcagtttccccagtgggggtatgtgtttgggggtggaggacctccctttcccacttccacagtttgagcaatcacagtatttggggtgtctcctgggtcttgcaggagcaatccacttccttcagagggtctgtgggtcctctcaggtttcctgttttattcctgcagttgttctggaactaaaattcacaatgcaagcctccacacactgctctgtccatccgagtcggagctgcagtctaggcctgcctcccgtttgccaggatctgttccaagtaggtgtgtcttggggaagtgaaaaggaaatgtgaataaggcaagcactgaaagaatgagtctgaatgtttcagacggtttttattaaatgactattgctacctcaaacacagaatttggaagttctaaaatttttatatatatgacttaattgtataattgtccagtctgggttttggctcaggatacacattattgcaaagttttccaaatttcatatgtgatccacctattttgccattttttccaaccttttctattaatatatatctactatttttttcttaaaaattgaccttctatttttacttagataaatttaaaaaaatggaaactagctttttatctgagcaatgtagaaccagcatcattgccataaatagatgctaaccaaatagtaagtttaataataataagtagaatgaaaaatagaccaccctcctttttaaatactaggaacatattcttgcctgttgaaacctccaaacctgctccctctttgtttgtgatgttagtatagaggggatattaaagacctactggctcccaaatctaactttctcttcaagctatgggaagattacaagggaatttttctgcaggtgactgaatgctatttgttggcttttctgtgcatcacatcccccagtgcatgtgatctaatcatgtttgtatatgacacaccataaatcacacatataatgcaatacaagcctatcaatgtgcattcctcagattcaggagggtgtttttttcccccatctatgggcttcagcaaagttattcctagttttgtaagctctgaagaaacataacaatataatattgaactttaccagtattcaaacaggaattttctgctaatatagaatcaggaaaaattctgactaaatgtgtaaaacttatgaactttattttgtaagagttttggcacttttttgaaaatctgccccacttgcctgtgaatcttctagaccaagattgtccaacccacagccagagagccacatgtggctcaggacagctttgaatgcagcccaacacaaattcataaactttcttaaaacattatgagattattttgtgattttttttaaagctcatcagctatcgttagtgcattttatgtgcagcccagaacaattcttcttcttccactgtggcccagggaagccaaaagattggacacccctgctctagacaattgtaagtgttctgcttatagtttataatctcacatatttttattatgcaaaggagaacttttggtcaaggaaattcctagacgtcgaaaaccaaaaatcaaagaaagaccttccctggcgttctaggttgggtttcagacgagttaaaaagtagatgattttgttgtgttttaaaacattgtgtcaatttcctttgataagaaattagatccatttataatagttttcagtgattccaaaacaaccgtatcttactattgggggggtgcataattggcttttgtttttgattacatgatcgttgcacaataccacatgtttaagcagcttagttacaaatgttaataattatcttaagtgaagtccaagtgcaaagcgtaacttctagctactagttataacaactttttatcaggtaagtcatctcattaccatcagatggccaagaaaaagagttgagaaacatactgagttttgtataattaatcacagcaaacatatgttcttaaaatttcatattttgaaagtaaatgccagcttcactgttaccactatgagacatcaccattgaaagctccaggcaataatattctttaacaacctctactttgtattatataaaggaaaacatttattttagaaaatttgggggaaaaagtctatagagaaaaaataaaattcactcataatcctatcactcagaaataccataattaatatcatttgtctttccttccagacttctgttctatgaaaagtttctcttatacagtggaggttatgctgtgtattttgttacctgtatactgtatcgtaactgcccgtggatgatattccattgtgatgaacgccacaatttatttagccattttcctgtggatagacatgtcttatattcccaccttcccagtttcatctaatcatggttatatgatagtaatcacttgttttcaggcaagtatctgcagagtaagtaaaatctatgaagctgatgttgaggagtctgaaaatcaagtgcacagaggatcatgatggatgcttaaggaacaacaataataaaaacctctcgagagaaagttatttctttatgtaacacttaaaattactgaaatgattatgtgtatcctgtcaattagtgttgtgatataaatctagtgatatgtcatcattttactaggattagttttttaccagttttttctaatttagcattctgccaacagtagaggttgacaggaaaaacctataggatatgaacgttgacaaacgatttccaaaaaatttcaaaatgtagactacttaccagtttaggtccagtaaattttggaactcaatcatcctattctgggttgcacttccacacaggttcaaatacaaaaagtaaaattagaagtcctagaagttacactatcaactatcccctgctcattcctaattcactacttgactccatacttttacaaaagttcattgtgttgcttcagagctatctaaactactggttaatagctatgtcagattaggctagtccaggctgaggcacctcaaatccccaaacctcagtggcctaaaactatacttttttttcttcaactcatactatatgttcatcatgagtgagattcagatctgatccattctgtctcccattctgtctccactcctgaacccagaataatggagcagccaatctctgggacttggcaatctcatggcaaagagaaaagagaggaaagcaaaccatactcttcaatgacttttatggctgccacttgggggtggcctatttccctttggcccacattccattggttgaggcaagtcctatggtgaagtcccatatctatgggatgccaatgagaaggagaattatgcctatttacaggcagggaaccacaagtcccatagccaacgccaacatcagtgagagctaggcagagaagcataatcctctcaaggtgcagaggacttaaacagagctggtttgaatccacataatacttctcactagtcatgtatcttagcaagcttttttaaacctttcattgtagtaaagtacacataacataaaatttaacatactaaacatttaaaaacatacagttctgtagtgttaagtcttttacatttctgtgcaatagatctctagaacccttttcatcttgcagaactggaactttgtactcattaagcaattctccatttccccttccaccagcctctggcaaccagcattttattttctgtctctgtgaatttttgactattctgaatatctcaaataagtagaattataaagtatttgtctttgggtgtctggcttatttcacttagcataatgtccacaaggttcatccatgttatagcatgtgtccaaattttatgtttttaaggctgaataatatttcattataggtaaatgccccattttgttcatccacccatcttttgaataatgctgtcatgaacatgcttatacaatctttttaaattttaactctctgggtccagattatgtatgtacagaaatgggctttattacaatgcaatataatgaggattaagtaaattatattaaagcacattctgtaatccctaacatattatagacgtgtactaagtattagttactaataatagcattttgaacatgggtgaaagtttctctggtccaaaatttcccaaatattgtcattcttaccagtggtggtaagagatgatcttaaggtagttcgcgaacattataaaaatttagaatgtttatataaggcattaaattcatttattttagagagtgcccaaaaatgtaactagcacatcaagctaattattgtgtgaatattattgagatgaaggtaaaatagatgtttaatttttcttaaaccaagttatttttttaaatagcaaaacatgacaaaaatgatacatgactgacgtttagaaaacagtaatatgattcaaaaagaacaaagttagaccctattatttcttttttgttttcctttttttttgttttttttttttctttttgtcatttcaaaaagtattcatttcaggctgaactcattcagcccacgtatgttgtgactcatacaagataaaccccagtgttctatttgcagtcatttctccctgaaggctgatgttggtataggtgatttaaccaaaattactcaaactttttgtaacctccaaacacacaccttttgttagaacaaaccatgctgtagtatagctcagctgcatcaaaccaaacctgtccttttatagtgctgtcaggccacagggtatcactggctttgggaaattgtcctaaaaattgtacattcatattatttgagtaaccagaacatggtcattagtatttcaaccctaagcagctgctataatttttttgttgttattagcagagcacagcagctcagacaatcttagctgacctaaactcattgtgaatactcacatcacagaattttaaaggcaacatagaatagtgttaaaagagacaaaaagcaaaagaaatccacagggaatacaatctcgtttggtgtcattagactcataaatgtatttgagttcttcctatctgtaagttcagctgtatttcccctatggcatgagtcaatgatgtttagaaatttctctggatagctaatgttttatatcatttttccattacaaattcagttagccaaatcacattctgtggttaaatctacaaatataacactgagggcaattgtgatgctgttgttgaatgaataatattatgtttgttgttgttattgacaagaaactgatttttccagtgccctatctgtgttgctattgacaaatactatcggccatccctcaacaccctcaccccttagcattagtttacagtccagcgttcacgaaaaggaactaaattatgaatctaagtttagaaaccgcagagagtttcattaatcctctaatggaatcctcattaactttttagcgttttgccttatttttctcaaaaattgatttaagcctggaaaacgaagacttttaaaatatagactctcttgcaatttttcatgtgtatagctattactccatgggaataaatctaagtaattcttatttttgattgcctcacattttgcccatcttatcatacaaggctggctccaaaatcatatacacttcatttcacagaactttaatctgtccatttggcaatttcttccagcctctgtatgcgtcaaaataagtcccgccgccttcctttcttggtttaggaacaagcagccctctagtggtagatagaggaatttccttatcccccccatcgacgtgttttcaacgagacacagtaagtgtgaaatgctctaaagtgtatgatgagcatgataaaatgaattatcttacacattaattgaaatgccttttttgggacttttattttagattcggggtacatgtgcaggtttgttacatgaataaattacgtgtcacgggggtttggtgtatgaatgaaatgcctttctaaaaaaaggaaatttatatactctgttatttttttctgatttcatctattacaccaagcattaccaaaggcatcccgttctacttccactagcttcctatgatagccgccatctcctccgtgtaaaatatcacttgtacttcgatctgttttaaaatttctcattttgcatttcaagctcccagtcagccaccaggaaatgttgtttggaatgccacagacactaaagtgttacttaattgggagcaagttaaagccatggagaatgagtcagaagtaacaggatataaagtaagttttctcatttgcaatgcttcattttcgtaattttggcagtacttttcaagagaagctaggtataagtgaatttttctatatattgatatggtttctgtaatctaattttgacaaagataccaagctttccataaaatgggtaatttttcaaaatagcttcttaaatatggtttcaagtgaaagaattctgctcaagtgggaattttggacacaatgtctccaaattgtgtgttagtttgctactattgatgctgacctatatactacttaaaaataaataaataaaactattggctctgattccatggccaggcattcaaggtccatacactatggccctgccttatctctccagcctcataaatacgcagcccagctgggcttttccacgggagaagttcactcttcccaagcctccctgattttgagaacctgatgattctgccatgtgctaacctctaatctaagacttacaattagagtcatgaatgaaacttacattctagtggatatagaaggacaaaattagttaatttcagagagacaaattctatgaagaaaacaaaaatgggcaatataacaagtaagtgtatttgttcatgcattttaggttttctataggactagcagtcaaaataacgtacaagtactgaacacaaataaaacttcagctgaacttgtgctgcccattaaagaggactacattattgaagtcaaggccacaacagatggaggggatgggaccagtagtgaacagatcaggattccacgaataaccagtaagttggttgaagccattatttactttattgacatcagtgttactatccgccatagtgagtcaatcagtatccctctgtccattctttctttccagcaaggcttacatccaaatgccggtaaggttttggcaggtgagacgtgggcaagaggaacccctcaagagtggtgcaaaatagggagaaaagtatgagggtgtgaagaaaagatgtcaaaaaatatttagcaaaacttcattaatttgattttttttccttattctgagttttacttaaatttgcctttggatctcctataaaagcagaattccctaatcatttcttttagatctttaatagtctagttatttgcctcctacaaattatagataaatcttatcaattctttaaatagaatgattaacattgtcaaagtcctaaaccacttacctgtgccaaactaaaagactccttaaaaattcttctcctagtttccaaggaggttcatacgaatttttcctctccaaatccaagtaaaacctattttactatagaaattatatgtttagagttggaaacagactttggtttgcgtattttatcaactgccaatgctagaataaattttatcctcactcttaaatcccaggtctggagttttctggcctcagtttaactattgtagagtccattttgacttcatatgctattctatagttcttagtgacatgactttgttccctgtttccattcatttagcatgggtaatcaggactgaaacttttgtctttaatcttggaaaacaaaatggcagacattagtaactgaagagaaacggaaatagaaaacttagagaaattctgtctttctgtaaaaccataaaggctgccatacttagactaaaacaaacaaagctacactaagaaaacaggaactacttattgcagaactaagttctgcaaagtaaaagtctgcagaacccatcttggactacagaactctctaaaactgtatgcacttcaatagagcaaaagtagaaattaaatttagtttattattgttgttaatttaggttttgaaataatgaatatgtgcttcttgttccctgaatggtgcaaggcatggagttaacattacaatatgggcaaagtggcaattttaaaagaaatatgttctaggcttttgcagggacagatgttattttagcattttagggctgctgagtcaagagtagccttttcatctgacatctgctgtcttgctgagcttgcaagtgaccacacagggccatctctatgaaaacgaagcttttatttattgccttttaaaaagattatgttttatattatgtgtaataatttatctggaaatgcataaaatagaaacaagcacagacccttcaaacccttacccaatgaagcattcttaattaaaccattgaattatctcaaagttgtttgtaatcaagtataattgttttcaaaatgattaagttgtttttcccatttcaattaaagttaaataatagtagatgaacaaagcctggtatcatttaagaaaacttaaacacattactgtttttatagatactcttggcaactagtatatgctgcattgataaataaaatgaaggctaataacaacttgtggtggttccaggataggttcacgtagtgatttggttttgataggagaggtattgcctttgctctgtgtcttagtcctttttggcttctctaacaaaactacctagacaggtggcttataaacaacagaaacttaattctcacagttttggaggggagtctgagaagcccaaggtcaaattgctggcagattcagtgtcacctctcgaagtccctcacctcctaatactctgacattgagggttaggatttcaacaaagaatttggggggaacaccacaaatatccagtctctagcaccctgattacatattggtacaatccttattaatgagctcttcatcaactttgacaggtatggatgcaagaggatccacttcagccatctcgaatgtccaccctatgtcaagttatatgcctatagtactgttcttaattgtatatgtcctgtggtgatattaactcctttttattatttattggaaagttatttggttaccaaaaaaagtgctttcatgaaatgcagtgattatgcatgtttttttcaactcttatttttaactttctacttcattataggtaaatatgaatataattaaaaaaacagtaaatccttttaggggaatctgaaatgccttaatattaacttgataaaccaaaggaatttacatattacatacttcagacttttgatataaatgttcttaaactatgagtttaagcactgcctatggataaagactcacacactctcacatgtacacacacacgcatgagaatttctttttacattgaaaaactctttcatttaattcaaatgctattttcccattataatagcattatttggaagacttaaccagtatcaatttgaaatgctgatttaagtccccaaggatgaaaaatacattttaaaaattattttgttggagaggagtggcatgtgattcaaaagagcattgttggaaaatgctactgtggggcttagaagaatgatgtttggtttggtatgctgctaactagttgtaagactttacaaatcactttgccatctgtacctctcaattattcctctataaaatatggagataataatacctatctgatcagactttgccccatgaattagtttttaaaagataaagactgaagtatgaaagtgcttttgtcaccccaaatgcaattgacccatgcaaaatattagcatgaatttatttaatcacataaaagtcatgaagaccagccagattttcaagcttcattctgtttcattcagttatattccaaaattcaaatgatcacattttattctttctcaaaaaaaaaaagtttttttaaattaaaaaaggaattgtttccttcacagctatgaataagctttcaggttttattaaaacctagaggaaaaaatcaggaatgacctgaatctcaacccaaatattaaacaaaatccacataatccctcatttcaatttccaattccattaagggaccctctctttttggatggcagagatggttttttaatgaaatcccaccatctatctgagtgagtctggcaggctttttagttcctgagttaaatttgtaatagaaccaaggcaatgctgctgactttgatatgtatgactcagtctttcaatatgtggttttcaaaaaattgttgaagacgtgacttcatagcaatatatagagaataaattaaaatcagcagattgagttttcaacattgcaaaatcagttttttacctctttcctaccaatttcacattttgcagaaacttgttcacatttccaacaatatcagaattagaaaacagttcagataacaagaaagattaaaaattagggaaattctgatatcaccataaagcactattttacatttagagattacatttaagataaagtcatcatacacaaaaacaataaatatttataactttctctataaggtccgcatatactgtatatattgaaacaatctgaatgactagtagatttcatatgaccattgttatttccactttctccaatacttgtattttatgctacatgtaatgaagttggacctttttattatttagtaattcctatatgttcctatacttttcattttcaagatgattgctctattgtttcatgttgtttctagcaatatatctccatgagatatgcactttgtttcatattgaaaagtataaaatttatctttcaattcctgtgtgtgtatcctatggttatctgtatgtattattttctattctaataaaatttataacaagcaaa

SEQ ID NO: 116 - DNA, 12479 bp, Homo sapiens
gttagacacaggacctgctgggccacagaaaggaggctctgggtagacgcactagattactggataaatcacttcaatttcccaatgaattttatattgtttatttttatacctggagttttttccttaaaaagtagcactttgaagcctactattgaaggtgagagagcatttaaaacttttataaaaatagtaggtaagaaggatgacccataatcatgaaaaattggtatgtggcagttttctacaggaggatataaactttattgttggagctatggtatgttttagattttaaatctctgcctctaatcctttgtgaaaaaaatgcagttagaaaaagaaagcagtaaaagaaatcaacatatttctgatctatggtgtgtgatacttttttttagcattgcctaatgtgctacctttaaatgaagatgttaataagcaggaagaaaagaatgaagatcatactcccaattatgctcctgctaatgagaaaaatggcaattattataaagatataaaacaatgtaagtctttaaagtgaatagaaatgtatatgcaaaagttgattatcctggtttcacttaagtgtcctttttaaatttccatcatttccccctgtatttgttgggtattttatttctacttctgtgacctgcctgttcatacccttgcccatttttccattaggttgtattttcatttctttttaagggctctttttatgtagaatatattaatcctttttacggtaaaagtaataaatgttttctgccaagatgctgcttatctttaaggcttattttattttattgtatcgtattcagtttttgagacagagtcttgctctgtcacccaggctggagtgcagtggcacgaccatggctcactgcagccagccttgacctcccagggttcaagcagtcctaccacctcagccttccgagtagctggaactataggcacatgccatcacaccaagctaatttttgtattttttttgtagaaacggtgtttcatcatgttgcccaggctggtctccaactcctgggctcaagcgattcacccatctcaccctcccaaagtgctaggattacaggtgcgagccaccacacctggccaagcctgtttaagtatctttaataactgagaagatttcaagttttataatatcagttctgtttatttatttctttataatctctgcattttgtgtcttgcctaagcaggctttatccagtccaaaatattgttttcttgaattttaaaagtaattttatcgttgtttttttttttttttttttttttgagacggagtctcgcgctgtcgcccaggctggagtgcagtggcgcaatctctgctcgctccaagttccgcctcccgggttcacaccattctcctgcctcagcctcctgagtagctgggactacaggcgcccgccaccacgcccggctaattttttgtatttttagtagagacgggtttcacagtgttagccaggatggtctcgatctcctgacctcgtgatccgcccgcctcggcctcccaaagtgctgggattacaggcgtgagccactgcacccggcctatgtttttgtttttaacttgagctttaaatccaattatttttgtgtatggcataaagtagggataaaacattatgtttttcaaggatgatagccaagtgtctaacaccaagtccctactgatgtgaaacttatatttaattaaccaaactctaagatgaaattaggccaattgttatacttgtttttttaaactgtctgtccctagaaagataccagtgtttcaacttttatactttcataactcatggcatgagtgttgggttgtgactttgttttatttttccatagctctgtctcaggaattgctcaaaaacgatgaaatattaatggtaccgtttttatgtgtgtcgtccataatttatctgttatcttgtgggagaacatttagtctatgtgcagtttttcccatgtacattcttctcatatacacactggggtgaatttctttgttctcacaaagagagaaatgaatacatatgtaaatattaaatacacatacattcgtgtgtgtatagaattttgtatcatcttatgaaattttggagagaggagacacatgtgcatgtccagtctgccgtcttgatccaattcactttgatcctttggcggggggaatatatacattagttttgaattgcagccaactccactaatgagtcttaagagcagcattctttatgtgcatgtgtaaatttgagtatatgtgagggaccttaattgttatcaaatgatatgctttttaagctgaagtgttcattccatagtctaacagaaggttcaagggcaggtaaatgcttcttacccggttttttgataatgtcaatacaaacagtgataatgttgcacatctacaaatctacttcagcacctgttatgtgcttacatatttttttccacaaatttctccaaaaattgcttcttggaaagggtcatttggcataaagatactagtttggcttttttcaatgagttttagatttgacccttgccccactttcttattttgtagatgaaaaaaaaatgactataacttttttaatttttttttaattagtgcatgttttaagaaaaaaactcagaggaagaaaaaggtaaaggaaaaaaagtgacttagctagttgctgaagactttcgcttttgtttttagatgtgttcacaacacaaaatccaaatggcactgagtctgaaatatctgtgagagccacaactgacctgaattttgctctaaaaaacggtaagaagtgaaaggcaccattgcacatgtaaaagccattaaagcaggatttcaaaacagcaataagagactgttggggagaaaagaagtcttcgttcctaaataagactaacattttccctctaaagtagattctgtgactgggatccagcttagttcttggccatcctctctgcttttctcacacttcctcccacacaaatacacctgagactccacatccattacactgataatttcagaagctggggaggttcttgcatttctaaacctcatacatatggtttatgtggaaagaaaaattaaatgataactacatttaggattctaggaaaatttacatctttcttaaacccacgtttttttgcctttctgatttttgtcttcagctttaaatggggaagagagaatgtttctagctatggcaatgtcaatattgagaaatgtgagactcaggaatgcctaattattaacaaagctacttgataataatggaatattttgagcaatttcaaaccttgggatttaaatgagacagtaacattccaagggcttatattaattcagtaaatcacttacgggaatcttgcttatccacaacaaacaacatcttgagttgtctgggacaagacatgaagaggcagctcttaagtgtaccagctacctcaaattcccttaggatatgagttattgagtacagactgcaggacccaaggaagagactgcgaaaccctcacttttatttccacaattcaggcccccagaggattgtcagggaaagtgggattggaataagacattcctgccattttaaacggggctctgacagaaggagacctgctggcatggtagggacgttctagaggagcaagcccccaggaagatggagatctgcggataactttgactaagggttgcttgcttaagtatagtccctaaaactctgaaggcaagggggaaaaactgaggcaatctagatgcttttctccagaggataagggttgcaaagcagaatttaaggatgacttactcacttttcgagttctgcttgaatcactatcaactccagtaactgattccctttcccaactttccttggcagcaagacacttgtcatgggtttgtgggcttggtgtgaattttttctgcccctctgtagaagtcctcctatagagggtgccctgtactccgtatggaactttattgactcctgtattaagcagttaattgaaatggccatcaacttgaagaaagggtcttccagtcacagttgttaccaaacactcccttagtgacattcctctagagggacccattacagactgagatatatactaaattagacctgaaaacccttgatttgtagtccaaaatctttatatccaaatgtctgtttccaatttacaaacacacttaatactcagcctccctttcttgcgtcgttacactgaacagcagccaagctgctctggacaaagaggatcatttcaccgcctgtgcagggaaccatctggagccaattatcttctccaagagatcttctttacctctgaagaaagcccggggccgcatgttcctttgcctctctttcacaaattatagtcatgttaatcccacctcagacaccccatgatcacaaaaactttattcttcaataccttcttctttctcctttatttctggaaaatgttaatgtctttctcttccgtttcttctctctccttttctttgttccataatatccatttaatagatattaaaaaatatctattctcagatgtttcgtcagtatttttacatgctgataattctttttcccttttcctagataaaactgtcaatgcaactacatatgaaaaatccaccattgaagaagaaacaactactagcgaaccctctcataaaaatattcaaagtatttaaattactacactgtattcatacctggagaatatcattatgtgacttaaaaatttaagtttcactactctgagcattacataaagccatagcatgcttaaagaatttatactgctaccttttaaagtcactaaaatcttttaaatggtgaatgtctaacagtcagtcttcaggtatacctgacaaaggatgagaaatgagcttttgtagaaatagaactttattttaataaaaatgtgttacatttgtgtctatattaaatacgtacttacaaattagtatatatttataaatatatgtcgaatgtatttgaaatataatttattttgctaataatggaaaatattctgcctgcttgaggaataaacttatctctggttagggtcaattattagtgtttcctatgattatttgaggttgggagtgggaggctgcaaaatcaaaattaccattttacttccctgtcaagaatattgttccttataaaatatgtgtggagccataacaacccaggatggctctcctctaaggtcttgaataagcggcctaattgaagagaatggatacttacgtgtcgttacatgaaaccctattttctccagtttatgcaatccaagtatgtttctaatgtaattattctgaattagtttgcatttttaacactactgaaaaaaatcttttttgatgtgttttaaaatgaaaacctgatcatcctggtattccccttcttaaacgtctttagtaacttactactaagtttgaggtcaagttttaactccttaaccaagcattcaattccgaaacaatctggccactgtgaaaattttccactctcaactctggttacgttctgcatccacacccttcactcaagacttacctgaagctcccagagcttactgagcctgcttacgattgtgcgtttgctcacggctggaatgagctcgctctcaccttgtttgcctggtgaactattgctagttctctaagcttatattggaacatcatctcccttttgaagggtttctggccttaagaagttaaattaaaccctgtgcataccacctgtgcatttccattaacgccttcattaatctgctacataagcagcaatgattcttgtctgcagccaaaattaaggtgggttccttgactgtaatgtctgagccttgtttacttctataagttagtgccaaccacaggtctgacacattataggagctcaaagtttaactgctaaatgactaacaaacgaatgttcctcaaactaaattattttgttatcctgttgttttcttgttgttcttgttgtgttttgttttgttttaacaggatcaaccccaaacgtgcctgcattttggacaatgttagctaaaggtaaagtcatacagctaggtagcttgggaaacattttggttttctaaaatcttacttagagctaagatcagtctaaatacctctaatactgagacaataagtcaacattttgttgccacatgtaatagcaaacttcaaaacaaacctagaaaggtgataaagtgtcacacattttctgattactcactctttacaaaagttttattctcttacaaatgttaaatgttattcaatttatttatggttaaaatttttcaataagattcttgctcaatatcattcatctttgtatttggagcagtgcatgcaaaagcacacagatgcatatataaatgcaaagtgtataccaaaatatatgcatgcataaaagtgtgtctcataaatatgtaagcatgcatgtatagcatgatgtacatagtatttctatgcgtgtgtgtataaatgcatgtgcatatatggatgtacacatgtataaaggtaatgcatgtatcacacagaaatatatgcattgtatatgtgaaatatataccatattcagttgatcattatttgcatattctgtgtttgcattctgtatcacctactcattaatatttctttgtcaccccaaaatcagtagttgcaacaccttcacagtcatttatggacattggcagagctttgaaaatttttgattgtctgacacacacattcccagctgaagtagaacaaggcaatattctgccttctttattcagctctcgttctgtaaataagtgtcatttttgcagcccacttaatgccacgttttttgcattttttgtgcttttttgttgatgattttgctgtttaaaatggcccccaaatgtagtgttaaattgctggttattgttcctaagtgcaagaaggctgtgatgttccttatggagataatatgtgttagagaagcttcattcaggcaagtgttatagtgctgttttctatgagttcagtgttaatgaatcaacaatatgtattaagtgaagtatcttttaacagaaacacacataaaacaaggttatttatttatcagttgatgaaaatgctgtgaccagacttgcaggaatctaaccctgtatttaccctgggagcaacagttcagtattcgttaatacagtgtttataagactttatagaatataactgccacgaataatgagaacagactgtacacacactgggtactataattatacatacacatacatacacaggcaataattttagtaagtgaacgttgtttaccataaccccaatttgttttaacagctataaatggaacagcagtggtcatggatgataaagatcaattatttcacccaattccaggtaagaacaaaatatttcaattgactgggtgcagtggctaatgcctataatcccagcactttgggaggctgaggcaggtggatcgcttgagtccaggagttcgagaccagcctgggcaacatgacaaaaaccttttctctacaaaaaatacaaaaattaggtgggcacggtggcatgtcattgtactccagcctgagcgacagagtgagaccctgtctcaacaaatgaaccaaagtacttcaactaatagacacataaatactcttacacatcttagtgtctttatgatgataatatttttcctagtgaagtctggcgtatgaaaggtgactaacatctcagagaggacattcactgttcaggagagttatagttcccaagcattcttttttagttatacctcccacatgaccattaccaccttcctgttttgtaacatttattcctgaaaccaaatggaggaggtgagtgaataatatgtagaatgcagtcttttttcaaaatagactttatttttagagcagttttgggtttaaagaaaaatttggcagaacgtacagaatttccatatttcaccctcctcagtttcccctatgtcttgcatgatgtggtacctttgttacaatttatgaaccaataatagtgattcattattaattgaagtccataatttacatcaggattcactctgtattatacaggtctttgggttttgacaaatgcataatatcacgtgtctaccatcccagtatcatacgaaagtttcactgccctaaaatctcctctgccccatcaattcatccctttgttcctctctcctcctgaacccctgaaaaccactgatctttttactatcgctatagttttgccttttctagaatgtcatatagttggagtcatacagtatgtaaccttttcagactagcttctttcactcagcaatatgcatttaagattcctccatgttttcttgtggcttgagagctcatttatttttattactgatattccattgtatgaatgcaccctagttcattcttctactgaatgacatcttggttgcctccaatttttggcaattatgaaaaaagctattgtaaacacttgtgtgcagggttttgtgtgtacataagttttcgactcattttggtaaatacctatgaatatgatttctggatcatatggtaagagtatgttcatgtgcagtgggtggcttgcctgtaatcctagcactttgggagggcaaggtgggaagatgagagtggttatctttgtaagaaactaccaaactatcttccaaagtatttttggaattctcaccagcaatcaatgtgagctcctgttgctggatagagttttccttaatggcttaattatactaatagaggtaaaactcctaatttgaatggaaaatttcatgaaagaaccacattaatttccccaaaaaaaacctctgtcctacaaataaatggttgaaaaatagcatgatgatatatctaagacctgtcccctcatttgtgcactggattgataagtgtggccatttgccttgtggcgcttcaagaaaattgagtcatttgtctgggtactgtaatcccagcactttgggaggctgaggcaggcagatcacctgaggtcaggagttcgagacaagcctggccaacatggtgaaaccccgtctctgttaaaaataccaaaaaattagccaggcgtggtgttgggtacctgtaatcccagctactcaggaggctgaggcaagagaatcacttgaacccgggaggcagaggttgcagtgagctaagattgtgccactgcacactgcactctagcctgggtgacagagcaagactccatctcaaaaaaagaaaagaaaagaaaattgagtgatccttctttgtttagaaaagttataaacaggaatgacaaatgctggctcattttataaatactgtgtcatttctcctatttaatatttaagtgattaaattcagcttgactgattttattgtttattgagcacatactacgtgttaggtgttgtagatacattattatgttagtcttcacagcaactccatgaagttggtattatcttcattttacagttgagaaaactgaggcttagagagaaaagctgcccacgcttgtaactagcttttctgtcacttccagtgattacgaattccaaacccttctctagttctgaccatcacctagataaagaagatgtactatgagcacacatctttattaaaaaccctttcaggagacagaaaagcaattcaggagcacagcccattttaacgtaatttgtttaattattcccaaaataacaggcctcgaagcattaaaagagtcattgacaactgtatacattttcatagtctaaggtcacacactgacaattataattttttaaaatcagagaatatagacatggaagcttgtcattgcttatcacctaaatatcattacctagaaaatagtgaaaacccttggaacttttgagttggcagatgctgggggttggctggggtaaaggggagaaataacatgttgccatcattaaatgtttattaagtcagatatatattcaggaaaatgtaaaatttggcagtaaacctatcatttcattaatagatttagttaaaaaaagactcttgatatctctggatccagacataatcttatatttaacttattttagaaagttaaataaattgattctatttatttttgtaatgtgaagtacactaggtttagtcttttcagtaataaaatggcaaaactagcccttaagcttcatggaggaagcattcactataccacccttttagcttaaaagaaaaatcagtgtatgacgcagcactagagcatgcacctttacctcctgaaagactggtcccttgtgtgtaagtcaatcgttttgaataataatctcttcagacatggtagattaaatcagagaaagtctgctatatatgcattttgacatctggtaacccggatttgcaaccagcttttgccacttactatgtgctatgcgcaaacacagaaacttctgtgatactgtaaaatggagctaaggacagctccttcggggttgctgtgaaggttaaagaggcaagttaatagtgcttggctttagagagtagctttctcctttgcattgcctgcgggatgggagaccggccagttaatactctggatggtggagggcttgcttctctgtatttgctttgcaatctttactccttcaggagaacacactgaacaccctattttccactgcattctctttcttttcagagtctgatgtgaatgctacacagggagaaaatcagccagatctagaggatctgaagatcaaaataatgctgggaatctcgttgatgaccctcctcctctttgtggtcctcttggcattctgtagtgctacactgtacaaactgaggcatctgaggtaagtctgcagacctctgcagtctttacaacaaatgcatgacatcgcattctctccctcctctctttagtagattcttaggaatatgtgacctctgaattcatccatacgacattcaaattgattccatttaccctattcggatggagcacgggactgtctttaagggaatatcctacttgaactttttcccagtagtcatccagagatagaaataaccttagtcaattggaaaggataaagcgaatctagatatgctcttttttatatagccctggagcaaatatattttgttctgaatagcatatctgcttagcatctaatgttttttattcaagcaagccttgagactttgaaaaaacagccaatctctatcacctttacattgtgagacctgtccagaggctctttcttataaaaatattaaattcaactcaagcctgattgaaggaattatttaacatttttcaggcagtgtaacagattaccttcaaaaatcctaacagaattgcttaatgttcataatgatcattaattccattcttttcattgtgctgtttttgacgaatggtgtatttctgtggtccattaaaactgtgatcctaggtatttattccccatcattcaatttcattgtacatgtttcttattaaattttattaaggcaacttctactgttttagtaaattggtttataaattctagtagagatttgaaacatgcttcaaagtgttacatagaatcaaattacaatgaaagaaaaactaggccgggcgtggtggctcacacctgtaatcccagaactttgggaggccaaggcaggtggatcacgaggtcaagaaatcaagaccatcatggccaacatggtgaaaccccgtctctactaaaaatacaaaaattagctgggcatagtggcgcatgcctgtagtcccagctactcgggaggctgaggcaggagaatcgcgtgcccctgggaggcggaggttgcagtgagccgagattgcgccactgcactccagcctggagatagagtgagattctgtctcaaaaaaaaaaaaaaaaaaaaaaaaaaaaaggaaaagaaaagaaaaactatatatcattcacataatgttactaagtaactaacactttgggcaaaattcgtatattttaatttttgaatgcttttctaagctgagttacaaatgtacacaattaaaaacaattcttgatatatgttcttttcttcttcagttataaaagttgtgagagtcagtactctgtcaacccagagctggccacgatgtcttactttcatccatcagaaggtgtttcagatacatccttttccaagagtgcagagagcagcacatttttgggtaccacttcttcagatatgagaagatcaggcacaagaacatcagaatctaagataatgacggatatcatttccataggctcagataatgagatgcatgaaaacgatgagtcggttacccggtgaagaaatcaaggaacccggtgaagaaatcttattgatgaataaataactttaattattttgtc

SEQ ID NO: 117 - DNA, 685336 bp, Homo sapiens
tgttgtgcgggttaatacaacaaactgtcacaagtgtttgttgtccgggacgtacattttcgcggtcctgctagtatgcgtggtgttccactctggcgcccaggagaaaaactacaccatccgagaagaaattccagaaaacgtcctgataggcaacttgttgaaagaccttaacttgtcgctgattccaaacaagtccttgacaactactatgcagttcaagctagtgtacaagaccggagatgtgccactgattcgaattgaagaggatactggtgagatcttcactaccggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggcataaacggagttcaaaactacgaactaattaaggtgcgttttaaaatcactttgttaaagatatcatctcattttttaaagagtaaaataaaatgatattaatgtatttcaaattttgagtaagccatcaccccaatttttcaaaatttatgtaatttaaagcatagtggagaaaattcatcaatgcagtttttgcaattacatgtggattatgaattttcatggtatgtatattcattttcaaacagttgtgtttccattaatctataaagggatcagacaaggaggttagccctgctacttacaaatcagtagtttgcccagcttcattcttttaatctgtccagtcatgcttctgccaaaaacttgatataagcaaatcattaagaatgaatccataaatctgattatcaatttttcctagtgattactttagatacacaaattttatcttgccatttgatatggtgccaaataaatctatttgagaggtgactagaacaatttaatttattactagcatttctgaacatatatagataaatatttttcatgaggatttcaaggtaaggcaaggtctttagcatatcctgaatcatcaaattgagattaaattttagtcaatgttctgttaatgttaaatattttctttttttacaattatttgaaaacagagtgttcatttgttgtaaagggtaagtaagccttttaacaaaaaagagtcaatcagttaatttgaataacctattctggcttgatttgggtcttaggatggagaagttagagagaagaatagatagaatatttggtattcttcaaaatatgtgcagagggggcacatttatcaagttaatgatcaattcttttaaattacttatatgttataaagagaaatagataactcagatttgggtatgtgaaatagtacaatgcacttgaatgatcttggaaaatatatgttaatgaaataactaatgtgcatgtttcagatagatatgttcaggggattttcacacttttataaatattctgccaaactatgatctatataataactagtgttaaaaatatgccccaaaacatataaataagacattctgatatatatcatctgaaggttttgacctggaggatatataatatgggaaaatttctcaactaatgctgatctattgtaaagatatatttatttataaattcattcaggaatggaaggctacaaacctcttgagcaaatttcggtgaaatgcagatatgtttgagtatatgaagtgaaaacagaaagagaaggatttggaaaacagggaactcttgaatactgttggtgggaatgtaaattagtacaaccactaaggagaacagttttgaggttcctcaaaaaaactaacatttagatgatttttaagtgagcactttggggtgaagttcctgcaatgacatctccttatctgatgaaatggaaaaatattcaggagtcagatagatatggatcacagttttatgcttacctcttaccagacatgctactttcagcttaatctttttgacctttaatttcttcagtcataatatgaggatgataatatcacaggggcagaattgggaagaataagcacttagtatggagtagacatacctgcatagaagatttttgaacatgctttaaaacatttaagtacttatagaaatgtgaggcttatcacttgacataataaattgagtaacagagtggacagtctctctctaaagcaacacttcacaacagaattttctgcaaggacggtaatctgtgtgagaacaatgcagtagccaccagtcacacgttgctgtagagtccttgaaagtacttagtagctagtgctactaaggaactaaattcttaattaattccattttaattttaatagccacgtggttagtggctatcatactgcacagcacagcctaaacaaataaaaaacgtttatttggacaataaaaattaatagataaaatcaaaatgagaccttaccaagtttaaatcagatattagcaatagggtctcttcaactgaccatcttgacaaatgtgttgttttaaaacgtagtgctttattcaaagaataattttgtcatgtctcccttagggcagcttaatgaacttccaagaaatttctgatttgtcttgaaagctgcttaactaattcagataaaacaaataagcctgctggcataattttagctttgttaaaatgtgctttcatttgacattctttgaaagattgtcagcaaatgacaaaaagtctcactacaggttcttagatgagtcttagaaatgctctaaaatttctttctgttttagaatgtgtgataagcctaaagtaactatatgatgtgcctaaagtactgaggcatttgtatggccccgtggacaaatactgttttgactgcttgttaaaaataatgagaatggaacacaaagcatagccccaggcatgcagacagccatgacatgggcgactttaactgaatgcactttgactcgcaaaaagtccctgtcatgaaagtggcatatatgctatgggaaaggagacttaaagaaaaacagagaaaagaagcatgtgttgattcatccataaactttagtaaattttacaatgtgaaataagtaggccaaccataataatttcttttaaaaatccctttgtcctgcagaataggatgagaatttaattaatattaattggctctacttttgttgaatagacaagaatagaaaaatcaccgtttatcctaactaggctaatataaaatgtatatgaatagttcaaatagcaaagggagagaagggagaaatatagagaaaaattctaggaaaaaagctcaatttaaatatttaaataggtcaatttatacatgaaggtgtcctatttactatttgatattaattaactgaaattaaaggcattggtggaaaatattaaatgtttaaaatgtatgtagtataaaatttcataagacttaaaacttagaatatttatttctaaaactaatatatacatatattaatttagcttaccttttgatgactttcagtataccttggcacaaacagggaaagtattatttcacattttaaatatttggaaaatgagtttcagagtgataatgtattatgcttatcatcatatgactggtaaatgatagaggtaggaaccagagtgcagttcctgactcctaatcaacagacagattgtagatggatagataaccttcagagcaggatcactgcaagttcatgatacaaaacgaaaagagtgaaagaaagaaaaaagactgggcgcagtagctcacacctgtaatcccagcactttgggaggctgaggcgggtggattacttgaggttaggagtttgagaccagcctggccaacacagtgaaaccccgtctctactaaaaaaatacaaaaaaaaaaaaattagccaagcatggtggcgggaggctgaggcaggagaatcacttgaattcgggagacagaggttgcagtgagccgagattgcgccattgcaatccagcccgggtaacagtgaaagactctgtctccaaaaaaaataaataaataaaatttaaaaaaattaaaaagggaaaaagtgggggaatgaagtgattaccaagtaattctgcttgtttaaaatataagtaaaaataaaacttatttatgtgactttgatgcgattaattttcaactttttaatggatcatgttactctttaaagaaaaaaaatcatctataagagttcttgatgttattaatagttgccacttaaaaaagaatccagatttgaaagcttctcttttctctctttcaagtaaaatcatactgcaatgctaattccctatatacattatagctatttacatactcacacacatcgtactacacattgcagtatttggaagaactgttgttcaggagtaggaaatcacagatctctttaactttcactttttaattcagatggcctgttatttataaagctttttaaaatattgtaagtattttttgacagggaagccaacattttcacaaatagaaacatccctcaagcacccagtctgactcagaatatgtatataaaccacagggacttccttcttttctcatggtaggaactcaggggaaattagtttatataatgatgttacggttatttttattttctgcttcaaatttccatcttccgtggcatatatcaacagtcacatttctgtactagcccagtgacagtgtgctgattgatttccttaaggcaggcatgacagtgtttcaaaggttgacaatttttgttgacagaacatgaagatcaactttttctcagattagtgatcctactcaaggccttcccttgtttctacccatcccataaggcatcctcatctgttccatgaatctcaaaagatcatttaaactggggtagtcttttaacatagtcaagatgtttgggcccttgtttttattttaagtaaacatcttccccattgatcaaaagctggactggatttatgaaactaaggttagaattagatttgttttgcgatctggggttagaaaatctaaattgtgaaaaatctcacctaccacaagatttagaaatcttgatttaaaattgccaagaatgagacatcaaataatacattgtgaagacaaagagcaagcaaactttgttgttctgaagaaattaatattttttaacattatgtaaccataactcaaagtgatgtgtaacattagaagtgagtaaagattcattgatgtcagtgcagagagaatatactataacaatgagtataacaattttagaaaacttacttagtttatttgcctccaagaggctcagaagagtttgaatataatgatttcctcattttttcaaatataaaatgaagtttcacttaaaatttctccatttcagctttaagtttacttgattttatagtctctgaattctataatttgcatattaatatttttgatctaatgttaaaaagcaaaagagatgacaatcaaatgctaacgactatgaggtttctgaaagctggggttattatcaaagtacacttccactggggaaaaaatgacaacataaaactcactgtcttcataaatgaatctttattaatgctgtcaggtcttaacaaatgagagtgtgacactaataggattaagtaacttttgacttcattactattatcagagtcttggttagtgttcatcgtccactaatgccttttgttaaatatatctgttattaaaaatcccacagtatggatggacacttatggaacataagttggacatcgtaaatagttcaattctggagtttataaattgaggctctgaagaacaaatgtgttcccaaatctgaatgatctactcacatcatgcctcttaacttaatattaccaactaactataagaagcaccactaaattttatgttattagatacagatttattgatctgttatttcattgtccactgtatctaagtaaaaataaatttgaacttaatattattcttgccaaaggaaatgacttaaatcctaaaataaaaacatatttttataagacaaaattaattggtatagaattatttaatgaaaacatgaggttgtattacacagatctaattgtctttaacaactttgatcaatgctaataatctaagattataaatatcccaatgtgggtagttttcttggcataaattattctttttgtctacactgatttatattgattatataacaacactgctgtggagacactctcttagtgaactgaagtgtgatctttcaatcttagataaaataaattgatggattggtaagatttctgtatcagaggtgatgacaccttgtatgagaagtgatgataaaagcaataaggtcattctgcagaaaactttctgagtttgtttgagttttatctataaaataatgtatctatcttcatgattttaccagggtatgagtttggaccagtttttgatggaattggtctttagcaaaaactataaagtgcagatgaaaactaattctcacttaaaaatcaaatactgaagaaattaatattctcccttttgtatttatcagtgtacagtcatcttcacaaaactaatcaagaatgaataaataatctagtagcctaatagaccaaataaattgctttgaccacaaattaaattttagccgattgttattcaagtgtctttcaatttcccagtgcaggtagatgtcactggaggaaggaaaatattgagtctaagttaattaaataacgcagaacttaattttcttaattatttttgaaatgtccttttttcattggtcttttgcttgcacaaattatatcttcaccaatctattctacaaataggtaataaagtgttttatccataaaatgttaaatatctattactagagcactaagggcatcaaaatagaatacatgtggacacacacgttttagcaattaaaactataaaaatatcgctagttatctattttgtatttcctttgaaatagaagaggtacttctaggtgaacaatcataagaaacctattgcttattatttatacattggaagagtatttagtggtagcatgttttaattgctgcatgcacatatctctatacttgctggtaaactgaggaaagtagtataacgtcatatataggaaacatattttaaaagacatattttgcaaagtaagtgtgaattttgtttcattaagcaaaacaaaggattttaaaagttgaaaatcataaaatgaagttttggattttctaacctaatttacatttgtctttgcgatctcacttaatctggaattttattttatgtagagtattatcatgaatatttctcatccttttacttattttatatatagaatttcattattttaagcttcttcaatacaatgaagtgaaattctaaagaatgaaaggctgttctattaaattttgtctagatgtaacaataactgactgctaactaatatcttagtctaattccagtaatctaaatttaacacatatttaatgagtgctcaatgtacaaagtcttgagggataaaaaatgtgtttggaaaacagtcagtgtccccaaggagattaataacaggcattatcaggattatatttttgctctaatgatagtaaagaggaaagtatttattttatatatacatacatacttgtgtgtgtgtgtgtgtgtgtgtgtgtgtgtgtgtatcttttttctttctttttctttgtgagacacagccttgctctgtcgcccaggctagagtgcagtggcacgatctcggcttactgcaacctccacctcctgagttcaattgattctcctaccttagcctcccgagtagctgggactacagacgtctgccacaaagcttggctaattttgttgttgttattgtatttttagtagagacagggtttcaccattttggccagggtctcaaactcctcacctccagtgatcctcccgcctcagcctcccgaaatgtcatggttacaggcatgagccatcacacttggccatatttattatgttgtaagaacattttatcttaaattgatcatgctgccattaagaaaatggaattatttaaagttttattgtctcagaaaagttaaaattttatatctatttttagtagatttttaccaagcactctcattaacttatgatatcttattttgttactaggtttgcaattatggcagtaatactttttgccaacatttatctgtacaatcattttgagactggaaataaaacgttttgatgacaatggtaattcttgtgctagttgtggtaattacctaagtctttctattatcttaattctcaaacttgttatctgtgcctacaattcctctcctatataatagagaaaattaaaattatccttatgtagcatgcagggatattataaaagctaatgatataagtaaaatctataaagtttgctgagtaccctgaagaaaactgttctgtaaacaatagttatgggttttactctgtaggttgaggttaattatagtctttcacaatttttctaagacttgatgcttcatactccttaaaaagcctattttacgacttaaacttagttttccatacatgttttatgtatgtatacagagaaaaatatgacaacattaatctatttcttgatcagtgccactggctctacatttttttctggacctagttcagtttttgttttgttttgttttgttttaagtcttccacttaccctctttggcttatcttttgaatcaaatgtctcctcttcatttgcctttgtctcctcgtggccctccatatgacagtgatactgctaatatgagtactttctcatatactgcctctaccatctggaattgctttatttacatctcattcatatgaccttatttttttaaaaaagatttcctctcttcttttcttttttcaagctgagaacttattttcctatcccctttctaagacaatcacgactgttttttttttccagtagattttgtagaagaggtgtgtaataacgtacttgaacttttttatttttaattattctaaattaaataggtcttaaaatatcctttttcaagcagaagatttgctataacaagcctttcctggatgctagtatgtttttctggcttataagagagccaagatatcctctgaggacaagagttgtttagaagaattcatttaaaatagtttgaccagggaaatatagcagaataaacagcctgcatcctaaggacagtggaacaaggggagcattgctgtcagtaatgcaaataacaaagtaaatggttaacagaagaacgaagttgtgttctagataatcatacactgcctctacggtctggatgcatgaattctagagaaacaatttaatggactataaataaattaagaagtttaatactttatagattacttttagttgaacagagtgctttatttaagtcactgaatgattatatgcatgaattttagattgcatatagatatcaaaaagccaaagaatatgatcatgcttagctacaagctaatgcatattcaattaactcccattaaactaccttcaataaataagtaaatataaaatgaaggctacttacattgtttgaatacacaatataataagattctgatgctgattatttgattttgtgtttagtggtttcatactgcttttgcttggaggatgtaagtatttaacagatcctgtgtgtttcaggaggcatttaaatcttttaattttgctgtgaggaaagttattcctaagggatcagtcacagatagctatattacccccatcaaatgcatcattttcctagattccaaaccctatgtagaaatctccaagttgaagaagtaacaatgaccatgctatcaatgtttaatcctttggaaaccatagtaatggtataggaatgcacctttttaactagaagtactcatgggcctggaaaagtgaagatgacctcatgggggaatggatatatggccctaaactggaaaatcattggctggcttctgtataggctatttatagcccatttattcatctgcagcttttaagattctaaacatttctctataatctattttccctatagtttgaggttaattatactctgtttatctatatgtttaagatcaattacctaactgctaaaatgaaagcattttcatatagctagagctctcacacagaaaactagtttacgtgtaaggtaaccagtttaataaaactgataatctctttagctcttagaaattggattttaattatttatctaatagacaagacttcttaagctatattttctactcaaatatactaatggaaatgtaagtaatttaaaatttttctccaactgttttgtggatgttttgtaaactgtaatctcattgtaactatgtctggtgttctacaatctagactataaaggtgtgaagcaaaaaaaaagatttctttctgaaataatgttttgcattactattttacaccacaaaatagtgactggccttatttaggtattgattaatgtaaaaaatggcattttacccaataaccttcctgttattaccaggcaactatgaaatttagtgacacaattatttttgtttctttttttcatcttaaggaacaagttcttaattagattcgatacagctataagtaaacataaactatgttcttatgtaacctcaagagttattttaggccgggcgcggtggctcatgcctgtaatcacagcactttcggaggccgaggcgggcggatcacgaggtcaggagattgagaccatcctggctaacctggtgaaaccacgtctctactaaaaatacaaaaaaattagccgggcgtggtcgcgggcgcctgtagtcccggctactccggaggctgagacaggagaatggcgtgaacccgggaggcggagcttgaagtgagcccagatcgcgccactgcactccagcctgggcgacagagtaagactccatctcaaaaaaaaaaaaaaaaaaaaaaaaaagttattttaaagtgtctccatgccttgttacacagttcattgacaattgtttaatctgttgctgctaagtttccttaaatttgtgattatttcaatgagttagtgatagtttattcacccatatttgtggtgcattgccacaaggaattattgacacttctttttactgacaacagcttttttgttttgtgtttacagtgtgatgttgagagttttgttgtttcctcacaaataactgactgcataactctatgctttcctacatggttagcaattgctatttcatgaaaaattggatttgctttcctagttgcagttatcagtcggtgcttcttaaaaagatagctgtttattttgatgactgcttaggcaatatttattattaagtattgctttctcaaatgatttttcacagaggcagtggacaaatggtttgacctgtacagtgtacagtgtacaaagattcattttgtagcttaaagaatgaattatctttgtgtcctctgtgtgtgtgtgtgtgtgtgtgtgtgtgtgtgtgtgtattatagagacagggtctcacagtgttacccaggctggagtgtagtggctttgcacaggcacaaccatggcatgctacagccttgaactcctgggctcaatcaattcccctgcctcagcctccttagaagctgagactacaggctagcactaccaggcccagcgttttttgtacattttttaatctgtattttatcctcatatgaatttttgttatctatttgccttgtataatattaggatgggtatatcatttatcctccaaattaagattaaacagggacattaaattaaattaaacagggacaaccagaatatatagtcacaatatttaaaaccccaaatttctacagtaattccttcttttccattttacatccttcttctcaaggtctggtctaccttgagccagagagctgccatcttctgcaaaacatcaatggggtcaactattatttgcacaaacttgaacttcactctgttttaatttagcagagcgactctcaggctgacttggttctgttggcaaaagactagcttctgaagaattgtctaacagcagaaacgctgtcatcaagcttgtacatagggtgaatttttttctgagctggcattgttcatctaatgtagtgttttctaaagctaaattttacacacacacaaaaaaaacagacatggaaaacgggcataattgcatttagaattatgttacttttggacataagatttctatttcctttgatactattcaaatagatgaagactatgtcgtttgcttctatgcactgatccacaaaatgtaggaggtattaaatgtcttgccaagttactaaacaagtaaagttttcagaagctcaatgtgtgaccgagtttctccttttctacacatatttccctaaatagccatttgtctacaggccatttgagtatagcctgaagacaggatgagatacagaaccacttaagcagctttccaaaatgaggttttagattgtagagccaaagctctgagtggtttttgtaagagaggaattttttttttgttttttttttttcttgagacagagtctcgctgttgcccaggctgaagtgcaatgacgcgatctcggctcactgcagactccgccccatgggggttcactctattctcctgcctcagcctcccgagtagctgggactacaggcacattctttatgactttatctccatggacatattcttcataaatatttagaacagcttatactgtcttctattatactggcttgaagataattgataccattgatgcaggatcaagtgttgtctctttgttcatctacattacaaaacatggtgtcaccaataatctaattgtttttgttatactttcctatgttactggtttgaagataatcgataccattgatttgggatcaaatttgtattttgctgtttttctccattcatcaacagtacaaaatgtgctgtcacccataatagtttatttttgcatcgtatgttttggatttctacattcatttgcctgaatttttcactcagggttttggatattatatatttcatatgcagcatgtatcatttgttggtgacttaaatgcctgtatcctattataacagaactaatcacttttctaaagataagtataagtttggtccacaaaaaaatttctatgtgcattgactcattgaacctgctacgatgaagacttctactttacaattcaactatgcatatcaggattactgatttctttatatgacattacttatgaaaagaagtaattttatgaattactaaacactttccaagtatgtttattttgaaacttgcctttaattaatagagatagcttgaatatttagcatagtccctaataaaaataattgaattaaatttaagtatctagtcaatagaattaatagcaattgctataaacctaaataattatggtgataataaaaatcaagttaaatacaagatgtggtataggggttcagttagcttaataatctaatgttttactagtccacattcaattttagagtaatgatgttgaaaatgcaaattacttattattaggttccttaactttactatttatttgctttttagtttttttaaagttttattttaggtttaggagtacatgtgcaggtttgttatataggtaaactcctgtcttgggggtttattgtacagattaattcatcacccaggtactaagacaggtaagtacccaatagttatttttttctgctcctctctctcctctcaccctccaccctaaagtaggcccaatatctgttgttcccttctttgtgtccatgagttatctttatattaattatttttatttcactacttggcagtttgccaaatcagaaacttgattttgataagagaaaaatgtctatttcagaagttaaaaatccgtatttaccaaatgtttaccagtctactatcattgatagggttcactatatttcaatacatatatcccagtgttgtcaaatttttgagatattgtgattttattagtgtttgataatgaaaacataacttcaaagtctattacctgagcattgctttaatatccaggattctttgtacatgccattatgttcctgaaagtacatttagcataatatgtatagctaatttatttgaaaacatagccaattcttcattattcagaagttaataatcaaatttcatgaatcatatccctccccactacatcctactacatttcattttccttcaaaatactttaaaaatacttcctagaaattatctactttagcaaatgcatttcaagattctcagaaaatattttttaatagtccagaattattcataggattagataagctcaaatctccattagatgttcttttctgttattagtaaactcccctctttagtttagatcagtgttgtagcacccttattcttggtttctattacatttacagtatcttacaaggagcagcatctgttactgttctaagagattaagtcaaaccaaataggtgtgtctatttagaataatagggatttttaagagaattataattggatcttgtaggtgtcacaaacctcagtgtaataggcatcattgataagagattcctcttttaactgtttattttggcattgctacattcgttttgaagattttcttggtagccttgcatacatgtctttaaaccatttttcttacaattagatgctgtgataacatacagaggctgtggatacctacaattttaacttctgctttgactcccagaaggaaagtataaatattatactggctctgatatattacaactttacattaatttttagacaagataaaaagtatttttaacatattttctaccatattgctcaattatcatccttttatcatagtaacttatcaatgttacaaaacgtttttgtgggcattatagtttggaactcaattttgagaacattgttttaaaaatcttatcaagatatgactttccaaatacaacatttgtattacaattagatgtataccttgttctttttttcacttttaaattaaaacatgtggctgctcacggattgaaaacaggtttacctatatatgtccttaccaattggtaagcattattcaaagtagatcataaaaaggagacaaaagccttgatattcccaattaaaaagatttaaactaaaaactccttctgctaactgtatactgttgaagcatttattgtataacccttaactatcaagaactgccacatcttttgatatttgtgacagctattttaggagaataagggagatgcaatgttataataggtaagggatgaagatcagcttcctggtagattacaaagtagtgataattctgctttcatcctattgtgttttttttctgcactatagattgaattacatattattgctcaatgtgatgctgattaattaagatgtagggagctgtggaaaattatccatattttgtcataaacttatgtttactgactgtacatcagaaaatcactaaataatgcatgaaattataaaaattacattaaaatattaaaattacctgtaaaacctagatatttaaaccactgtagtttttcatatgatattgtcagatcaaatacacttgccactttcatttaagaaataattaccaatattagatgtaagttaaaataaacataaaataaaaagagttggacatttattcatatcaaataaatagactaatgtcttctatggatacctactcttttccatatttttagttgttcttccatttttaatttttatgactacatagtaggtgtacgtatttgtgcggtacatgagatattttgattcagtcatacaatgtgtaataatcacatcagggtaaatggggtgtcctcagttctttgtcacctgtggttttagctctgattaagaacttgtcttggaacctaagtcaaagtttgattttaaatttttcattgaaattgacaggtcggctgaggaaatcaagatttctccagttctgtagtcaggtggtctgatcgttagactaattggatttacataaacccaagtattacattttacatatgcattgatttttatcacctctattttcaagctgttgtataaatgttgcagctttcaggccctacttccattggtaacagatagaaactggtttgctgctattctgtcctggcatacaaataatctaagtcaaaagcttcgcttttcatgtttttctaggatagtgagaggaaaaaaaaaaatttctcctactcaaagcatttatttcatttctattttcataaaattaggaattcattttttttttttcttttttgagacggagtttcactcttgttgcccaggctggagtgcaatggcacgatctcggctcactacaacctccgcctcccgggttcaagcaattctcctgccttagcctcctgagtagctgggcttacaggcgcccaccaccgcactcagctaatttcttgtatttttagtagagacggggtttcaccatgttggccaggctggtctagaacttctgacctcaggtgatcctcccgcctcggccttccaaagtgctgggattacaggcatgagctaccatgcccagcccaaaattaggtattatttgttaatgacttacgggtttttaattagccacaagatacgaaagtctaaacaaaagtatgttttgttatagtcagtttaatgccctaaaaaaatgatgtttgcacaaatgattctaatgcacaaatgttattagtttctatacatttatattttctcagagtcttttctgattatttgctggaccctacatttataattctatttatgccgatttcagagtaaaatttctattggggtacaatttagtctttttcttctaggattgcaattttcattctgttggcctagggcttctcaaccttggcattattgacatttgaagctagataattcttccttgtggggtggtgtgagagctgtcttatgtactgcaggaagtttggcagcatctctggcctctaccaaatagatcttagtggcactctcttgcctaattgtgacaagcaaaaatgtctccagagtttgacaaatgttttctcgggttgcggtgggggccccaggaatttcaacaatagaaaaccattgctttagctcacccttacacatattcataagagaggattttgtattttatagaaagattttattaactccaaaaaggagtcagacttgaaaaccttcaaaaaccttcaaatgatgagcattctcagataaaatatttcagaaatgttgaaacaataaatgctatttgaataacacatactttagtggtcataggtgaaatagtattaggacatatatcaagtcctttgataaaaagatattttatgaagtaatagtgccttttaacaaattcataatatgttataatttatcgtaaatgtagaagttactttcttatctggtgtgactgaaggggaacacagtgctaaatgataaaacagagtagcctgaggtggttttcttctaatttcaggtcagatttacatttcactaattgcacaaaagtttttcaatattaattttgttttgtatatacagaaaacatatttattattagcactagcaaaatcttatgtaatgaacccacttcataaatagaatatttatgttaatcaaatatgaatgttttgccaacctaatttcaaatcttaacataaaaaattggaatgagaaaattgatacatatgagtatattggtatatgtattataaatgattcaacctcagctagtaaaggaagttttattattttcaacagtaaaatcattatttttctaatttgatttcatagttatgtaagaattattagcaatgttaaaataataaactttgagcaaaactatttcctgattgttaatggataagaaaaagataaaaattgacatctagaattaggcaaaggaaaaactaatggaagattcaatatatgaatgagacacaaaagttgatagtggtgtgtgatagaactaattacaagcgttttttaagctaatgtttttagttatagatttatttatgaaaaattgttcttagctcttgaattttatagtgtttttaaatttttaatgtatttacttttttctttttaatttttgttagtacatcataggtgtatatattcatggggtacatgaaatactttgatacagacatgcaattgtcatgatcacatcgtggtaaatgggacatccattccctcaagcatttatcctttgtgttacacacaatccaatgatacttttagttattttaaaacatatgattaaattattattgactgtagccaccctgttgtgttagcaaacgctaggtcttattcattctttcttttttggtacccattaatcatccctacctcccctgcctaccaacaacccttgctagcctctggtaaccaccttctactctctgtcttcatgagttcaattgttgaaatttttagctcccacaaatatgtgagaacgtgtgaagtttctctttctgtgcctggcttacttcaattaacataatgatccatgcatccatgttgttgcaaatgacaggatctcattctcttttctgaatagtactccattttgtatatgtaccagatttcctttacccattcatctgttgatgaacacttcagttgcttccaaatcttggctactgtgaatagtgctgcaaaaaaccctgggagtgcagatatcactttgatatacttatctcctttcttttgtgcatatacccagcaatgggattgctggattgtaatggtagctcaattcttagttttttgaggaacctccaaactgttctccaagtgattgtactaatttatattcccacaaacactgtacaaggattcgcttttctccacatcgttgccaacatttgttaccacccgtgttttagataaaagccatttcaacgggggtgagataatatcttattgtagttttgatttgcatttctctgatgattaattatgtcaaacatcttttcatatgcctgtttgccatttgtatatcttatttcgagaaatgcctattcaaatcttttgcccattttttattacaatattagatttctttttctctagagtgatttgagctctccatatattctgattattaatcctttgtcagatgggtagtttgcaatattttctcccattctgtgggttgtctcttcactttgttgttgattgtgtcctttgctgtgcagaagctttgtaacttgatgtgatcccatttgcccatttttgctttggttgcctgtgcttgtgaggtattgctcaagaaatctttgcccagaccaatatcctggagattgtttccaatgttttcttgtatggtataatagcttgagatcttaaatttaagtatttactccgatttgatttgatttttctatatggtgagagataggggtttaatttcattcatctgcatgtggatatcaggtttttccagcaccatttattgaagagattgtattttccccaatgtatgtttttggcaacctcgtcaaacattatttcactgtagtagtgaggatttgtttctgggttatctgttctgttccattggtatatgtgtctgttcttatgccaataccatgctatttggttactatagctctgtagtataatttgaagtcaggtaatgtgattccttcagttttgttctttttgctcaggataactttgtctatactgggttttttgtgtggttctatacaaatctgaggattttttttctatttctgtgaagaatatcattggaatttttattgggattgcattgaacctgtagattgctttaggtagtatggacattttaacaattttgattcttctaatctatgaacatggaatattttttcccttttttggtgccctcttcaattgctttcatcagtgtttcatagttttcatgattgagattttttacttctttggataagttaattcctaggtatttaattttttgtgtggctattataaatggaaataatttttaaattctttgtcacattggtcactgttggcatatagaaatggtattgatttttgtatgttgattttggatcctgcatctttactgaaattgtttatcagttctaatagttttcttgtggagtctttagttttttccaaatataacatcatattatctgtaaacaatgataatttgaattcttcctttccaatttggataacctttatatctttctcttatctgatggctctagctaggactaccagtactatgttgaataatagtggtgacagggggcatccttgtcatgttccagatcttagagggaagaatttccatttttccacatttagtatgatactagctgtggatctttcatatgtgactttaattgtgtttagatatgttccttctatccccagttttttgagagtttttgtcatgaagggatgttgaattttataaaatgctttttcagcatcaattgaaatgatcatatggtttttatccttcattctattgatgatatctcacattgatttgcatatgttgaaccatccttgtttaccaggggtacatcccacttggttatgatgaatgatctttctaatgtattgttgaatttggtttgctagtatttttgttgaggatttttgcattaatagtcatcaaagatatttgcttgtagttttctctttttattatcatttttaagttccagggtacatgtgcaggatgtgcagttcattacataggtaaatgtgtgccgtggtgatttgctgcacctatcaacccatcatgtaggtattaaacacagcatgcattagctagttagctgatgctgtccttccctaactggcctcagtgtgtggtgttcccctccctgtgtccatgcgttctcgttgttcagatcccacttataagttagaacatgtggtgtttgattttctgttcctgtgttagtttgcggaggataatggcttccatctccacccatgttactgcaaaggacatgatctcatttctttttgtggctgcatagtattccattatgtatatgtaccaaattttctttatccagtctatcattgattggcatttgcattgattccacatctttgctattgtgaatagtgctgcagtgaacatacatgtgcatgtatctgtatcgtggaataatgtatattcccttgggtatatacccagtaatgggattgctgggtcaagtggtatttctggtcctaggttatattagtctgttctcatgctgctaataaagacatacccaagactgggtaatttataaagaaaaatagggttaattgactcacacagttccacgttgctggagaggcctcacaatcatggcacaaggcaaaggaggagaaaggcaggacttacatggaggctggcaagagagagcgtgttcaggggagctcccttttataaaaccatcagatctcatgagacttattcactatcacaagaacagcacaagaaagaaatgcttccatgattcaattacctcacaccaggttcctcccatgacacatgggaattatgggagctgcaatttgaaatttgggtggggacacagtgaaaccatatttttctgcccctggcccctcccagaactcatgtcatcacattttaaagccaatcatagcttcccaactgtcctccaaagtcttaacttatttcaacattaactcgaaagcccaagtccaaagtctcatgtgagataaggcaagccccttccacctatgagcctataaaatcaatagcaagttactttctagatacaatgggtgtacagggtaaatacacccattccagatgggagaaattggccaaaataaaggggctacaggccccataaaagtctgaaatccaatagggcagtcacatcttaaagttcaaaaatgatctcctttgacaccatgtctcatatccaggtcatgctgacgcaagaggtaggttcccatggtcttgggcagctccacccctgtggctttgcagggtacagcccctctcctggctgatttcacaggctggcattgagtgtctgtggcttttccaggcacctggtgtaagttgtcaatggatctaccattctggggtctagacgacagtggccctcttctcacagttccactagatagtgcaccagtggggattctttgtggaggctcccaccccacatttcccttctgccgtgcccttgcagaggttctccatgagttctctgcccctgtagcacacttctgcctggacatccagttgtttccctacatcctctgaaatcttggtggaggttcccaaacctcagttcttgacttctgttcaccctcatgcccaacaccacgtataagccaccaaggcttggggcttccaccctctgaagcaacagcctgagctctacatcggacactttcagccatggctgggatgtaggtcatcaagtccccaaactgcacaaagcagcaaggccctggtcccagctcatgaaacaattatttttttctcctaggcctcccagcttgtgatgggagaggctgccatgaaatctgcggacatgtcctggagtcattttcccattgtcttctcgattgatatttggctccttgttgcctatgcaaacttttgcagtcagcttgaatttctcctcagaaaatggctttctcttttcaatcacattgtcagactgcaatttttccaaactttcatgctctgccttccttttaaacataaattccataagttccaaaccatattgtagtgaatacataacactgaatgcttttgacaataccgaagtcatttcttgaatgctttgctgcttagaaatttcttctgccggataccctaaatcatctctctcaaattcaaagttccacaaatctctagggcagggacaaaatgccaccagtctcttcactaaaacatagcaagagtcacctttgctccagttcccaacaagttcctcatctccatctgagaccacctcagcctggactttattgtccatttcactatcaacattttggtcaaagtcattcagcaagtctctaggaggttccaaactttcccacatcttcttgtttatttaggatccctctaaactgttacagtctctgcctgttactcagttgcaaagtcatttccaaattttggggtatctttacagcagcaccccactctaccagtaccagtttactgtatcagtccattctcacatggctagtacagacatacccgagactgggtaatttataaagaaaaagaggtttaatgaatccacagtttacaacaacagtgtaaaagcttttctatttctccacagcctggccggaatctgtattttgtggacattttaataatcgtcattctgactgtcctgagatagtatctcattgtgattttggtttacatttctctagtgatcagtgatattgagctttttttccatatgttttctggtcgcatgtatatcttcttttgagaattgtctgttcatgtcctttgcccactttttaatgtttttttttcttgtaaatttgtttaagttccttatagattctgtatatgagacctttatcatagggatagattgcaaaaattttctcacgttctgtaggttgtttgttcactctgatgattgtttcttttgttgtgcagaagctctttaattagatcccatttgtcaatttttccttttgttgcagttgcatttgacattttcatcatgatgcctttgcccttgcctatgtcctgaatggtattgcctagattttcttctagggtttttatagttttgggctttacatttaattcattcatctatcttgagttaattttggtaaaaggtgtaaggaaggggtccaatttcaattttctgcatatggctagccagttctcccagcaccatttattaaaaagggaaccctttccccattgcttgttttttttttttcaggtttgtcaaagatcagatggttgtaggtgtgcagtcttatttctgagttctctattctgttgcatttgtctatgtttctgtttttgtagcagtaccatgctattttggttactgtagccttgtagtatagtttgatgtccggtagtgtgatgcctccagctttgttgtttttgcttggaattgtcttaagtatatagtctcttttttgattctatatgaattttaaaatagtttttttgctaattatgtgaagaatgccaatggtagtttaatgggaataccatctataaattactttgggcagtgtggacattttgacaatattgactcttcctatccatgagcatggtaaggtatatttttccatttgtttgtgtcctctttgatttccttgagcagtcgtttgtagttcctcttgaagaggtccttcatttcccttgttagctgaattcctaggtatttgattctctttgtagcaattttgaattggagttcattcatgatttggctctctgcttatctgttgttggtgtttagggatgcttgtgatttttccacactgattttgtatcctgagactttgctaaagttgcttatcagcttaagaagcttttgggctgagacaatggggttttctagatttaggatcatctcatctgcaaagacaatttgacttcctctatttctatttgagtatattttatttctttctcttgcctgattgtcctggccagaacttccaatactatgttgaataggagtggtgagagagggcatccttgtcttgtgctggttttcaagggagatgcttccagcttttgcccattcaatatgatattggctatgggtttgtcataaatggctcttattattttgagatatgtttcttcaatagctagttcattgagagtttttaacttgaagtgttgttgaattttattgaaggccttttctgtgtctatttagataagcatgaggtttctgtctttagttctgcttatgtgatgaattatgtttatttatttgtgtatgttgaaccagccttgcatcttgaggataaagctgacttgatcgtggtggataagctttttgatttgctgctggattcagtttgccagtattttattcgggatttttgtattgatgttcattaaagatattggcctgaagtttcattatttatttttatttttttcgttgcatctctgcgaggttttggtataagaatgatgctggcctcataaaatgaattagggaggagtccctccttttcagttgtttggaacaatttcagaagaaatggtatcagctcctctttgtacctctggtagaattcagctgtaaatccatctggtcctgtgctttgtttttttggtaagctatttattactccttcaatttcataactcattattggtctcttcagggattcgatttcttcctggttcagttttgggagggtgtatatttccaggaacttatcgatttcttctagattttctagtttatttgcatagaggtgtttatagtattctctggtggttgtttgtgtttctgtgggtaggtggtgatatcccgtttatcatttcagattgtgtctgccccagtgagatcagagttctgtccataaacccctgactggagttgctgatattcctgtagggaggccttgcccagtgaacagggatagatccaggtcccacccaaagaagcaatctggccacagtctgtcacagccactgtgctgcactgtggagaattcctcccagtcgaaaccttccagtctgtcaggccctggcagcagaaaatggctgtttggagccacagggatggctgccgcacctccccccaggaacttggtcatcttagtcagtctccagcctgctacctacctctgggtccaacccaaacggctgctgagattctgcacagttctgtgcttgggagccaaagtcctggtggcataggctcacaaaggaatctcctaatccctgagttgtgcagatgggttgaaaaagcatgatttcccgagcagagtagcacaataactccctcccttggctgagggtaggaacttcccttgccctgtgcaactagcagatgggccatcactccaccgtgcttttctctctgcatgggttgcatcaaccacctagtcagtcccaatgtgagaacctggataccttagttgatggtgcaggatgcactagctttttttgttcttcttggtgagagctgccaaccacacctgcatctaatcagctttctcggccccaccgccactcatcttggccccgccaacacccagttttctttttttgatgtgtcttagtctgatttttgtatctgggtaatgttggtctcatagaatgagtctggaaatattctctcctctattttttgcaatagtttcagtagaattggtattagttcttgtttgaatgtttggtagtattcagcagtaaagccatcgggtcccaggcttttctttactgagaggcttttttattacagctttgatctcactactagttattggcctgttcaggatttgaatttcttcctggtgaaatcttggttggttctatgtgtctaggaatttctctattttcttctaggttttccaatttattggcatatagttgctgatagtagccactaatgagcctttgcatttctgcagtgtcagttgtaaagtctcattttttcatttctgattttatttatttatatcctctctcttttttcttagttcatctggctaagagtttgtcaattttgtttaactattttaaaaagccgctttttgtttcttcaacaatcttttttcattttcttcatttcaatttcattttattctactctaatctttattatttatttccttctactaattttgggtttggcttgttcttgcttttctacttattaagatgaattgttagattctttatttgaaggttttcctcttttttgatgtaggcactaatagctataaacttccctcttggtactgcttttgctctaccccataggttttggtatgctgtgttttctttattatttgtttcaagaaacttttcaatttacctcttaatttctttattgacccactgatcattaagcagcatattatttaatttccgtgtatttgtatagtttccaaaattcctctctttattgatttctaggtttattctattgtgcttagagatgaggcttgatattatttcaattttttgaatgttttaagacttgctttgtgacttaacatatggtctattcttgacaatgatccatgtgctgaggaaaagaatgtgtattctgcagccgttggatgtaatgttctgtaaatatctattagatgcatgtggtgtatagtacagattaagtctgatgtttctttgttgattttctgttgggaagatctgtccagtgctaaaagtggggcattgaagtctctagctattattgtacttgggacaatctctttttagctctaataatattttctttatatatccaggagctccagtgttgggtgcatatatatttaaaattgttatatcctctgactgaattgaaacctttatcattatatactgactttctctcttcttaattgcttttgtcttgaaatttactctgtttgatataagtatagctacacctgctcttttttgttttccattggcatggaatatttttttctctttttcattttcagtctatgtgtgtcttcataagtgaaatgtgtttctcataagcaacagatcactggttctcagttttttcatccatttagccattctttgtcttttaattgaagatgttagttcatttacattgaataatattgataagtaaggacttactcctgccattttattatttgtttcctggttgttttgtggtcttctcttccttctttctgtccttcctgtcttcctctagtgaaggagattttctctggtgatatgttttagtctcttgcttgtcattttttgtgttttcattttatgttttttggtttgaggttattttgaggcttgcaaataccatcttataatgcagtattttaagctgataatagcttaacattgtttgcataaactgacaatcaaaaagaaaactaataaaaattctacaccttaacttgatccccaagatttttaactttttgttgccgtactatgtcttgaaaagcggttgtagttattacttttgattggttcattgtttattctttctacttaggataagagtagtttacacattacagttacagtgttataatattctatgtttttctgtgtacttgctgttaccagcgacttttgtacctccaggtgattacttattgctcattaatgtctttttctttgggtttgaagtactccctttagcatttcttgtagggcagatctcgtgttgatgaaatctctcagcttttgtctggggaaatgtttatttctccttcatgtttgaaggatattttcaccagatatactattttaaggtaaaagtttattttccttcagcactctaaatatgtcatgccactctcttctgatctgtaagatttacactgagaagcctgcttccagacgtattggagctccattgtgtgtgtgtgtgtgtgtgtgtgtgtgtgtgtattttccctctcttgctgtctttaggatcctttctatatcattgatctttaggagtttaattattaattacctgaagtagtctttgcattaaatcttcttggtgtaaaacttccttttactttgatattgatatatttttctaggtttggaaagttctctgttattattcttttgaaaaactttctacccctatctctttctctacctcctctttaaggccagtcactcttagatttgcccttttgaggctactaatatttcttagatcctgtgggcatgcttcgttgttttttattctttgttcttttgtctcctctgtgtattttcaaataccctgtcttcaagctcactaactttttcttttgctagattcattctgccattaaaaggctctgacacattcttcagtgtatctattttattatttaacttcagaatttctgcttcattatttttagttatttcaatctctttgttaaatttctctgatagaattttgaattccttctccacattatcttgaatttctttgagtttcttcaacacagctattttgaactctgtttgaaaggttgcatatctgtttatctaggctttgtcctgggtgacttatttagttcatttggtgcgatcacgttttcctggatggtgttagtgctaatagatgttcttcagtgtttaggcattgaagagttaggtatttattgtactcttcactgtctggaattatttatacccatcctttctgggaatgctttccaggtatttgaaagggctttggtattgtgatctaagctgtatgtgctttagggtacactccaagcccactaacactgtggttcttgcaaactcacagaggcaccacctcaatggtttggacaagatccaagggaattctctgtattaccaggcagagactgttgttctgttcccttatttttctcaagcagagtccctctctgttctgagccacctaaggttggggatatggtaacacaagcaccactgtggctttcaccactatgactgcacctggtcagacctaaagccagctcagcactgggtctcacccaagttcaagctcagcactgggtctcacccttgttcaaggacctgtggctctacagtcagccagtggcaaagccagctaggtctatgtctttcatttcagggtaacaaggtctctctgggaccaggtgggtacagaggtgccatctggaagtgagggactacagtcaaaaaccttagaagtctccctgctgttctattgtaccacgactgagttggcactcaaaccacaacatgcaatccttcccttgcttccctctactttccaaaggcagagaagcctcatcctgtagccactgccatcccaggccacagggagtcctgccaaactactgctgatattcccttaagacccaaaggctcttaagtcagcttgtggtgattgcttcctggcatgggactcacccttcagggtaatgggctcccctctgttccagcacaggtccagaaatgctacccaagggtcgtgtcctggaattgaggaccccaaaagcccacttggtgctctgctcccctgttgccatgctggtacctgaagccagctgtctagaaatgtcatctgggagctagggcctggaatgggggcctcatgactctatccagtgccttatcctgctgtggctgagctggtatccgggatgtaaaagagagacatcctcactcttccctctcctttccctaagtagaagaaaggtgtctcttttggagccatgaactgtgcagccttgggttaggggacaggggatgcttccccagctgatgtctcagtatgctgcatgccaccctagtccactgtcctatgcccagttctgccttaggccttgcctaagaattgtagtccttatggtctaggctgccttttaagtttacttagagacctagagcactttggcccttggtggcaaggtttgtgagaattcaaatttggaccactgggatcagtggttccccaccagatagggctggtttaaatgctccctctgtgggcgattgtcagctgcgtttggtctggtatttctttctgctctaacagaacagcactgagttcagtggctcacaattgctgtattcttcctcccccagtgcccagagaagctctctgtaccatgaggccactgcagcagttgggggaggagaagtggcttcggtgattcaactttttttttttttcttttaatctcttcagtgcctcttttggggtatgaggttcaaactaagtactatgagtgctcatctgattttttcattcctatgaaggtgttttttctttgtagatagatgttaaatttgtgtccttgtggggaggatgatcagtggaaccttctattctgccatcttgctctgtctttcattatggtattttttttcttttagtattgtggcatatgaaaaaatatttctgaccaaccacccataatcatttttatctaaactgctatcaatcattaaaaatgtctgtgtttcattgagcaaaactgggaccagtgtctttaagcttgtcacttgctgagtctgtaaagaattggttaattggatattaatggaaattttagttattcgaatgacttacatggttgctgaatattgtgccataaaatactggttctgactttcaatacatcattttaattaatgttggtgtaatttcatacatgttattaatctctggatggaggttagagattatattgtattgatgccctgattaaagtgtgttatattcacggcacttgaagaaaaaaatcactagtagtacaaaaatatcattgtttctcttaattcaacttgataccaaacataacttaaatcactcctagtttcgttgctatggggcatagtatcttaactagaaatatgaaatacttctagtaaatttgagtaggtaaagactccctaaatatataaacagtagttatgcttacagaaaattggtggcatttttcctatcaatgagttgttttaagatgagtcagagctaatgaagagtcagaaatcatctcagaagacatggtactttcttctaaaacagaaacagaaactattaggacaaatggcaatgaattctgcctccccctaaattaaagcaggaaagtatgagtcagaggtaaggcccttttaacatctccagatatatcccatggtgtcaggccaactggatagaccttataaatggacttacctgaagctttctttagcctctctgtgcatggcctcgtattttctgccctaaacttttctctttttacttcaattatcacttatcccggagacatatcacgactatcccatactccccattccttgactagtcttacctccaacaaagaagaatatgcattttagttaaaatccagatttataaaaaaagacacgtctatgattcccagtcctttgcctccactgggaaaaaatttttgatctgtttgaaatgttcaagggaaaaaagacccaagtttgctgcctctcccatgccatccttcagcttcccagccctgcctgtggaggtttgattctacttgggctacatcctacttctcaaaaaccaggtcactgagaaatctgggactttcattcatatatgtgtccaatgttttagtgaccaaaaataacaacaacaacaaaaaatctaccacaagattctgtcattcacccactatagcattaatgacttccaattattcaccagggacttgattagaatgagccatctctgactcgttactgccaatttgaaagtatttgcattaaagagcaaaagatacgaactattcttacaatgcttacccatttccaaaagaatgtgatccacagacaaatttgtcatttaccaaacttctctcaccaaaatttgccaccatctttattatgacgtccatttaatcaatagtcagaggccatgagacacagaagaaatggccttcttatgtgatagagaaactgaaatcttcttttggagaaaaggagatttctggactttgatgatagtagatccaaaagaaactggttgaggtcttttatcaatttagaaggtagaaccaatcagagttagaagcacccaagaagtcctgagacttaaaagataaaacaccttcatatgatcttaaatgtttagcactattttcccttcttgaagttgtattattactgacttcctttacctgaggttttcgctgacatacaatgaaccagaagcaactttagttttattttcctgatattaataagcaatcagttaggtttatagcagtgtctattagtgaaagatcatattttcatttttgattactgattttttaaagtttaagctaatcacaagttttcattaaaatttaccattagatcattaccctgcttctttaaaacaatagttcagataaagtacacctgcaacataaaaagcttttggacttttcttacaatgttcttaaaggacctttttacaagaaatttttaagaaaatcttctaagaaatgtaaaatactttataccagctattgaagaatagtaacggtgaattttattttgagaacctgactcaatttatacatagaaataatagcactcaatatttattcatattcttaaatgggcaagttaaaattgtatttaattatatactcttaaaattttagatggtatttctttggtttcttttttcaataaacattacttttaggggtggtagttttgaagggagcagggaagaaatctttttatcagtagctcaatattctgggatcagaaaacacaatagtttttgttttgcttttgctctttttgggcagtaattacctgataagtttctcatactgagagctctgcagaatacagagttcttgccagcatcaaaaggacttccttttgagaagtaaccatatttcagtgaaaaaatccttgaactaaaaactaagagacttggctttcaaatcgggttctgtaataaaccagctgtgtgatcacgggcaagtcacctaaccttactgtgtcttagtgtccttttcataagaggagaagtaaggctagatgatatctgaagtcttttctagtactagtattcagtggttgaatatcctatatttttgttatgaatgcagctcatctaacttaagcacaagagagcagctgctaaaaagagctgattagcaacaattaggagtggcatttcatttgtattgcatatcttcccaattaaaagcatttagtgattaaaattacatgcttgaaatacagtctttaaaaggaaatattttcaaataaatgaaatctctgggtcaaggccaatttgtattttaaacatttgcataatattaaagagttttgctgtagtataaggcatgcttagccattgcaggttttagaatctgaagcgagacagagatagagtcaaagagcgagatagagaatgcaagtgcacatgtgagcacaagcaaatgaaacaagtaaaaaagagaattctgaattattatgcatgctagtaaaaaatgattggttcctcctaggatgtttacagaattaatcagattatatcttgtgtttcatttctatacttcacattaagtcatatgtttaagattttcctttctctctgaaagccaaaagctgacttttcaaaatcaagggaagaatagactaaaaaaatggagacccgaaaaatagatgtgcttcactgttctcgtggatataacaaccctgatgtcttcaattaaatctcctttgttccagcttaaaacattgtgaatttaaattaacactttacgacatttcaatctgagtgcatatttcaaattttaacgtaataaaatcatttgattgttctctcagatggagaaaccagagtagtgatagtgaacacaaggccagaaaaaatgaaatggtatttattatatattttcttataaaaacaaagttgggggaagtacacattaaaacagaacttagtacaaaaattctatcattttcaagaatctgttcttaattttgaaatctgacaaaatagggaaaaaaaatcaatcacagaaattcctattctttggactaccatttaaaaaaaagaaccacatgctatgaatagtactgttctacaaaataggttttgctaagtcctagtgggaaaaaaaatccatgtataatatcttaaaccttgtatgtggctttatcaaaattaacaatactattattaatattttaatgtaaacttatttcttcctaagagacatagtgttttcttacccaaagggagatggtgttttcttacccaaagagagatggtgttttcttacctaaagagagatggtgtttccttacccaaagggagatggtgttttcttacccaaagagagatggtgttttctcacccaaagagagatggtgttttctcacccaaagagagatggtgttttcttacacatcactctcctttccttagtatgactttaaagtagcgagggactggctgacattagggttatcggcagatatgtgactaacggcttgggacattttattgtaatccattttttattgtatttcccttgacaaggctacaaatgaattctgaaataaatgttctagaagtagtgcatagactctaaaaggcaccacagtattgaatatataagcaacagttgcttttccccctaatagttttagacagcctatagcaaaccaagaatttttagtggaatgaaagtgaatttatgataatacttattatatctgtattgagaatattcaatgtgtattaaagtatttccttagtgttttctaaaacagccattttattgtagtgttatccatttgaatctatgttcttgcattcctgtggcccaaagatgtatcagtaatactaagagaaaagtgaaaaaaaattaaatatcaggttagttattgataaatcaagcagtggtgaaagtcagaaataaattttgagtctttccaccagcattcctcgatctaaagagtaaatggcttttaatcagttttagaactagatctctttggaactatttttagtacttactggcactgtatgcattttctgggcaactgtaccagatttatagctctaaaagtgctgtgttatttattgccttccaataggcaatgaagtggtgtcttgcacatgcatgtgtcaaaaatgttaaagttttctccagttgtcttgttaattctttcccaggacaatagacaaaatatatggctctctatttggcaatgaatatcctttatcaattttttaaaagaaaaaaaaacttctcttgcaaatttcacatccaacatcaactttctcttttttgattttacaaatctccacaaagaattaaagtctcagaagggctttatcttgtttattttagcagtttttgtcttgggtttgcaatcctaaagcttatttttgaatttaggaagaaatatcactcacaaatgaaggttattaggatgaggttattagaaagtccatacatttttcatgacctcaacctgaattggcacttttgtatactagagatcaatgccatttcagatatcagaatccaaaaatcaacatatcatgtgtaaatgattcttgcatgcagttcttatatattattttcttccctgatttttgttttctttgttgatcacacgtatccgtgtttgacagatgtagggttttgcatcttttcaataatgcactggctacataccacacttagtatttgtcataatttattctgaaaatcaagttttacaactaggttgtaaaattttactagcaattgacactttggcttttattacatttttgaacagaaaagaagtagttgtttcaggaaataattttgaaattgttttctggacagttttattaaaataaaagacaaaaaaaaaaacccaagtcaacaattatagagtattcctgtgcctatacagactgagaattaacaacaaccaaattctgctcttcttttatcttttaaaataagagccactactttaattcgtgcatttatttatctaacaaatgttttctgaatgtgttcacatatgccaggtgctatatctttagatattatacatttaaacaaagcttcatgccatattacttagtatatgaaggcgtacctagagatatacacatagagagtttgcccctatacacagaaataaataattttaagtggatttggaattcagggtagtgcaggtcaattcttccaaacttttaacttttttgtatataaggatgtgtcgatgctgaagatagggagatgatgaattaaggagccatatgttttatcttctttttcatttttctcactgtcctgctgtcatggtcaaacatatggcaaaaggcttcagttttttaattgctcatgtggatgtgagctcagttgaactaactacatttggggtaggactgatgttggattcatgtgttagttattctttattcctgaaggagattgaacagaaaacagtcttggaatcatcattcagtaataatagtaagctcatgttggtactatactttgacgtcaacttagatatctcaccaaaattttgttgaaaattatttatgtcttaacctgtgggcaactcctgttcaaatcccgtggacaatattaagtttaaatatgtttgctcagcaagtctttgtagaactctaaaaatctggaaaaatgggggttatgcatgcaatcacctggctaatcatagattctttttaaagaaaaacatgatgtcttaggatagtacagttgaatagaatttgtgcaataatgaaaatgttctacatctgcagtgtccaacgtagtagctactggccacatggagctgttgagaacttaaaatatgggtagtgcaagtaggaactgatgttttaaattaatctaattcatttaatttaaatctaaatttaaatgctcctttggggctaattaccatcatattgaacagagtagttgtgaaacacagaatagcaatggtgacattatccattaactaatatgtacatttcattatcaccttgagagttagaaaaatatatttttaagattattgccatttcacataaagtaattaaaagacagtgagtatgctgatcttggatttttcatctgacacaagcttgccttaatttgctttggaaagcaaaggccaactcaaaattcagacaaacacataaaagtaaaacctaaatatataaacaagaaatgcacaaacataaatacataaattttaaaattaaaacttacatattcgttttcccagatgtattgtattcataaattggatagttggctccgaaacttaagaactttggaacattttccttgttctttttatattatattatctttgtttctgtttatgcaacctctaataataacttacaatttccccttatagctcttattaaaaatgtagtgattctcttaatgtaaatccgttagtgtcaataccatcattaaatccatagttattgatttttctttcaccttaactagaacttaccttttatcacattagtaaaatatgtttactcaccaccataaccttggcatctaggagaatgctctcactatattagccactcagtattggaatgtcaaggattaaaagaatagtattaagtgccatggattttatgaagtacaatttagaaactattttttctacccataaatagacattttggatttgaaccttcctaaaaacctcttagaatatcattacaaaaattaaattatcattaatcactaaatttgtttagatcaaattatagtagtatgttatggtatttacttacattcaatgttgtcatgaaattctattttttcttaaaatatgcagtatatcaaataatagattttgcttgctaattttcaaatataaatacgtataacatgaaaatgtttttcttactatataatcaaggaaaagccaggttgattattgctctatctgagtaaaataggaatagaatgctcacgtttattgtatgaattaaaaacaaaataactaatatactttggttagctcttgtgaaatgtttttttaaataacgttggaacaaactaatgattttaattaatatttctgaaatgccatcttaaattttgtaataaacatctaattcctccacaaagatatattatggcactgcatttgaataaaagtataagtgaatctcagcacccccccaaaatctgaaagtttgcagaaatatcttcaagtaattcataagaggaaaaaatgagatgcatttggatattgtttaagactatatataggcaattataagacaggtaaattttttaaagataatgtgattgaaatacatttataaactgatcatatattctagcagtctctgaaaacctggtattatttattaggttctaatttttaggatcttgttttagacagtggtatgacaaaactataacctcagatcttatcctgttcttttatgatacagcacataaatgagagatcaataaccaatccatgccacttgtccagaacatgtatgttaaaaatgtagtagagaattaaaaattatttagatgtacgtgtgtgtgtgtgtgtgtgtgtgtgtgtgtgtgtgtgtatctgttcataaatcacccatgaataggaatcttaaagtcctcctccgatcttttcttcataccctccagtacctttttatctcattcatctctgtcataatgctgcaagtaacactggacaggaatcctcctctctcatttctcctcggtgagctggcaagatcactacgtttgtgtgtagggatcatcttattgtagtacagggaggggattttttttttttttttttttttttttttttttttgagacgagtctcactctgtcgcccaggctggagtgcagtggcgccatctcggctcactgcaagctccgcctctggggttcatgccattctcctgcctcagcctcctgagcagctgggaccacaggcacccaccaccacgccaggctatttttttttttttttgtattttttaagtagagacggggtttccccgtgttagccaggatggtctcgatctcctgacctcgtgatccgcccgcctcggcctcccaaagtgctggaattacaggcgtgaaccaccgctcccggccgaggggattgttttttaaatattcccatactgtgactttgtgggcatgaattgaaaataggtcctatccgaagctacctttttcaatttgagatcttgacctgtgaattttagttccttgtgcttgcatgttaaaaaaaaaaaaaaaaaaaagtaagaaaataacattgcattgttaatctctgagataatttcattttaactgtgtgttcctatgggaaatattgaaattctttgtattttatacaaatttatattttaaccagtttgtgtattttttttccatctgctaaaggttttagctgtatttattagatatgatacttatgatgttgtcttggaggaatatttttatttcggtgcttactttggtactgaaaaagcatcttaggcaactgaaatctacagtaaaaaatattttaattcatttggaataatcttggataattcacttacagcttcatttatcttgcaaaaatttagtgacaattctttttaaaattctatatacttttttcttttgaaaacttaaatagttcgaaaaccaaacattgtgtgttctcactgatatatgggtgctaagttatgaggacgcaaaggcataagaatgatacgatggacattggggactttggggaaagagaaggaaggtggtgagggataaaaaactacaaatatggtggagtgtatattgctccagtgatgggtgcaccaaaatctcacaaatcaccactaaagaatttactcatgtaaccaaataccacctgaaccccaataacttatggaaaaatgaaataaaaaattaattaattaaaaaaactgaaatagttcacataatttaaaaaaacttaaatagctcacataaataagttacatatattaccataaaatgctacaatctgaagcctcctgtccccagaacatcttctagtacagttctctaattttacaaatatcaagaaaagtaaagtaacttgcttgtaatcacgatatttgttataggcagagttgagacttagaactgaagtcttctggcacctatttctgaactgatcccattattttatgtggcttcaagaaactgaaaattgttctcattagataagctaacataagttaaattatattttattattcacattaatattaatatattaatttatattaacataagttaattctgtttcattgcatgttttccagagtcaaaacatttttggcctcgatgtcattgaaacaccagaaggagacaagatgccacaactgattgttcaaaaggagttagatagggaagagaaggatacctatgtgatgaaagtaaaggttgaagatggtggctttcctcaaagatccagtactgctattttgcaagtaagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaattcctttcagattaaggccagtattcagtaatcagttcctcctggagaatgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgatgaaagtaagtgcaacggatgcagacagtgggcctaatgctgagatcaattacctgctaggccctgatgctccacctgaattcagcctggatcgtcgtacaggcatgctgactgtagtgaagaaactagatagagaaaaagaggataaatatttattcacaattctggcaaaagataatggggtaccacccttaaccagcaatgtcacagtctttgtaagcattattgatcagaatgacaatagcccagttttcactcacaatgaatacaaattctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttacaactattcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcagtgaccaatgctacactgattaatgaactggtgcgcaaaagcattgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacatgcagaattctgaatgggctaccccaaacccagaaaacaggcagatgataatgatgaagaaaaagaaaaagaagaagaagcattcccctaagaacctgctgcttaatgttgtcactattgaagaaactaaggcagatgatgttgacagtgatggaaacagagtcacactagaccttcctattgatctagaagagcaaacaatgggaaagtacaattgggtaactacacctactactttcaagcctgacagccctgatttggcccgacactacaaatctgcctctccacagcctgccttccaaattcagcctgaaactcccctgaatttgaagcaccacatcatccaagaactgcctctcgataacacctttgtggcctgtgactctatctccaattgttcctcaagcagttcagatccctacagcgtttctgactgtggctatccagtgacaaccttcgaggtacctgtgtccgtacacaccagaccggtaggtatccaagtttctaacacaactttctaactatttttttattattattttcagttgatgtagaactttacaaaatctattgacttcaaagagggatcaaaacaatcatattctacagatgtacccaatagatatatggattcaattaagtttggtagaagatgagaacaaaataactactgatttaggaaaattggatgcagaataataattatagtaggggcaattttgtctgtagatggcagtatgacaattcttgctagaaaatatattgaaaaaaacttcaacacaaagggttgtagcactgtcctcagtaccattgtgggcatgaggatcagaatagtctgggctagatacatcacattaaagcttttcagaatctgataaatagctctaaatactaatgatattgagaagcctagcttcacttgggaaaatctgtggctgttcacagaaattcagcaccaagatattccccccatactctaccaggccttcaggtcctcataaagaaaagtgtcgttttcagattaggaactcaaaattattttggtgcatcaaatctacagtaacacaatataacaagaatgggattagaaaaatgaaagcctactcattctcatctttaagccagagaatgaaatatatatgaggtctctactttagatagctatttaaatatttgcatatttatgcaaggtattttgagcccttcagaagacattcttaaaagataataacttttggaaaataaaatgcttgctttctctaatgggcacaaagaaaactgtgggcatattaagacccaagaaatctgtgcacaataacttaaaacccaatacatttatgaaagcaagagtttatccagtgccttttatcagtgttccatgaagaaatgaatacaaatttatccagaaactcttaaatgttgaatgatttaaatataattgttccctttaaaaatacaagcaatggaatttacccacatatttttctcgaagtcatgctacatgttgagtttattattttgtttgtgttaactcttaaaaaagtattaatcttagtttcagggaataaagtcttttgaacacctattcaggcttaacaaaatagtagcaatgtgaaaatcaaaactgattttctttcaccaaaagttcgagatattaaagaaggctactggattcaagatagcaatgcaaatagtttaccataactttggaaatgggtttaagaatggaggtcattcaagcataagcgcagttatataatacgataacattaacttttctctctgaatcacacagtgaacgtaaggtactaattcagatgtgggtgcatttttgttacagtaggtacacaattaaatgctgtttcaaaaggtaaactagaaccctagtgtctgtatagagagcttctgttagactttaaaagaatttacgctgcagttgttatttctacagtttagatgaatcccatattttacatagttagtggatctgggatgggcaacaaatgttaagagatgtcgaacatctccacagggtgtgtttttgtttatatttaaccattaaaaagggcactctcattttcaaattcttattgctattctgcttattggataagtttctcaacataaaagtatcttttatgactaacactacatgatttgggtataataacattttttcctgggtttaatttgtgactttctttaagaaatgtacaaagagtgggtttgtgaattacgtatgtagatcatcatttttaacagagttaatgaagttaattaataaagcaagttctggtttcagtgctttttgaaggcacagagatattttatgagctagactgattttacttgagtttatgaacacatagcaaggagggcatggatgaagaacaaaaaactgaagtatttttcaaatatcctcacttttttgtttttttaaaaatattttgtaatcctaaaaagtcattaaaaataataaactttttccatgacacattttatatcatataactaagagacattttctgaatcataagaattagtcaaaatacaaaaaagtaaatgctaatgagaatcagttattggttgttattaggtttttattaactgaaaggactatcttagaatcattgaattagcagatgacttattatttcacagcttaaaaagtaaataaattatatattttattattggttcacagttgtttcatattcgttactaaatatcttcaagacatgaattggtgaacttaggcagactaatatgatactaaaaataatttgaatctttacattttgtgctacatttgcaatgttctttaccttttctatatgctcttcaatttgtgtttaatgttagggtgttcactgatgttgcagaatgctagcaaaataactgagcactgaaaaagaaattatgtatttaaaaattcaaatgcagtaggtgtcttctttttaaagaaatatcatacaaaatgggagaagtgacagccaatacaatacaaattcattgttccttaaggaaatacttagagtggaataaaatattactgttagcagaaggcagaattattccaatttattttaaacagtgagaaatgcattttcaaaatgagggtttggggaatatttacagttagttcattactcatctgtatagaaacaggaaagtggaaaataaaatgttctagtagactataagagacaagggaattcatctgaaattttatgttttataaagggaatcaaatactttctagttctcataatttctcattctccttgatcattctataggttgtttttctgacttggatgttctgaaaatatatggaacatttattagataggagtacgtatattgcataaagccatctatacctggggaatataatggtcgtctttggcataagtttctacatgtattatggaaggcatttttgtatacattgtagtagaaattttaaaaacatgaaatttgagaggatgaggctacacattatcttctattaacaccttccaaagcaagcagatagcaattggttgttatgacactagagaaaccataagtataaataattattttaaaatcacttttgatcaatgtcatataaaagagataaactgccaaaaccaagtcttgcttaatacaattcacccattaaatattgtgaagactatacattttaaaaaaaatagagaggagaataaaaatgaaagtagaatttttgaaggtcttccagtcactgtctaagacaagtatttggggtacatcattttccaaaaaacaaacaaacaaacaaaaaaccttacaagtttctgtgatttgagttggaatagtctttcagtttcagaaatgaggtgaatgaatggtgaaaactttagacagttctaattcatgcatgaaaccatcctgtagatatgatacatggatttgaaatgataattgcagtctgagttagcttggaataggattggtattcgctattgtaaaattcagtaactttgattctgcatttatattttggtaatgcaaattttaaccatgaagcatgcttggcaaatgaaactcctagaacacaaccatctgattttgataacctgttatttttcttgtcctagactgattccaggacatgaactattgaaatctgcagtgagatgtaactttctaggaacaacaaaattccattccccttccaaaaaatttcaatgattgtgatttcaaaattaggctaagatcattaattttgtaatctagatttcccattataaaagcaagcaaaaatcatcttaaaaatgatgtcctagtgaaccttgtgctttctttagctgtaatctggcaatggaaatttaaaatttatggaagagacagtgcagcgcaataacagagtactctcatgctgtttctctgtttgctctgaatcaacagccatgatgtaatataaggctgtcttggtgtatacacttatggttaatatatcagtcatgaaacatgcaattacttgccctgtctgattgttgaataattaaaacattatctccaggagtttggaagtgagctgaactagccaaactactctctgaaaggtatccagggcaagagacatttttaagaccccaaacaaacaaaaaacaaaaccaaaacactctggttcagtgttttgaaaatattgactaacataatattgctgagaaaatcatttttattacccaccactctgcttaaaagttgagtgggccgggcgcggtggctcacgcctgtaattccagcactttgggaggccgaggcgggtggatcacgaggtcaggatattgagaccatcctggctaacatggtgaaaccccatctccactaaaaatacaaaaaattagctgggcgtggtggcgggcgcctgtagtcccagctactcgggaggctgaggcaggagaatggcgtgaacccgggaggcggagcttgcagtgagccgagatggcgccactgcactccagcctgggtgacagagcaagactctgtctcaaaaagaaaaaaatgttcagtgatagaaaataattttactaggtttttatgttgattgtactcatgctgttccactccttttaattattaaaaagttatttttggctgggtgtggtggctcatacctgtaatcccagcactttgggaggccgaggcgggtggatcacctgaggtcaggagttcaagaccagtctggccaacatggcgaaaccccgtctcttctaaaaaatacaaaaattagccgggcgtggtaatgggcgcctgtaatcccagctactcgggaggctgaggcaggagaattgcttgaacccaggaggcggaagttgcagtgagccgagatcgtgccgttgcactccagcgtgggcgacaaagcgagactccgtctcaaaaaaaaaaaaaaaaaaagaaagaaagaaagaaagaaaaaaagttatttttgttgtaataatgttttctttttccataaatattttcaaagaaagaggtcctttctatttttatctgtcaaaaggagaatgtaaagttctttatactccctgatattttgaaaaaaagtatattgatatttcttatattacgaaacataattccagtcatatgagggtggaaacaacgattgagataggagatttcaaaaagattttatctcaactttgaaactacctaagaaaaatgtgaggttgctagagtaacttatttaaataagtctgttttatttctctagcattaaattactaaatatacatcattgctttgagtaatttttcctttaaaatgaattcacttttcacagtaagtcaactaactcatttcctacacgaatgagacaatgcctcatattttgtgtacattatattttattgaggaaagaatgacatgttccaattttatgctatattcttaaactatttatgacttactaacagtactaacagaattttttaaaatcatgatttattgggataaaaagggagtacaaaggacccttataatgattacatagcatatgcttcctgaattttaattcaaatgttaattatgtatcattttacctttaaaagtgtgaataggatttggtctgttttgtatgtacattaacgttagtgtattatttgaagtgttctttgatgtgaatgtatttagaaaaggtttatgctctgttcagtatttcaaattagtgtaattcttggatatttaatatataggtaatattttaaacaagtttctgttaaaatttagtgttcccattaactcggtacagaatcccttgtatttccaatatgtcaggttccatgaatgtacatgctatctggttgtttaaacattacttagttgattataatgactgtgagtataactacttttactgcttatggtagatatcatgtgagttacaatattatattacatactcttaaacaactgttgtagaaaagttgcttgaaattaaaatacacacttgtacaagttattcacatagaacaagtttacagttcctccccttttattcttgataaatatttcagtttagttcaaatcattccaaggaatgtaaaaattgagtcaacttattatattcctaaaatcagtgccctgcaggtagtaagatatacctagagtggaggtttccaaaatctacagtctcaatttaattttgaataaaatgacgaagcccagaaaagtgaatcagaagttgaagtgtcccataataagctgtcatggcttcatgatcatttgtgtatgtaattattataaaaatgcatttgcatttttattgcttgtgtcatgactagcctggcctttcctttccttttctgcacacactgaactaagggagaataccttgtttttcttccatttcagtgaacctttccttcataactgcaatgagtaaaggtcctaatcactcctttgtatatatgaagatgaaaattccttgaaataattatccagaatttctttaaaagcattcctcaatggttttatgggtgctgtatttgaagaagattaaaatagaaactttattttaaagctatgactccatctcttagaatgcagcgtctctgagaaaggaacttctaaactgacttctgctttgggctaaaatatttacccatataagccaatgatagtatagagatttaacagtatttaaatttgggccatagatgaaaatgaattctacttttgactagtaactattcttgatccatcctttgcttttgtttgagagaatattatctctatttgagaacaacatggaaggcattgaaactagttttccacaaaggccagaggacaaaaatatttatttccttagttgattccttatcagttgacctggtcgcacctttaatttaattgatattattattacgtttgccttgcaagttctcagatatctccaaccttttgtgttgtcattcatcgactacgggaatattctcaatgaaatgtccttgatggtctctctggttcttattctagtcatgaaaaggaaaagacaaaaagatagcaaatcttaaaactagtcatcggccgggtgtggtggctcacgcctgtaatcccagcactttgggaggccgaggcgggtggatcacgaggtcaggagatcgagaccatcctggctaacacagtgaaaccccgtctctactaaaaatacaaaaaattagccgggcgtggtggcgggcgcctgtagtcccagctacttgagaggctgaggcaggagaatggcgtgaacccgggaggcggagcttgcagtgagccgagatcgcgccactgcactccagcctgggcgacagagccagaggctgtctcaaaaaaaaaaaaaaaacaaaaaaaaactagtcatcatagataaataaaaggaacttttagtgaactttgtccattaaattataagtagcttacctgatgagctacagtgtactgtatactttctcccctgcaagcactcaaagaaatattatttgatcaaaatctatagtgcataaattaaacaaaaaatactgaaatatattctcattttattttaattatgaaagtttatttttaatgatatgatatttaagctattatatttctcacttttttattttcaatgatttaaatgtaaaaattataaaacaattttaatctcattcattaattcatctttcatgtataagtctgttttctctgttgaccaccctgtccacattatgaatgaaaatatgtatatacttggccgggcgtggtggcttatgcctgtaatcccagtactttgggaggccaaggcgggaggatcacgaggtcaggagatcgagaccatcctggctaacacagtgaaacctcgtctctactaaaaatacaaaaaattagccgggcgtggtggcgggcgcctgtagtcccagctactcgggaggctgaggcaggagaatggcacgaacccgggaggcggagcctgcagtgagccgagatggcgccactgcactccagcctgggcgacagagctagactccatctcaaaaaaaaaaaaaaaaaaaaagaaaagaaaagaaaagaaaatatatatatactttagaataatttttagaagttgagtttatattcaatcaatatttactaaccttgtcatttcaccatgaaatactaactgcatcattttgctgttttgtcacctgcactcctcactgttgaattccatgttgtaattgtgtatctagctagatgtgatgtgcagcctgagtgtaacagaagcactacaggacaagcagaccttgagtaatcttatataaatctaagccacattccataaatgcttcttgtaggtgcttttgtgtaataaatgtattttcttggcttttatgaagcttagtttgtgtttattttaaatatgacttagcttcctagaatattcaaagattctgtgataatacaaagctatatttcttgcatataattagtatttttagaaagaactacagtgcattttttcatacatcgtgcgtgttcatacatgacatctttggtttaatgtatttagaattaggagttgacttttaaaattctagagtagccataggtttctatttttattgtacgtgtgatacacatttgttgtagaaaaatctagaaaattgtataaagtttttagatgaagaattttaaaattatttgtttttatttcaagctatagcagtgagttctttataacagtaattctgtttgaaggctatataactttttgaagtggtgcattttaaaattatagaattatgcttattgttttataaactatacatccaggactttttacatgtattgaagactgatttatttattaaacatattgtttatttttatagatgtatgattggacaaatttatgtaataacataccttgattagttgatagtgtaatacagaggcatgttacatatctccatcatgagactaaactcccctgagtaaaaatatcaagtcttgatgaaaaagcttttatactttaaaaaaataccatctaatgttttccaaaagttcccttagaacaacctagttacataattatttcccagaattttcagaactcttttaattttcctatattctagatatttgcaactgaaattgttttaaatgttccttttgaaatagttaattacatttaattatccatacatacacaaatatatccaattaataataaaacgtttttgtcaagtgaaaaaaatcacaaatcacatttcattagatttcaggtagtcaaattgacataatcatgaaaatgaactattccaatagattttctagaaatatttgtactttatcccttatcctagaaccttatatgtaccaattatatattgatttacttcataaaatgttactgtcttttgaatacagttgacttttaaaaaaattttcagtggccaggcgcagtaactctcatgcctgtaatcccagcactttgggaggccaaagcaggtggatcacttgagctcaggagtttcagcccagcctgggcaacatggttgaaaccctgtctctatcaaaaatgcaaaaacttagccgggtttggtggtgcatatctgtggtctcagctacttgtgaggctgaaatgggagaatctcttgagtggcgggggttgtgggggaggttgcagtgagcctagatcacgccactgcactccagcctgggtgacagagtgagattccatctcaaaaaaattttttaaaataaataaataaaaacattttcattctttttatcttaaaacttggaagaaacattagatacaataatactttcattagtcaattagagaaaactttaagtaataggctttgactattcagtagtagtgaaaagtaaaacaaatattgaactctaaagaaaaatgttatttacagaaatctataaaataaactttaaaatgtatttacttattatatatcagttctaaccttaattacaaaatcaatgcagagcaccatttcaatgatatattataactaaagagaactgatcataaacaactgttacattatccaaaaatattttcagtaattcaaacatgcaacttgaatagttgttgagtgacacaaacttgaagtaactaaaattatttttttaaatgcactggctcttttgacatgtaaatacagaaatagtctcatattcaaggatggaacaaatacacaaaaatggaatttcatggactctcaacactagtttgtgacctctgaaatgagagaccatattttattattatttttatttatttcatctcttgttattcaaaactatgaattgagtgtattttttgcagaaaattatactcatcatttatgatgctcagattaaataattacttttttgttttgttttgttttgctttttaagacatagtcttgctctgtctcccaggctggagtgcagtggcctgatctcagctcactgcaacctccgcctcctgggttcaagagattctcctgtctcagcctcctgagggactatagtcatgtgccaccacacccggctaatttttgtatttttagtagaaacggggtttcgccattttgaccaggctgttctcaaactcctgacctcaggtgatccacctgcctcagcctcccaaagtgctgggattacaggcgtgagccagcgcacctggccaaataattagtttttttacacaaatttaattatccaaagaaactgctgagttatcttccagattgttatcatgactgtgtttacatgataccaaaacatatggaggcaaaatagaattttttactacatatagggatattttgctgacctgacagaattatttgactacataaagacacagaatttagtactacagaatgatattgtaaatagtttcattttcgatagaaaaaagagttttacatgctatataaagttgtcattatctgaatctagaataactgataacagttaacaacagaattccacacagtgctgcaattcaattttacatttatacattttagttgtgtataaagacatacacttatttatttcaaaatgcacacaaattaaagaaatgagagggaatgtacacttaaatctttttaggtgtctgaactgaaagatagatgtctagaagttaatatacctaattgtgtgtctagaggaaatgtcatattaatttgatgtttaagcagttctaatgtattggtattaaaatgggttagtgtatgtgtgagcacagatatgtttgcatatatgtgtgcatatttatgtttctcaaatttctagcagaaaaaagtaatataaacttcaaactaaagaaagcttgttaaaagattttgcatctacatttacaatgttattgtccccttttacaccattatgcctcgtttctaaactataatcatccagtatccctgatatcatcccatatataatctttcatttagaaaatccttgtcatatccagtacattctgtatgtgtcctcatgtttttttcttttaaaaaaattatttgtctgtttcccaaatgatcacagatccagtaatgttaaagtacatataaaaaattaaattgatttttgttatctaagtactagtacagattctgcttctcttgcacacacacacaaataaagacaaatttgctttccataatagccaacttctgcccagttgttataactaaaatatatccaagtaaaagtccattaaaacaatcctctttattttgcattgttacattacttaattttaataattatgaaaataaaaagaaagaagtagttctctgttagtcttctgtacaatgtcagatttgctgtttcatgtgtcttcaactttatgggtttaatttatgtcttcatcaaatggctatggtatggatttaccataattatatacatgcgtacatgcctacctatgtatatataaacaaacatttttgtaaacagctcagtgaggactttggactggcataaatcataggaatatgattatgaggatacatccaattttcagattgggcaatgtatacagtttattatcatttctgattttgagtagagttagtactaagaacagcattgaagaaaagcagtataacattaaaattaagaagatttaaaatacaagaggattcataacagtcacttttaaaatattgttttggctttctactttggagctgtaattttaaaaaaccaatgaacaggtttttgtatgaatatgttagaatgactaattatagagcatctttcaactggaatacatgtagatactaacacctggttgtatttgatgtaatttcagtgcatacagtgtgtgtaatctgtattaagtgaaatacttatgaataaagttgtttctgcattgcaataacacatcttctgatattttttgaagtgcttcttgtcagcaggggctactagtttcattaacatcatcaaggatcctaaaatatttttagcacagtgacatcctacattcttcatggtatagctcattatctgtgctggattaaccagaatttttatattgtcatttctgttcaccaccattgtggtgtaattgatctttttcgattaacccaaagcaatgaagtagtcatatttactaaagttttagtttcgtgcgttttattgtattaacattttttgaatattggtaatgtggtatcatttatgaaccactgtatttgataaagcattatcgataacggagtttaccatgagttcagacaagataaattaaatatttctcaaactcctactgtgagtaaggcaatgtggagaaggtcaatggttatggtgagggatggggtatagggggctagaaatgtaggatgaccaaggttctcccctagttgctattactgtaaaaagccccctgtccaaggagttgaactgcaagtatgtttaataaaaaaacaaaaaacaaacaactttcctttttccagtgcagaaaatttgtgagtatataatatcagggtttaaaaaaaaaaagaaaaagaaaaaaagcacataaaagtgacaaaatataaaatttcagtgtttactataataattagaggggtgtgtgtgtgtgtgtgtgtgtgtgtgttagagagagagagagaatatcactagtaaaccacctcccaagtatgtattgggtatgggcatgcatgtacttaccccatttcaggaagcatcctaaaatcagcaacactttcctctcctcagtcacatccaagccaacagctatattatgttgataatacctccaaaatacccctgacatttgtcccgtcgccatttcctttttccagtcttagtcaccagttacctgttccactactaacaggttgccttactttctactttcatttgttcaatcaattttctaccctgtacccataatactcctaaaacacaggtctgatccagtgaagcctgacagaaaagcttctctttcctcattgcacatagaataaagcctcaatttttatatttttcaagggactttgcaatcttaaccagttctacttgttcattctatctcgtaccttgccatgcacctcgtatttttgtcatttcttctgccaccccctcctccctgatcatggcatgcactttgatgcctccataaatctgcacaatttaccagaattattttgaggactttttttttgttaagacaccgctgcaaggacaaaaacaaaaataaactgcagttggcgatattgaagtgcaactgtggagataggacaagaacacatttttttttttttttttttttttgagacggagtctcgctctgttgcccaggctggagtgcagtggcacgatcttggctcacggcaacatccgcctcccgggttcaagcaatttcaggctaatttttgtatttttagtagagactggggttacaccctgttggccaacctgctctctaactcctgacctgaagtgatccgcccgcctcattctcccaaaatgctaggattacaggcgtgagtcaccgcgcccggccaagaacacaattttaataccagagagtatatgacaaaaatgaagaaatgctacctgattttattaaaaatgaaacaagtcggcatgctatcatttccttccatatcttttcaaatcttagcatcaaccttacataattcttataaaattaaaatgtttcaaataaatgactaggtcatataacctgtaaacatcagtttctggaaactattcccagaaaattgttacattgcttttcttcattaattctagaaacatttttaaagctctattttggatattttgattgttgttacaccttttgtccatgagttacactcaaaaagtatcaaaggaaaaatttaacgcatttattgatctgcatatagtccatatacaaaggggtgagagaaccgcattttttttttttttttttttttttttttgagatggagtctcgctctgtcgcccaggctggagtgcagtggcgcaatctcggctcactgcaagcgcttttaggcattttagcacaagaagcatctcagtgtgtgatttcttcaaagaaaaatattcccagtatgctatatggcgagaaaaaaagacattcttgtcttcaatagagggacattttctgtggtgaataatcacaaatctatattgacgactatggtttggatgtgtttgtgtagacataaatcctgtcgccgaagtactgagatgaaatgttcacgccaaatagaaatcattgtgtctctccgcccctctgctgaaaatcaaagttatcaattttgggaaaacatgaacagatggagaaaccatgggatatcaaatgtacatatatgtatgtccaaattataacatggcagagctactctgaaaatgcagaaactacatatccctactcaaaactgaccatatatatataaaattttaaggaatgaacttcttggcacttacattgaaagcaaatatgctacctgcttcctggaaatagaacggataaaaataaaccaccgagttcttttttttttttttttttttttgagatggagtcttgctctgtcgcccaggctggagtgcagtggtgcgatctcggctcactgcaagctccgcctcccgggttcacgccattctcctgcctcagcctcctgagtagctgggactacaggcgcccgccaccacgcccagctaattttttgtatttttagtagagacggggtttcaccgtcttagccgggatggtctcgatctcctgacctcgtgatccgcccgcctcggcctcccaaagtgctgggattacaggcgtgagccaccgcgcccggccaccaccgaattgttaagttagccctttttactttcgttcttactacgacataaaaagtctttctaaattatatgtaggaaacattctgggaaattggggttttgtttagtttagtttctctttcatatctttcctagacaatcttatatcaggagattcttaacaccagctttaggataagacatttccatggtacatgttttataaaaaatcgtgacttatgtcacctctttttgtaaaggaaatgaaaaccatcatgaataggaaaataatgtttcttttgctcagttacaactatagagaattttcaatcatcccagataaaataaaagcagctattaacattcttaaagtcggtgactattttcttcagtgcacataccttggtaatagagggtcattataaagggttaatatagtgaaagactagatatgaagacaagactaaggactcaataacatgaaaaacatagcaaaaacagtacattaccatatttctagtgaacaaatgttgcttttatgtttgtgtggtgttttacattttcttgaagtgcttccatcagggcatcggaaagatttttattcataaacgcacccctcttattcccttttaatctgatagaggccaaaagtatgttttactctgatttatttcttagaaacaattatatctaaaatgagtctaactgaaaaggtacaataacaatattccaaatatgccttaactctatttctacctcaaatatcactgtgcttatgtatgaaatttcaaatttcatggtccgttttttttgtttcatggagaaaaataccatgtcccttctgatatgaaatcagaatcccaagagacaactcagaaaatagacttgcaacatacccttttttaggttagtctggcatgtagaatgtgttagaactccagattggctaccacatatagacatgggaagtgttagatatactaacagatagagacttgtcctattaacacattaaagaaacatgctgtagttcagagcttctcatcctctgggcaccctttgtgaccctatgttcacataggggcatgcaccttgactcatataatttctgttaatccaataagagaaaaaatctcagtcaactacacactttctggataaggtgactctttttactcaggaaaacagttttctgatcatgttcccttataatacatttttatgcctttcttagcaatattactctgtggtatacttcagtcaaatcacctgaactctctcattccctgagcggtggtcactgtactcatcacaatgtctatatacactgtgtggagagtaaagtttatttaaccacataagctgctattctgaaaatatatttttcacattgagagaagtatagtttgtgtagctaaagctatacaaggtggttgagtgttgggaaaaagagattgagacagggagagggtgctagtgctgaaaagatcaaaagcctaacaggaaaagagaaagaggtggtaggatacaaaagatcaaaactatggattctctcggacatttcctcagtttcatcaacctacatatttattagtttgcctctccctggtaatgcctaggattggtccttgcacaagttaccatttctgaaggttttacatattcatgcccccaagttttaacaccttctctcatctctgacagaaatatcaaataattgtatatattctacatgaggtttccccttgcccaaagaaacctaacagtccagaaagatatttatgtaagtttgatttctgtacagatgtatataatactgatattatatataatacatattatattatatgtatatatttatgtgtatcaaatattcattatattacacattccgtatatttacatattacatgtataatatgtaatacactttacatacattatacacatatacatatacatatgttatgtattatatattatacatattatatacatatacacgtatattatgtatatgtatatatgtatattatgtacatgtatgtaatacacatacatagtatatataaatataaagctaaaatacagttaatagaacttaaatttatgttccaatttgaaaaagaaaaagatgaagagtgtattcttctaataggaacaaatttttgttttggtcttggagaaatattttacttacttaattaagtaataaatatattttttgagacagagtctctctctgtcacccaggctggagtgcagtggtgcaatctcggctcactgcagtgtaaacatcctgtgctcaggtgattctcccacttcagactcccgagtagctggaactacagacacgtgccaccagacttggctatttttgtgtgtgtgtctttttagtagagatgaggtttcagcatgttggccaggctgatctcaaactcctggactcaagcaatccacccacatgggcctcccagagagctgggagtgagccaccgcacctggccttattttatattgagaatgctctctagtcttctggttatgttatactgcctgacctaattttcaagactgtagtattacctataatctttatgagatttattgttttacctgtcttcagcttctattttagagatggaatggatccttaaagatcatgtagtatcctagtctgcctctattatttgacaaatgatggaaccaaggcccagagaaagaactgacctttaatgagcagctattttatgtcaggtaatgtgctaggtaccatacctatgttagttctttatctcagagaggttataacattagtaagtggcagagagacagtctatagttaagtctgattgactcttaagttctccttccactatactacatcagaattctggcagatccatggctccccaatctcctggtttgaagtccataggcccttcccttttagcactaacctattacatttctcctctgctctataaaacacgaagttcaattatattttcccaacactctttgcaccttcctagatgcattctcttctatttaagctcaggcagataatcttgtatatgattatttttattagattttcataaagttggcaagcactacattcattctggaagctactattattagcagatatttgccgtggagcataatttcctatgaacacatcagttgggaaatgcaaatagcatagacaaggaagtctttcttccttcacctactcccatttctaatatatgaacccaggacaaactttgaagatagtagctattcaaaaagttttaactgaactttctgcagatattgtgttgcaagccctagctctgttttccattctgcctttgcaatctttaaaatataatatgattctaatgtcctgcagtttggtaagtcacaggatgagtttgatggaggagggaatatatatacatcaccaaatctaagtgtaaagtaattttgacatcaatttataatgaaaaggagcattttgatacattaaatatagctatgaatttctacctagcctgattagactttttggtaatcaccagaaatatatatcaaatatggatcatcagatatctatagaagggaaggaaagttatcaattcaaacaatatgaattttcaatttagtcagaattactaacttttgcttatataacataaattggaaatatattttgtttctggattgtgcttcctaatttaactatttaattcatatgtaacaattgcaacattaatttttaatattgtcaaagatatacaatgccatactataaatacattttgttccaaagaggcaaagttcatcatttatttaggaagctgcattaactccttacgtccacttagggaacatacatcaaatgcctctgctacattaagttctagaaattagaatttataaaaaggagaaaaagagggaaggattaattcaaggaaaattctgtgagtgtttgctaggtgccaggcatagtgctaggcacactgaaaagcaaggtgtggtgggccatgactgggctttaaagacagacctttttttttccaaatctggatttgcaggttttagctgcatggtctttatcctgtttgaacctcaggatcttcatctttctagtgatatcaagatgtctaatcaacaggatcatgaggagtaaattagatagtataaaaaaatgtacatagcacagcataaaggagtcaataagtataagacttcttctacatagatgaactcatctaatcttcttataatattacgagctagatatcattggtatcatactcattttaaagattgagctctcagagagctcaataatttgccccagccgaatttagccaatttcttgttcattctcctgtaccaaagctatctcagatcaacagtctaggtgattctactttattaactgcttaattagagctcacttgcatggtaggaatgttgcttcctaaaccctgccattgtgtgttctttatgggagcctgagtagaaatattgagtatagctctgggcagtaatgtaactttaaagcctttccagttgtaggtgaatgtacttttaaatatagctgatataaagttttgtcttctaatgatagtgaaaattattgacaatattgactaagtggtagaatcataaaatgtcagatgaagataagagtcagaatgtgtgcatgacttgcccacggttattcagttagattttaatagaatcaggtgatgagttttaatctcctgactttcagttcaggattcttaccactgcatacacattctatttactatgtgacaacactgtaacaactgtatgaaatggcattaaatactattaaaattaagaaaaagtgaagctaacaaaaacaaaaccattctaggagccagaccattgttgaggtttagctttcctatctaatatatctactgtgaccttggaaaatcaatcatcttctctgtctgagactcaatttcttcttgtgttaaatggggatgatggattgttcagaacctcaatgagatgacttttcaaaaagcatttgtaaaatgagaacttttcataattgttaccaataccacgtttattagggttctctagagggacagaaccaatactatagatgtatatattacagggagtttaataaggagtattgactcacactatcacaagatgaagtcccacaataggctgactgcaagctgaggagcaaggaagcgagttcgagtccccaaacctcaacagtagggaagtcgacagtgcaaccttcagtctgtggtcaaaggtccaagagtccaaaagctgaagaacttgaagtccgatgtttgagggcaggaagcatccagcatgggagagagatgtaggctggaagactcagccagtgtattctttccagtttcttctgcctgcttttattctagccgtgctggcagctgattagattgtgtccaccgattgaaggtgggtctgcctttcccagtccactgactcaaatgttaatctcctttgccaacaccctcacagacacatgcaggaacaatactttgcaaacttcaatccaatcaagttgacactcagtgttaaccattgtaagtccaccccttttcaacttgaacccatatacatctcctgaaattatatatatatacatataaaatcttcaaataattacacctaacataatagagctatcctttgtataactggaaacacaccaatccccaacctaaatgttattacataaagttaacaatagttaaatgctgatatgaaatcaatgactcttatgtcacatgataaagaaaaaagaaaggaaataaaatgaagacattttcttagtacaagtgtatacatgcacaaacatgttcttaacaaaataaggaagaaacactcatgacaattatagtccttgtttctgcaactggccacatggccatagctggtattgataactaccttcttctactgcccattctgtattccctttgccttcagcaagcacctcagcaggttgtggtttttacctggtggagtggcccagacctttattcctgaagagtctggaccatttgtagtcctgcctggattgggctgttgtagtttccaattgaccttaatcacagggcatggtaataccaagagatgccctaaggggtctcctttattccatgtatactattccctacctccattgtggagtagtagactggtttcatctcgatagtcggggtcaattaccccagcaaacactgtaactcccttcttagcctgttgacttagaggtaggaggagcccagagtggccaggtagcaatcttaacttccagtttaatggaattgttgttgtgtctcatggtggcagcattcctccctctggagttaagacctctaggccagcagaacgtaatgtcatgggaacaggaagcaaaaattcttctagtaggttactggggtgatggtgagtggtgccacttccacttccaccacttgattcctggacctgtgaatcctggctatgagaggaagcagtaccatatattggacagtgattcagaggatacacagccttctggagaactttgccccatccctgtaaggccattcacaattctatcaatccagctgcttcaggatgatggggaacactgtggaactaaacaaggctttcaacctgctgtacaattaggtttgctccctcataaaacactgaaatgatgggcctttgattacagacatctcaagattttatgcaagtatccaaaatgtccaacttatgattatatgggggtgactgtaagactcctgtgtttctgaaatgcaacttctaattcatgaactacatttataccaagtatgtcttagaatagctcataagcacatgaaatcaaattccataaaaccacgggttttgtatggcacttaattaaggaaactgaacagctttcagtggcaagtaaggcgatttcagaaatggtaactatagtgattctcctcaaaattagaaagagaaggagaaaactgttcttgtgtgtctactctgtgtcaggcacactggggcctcaggaagtgaatgagcttcagaatcagggaacatggtttgtaacactgactttttagctgctgggccttgcataaaactgtttaagatttctgagccttaggatctttaactataaaaatggcaaaaataatgtcaaactcccaggtttgttgtgtaaattaaattagataacctatgaaatgtgactgggatataacaggcacttgataagcattatgccccttcttcaccagttacctcaactaacctgcccagctacctggtaggcaagtaatgttgtcacatcacaaacaaaactaggagactgagtttcagagtttcagcaatttgctcaagctcaggtaattggtaagtggcctgattggaattttaccaagattggcctaactctcacttcccagtcctttcctgtcagcctttctgactctggaataagacctcaaatgccactgttcagtggtagtttatcaactcataagatatatgtctttttcacattctttctccataggcatagggagatattatgtaagtattactctcttttctgaattaccaataaattactttaagggggatgtttataataaaatgataagaatatgacttattatgtgattttaatattagacattttactctattatcactctatgatctttgaaattataaacacttcattccatgaatgtggatgggtatcttacaaagataactaattaaaataggtatcccaagataaaacgtaaagacaaaatttaatttaatttttatttgactggtttcagaatacatactacttaggctcgccaggcatacattcatgaaaataaatccctaaaatacaacacagtatgggaataattcctatttttgagtttgaagaagccattaagggctagagtaaattgggaaagactcgtggaagagattgaacatgatttggtccctaatgcaggatttggaaaaatggagagaaaggaaaagtcccagttggtaggaattaaataagctaaaacatatgtcatatttttggagcaatgttttcagctactgttgagacacatttaagaagatgttagggccatgttattgacaattttgtggaggcaataaaaaacaaatgaaagaaatttctatatttatttttggaatagtgtttctcatgtgtcctgctcaaacgggaatgttacgtcaaccacctacacttcctcaattcccaattgctcttcaaaacatcttaatctagtctctatcccctccattcactactcatatgtctcatgtagttagcagtggcctcctatttgccaaactcaatggacattttttatttccatctttctgctctattcggcatttttcctcattcattcactccttttgaagttctattttcttagcttgcatgatgatattcccttctgattttttttggccttctgataattccatttctttttctgtgtggtaatttcatctgtccactgcataagtgttaattttcttagagttatatcctcagcctgttctcatcattttatactctctctgttgttttatatataacctatatcctgatgagttctgatctccatatacagtcctggtccctcacctgagattttgactgatacatcaagttctcctataaacatctccccttcactggtccatggaacttcaagctctactcgctctaaattggattgattcccttcaaattccttttcccaaatctggtttcttacctacttcaactgatagagtcaccattcattcaagtcactcaagttaaaaatctcagtaacatcctatgcttccttctctccccctccccttcattccaattgttcaacaacatttttttttctgactttacatttaaaatatttttaaaataatgaaaatgatagcagataatatttttcaaaatgtactacatgcaaggtatggtgccaagaatttaaaaagtattaactttcatactacaggtactatttttcccatttcacttatggggaaaatggagctcacgaaggttcattgtcttgctatatgtcacacaaatactatttggtaaagctgttatttaaatacaaatgtttacattccaaattctgtattcttaaacacaagagtagcatttattgcttctatctctactcctgtatcctattttaagttcttttcatgttttatgtggacaactgagatagctgcttagctggcattcatcatatctctaatcttgtttcactcaagtcagcttccacatagccaatgaagattctatttcacttgcaaatctcatcatcccacccctctgcttaaaatccttcattggatcctcataagtttcagtataaatacctattttttagtatactaaacaaaactctccatggtgtggtcttgtgcttaattttcagcttgaggtctcattcatccctgggtcatagtttacgcttcagagatatcatatcacttgcagttttctactatacagcatgctggttttagtttctacaaattcattcatatttttttgtagtggagacttgctctttgccattctatttacataacatgattaaattccacagagtcattgtgactcagctcaggttcctctatgtgcatgtgtgtgtgtgtgtgtgtgcacgcatgtgcgcgtgtataaaatatttgagtaggaaaaaaatgtgataacaaatattttgagatgattaattaaaaattataatgacaaatggaaggcaagttttaaagtaggaaaatcagctaggagaaccagaacattgaattaagaacaaaataagggataagggccaggactagggtagtagaggtgggaaatgaaaacagggactgacgaatgagatggtggaggggatcaaatagagtatattttctaaaacaactccaaaattgaaggcagttgactagaaattagcaattggggtttgaactaagataatcaggagtgtaagttttgtaaagaagtaggagttgaggagatggagaacaaatgtgtagatgttttacatgtaaagatggtaaaactctaattccttttaactgtgggacaaaagggtgagaagatgggtgtggggattaaatactttgaaatgtaggaaatagtatatgataaagctattatattatgttggtgcaaaagtaattgtggtttttgcgattaaaagtaatgacaaaattacttttaaaaattacttttgcaccaacctaatatcataagtaaatggatatttagcacagtttaacatatgatggggaatagtctgaagttaaaggcagcagtacgactacatatttacatttcatcatcactatatagtttagtggaagcatccaactatgattgactgattaataagccaagagtttcttcagctataattcaatttggatattatatttctcaaaaataacttgtacttgttatttaattgttagtaattgatccttttctgactataaaatagtataaattaattgtagaacgtttgaaaaatacagatgaatagagatataatagagaagaaaaatagaaattacctataatcctaccaactcaatgataataagtgttacttcagtgcatattctttcaatcttttttctgtgtgctcatttttattttattaaatactcttctcaaataggatgtttgatagctacataatattgcatcacatagacattctataatacatttagatatccaatattaatgaatggttttatttttatgctattataaacaaactataatgaaccttcttgaacataaatccctttgtgcaccgatccaacagccaacagtgtaattcacaaagaaacactggaggcaattccattaaaatctataataagctaaggacaatttgtttaaaattgttttagacatttcatttacaacagtagtacaggggaaaagaataaatattaaaaagaaaaatatagtgctatttattgtttataatgatcttccaccaagaaactccaagaaaaacttctggtagtataaagaggaacagcttttattttttacttttttgttgtttattattattattattattgttattattattttgagatggagtctcactctgtcacccaggctggagtgcactagtgcaatctcggctcactgaagcctcaacctcccaggctcaacctcttttactgcctcagcttcccaagtagctgggactacaggtgtgcaccaccatgcccagctaattattttagtttttgtagggacaaggtctcactatattccctcaggtgaaagaatagcttttaaaagtcagctttcatgatgtgtagtaaagtcagtaattctacttccagaaatttattgtacagataaataagaaaaatatttaaaagctactgagttttaaaagatatttgtatactatctcatcagttatcaatactctaacggataatctatcattattaaatgcttttctctttttcatataataattgctttttgtataaaagtaattttatagagaaattcagtttacaaagtttagacttatatatttttagttatattttatgcctaattggaaagtaatgcctaattaataaagtgtttttcaagacacatgatattttcatttttctttttgttgtttttttcctctgtgtcaactctacacttttttttactaaggtatgaaatgacaatcaactaattttctcaagatttgaaacttttgtttctaaaaaataaactaaattgtgcctttttctaagtgtttaactgtgccatggtgccattcagaagaataaaagtctgcccaatttattgtgacttttcctgcataatttctatgtacattaaacaggtttataattcacttgttcttagacttcatacatataattagtcatttgtcatttatatatttcaaaatcactgcttcagagaaataatgtagaagcatcatggaggttatggctttctatgtacatataagatctttacgtttgaggatcatatttaaagactaaaaaattataatgtacttgactcatatattcaaaattgtgataaagaagacatttttagcttacaatttgctctagaagataacatcaacttactaaagatatgtagaggtaacttttaaccttatgttaaccaaattcaacatattgaaatatttgtttcctatgctgcatatgggcagtgaaacaaataaacaattatacactgaggattctttagcatcttcccattttgttttaatttagagtacagaagacttcaccttctgtcactattagaataagagaaacaagctgaatcaacagtggcccaatatattaaccactttgataaaagtgaccttgtatttgatcaacgtctagaccagagattcacaacactggctgtgcattaaaattgcatttggaggtcagaatctatcctaagaaattataatagaggtctgagttgaagcctagctatctttgttgtcagcctgacaggtgatttatatgagcaaacaaggatgataatcactgaacataaacatacatgcatccattaattgactgcttatctacatatttgaaatattgcccattaataaccttatactcactagactgagcatttgaaaagcaaacacaacgcctttattaacttcgtaaccctagtaaccagcttggtttcagcacataggcactcaggaaaattaattacttaattaattaattatggtcatatgaactcattaaattaacgaagaatcatggcatttgttagattcataggtagtgacaaacaaaatgtttgtgaaattcctttttaaatatcaaacacaaaaccactttggaacaaatttttattactcttttactctttttttcaaagaaggataaatcacttgaggaaaacaaaaaataatttttgctagaaagatattttcaccaataatgtgctaatgcacacactgtggccaaggaatacattttcggtaactctgccaacttcatgccatacagacaatatatagtttgtaatgctatttttaaaataaaatgacatgactagtgaaagtatgtactaccacactatttacactagtacactattataattctaaaacataagcagttattacaatgattttagtgtttttgtacatagttgatcttcagatagagataaggtgaatatggtatttattttttatttgctgagtggattctaaatttctgttacttccccaaagagcaaccactggcacacacatgcatgtacatgatacacaccaccctcaacacacacacacacacacacacatacccacacacacacacagagagagagagagagagagagagagagagaggctgacataaatttattttaatagacaaatataaatatttaaattgtcatggtcttaaatactaccaatggttttcaatttatatttaaaaaatcaattttaatatattgccaatgtcaaggacagccatatatactttagttatttctttaacagtttttcaaacaatcacagttatgtaattccttgttttaaattttattttaaggtcaggggtacaagttcaagtttgttagataggtaaacttgtgtcatgggggtttgttgtacaggttatttcatcacccaggtattaagcctagtagccattagttgttttttctggtcctctccctcttcccaccctccaccctctgaaaggccacattgtgtgttgttcccctttatgtgttcatgtgctctcatcatttagcttcctcttattagtgagaacatgcagtgtatggttttctattcctgtgttagtttgcgaagaataatggcctccagctccatccatgtccctgcaaagaacatgatcttgttcttttttatgcctgcatagtgttccatggtatacatgtaccacattttctttatccagtctatcactgatgggcatttaggttgattctatgttttgctattggaagataccctaagcaataccattcaggacataggcatgggcaaagatttcattatgaaaatgagaaaagcaattgctacggaagcaaaaatcaacaaatgggatctagttaaacaaaagagcttctgcacagcaaaacaatcaagtaaacagaaagtaaacagaaaaccaacagaatggaaggaaattttgcaaactatgcatccaataaatgtctaatatccagcctctataagaaactataagcctctataaggaacttattaccaagagcaaaacaaacaacgccataaaaaagtgggcaaatgaaatgaacagacacttctcaaaagaagacttacatgtggccaacaatcatttgaaaaatatctcaacatcactgatcactgaaaaaatgcaaatcaaaaccacagtgagatagcaactcacaccagtcagaatggctattattaaaaagtcaaggccagatgtggtggctcacgcctgtaatcccagcactctgggaggccgaggcaggtggatcaactgaggtcaggagtttgagaccagactggccaacattgtgaaaccctgtctcgattaaaaatacacagattagctgggcatggtgggactgtgccagtaatcccaggtacttgggaggctgaggcaggagcattgcttgaacccgggaggcagaggttgcagtgaacaagatcgtgccattgaactccagcctgggtgacagagtgagactctgtctcaaaaaaaaaaaatgtcaaaaaataacagatgctgatgaggtcgtgaagaaaaaggaattcttatatactattcatgggagtataaattagttcagtcactgtggaagacagtgtggaaattcctcaaagacccaaagacagaaataccattcaacccagcaatcccattactgggcatatacccaaaggaatataatttattctattataaagacacagttatgtaattctaaaacaaattgtacaaaacattcaagataaaatagaaaacagcacattattaaagctattttattgttataagagttatttttacacagtcctcttcaaaacaagctatttgaaatgttttgctccaaaacgtgtatccattaaagtggagtcaaaatttgattgctctcagccaacatactttactggaaaaagtgtgtttaaaatggtatagtaaaagaaaagataaaagataaaaaggtaaaggattgtgaagaattcaatgctgctatctgcatgtactttgtaaaaatatcaccctctccttcctgatcctctgtctctgtcacatttcgtggctcatatgttaatatgtcccacctcctgaacacttcagtcatgagagacccagcttaatgcacccaattgaaaatccattaaaaacacatatggcatcttctgtgttgaaaggattctcttaaagatcttacagtggtttgctgatttaaaaatatctccctgttataacaaaagaaggtgtaggcatttattatggcttgctgacttcaggctaaaaattttttatttaaatttagcctcttttagatgcctccctagattcaaaatcttatcggcattgcctaataagtagttgaaactttcagttcaacagagacctcggaaatcgatatatcacatcagtgttttattttgtctgtaaacgtggcatattaaattattgagttgtctgattttttctcggatttattgaggtataatgcacaaatcaaaattatattcaagttgtacaaagtgatattttgatatacctatacattgtgaaatgattaccactatcaagctaattaacatatccataacctcatagttaccttttttgtgtgagattgagatcgactatcttaacaaatttcaagtactcaatacagtatgattaactatagtcatcatgctgtacgttaggtctccataactttagattccctgttttgtaacacctgctttaggcttgctgagggtcactgtccagtagtagtgagcattttaagccaatttcattaagatacgatatttatgataaacattttttgtagcatcagccagtgaaacaaagtatctgaactaatctgaaaggattgctaataagcatcttagcctttctatctctggtttctctacaggtatcaccatgataaaatttttctttacctgaagcaattaaaaataaaaacactgtgtttccctggttgggcctttttagttcccagtgaaggccacctacggtggatagagaagaaagatactttccacacaaaatatcttactatttgaacctggtaattcacatatgcggtgaaatgttaccacaagaaagcttcagttttcataggtaaaaatagttatccacatatttaagcaagtttataattcttcatacaaatattcacaaaaacaaaaaagaccattttctccagcttcagatacacaccatttgacttcagaaactaagttacatccttttgtttgttgattggtttgtttttaggccatccaaccccctcaagataagttacattctaatgtgggcatgttcaaatcttacaggatgatctgcaagtatagaaaaacatacaagaagaaaaatttggaaagatttttatatcagatcacattttccaacatgattgtctagttggtaaagttcagcagtatcaaattcccattgttttctgtgaaagtatctcatcattatttaaaatgtcatattttaccttattcactaaactataaatataattggttccattaataatacatggcagataagctagcttttttatattattcatcattatgagataaaattcataggaccctatgaaaatagttcaatatatacctcatatgactgttaataatttccaacttattttagaaaacctaaaagcggaaccaaaactagcacaatttggaagaatttgaaactatactttctttcataaattttgaattatctaaattatctgaatttcaaacatgaaattttatgtttacaacttctagagatatttatttggaattaaaattacaaaatgccaaaggattggataatatttatccagtccaataaatgttaggtccttttttattgctgctacatatgtctagccacttaaataattgtattcaattaaatccacttttcatgtccagggatagttctattcccctgttatttccatcaagaaataaatatcctatcattttatttttattttttatttttatgggtatatagtaagtgtgtataattatgggctacatgagatattttgttacaggcatgcattgtgtaacaatcacatcagggtaaatggggtatgctcacctcaagcatacttccttcgtgtgtgttacaaacaatccaattatacttttttggttattttaacctgtataattaaattattattgactataatccctttgttatgctatcaagtactacatcttattcattctttctgactatatttttgtgtccattaatcatccccacttaccctcctctccccaacttaccacccttccagcctctggtaaccattcttctattctctatctccatgagttcaattgttttcatttttagctcccataaataagtgagaacatgtgaagtttgtctttctttgtcctttttccttactatatctttgtctattctgagtctcttgtggttctatatacattttacattttttttctacttctataaagaatgtcattggtattttgatagagattgcactgaatctgtagatttctgtgggtggtatggacattttaataatattgattcttcagtccatgaacatggagtatttttccatttttttttggtattgtccttaatctctttcatcagtgttttatagtttttgttatagagatctttaacttctttaaattaattcattgatatttaattttatgtgtgactattgtaaatgggattacttttttattctttttctcattgttcaccattggcatatagaaatgctactgatttttgtatgttgattttgtatcctcagctttgctaaatttatcagttcaaatggttttttttgctggactccttagttttttccaaagataatatcataccatctgcaaacagggataatttgacttcttcctttccatcatggatgccttttatatctttctcttgtctagtgtgtctaagtagaacttccagtactgtgttgaataataatggtgaaattggccattcttgtcctatttctgatcttagaggaaaggctttcagatttttccccatttagtatgatgggtctgtcatatacaatttttattatgttgaggtatattttttctattcctagtttattgaaagtttttatcatgaagtgatgttgcattttatcaaatgtttattcagcatcaaccaaaatgattatatggtttctgatcttcattctgttgatatgatatatcaccttaatgatttatgtatgctgaaccatccttgtattccagggataaatcccacttggtcatgatgattggtctttttaatgtggtttgagaaaatcgaagtgggggggaaatggcagataggagacagggataatgtatagctcccacatggacagacagaagagtgtgtggggactcacactgtgatcttttgcttcaagaacccccacaggaacataccaggaaaactgaaagaattcacagatcctttgaaggaagcagcacactgctgcaaattccacaaaacaggtgaaaaactgtgtgttcccaaagtgtgagagggcgaaaggaaaacctaccttcgatcacacatcctgactggggaatctgaaaatccagatcacaagaggatttaaccttacctagaaatgaaatggatttaggaagtcacatgagatataaaagtagaagtagcagtgggaagtgacttgcatgcactcccagcctccacctctaacctagaaaggccatccctgactatatctcacaggagccctcaggaaaggtggccagaggaattggggagggattatggggtgaaggaggctcccaaatgaaattggtagtggttttggctgggcacacattttcttgagtccagtctgggggacgggagggagctgctgcacatacaagcaagtgcaggagtacaggagctgctgctgatggagtgggcagacagggaaaggcaaggtcctaaagccatgcttgctttcccagtggagtagctcatggcttctggcaaggtcagagcaggggcactgcatgaatgagagactggcctcgccaactgcatgagagctgggtacggcttcttgctactggctatctcccacttccctggtgagctatactgcacagcagaggcggccaggattgcctatggaacataaccccattggcctgagaaccacctcaccccatgctccacagtggtcatggcaagccctccccaaggagagtctgcacccagacccaccaaaccctgcccccacatgacagtatttccgtaactaccctgatagctgaacacaaaacacagaaactcatgggagctttatggccccacccaacacctgagaaaccaaaatacttagcaggaccatcttagagtaagcttagagccctttagtactatcacagctggtgctatcttgaaagtgccacctcttagctggaggccaaccaactcaggccattacagcaactcaggacagaataaccctgatcccaggaaggagaagacaacacctaatttcactgcctgcaacatcctggctaaccagaggtcctgagtgtgtccatgtgacaacttcatcactagcataaccagcattcaagaaagccagcatactaaacatattaacaacaaagagctctcgcagagtctactttgcttctctgccacctctaccagagcaggtgcttgtatccacaactgggagacctgaagacagatcacatcacaggacactttgcagacatcctgcagcatcagcccagagcctgatagccccactcagtggctagactcagaagagcaataacaatcactgcagaccagctttcaggaagtctcatctctaggggaagggggagagcacgacatcaaggaatcaccctctaggacaagaaaataaatctgaacagcaggccttaagtttcatacctctccactgaaatagtctacccaaatgagaagaaaccagaaaagtaatcctgttatagaacacggttctataacacccccgaaagatcacaccagatccccacgaatggatccaaaccaagaagaaatctctgaattgccagataaacacttcagaaggtagattattaagctactcaaggagataccacagaaaggtgaaaaccaacttaaagaaattaaaaaacaatatagggtatagatgaacaattctcaagagaaatagatatcacaaagaaaatacaattacaacttctggaaatgaaagacacacttagagaaatgcaaaatgtagtggaaactttcaacagtagcatagaacacgtagaagaaataactttagagttcaatgaaaaggctttcaaataaacccaatcacacaaagacaaagaaaatattttttaaatgaacaaagactccaagaaatttttgattatattaaatgaccaaacataagaataactggtgttcctgagaaagaagagaaatctaaaagtttggaaaacttatttgagcaaataattgagggtaacttccctggtcttgctagaggtctagacatccaaacacaagaagctcaaagaacacctgggaaattcattgcaaaaagatcaccacctacgcatgtagtcatcaggttatctaaaatcaagacaaaggaaagaatcttaagagctgtgagacaaaagcatcagatcacctataaaggaaaacctatcaaattaacagcagacctctcagcagaaaccttacaagccagaggggattgaggtcccatctttagccccctgaaacaaaatgaaggagaaatgaagttgttttcagacaaacaagtgctgactactaagccagcactacaagaaatgctaaaaggagttctacatcttgaaacaaaaccttaaaatacaccaaaatagaaacaccttaaagcataaatctcacagggcccataaaacattaatgcaacagcaaaaatgcaaggtattaaagcaacaactaacatgatgagtaaaacaatacctcacatctgaatactaacactgaaagtgaatggcttaaatgctccacttaaaagatacagaatggcagaatggataaaaatccaccaaccaagtagctgctgtcttcaagagactcactaacacataaggactcacataaacttaaggtaatggggtggaaaaaaacattccatgcaaatggaaaccaaaagcaactaggagtagctattcctatatcagacaaagcagaatttaaagcaacaacacgaagaaaaaacaaaaagggacatcatataatgataaaagaaataggccaacaggaaaataccacaatcgtatatacgcacctaacactggaattttcaaatttataaaacaattactactagacctaagaaatgagataatgagatagatgtctacataataatagtgcaggacttcagtactccactgccagcactagacaggtcatcgaggcaaaaaatcaaaaataaacagtgaaattaaaccatagtctagaacaaatggacttgatggatatttgcagaacatttccccaaccacttcagactatacattttttttcagcacatggaatatcctccagagtagaacatgtgataggtcacaaaacaagtcttaataaatttaagaaaaaaattatatcaagtatcctctcagaccacagtggaataaaactggaaatcaactcctaaaggaatcctcaaaactatacaaatacatgaaaactaaataatctgctcttgaattatctttgggtcaacaatgaaatttaaaaattctttgagctgaatgataatagtaacacaacttaacaaaacctctgggatacaaaaaaagcagtactcagaggaaagttcatagcattaaatgcttacatcaaaaagtctgaaagagcacaaatagatgatctaaggttgcacctcaaggaactagagaaacaagaacaaaccaaatccaaaaccagcagaaggaaagaaataacgaagaccagagctgaactatatgaaattgaaacaaaaatataatagataaatgaaacaaagagctggttctttgaaaagataaacaaatggatggaccgttagtgagattaaccaagaaaagaatagagaagttccaaataagctcaattagaaatgaaccaggagatattacagccaatacacagaaatacaaaacatcattcaaggttactatgaacacatttttctacaaaaactaggaaatctagaggagatggatacattcctgaaaacatgcaaccctcccacgttaaattgggaagaaatagaaactctggacagaccaacaacaagtagcaagattgaaacaataataaaaaattgccaacaaaaagaagtccaggaccagattcacagctgaatcctatcggacattcaaaaaagaattggtacaaattttactgaaactatactcaaagacagagaaagagtgattcctccctaaatcattctatgaagtgtcaccctaataccaatatcaagaaaggacgtaacaaaaaaagaaaactacagaccaatatccctgatgaacatagatgcaaaaatcctcaacaaaataatagctaactgattccaacagcatatcaaaaagataatccaccacgatcacgtgggttttataccaatgatgcagggatggtttaacatacacaagtcaataaatgtgatacatcgcataaacagaattaaaaacaaaaatcacatgattttctcaatagatgcagaaaaatatttgacaaaatccagcatccgcttatgattaaaattctcagcaaaattggcatacaaaggacatacctcaaggtaataaaagctatctgtgacaaacacatagccagcattatgctaaatggggaaggttggaaagaattccccctgagaactggaacaagacgaagatgtccagttttaccacttctcttcaaaataggactgggagtcctaccagatcaatcagacaagataaaggaatcaaggtgcatctatattgattaacaggaaatcaaactgtcgctgttcactgatgatattattgtatacctagaaaaccctaaagatttatccaaaacactcctagattttataaacgaattcagtaaagtttcaggatacaaaatcattgtacacaaatcagtagcattgctatactccaacaacagccaagctaagaaacaaatcaagaactcaatcttttttacagcagctgcaaaaaaaaaaaaaaaaaaaaaatccttaggaatataattaaccaaggaggtcaaagatcttcacaaggaaaactacaaaacactgctgaaagaaatcatcgacaacacaaatagaaacacatcccatgctcgtggatgggtagaatcaatattgtgaaaatcaccatactaccaaaagcaatctacagattcaatgccattcccatcaaaatgccataatcattcttcacagaaccagaaaaaaaatatcctaaaattcatatggaattaaaaaaaacaccctgcatagccaaagcaagactaagcaaaaataaccaaacttggaggcatcacattactagacttcaagctatactacaaggctatagttaccaaaacagcacagtactggtatgaaaacaggcatgtagaccaacagaacagaacatgtatcaggtaggatgtgattattgaagagagacacatcattttgtatttgtggaccttgtgggtctcagtttctttatctaaaaaaatgaatgtgtattagttttggaagttgcgtaataaattaccactaacttagaagcctaaaactactaatttattatctcacagttctgtaagtcagaagtttaggcaggctgggctgggttcattgcctagagtctcccattattatttattattatttgttaatctcctaggctaaacttcctttttgggaagaaaagtagtttatttttgctggaatttctctctgtgttgttttcatcttgaggagatcaagtataaaagtgttgcgcatttactgagtaatattacaagcagaatgccacatattattaattgaaattctgattcaaatgtttatattaagtagaatttttccaacacagtgtatatgtgctaaacctctaggaagaatatgtttattttgcacctaaacattggatgatatgaggagaagcacatcttgataatgatacataacaataagttaggtgtagactaagacgttgttgattgagagacagtgtacttgatctaaaatctgtttcaggaacattgctatgaggatatttactgcaaaaaaaaaaatgtgtttttttcacattttgtactaatggtggaattttcacttttaataaaggaaagttacaaattatttcagggaatttttgttttattaaacctcctggtaaatcaaactgatttttttttttttattattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaaccgccacactgacttccacaatggttgaactagtttacagtcccaccaacagtgtaaaagtgttcctatttctccacatcctctccagcacctgttgtttcctgactttttaatggtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaataccaaaagcaatggcaacaaaagccaaaattgacaaatgggatctaatgaaactaaagagcttctgcacagcaaaagaaactaccatcagagagaacaggcaacctacaacatgggagaaaattttcgcaacctactcatctgacaaagggctaatatccagaatctacaatgaactcaaacaaatttacaagaaaaaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcactaaaaagtcaggaaatcaaactgatttttatgggtttgtgtgtgcagtttttaaaaaaaatttatgagcacatgataaatgcctactaaaacaaacactggtgttctagctctctctctctcttttcaaatatcatgaagaattgtccacagaatagcatttaggatggtgtagacttaagagggaaatgcatgtaccatcagtacttttccttgggcagtctagctaggatgtcacccacaggaggggatacaagccttgcaggacatgttaaaaaattaagactataaaattaaggaatacaaaggaacacattactattcaattcagtagggatctgtaattctgcactgctcaggtgcagatgaaaactactcaggtcagaatcaagttgtttctgtaagagacagctctataaataatgagctgtttgtttctatgagagatagccctataaataatgagctgttctcaggtgagccaatcattaccaattgcctgtttaaaatgtcagaattgtcaaggtcaattggtgttaatctaatggcagcactgacctagtgtcacacagagtctataaattaaattttaagtctcacaaaaggattatctttgtttctagagacaatatttgaatcaacaatgttttgggtacttccgtgaaagtgatgtgggtggattgaagtttaaaaggtgtagacaattgtccattaaagcaattacattaatgcatcaggctgatttgaaatcagtattgaggtagagtcagaatatttgcatatttttttctttgtcataacatcctcaccaaagcttttggaaattgctgttttcaatgcacttctcactccacagccaggacataaagagtgacggggaaaaagagaaccttatcaggaagagaaagaaataaccattagaaagttgttcaaaatatattatttcatgaaattgtctttcttctgtaacttgtctgtttccatatctccttgtcacattcttaggtatttcagtaataaaaaaattatctggataaaaaaagaaagtaaaaaaaatgaagtttaggtttgataaaaattacttttatgagttaaaagaacaaagtatatttcctctaaaagaagttgattaccgactccttgtaacttttcataaattaacgttcagatatttttcaaataaataactgatgggaactcagcttgttgaaaatttgcttggttacacattcaacaaacctgatggacagttttgattatttttgccctttacagagtaagtgtgaaataacactaattaaaagcttttctactgaataatccatgtgcatcaccttccaaaatttcacttaaggggcctacacattgacaaaaacacattttattccctttgcttaatttcattagtgggacttttctttgactttgtgggaacatttagatttttctccagagcatgttagagctcagaacgattagcagagcatttgaagtaaccacagctcagggataatgggaatgagccctatagcactgtgtaagcactgggaccatttatagatgttctgtgcaatggtggataaaatagggccacactatactgttccagaagcattttctctagagccttctataagtcccttctatgctaaataattcaaacatgcattttgcattcagtaaacaattgaaaacacaaggaaatgaagctttaaaaaggagttgtgctcagtcagtatattgctttcaactttgaaagaaggcaaatatataaaatgatcctgaattgcctactcaatttctagcagtaagagtaaagcagagaaatctcattctactccacctatccccctctcaccaaaatcaagaattgtgtctttattgttgttataatttgcttcataatgttttcttgacaattgagacattgtatactgcattaattatttacattttgtatgaacattaaaataatgagaacatatatttgtttagaaaaaaatccctctattttttctctcataaatataattctactgttatgttagtatgttcataatttgagaaattctaagtcttaagaaatcttggaattgtatgaattctcttttacctactcattagcagactcataattttagaaatcttaattgagatccatgtgccagttatactaattagtgtataatttcataatctgagtacttacagaaagcacactcttgaaaaactctgtatctacaaatgcttttgactatatggatttccagagtcaaaatattattcaaaaaagtaataataacatttaccacaaagcttccaatgatggttcatctgtgggtgaatttcccatttacaactttgctcccagagcactcagaaatattttaccccttttcatttttttaaactagactttattttttacagaagtcttaggttcacagcaaaaatgagaggaagttatagagatttcccgtatcttctctaccctacacatgtgtaacctcccccattgtcaatatcccccaccagagtgacacatttgttatagttgatgaatttacacatcaatatcacccaaagtccatagtttacattggggttcgctcttgtatattctatgggtttggaaaacatttaaaataacaagtatcaacaattatagtatctatagagtagtttctctgccataaaaatcctccattctctgcttgttcatccctccttcccctattccacaacccctggcaaccactgatatttctactgtctccatagttttaccttttccagaatgtcatatagttagaatcatacagtatgtagccatttccaattaacttattgtacctagtaatacagatttaaggctcctccacgtcttttcatggcttgatagatcatttttttttagcaatgaataatcatttctgaatctaccacagtttatttattcattaacctactgaaggatatcttggttacattcaaattttggcatttatgaataaagctgctataaatatctgcttgctggttttgtgtaaacataagttttaagctcctttgggtaaatactaaagaatgtgattgctgagccttatggttaatagtatatttagttttgtgaaaaactgccaaactgtcttccaaagtggctatagattctctttcattgggaagatggcaatacataatatctaagtcattttacgactcagtgttttctatcatataggaatgacctttactttagttagtatttggcattacatatgcatgtataaaatgtatagtttttaaaagagtgtttgttccttaatatagttagtagttatgaaatgagtcaagatctgttattgctaatgttggcaatatatttttattaaattagacattttggatggttttaaaattataactcagtaataatagctaacctgtatgtagcacttaactttgtgccagacaccattctattggcatatatcgtctcacttagttaatattttaaattctgtttcttcagattaggaaactgaagtctagagtagttaaatgacctcttgaagatgacacagttagtaagtggtaaagctggggtttaaacacagtctgtctagctcgagtccatactctacactttaagactatagtagttgtgtttaacaggctttagatcagggatccccaactcctgggccatggactggtactggtccctgacctgttaggaactggggccacacagcaggaggtcagtggcgggcaaagaagtgaagcttcatctgtatttacaaccactctccatggctttcattactgcctgagctctgcctgctgtcagatcagtgatggtattagattctcataggagcataaaccctattgtgaactgtgcatgccagggatctaggttgtgcgttccttgtaatctaatgcctgattatctgaagtggaacagtttcatcctgaaacctacctctctccatggaaaaatagtcttccacaaaaccagtccctggtgccacaaaagctgaggacccctgctttcaataacagaatcttaggtctctattataaatgtctttcagaggttaaatcacttttgcagcatataaccaacccttggcaaaagcaattgatgtaagatatctcttgctaacttttaaggcaaattcagatgacctgtcatttcacatggactctacaaaagcacagcttctggagattctaaatcaaaagatacaagttcttgaattaataaaaatcaaaaacaaattcatattttgtggacatcaatgtaaaaaatatatacatactgtgctacaaataataattagcgcacttctagttatacgaaggatagctgtatgttaggcataattatgacctcattattgtttatatttgaagattatgtatgatttcaagagatgtgtgtgggttcaagttgacaaggggtggacgtgtgatggttaatattgagtgccaacttgattgaaggatgcaaagtattgtttctgggtgtgtctgtgagggtgttggcaaaggagattaacatttgggtcagtggactggaaaaggcagacccaccctcaatctgggtgggcaccatctaatcagctgccagtgcagctaggataaagcaggcagaggaaggtagagggacttgacttgctgagtcttccaggcttcatctttctcctgtgctggatgcttcctgctcttgaatatcagactccaaattctttagttttgggactcttggacttacaccagtgatttgccagagggtcctgggccttgggccacagactgaaggctgcattgtcggcttccctacttttgaggttttggaactcggactggcttccttgctcctcagcttgcagatggcccatcatgagacttcaccttgtgattgtgtgattcatgtttcctaataaacttcccttcatatatacatataccctattagttctgtccctttagagaaccctaactaatacagactcccattatcctaaatggattaatgcaagaatagaaaaccaaataccacatgttctcacttataagtgggagctaaacattaagtacacatagacataaagatggaaacagtagatactggagactactagagttgggggggagctgcaaaactaccaattgagtactatgctcactagctgggtgagggatcattcataccccaaaccttaggatcacacaatattcccgtgtaacaaacctgcacatgtaccccctgaatctaaaataaaatttgaaattatcaaaaaaactcataataacaacaataaaaagaataactgcctgccagagatgcccatgccttaatccctgggacctgtgaatatgatgccttagataggaaaggacatggaaagtcgctaatcagatgatattgcagtaagtatattatcctgaattacccaagtgagttcaatttaatcacaagtctccttaagtttggaagagggaggcataacaggagatcatagtgatgggacattagaagaactgacctgctcttattgtctttgaagatggaagaaaagggctgtaatccaaggaatgtgagtagtctctagaaactggaaatggattattccttagaaagaaatataggcctgccaacatctccattttagcccagcaagacccattttggaactctgacctccagcactataataaagatttgtattgcgttaagccactagtttgtagtaatttgtcacaatggtgataggaaagtaatacacgcacacacacacaaaacaaaatttggctttaattggaaacattgtctttgttaaatcaagccatatgcataatttatctcttggctaatttttgacttttaacctatttgagctctctcatccttgcatctatctagaatctattactggcttcgttttttgtgggactttacttggaattccaattcttcttattatagggaataagaaattgagtaccttttgtttagctggtttaagcacatttcttcctcctggtctcatcagtaattgtgtgtgtgtagtaagtaaggcacaaaactagtatagaaacatctgaatggctgctggaaatatttttttaaacatgccacttaggggcttaaatactaagaaatatattagtatccagttttcaaggaaatggaccattgaagctcaacttgaaagcaacatatggcagtctcatcttcatcatggtttgacatgtgttaaaaaatttttgaaaagaaactaccaatattaagaatcaactaggcaaacattataaacataaatacagatgctcctcaacttacagtggggttacattatgataaacccacagtaaattaaaaatattgtatgtaaaaaatgtacttaatacatctcacctaacaacacatcatagattaacctagtctgccttaaacctgctcagaacagttacattagcccatagttcagcaaaatcatccaatacaaagcctattttattaaaaaagtttaatatatcatgtaatctattgactattgtgctgaaaaacagaaaggttgtatgggtactcaaagtacggtttctactgaatgtgtatcaatttgtgccattgtaaagtaaaaaaaaatcctaaattgaaccatggtaagtcagggactgcctgtattgaaaagctgacttgggaataaactacattttcattgaaatatgaatgtatgatctagcagtctttctctccaatcatttttgaaccaaaacagatttccctatctcactaaagtcattatttgaggtcccttgttgccaggcactagctgtatagaacattgattttcagagaaaatgctatgataattgaagaatgttaaaaagcagatagattgtttccaaatttctcagtgaatagtttaccattaaatttgaattttatcatcatgtaggatttactcatagttaataatactattccttttaagaagaaagactctcaagattgagaaaatatagctagagcttgtgtgcaatgatttcaggcagcacatggctttagaaggcttgaattctaagttagtatggcagagttatcacatcattgactgatttttcctttcaattcaaagcatgttgataggttttctttcttggtatagaagggagaggaatctcttgatgacatattatcttagtactttgtgcattttcttggttgagacacttagaagactgagcaaatactgtataatcagggttatatagaaaaacagaatcaacaggatgtatgcatatatacacacacacaaacacacacacacacacacacacacacacacacacacatatatatatagaaggagatttattataagaaattaaagcataagattatggaggcttggtgagtccaaattctgctgtgtgggtcagcagagtggataaccaagagaaacaatgatactaataaaatctgtaggccatctgctggagaattccttcttgcacaagaaggccggtatgttggttctattcaggccttcagttgattggatgaggcccccccacatcatggaaggcaatctgctttacccaaagttcactgatttaaatgttaatcatatgcaaaaacacccttcaagttggtgcataaattaaccatcacatgatattttagaaaacatctcataccgttgtagagttatcacttcttttgatgagggtgctattttatcctgccttctatgactttatttttaactattgtagattttaaaagcctattgttatatcagacagccaattgattgaaactaagtaaatacatttttcccaaatatctgtatattccatgtgtaattcttattgtaatagaattttttgcaaatattatattttttgatttgtattttttaaacatttttagttcacacataattgtacatatttatgggttacatagtaacgttgcaatacatataatgtatagtgatcagatcagggtcattagcatatttataatctcaaacagttatcatttctttgtgttgggaacatttaatatcctccttctaactatttgatatattatcattaactatagtcatcctacaatgctatagaatactagaacttattctttctttctagctgtaattttgtaacctctaaccaacctcttctatctccccttcccctctatgcttcctatcctctggtagacaatattctactctctacttctatgagatcaacttttttagcttctgcatcaagaatgaaagcaagaactgttttgacacacgggaaatatagtttatttaaagcacacactatctaaataatctagatagataatgtgctaaataatacactcacatgcacacacactcgctttatgtttcctgaatatggatgttcctcaatagaagacaatatttttgtgaaatgctcagtaaaatagtgaaaatgtagtcaatatgatcgcaagttttcatcatcagcagttagggaacatgacaaattcaccatctaagtgtcaaatacttttctaagtgctttacatgggttaactcatttaattctcataataactatatgatatagattccattatcttccccttttcataaatgagaagactgaggaacagagcatttagatgatgtgttcaaggtctcagaactagtgaatggtaaggaatccagccttttaggctttagagaccatgctcttggcaattaaactataaagccttttaaaggagattttaaaaaattcttataatgtgactcagttgtaaacaacgtaagtgatagagattttagactcacggagctagaagagctttcatgtccaaatctttcactttatcaatgaggaatcttaggaaaccagagcagtaaaatgactttctctgcttatgtaatgcatctttgatatctattgtaacttttctgagaagttcccccattgcagaaggcaatggcagatagggaagcaggggagaaaaatcattctgaaagaggcaatgtaagagctgcagaatttgtttccagcttctgatctattacttaatttaggtattggcttagacatgaacatgattaagcttcataattcacaagggtgtggaggaggaagaattgtactcagggccccattgtttactaggggatttttcacattcagcccagtgtttaaaggtagatttagtctaatttatagtccaaataaatgaccagataaaagtacatgtttttctctgcacctattcctcagcttaaaaaagaggtgagacagacacttagcctggaaattaagcttcatggtttattttagtgactccccttatctgtactaccaatggcatgctgtgaatatattcttgactgctgcacttagtaacacttctctcactatgtatataaaaaagaccaagctacttattttggggttttgtaaaatgaacaacctaatcaaacgtggctcttgtggattttattctttgtgggcacccacagtaaatatataactttatatcatgctgaagattatcatttagtcatatatattatataatgagtggtgctttgtatagagaagatgctaaaaatgccctgattaaatttattaggcatgatgagatagaaaaatacttactgtaaaacaagaaacaaacttggagcctaaaaaacattcaaatattactttgaaagaaaggaaataagcattttattatatttactaaactttaagagaagttttttaacagaagtttttccagacagtacactttcggataccctcaaattacatttcaacaattagtggtttgttgtgtgagcaaatttctttatagagggaaattaatggctggtatatcctagctaaggatgtaaatgtcatgggtaagtgttcacaatggataatacatgccctgaaaatgatacagatggattttgatttattttcaagtgttgtgatctgatataatatccttctaattcacattataaagcatattttcaatgtatgatattcactgctctggaatatcatagaattaatcaaatgctgtgcatagataaaggaaacaaatgaattacttaagcttgtgaacaaagatcaagtaggagcaaatgaatcaaatccttaagtgtagtgtgtatatataaacatttgttttcgtgtaggtaatcccgtatatatagatgtcttaggagctttgtagaagtgtttctgtaatattttagagaccttaacaactgtaacctgaatctgataaaatggtgcctagcttagattataataaatattgtttgttttttatgaattataaaatgaagtaataaatttaaagtctgataaatatcaatcctatttatctgtttttttctgaaaagtgaaataatctgctattcatatgtctagcaaaattatttcaaccattttgatcattactgtgaattatttagtttatattgttataattaacatattatatttacagtctacctgatagtcacatatacagagagtctaatgagtaagtaaaagagtacacaaggtttgctgagttcttactatgtgccaggtactagtctgagcccttgaacataacacaagagccctatgaaatacttacatttctttgtgtctgttattcaggtaaggaaatcgaagcccagaaatgctaagtaaattgccaagatcaccagcctaggaagtaatggagctaggattcaggcccagacagtctagctccaggaattttgttttaactatcattactgattatcatggccacgttgattagcaaagcagtagcattcttaccaatacacttatgaaagattgagacatgctattaaaagcagtaatctcagggaaataataaaattaacttcgtggcagataaaatgcaaaggaagtgaaataagaattagcaagtataatgactccattgttcaatgagattccagcagtctttaagaaaaaatatgcagtaaagatttagtcaactctagacactttgactctcagaaatttggtgagtttttagaactacttgacttctatcaatgttatgcaaatatatgacatgttggtgattctgtattcttcagatactaggcaggctcataaaaagcctctactgaggagagtagtggagtgatttacttaaaaagagcaggcctaaaatgacagaaagcaaatcgaaatccataaagtagtaagaaactacttaactattatataattagtgttagcatatatacaagatctctcagaataaattcaggaacagaaagataataaagagaaataagccccaacaacagaaattttgtaaggctcaaagactcattaaaaggtgttagatctagcccaaatgtccatagatagttctaaaacgtagactattcactggactaaaatgatagaaaaaaattggtagtaataggtagaaatctattttaaatataaaagactaccaaaatttggaagcatacctgatagtggtggtaaaatgctgtccatgtgtgtctgtgtgcatgtgagaaatattagtaaaagaataaaagaaaaggaaatcatctctcctaagacactatggagagatatatggtatacaattctgtaaagtaacagataaaccacggcaggaagggaagatttttggcagaaaagagtaagaggaaaaaaaaaaaaaaaagaggtcctctccaaatatatatatatacacgtatatatatacacatacatatacatatatacacatatatatacttactatatattatttttgtttctttctcagaaaaaaaaaaactttgaggtacaacttgtgaccatcaaaagtgagaagtaggggattagcccttagctagcaaatacaacagagctggtagccctgtcacaagcagtagcacatttaggacttagttttccatataattcccaatacaatgacaactgttgtgtttacttggaagtagatttgatggcttaatttggcccttgatgctggaaccagacaacatggtaaataagctttgaaagtagcctagtgtcagagttggtcattagagtggttcattcaatatggttatggtgttcagacttgaaatctaagcataaaatatatatgtagatgggaaaattctgtagccactcctatggttagttttaatagattagatttctaaatatgtaagatttaaaagcacctgtaatcttagagggactatttcaaaacactgtccaggcaagggagctgaggtgaactttgttttgggaaattcattacagatagttttgttttttcatttttcttttctttttcaataagctttagtggtgtgtgtgtgtgtgtgtgtgtgttgtgtgcgtgtgtgtgtatatgatcattaattttgaaataactgccaacattagttggcttgaaagaaaacctttttgaaagtttttagcttgttccaatttacttttatataataaggggcagtaaaactatttgcatgttggtctggcagaaaaagaaattatgaaaggcaaattaattatgttgaaaatagtctgctaatgtactatgagtaattggtattaacctatgagtgaagtttacactgacagattttatttcattagaagacagcattttctaataaaatgaaatgagccatcttatgaggcagggagatttccagcactaaaattgaaaaagcaaaggatatgtggacactgacagactgctctattgaagggcttcaggtgaaggttacactacgtgaattctaagtccacttctacctctgtgttttataattttaggacttatttaaaaacttctagataaaaagaaacacagtattttagatgtgcattatctggtcttttgtcaggagttgagttcagaaaaaatgattaagataatattttttggctgatgaatgcaatttaatcctatagagaagtcatattttaagcagtcaaacattctctactcaatagaaaaatacgtcattatacttatatatattttttcatcaacttttattttacgttccagggtacatgtgcaggatgtgcagctttgttacatacgtacatatgtgccatggtggtttgctgcacagatcaactcattacctaggtatgaagcccaggatccattagctattcttcctgatgctctccctcaccccacccgccctcaagaggcctcagtgtgtgttgttccccgctccatgtatccatgtgttctcattgttcagctcccattataagtgagaacatgcagtgtttgattttctgttcctgtatcagttggcggaggataacggcttccaactccatccacgtccctgcaaaggacgcgatgtcatgtttttttttaatggctgcatagtattccatgaatacactattatatcttttgatggtctgttcttgaccaaagctcagccacagctgtggaacattgtgtatgattatgtgtatacgttatttcaaaaaagaaaaagacaaaaatgtcatgcccctttttgagttttggaaagagaaatggtgagaaagaaagggggagaaagggaaaagaggtaggaggtgagacagggggagaagtttggaagaaaaagggagtgaaaataggaagagagtacagtaaagataaagtggagaaacatgggaagagggaaaggggagcaagagagggaaaattcaaaagagaggccgagagagagaaaatgtgttaaagatgaagagaggcaaacagagtcagtagtagcaagagagaaaaggggagaaatggaggaagagagcagagagaacaagagaagagagggaagagaggtatgaagaagtgggcatggtgtatgtgtctgcattgtgtgagtgtgtgtgtgtgtgtgtgtgtgtgtgcgtgcctgagaaagagatagagggagagagcaaatttctagacttaactgtgtactgaaacatactcatccagtacctacttaataatctgaaaacattttcattaacatcttacagtcatcctatgttaaattcatgaatacgttacaagtagcatttccaataagaagtggagattactggcactcttgctcccaccctttttacccacaaatcttaaacacatttaagtctctggaattacccacctttagttaattttgattcctttacctttgaatgaaaaatttatcttttatgaccaaatactgaaatgatgcattactgaagatgtcatgaaagaaaatgtagcatgaaaaacatttaacttcttgacttcctgagtaccactatttggattataaaaatattttaagataatcaaggtgggtctattttgaaaatctctaactagtaaaagcagacctatgtcttgcaaagcttttgccacttcctaatgcctcatttgtgccagttgaaaaactgcagtaattaacaggccaagctgtattcagaagattcagacacagccagagaaaactgtctcctcctttgctactatcagcctcaggagagagaatgggttactcatggaccagatcatcttaaagaagaagcagtgaaataccttagtaaaatattagaaactcttttgatgtataatattactttacattagtgaatttttgttgtcagataggcaactcaaatacctacaatgcgttttttcaaccttcaaacacaatttagcacagttctctatgcaaatatttgaagatatttccacccatgatgaattttaaagaaaatttattttactaaggaaaaggagctcagcttttataggaaagataacattaatgtttactataatcctgacatattttgatgcatttttatcaaaatattcgctagtttatttgtttgttgacaaaaatccatgcatatttatgaactgcttaggtagtaagcagttattcctaaatttgtcagtgaataactattgctaaatgggaaagttggtgtgaagaaatgaatattttaggtgtcagacatgcctaagcaaatttcattttgtttgcaattagtgtttaattcttatcctcaaaaattttctagtaaaaaaagtaataacaatcataatgtgaacaattaacaaaaatcacccaaaatagggtttctaaatggagacattcttaatggccctttcgttgaatgtgttgagtgtctctaaagagaaagggtgataacaaagttgtggttaaggatatgtctccatccaaacaaaatgttataagtttgttaattaggacaataataaaactaacatcacagatgcattcttttcttaaaacgtagctaaatatttcacctcagctattgaaatctttttttcctttaaaaatgggctttgtctttgtctttcttttagctgttccctttgttaattgtccctaaccatgggaatgttattgtagaagaatttcacggcccaagctataagaatcattgattagtggcattcaaattttaccagcacgaggagaaagcttagttcctttaggcttgggttggaatagcacccataattaaagatgtctgtcaacccttgttatgcttctagtcttaacatttttcccccctgaacataatttgctcttttgaaagaatagctttttcttgagatttataggtcactctttgttccttgctaaaatcggaaattcttggcacaacactccgctgttagctagatatttttttctgactgtagtgaggtttaaagacattagttctgggatactttctgtgtgtctctctttaggatactctaaaacagactaggggcaccttatccaattcttcaaaactatatggaaatagtttaaattagattttaagtcaatatatgattttaaaattctactttggagtaccttaattcaattaattatttacccaaaatgctactaactttactggaaccatcaaattgttgttgttcatatacattatatggcagcaattccaactgaagctatcttcactgtttttcctcaatgaagaccttttgttattcttcattgaattaaagaaagcttgagttttgtcttttcctgcctgagagtcctagataaattatagaaattagactggaatcccactgtagatatgttactgagtttaaactgaaataactctgtgtctaaaataaatcacccaaagctgaacagaaaagttattggacaattagaagaacatttaattgtataagatgaaactcagcaagctgtaaggcaatgtaattaaatagacacagcttaatgaagataaggaatttgaaagggaaataagtatttttcaatgtatgctaattcaggtagaaaatacctcagcaagatgtgttatcccaattatatgtcaagcttaggaaattcaagttttaaaaaaagcactgtttaaaaaggaaatatgcaagtgaggaacaatattggaacatattttcagtttttcatggctatagagataacaaatgtcttactagagaagacccagtacaacatgaagacccagttttcatggacagctaaattattttcttataatttgtaattttgtacaatttcttacacttatatttcccagcttcttattgtcatttatcttaaagttaaattatttttcctaaagaacattcattcctgaatttgtgtgttatttcatcttatcagcttcaattaatttaacgatacacttttcaatctccatagtgaatcagtgctgagaatatccactaaaccttgtcacactttttgttactgtccatttttttagagaaacagaagttttgtaaaccaaaaagtacctgagacaagtctcaatcaatttagaaagtttattttgccgaggttaaggcggccccaatgacatagactcaggaggtcctgatgccacgtgccaaggtggttgggtaccgcttgattttatacattttagggagacataatacataaatcaacgcatgtaagatttacattggttcaatctggaagggtgggaaaactcaaagcaggggcttccaggccataggtagattcaaacatatactgattggcaattggttgaaagagttattatctatagaaaggaaagtctagatattataagcgcttgtgaggacctaggatttctcatgcaaatgaagcctccaagtagcagactttagagagaatagattgttgatgtttcttaccagacttaatgtattgctgttaatgttggcagggtataatgaagcatgcccaacacccacttgccataatgggttgaaccagtctttcatgttaaattttagggggctctggctgaggagggagcccattcagatggttgcagggggcctttaaattttatttttggtttatagtttctttgtcctatccaggtaccttatgatcttcaagttatgtacaatccagagggggtgcgatatttcagcaaaatggggtcttttggggcaatatttatccttagtacccctcaattaatggtgcataaagaattagaaagtagttgaacatagagttaaattgtaattggcagttctgtgagatgaaaatttgatttgcctaagtaattttaaccttcttaacatttagctaatgtatacaccaaaagatacacatttgaccacttgtaattatctcaaacccttacaacttacaatcgtattttcattcttgacttgctcctctctgaaacatacagttagctcttttttgaaatcaaaacatttatataatataatatatataatataatataatataatataatataatataatataatatagttgagaatggttccttgcctaaaataatttttatcatttgctattaacttgaaggtaatatttgaaggtgtttgtttatttgtttttgttttttgagggtcctgaaagggattatttaagtttagctataggcaaaatatttatatgattttagcatgaagccatacatgaataaagcttatttcttagctgcatcgatgtcattaaggaaatgatcgtaattgaatgggcttaacactttaccttttcattttttaagaatattcaatgaggatgcttattatcttctcattttattagatttactattaatttaataattttaaatatatgttattgtaattatttatataatgatttaaatagtttaattcaaagttacaactggcaaaggaatcccttttatgaaactataatcacctttaaggttctggattgatatgctagatacttgattaggtaattgccacttaataggaatctattttcttaaaactatatacagattttgtgagtgaggagaggtttagactctgacttttttcattcaactgccatatatataatgagaaggaggacaatagtctgagcactttttctacgtctatagctcaatatacatgactattattttcttttaaataatagtacacatcagtactatgttgttacagtttcgggaatctagtcgaatttacacaattttttcttacctaatatatggaattatttgctttgcttttgcttatgttttctaaaataagcctatctaaagagtaaaatcagaataatttcccattgcatcaaacacagggacaaatattaaatgcccaaagtttattctttatgaaaaaagtaaaatataaagttcaaataaatgcaacaaaatgtacccggtatgcatattggctgcttgtgaaatgattgctaccagttttactaattcatttcttccaaattcatgtgaatctaaaaaaactaatataagaaaatatatttggaaactgtgtttctttcaataatctattctgatatgcagagtttttactgtatggataggaagagtgattagatttattaactaggtctcattagttcaaaacatcattacactgtttctctctgtctttagcgactgtgtaggatcttcctttattcattgtataatttcaacatctggtacagtttcagtagttttttctcttttttctcaaattttaaaaattaagcttaatgtcctcatgcaaatatgacttttatagctcatacaattgaattaaattcactatgtgtgcctatttgtctaattaggtcaataaagtcgccattaattttagattgtccatctgatattatgcaattcttctcacattgagaaaatcatcactagaatatttcatgacaaaacaatactggttcttttaaaaatgtgtgagcttctattttgcatatactttcataccatctttccaaaagaaaggtaatagccatgaataaatattgtcttggatctaaagttgctacaacttccctttaatatctgaagactggaagaatcaaagtagcctgacacttctaagtcagaacataagtgttttcacaagatacaccctcagaagcatatttgtggtttttaaaaactacttgaacatttttacatctgtccaagatggaataagagggactagatttatcctacttctgaaacaactaaaagagagagagaatatatgaaatgacatctgtcaaattatggacctcaggcaaaaaaggacagtgatccctgacagacaggaaacaagtgaagtaaacctaaaatttccacagctcacaatcttgagggagttgccagaacacaatgcagagaaagataatccaggtggagcctgaataacttcctgagttaaggagacagagatggttagaatttctggagcaaagtactgaagagaaaagagctagacagagagaataccctggagatcagcacagggtctcccttgggtattcatcagcttgttgatcagtgtatttgtgagggaaacatctgaagtcactgtgaaaaagccatccagtagtattacagaataatgcctggttcttatacatggctagaaatagtgcctgtttctactagtcagactggaaaaaaaattatgtttctaaggcactgaacagagtactccaaaaggtctttctcagtagtgggacataattagcccctagatgaagcataactctgcatctactaacaaataacaaaaagaaggcctgaaagaatcaaacttttgaagtaacttatattcattccagataaaatcttgatcatatttataaaaatagaaaaatatctggaagccaacacagtgaatttcacaatgaatgacatagaagcaaagattagtgaacatactaataagcagggaatcataagctataatgagtagaataatcaacagaaactgagagctgacacaaatattaggattagcatataatagcatcttaaaatgttattgtaattgtgttttctatgttcaaaatgttgagtagagatacataagatattaaaaagactcaaatcaaacttccagaaatgccagccaaaatgtatgagaggtaaaaatgcacaggatggaattcatgttagagtagacatgcaagaagaaaagatcagtgaatatgaagacatagcaatacaaactattcaaaatgaaatacagaataatgactttttaaaatgacaacaaaagtaactgagctctgggacaatttcaagtagctttatttatgtggaactagagtctaagaaggagaggaggtgtgagacaggcagaaaaaaatatttgagttaataatggcaaaaattttccaaatttaatgacggctctgaactcatcaagtcaagaaggttaatgaatccaagcacaagaaacatgaagaaaactgcacccattacagctcataataatcaaattgctcaaactcaatgataaagaaaaaaaaatgtaacgcagccagagaaacaagacacactatgtagagagaaacaaagatgacagcagaattcttgtctgaaacaatgcaagtaaaaagacagtggagggctgtctttaaagtgctgaaagaaaaaaaaaagtctacctagaattttatatccaatgaaaatatctttcaaaactgagggcaaaataaagatatttccaacatacaaaagttgaaagaatttatcaccagcccacggaaatgctgaagtccatcaggcagggaaaaataaaatgccagatggaaatgtggacatacaaaaacaaagaataacactacaaatgatcactacagggtaaatatacaagctagtttttgtatcattaaactctctgatatagtttggatgtgtgccctgcctaaacctaatactgaaatataattcccagttttggaggtgggcctggtgggaggtgattggattatgggagtggatttctcgtgagtggtttaccaccatcccccttgttattgtccttgtgataatgagtgagttctcattagatctgatcatttaaaagtatgcagcccttcccccatgcctctcttgctcctgcttcaacttccgccatgattgtaagcctccagatgcctactccagagcagatgctgatgttatacttcctgtacagcctgcagaaccataagccaattaaagatcttattttcttttaaattacccagtttcaggtatttatagtaacgcaagaacagccttaacacactgtattataaaataacttagctatttataaaacattaatgacaatatattggagtttataacatatataagtaaaatgtatttcaataatagcacaaaagtttggaagaggagatatagaagtctgtgtgtgcatgggcgcacatgcgcatgtatacacacacaggcacacaaacatatatatgtattgtttttgaaaacaggatctcactctgttgcctagtctggagggccatggctgagtcatggctcactgcagcctcaccctcctgagaccaaatgatctcctggctcagactcccaagtaactaggactaagggttaccacacatggctaatagaatttttttttttttgtagagataaggtctcattatgttgcccaggttggtctcagactcctgagctcaactgatactcttgcctcagcctcccaaagtgttggaattataggtgtgagccactgcgcctggtcagaagtatattattgcaatgtttttataatatacgtgatgtaggataatatagtctgaaggcagtctgtgataagttaaaggtatatactattagtagtaaagcaaccactaaaatgaaaaagttgtatctaaaaagacaacagaaataaaatttgattataaaaaatattcaatctactgtagtcactaataacttaattgtgcattttaaaataacttaaggagtataattggattgtttgtaattcaaaggataaatgctcacggggatggataccccaccttcagaaaagaaggcagagaaagaagaaaacaggaaagacataggacaaacaaaaaaacaaatagcaagaaaatgggaaagacataggacaaacaaaaaaaaaattcttacaaacaaccagtaacacctttaaatataaacagtgtaaacacctcaattaaaatgcagatcatcaggtttgataaaaatagacaagattttaatgtaggctctctacaaaaattcactttaattctgaaaacacatcttaaattatacattatgtaaacaatagttaaaagaagtggaaatggctatttaatatcagaaaaatagatttcagagtaaataatactaatagagatcaagcaagatagttcataatgttaaaggcatgcattcatcaagaggatatactcattattcatgttcgtgcaactaataaaagaaccttaaaatacatgaagtaaaaactggtagaactgcagggaaaagtagaaggattaacaattttggttgggaatttcaatattctttcatcaactgattcaacaagttttgtgatcagagaggacataatagactggattgccactgtcaactaacttgacctaattgacatttattgaacattccactcaatgatagccgaatacgttctttgcaagtgcacatagagaatctactaagatacactccattctggactataaaatgtttcaataaatttaaaagaattcatgttatagaaagtatgttcagtaacctcaatggaattcaactgtatatcaataagggaaatatacctggaaacatctccaaataattaaaaactaaatagcacatttttaaataaattattggtaccaaaataaaacattttgaactgaatggaaatggaaaaatcagtttgtcagaatttccgtgatgctactaaaccaggaaatagggggaaatttatagtgcttttattagaagcaatgacctcagtcttaatttattagaaaagaaaaaaaaggaaaagaatcaaggacctcaggcttaatattaagcaactggaagaagaagaacaagttaaacacaaaggaatcacacacaaaaacaatagcgctcaaagccaaaaccagtgaaattataaacagaaaaagcaagagaaaatcagtcaacccaaaggttcattgtctttgaaaaaatcagtaaaattataactgataaatctctagccagacataagaagagaagatgcaactttgtaatatcaacaatgagagaagtgacatcactacagattagaaagacattaaaagaagaaagacgaaatattttgaacaaccttatgcatataaatttgacaactttgatgaaatatacaaattactcgaaaaatgcaaacaaccaaagttcactaaaggagaaatagataagctgattagtcctatatctattaaggaaatggaattccttgtttaaaaccttcccacaaaggcgacggcaagcccatatggcttcacttgtcaattctactaagtgtttaaaggaaatataacactaattccataaaaaatttttctgatagttaaagtggagagaatacctcccagttccttctatcaggccagcattgccctgataaagaaactaaacaaaactaaaaatccaaaagaaaaaaagaaaactaaagatcaacatccttaatgaatatagatataaaattctaaacaaaattgtatcagtcaaatccaacatgatatacgtcatttgcaagtgatgtttattctaggatgcaaggatggtttagctctttaaaatctatcaatattattcagtgcttaaaagaaatgatatatcaagccatgaaaagacatggaggaaacataaatgtgtattactaagtgaaagaagtcaatctgaaaatgctacttactgtatgatttcaactagatgacattctggaaaaagcaaagtaaaaagattaattgttgccaggggttgtgaggggtctggagttggagtggggaggataaacagttggaacatggaggattttcaaggcagtggaactactctgtatgatactataatggtggaaacatttcattgtacatttgtctaaacccataaaatgtacaccaagtgtgaacccaaatgcaaactatgaactttagctaataatgatgtgtcagtgtaggttcatcaattgtaacaaatgtaccactttggtgggggctattaacacgtaagaaacgatgcatgtgtggagtagacagtatacgaaaaatctctgtaccttcctctcaattttgctgtgatcctaaaattgctctaaaaaataaagtctattaaaacaaatcaattaatatattttaccatattaagaaaactgaaaaaggaaaagcacgtgatcatcacagcaaatataagaaaaatatttgacaaaatttatcatccggtccttataaaaattcttagtaacatacaaatagaaaagaacttccacaacttaagatagaacatccatgtaaaacctacagctaacgtcataataatggtgaaaaacagaatgctttccccctgaatatcaaaagcaagatatgcaattattaggaaactattgtattagaagttaacaacacaatctttaatctatcagttagtagttcacatctgacagttgaaaacagaataacagccatgccatagttaagagaaaacacgtaaatattactaatcatgatactccacatttctttcagactagaaagtaagaaaaaaaaaagccacaggcttacttataggttttgatgttttgatgcagccattaaaacatccaataaactcggtgagagccatctgtgatttcaccttagctggcttagctgcttttctcctttcagaagtgcatatcccaaagctgtatctcttggattgtgtgtgtgtgtgtgtgtgtgtgtgtgtgtgtgtgtgtgtgtgttcgcttgctcttgttcagtgcttaataacagacttacaaaagcttttagtatacaactagatttccttgatcacattatgctagaatttgggtgacctactccacacacaacacaggaaattgatggtaacttgtgaagtgagtagaagtgactgaatttaatttggaagagtccccaaaaaacaattagtttagcttgaaattcttataaggagagttttgggtactgttaggtttcattttatttgcctatactccagaaaaaaaaagaaaactacatcaaaactgttgtgatgaaagctagtgatcttcagcacatcaaaacttgttcaaaatgcttgcatctgatctcacacaatagggatattcacacaaaatatctgtatagaaatcatgttttaaaaattaagaaacaaaatacatgaagaaagtaactttcgggtgaatcatatagtgcatcattatgtaacatcaaataagcctttgatatttcctcatttttcttagatttttatacactggctctatctgtagaaagtaggctggaagggaaatattcttataggacacaaattgaaatagtttattttagttgatcccttaaaatctcttagtaatagtcaaagaattatgtatgggtttactttttaaatggatttacacatttaatgaaaccatgtaagatgaaactaggatatttatcatttagcatcttattttcattagttgacagaaaaaaatccttttgtagaacttattttaaaggcatttcatactgttaaaaaggaacagctttcaaaatacaaatcaagtatataaatccattaagtgcagtcacatcaatacttaggtcaaaaccatcacatgacacatagtactataagatcatacttaaaatccctcttatctgtaagtctttatattaactgcttagaattgcagctgtctcccttatttttctctaagtcttcgtagacatcatatatatatatatatatatatatatatatatatatatatatatatatatatattcttaaatgtcagaaggatagtgttgttttcatatagagtggaaatgactagatacttaaaaatacattgttcctatggaaagtaatctctggaggtttagattaaagaaaaatactattcgggtatgagatgaaagctatataaaatgactaattttatttcaattttataatcattcagggctacatctttcaaccttatctctaaaatatgcaagtagatagcaggacaatactagagtgccgtgttaattccctttgctaatgtactggcagtcaaaactgaaagactacaattttatgaaagcaagaataaattgcatgtaatcctggcctttacaatgaaagtcaaacttaaccctaaatgaaattcctaaatttttagggcctcttttatcccaaaatgcaaaggccagttttgtcatacatgatgaattagatgcgccacgttcttgtattaacctccaaagaaggcaactcttggtattctaaacatctttttaagtcagaagacaagtatatgataataaatctctgaaattgttatgggcaaaattttctggtgttctaaaaatgcagcctatttgccagcatcttataataaatattataagtaaaaaataatggtaaatttatagttttgttgcaaagaaagaattatagtaggctcttacaaaaactaaaatttgtcttctaagttcagataatcgtaggatgaaaccgaacctttacccattttgaaattgctgcatgtttccaaacccatcttggactttctataccctacttctcagctctgtttctagttgcattgccagatttcagtttagccatttagtaccaactacttttggcatgaaacaatgattcaggaattagctagacaattgttagtgtttaggtgctataactacattatacttttaattgggacacacaacacaaagaatggataaggaagattttatacatacacatgctgaatcctctccgtggtgaaacggaatactcagagccattttatttagtacactaggatgtgtttggggtatttttttgttagttgtactcctcacagtacccctttagatatagacattattgtgattcccattttacagataaggaagaacaagtgatttaaattattgacccagaatcacatatcttggaagtgcacatttattttgccttaactaaatattaaattttgccttttcacactcctattatcagggatattataatttatattttaaacattatactattaaagttgatgctgaaaaagctttctcagtaccatgatcttattcataacacagttattgaactgcaaaatgttggaatcccatgcaaagttaattaaaatatatatcatacttgactgcaagtattgtaaatgaccataaaaaatataagaaagctgtgcttctgtcatatgttcttgatgcctggagtttgaatttggattcaaacctgtttcccatatatatatagctatttaaaataatgtactaggaaggatttgtgatatatttatctttacgtgaaggacaggctgaggcaatatatatttttaaaatttagcagtaatttgcatctcattaattctgattttccttctcttacctttctctctgactgattctcactgttttcttcttttgtttataatcactgtgactattcaaaattcgtccatacttatagagatagtttagtaacgcatgcttgcaggtgttcaaatgaaagcaggtcaagtttaaaaatcctgaagatacaatttttatttttgtattatgagcatgtattttcttgcctggttacatgcttcaattcttggggttgagagcatgaaatttaactccagaacacctaatgcacaggaatccctagaaaatgataaaccccaggtatatgtagtacaaagctgatcctgggtaattaatggtcagtcaggaagtgcagttactgcaaagagcatgctacctaagaattcctctatattcatattcatgctgagactagatacaaaatttttataaaaattttgatgtgtgcatttgagtgtgcaagctaggggaaagtttgtgttgggggggtgcagcagtctaaaaaatcttgatattagactccaagaaatgattgttatcaacatcattcaagtgcaaatcttgatgcgaagggcatacaaaaagctataggtaagaagcaattcaagaatatagagtgcagaagtcatctatttctctatagtcacattcagggaacatttatacacttccaagatgtgttttgcatacatacactgtacaaaatttttgtcatttttaagatgcacctagtaattggagggagttttatatttaaaactcatattctatatggttattttagccacgactgataaaattttgtagctaaaagttgatattattttgcagtttgagatttagaagaaaagaaatcatagagaggagaaaatgcccatacagatttttctcaagaagactacaggatgaggctctcagttaggaattcttttctctaccagtctcctggggacataaagagtaattttcctccaggccttggcatggcaaatgcacaaaaattagtgaatatagtcatttccaattcactcactggtgtgtgggatatggttgccttaaaccatattctctttaagtacgtacacacttccagtaacttgggcaacatactggtatcctcccaattacccaaatttctggaaatcagaagccaatcctgtttttatttcaaaaatcagatctaattccttagatggaaatgccttctaggcattcggttatgaggcattccatgctaccaatgtctccttcctaatctaggctcctgagacctctgaaatgttttacattttgttatatgctatatggtatcctatgttttaggatttcctagaagcaaatttaaggtacttgctttgtttttacttcattctcatgcaagcagtcttactattcttggatccttaacttccaatactatgctttaattaagagtttttagttattatgatacaattatttttaaatgaaatcattaatttttaccaaggaaaccttaagtcaacattttccctttaaaaaaagaaatgctatttaaaattggcacaataaagtcagcaatcaaagcaaaagaagaatttgtgtttaaataatagttgacaattctgcccaccacattatttccaattccatgttctgttacagccagaaaggaagcaactaaactcatgcagcttatctcggcgtgctaggggtaatggactgtgggataagtgatggcatgtacagaagaaacgtaaaattccacagttgctctgataatgtaccttgggtttggaattcaatacagtagttgttatggttatacaggctgtgctctgtcctacactaagatgttgcaatcagatgatacattgatattagttgaatatgttataactgttaaagaaaagcattatttataacacttgttaaataaggtgaggaaggtcctaaggagggaccattgcaataggtgtagggaccactgcaatgggaacttgcggtgcagtggggaagaaagattgggcttgactctgattccaacaaggacaagaggacattgatatccaaggagcagtatggggtcagtggatagaatattactaagaggaaacatcaggcataaggaggattcctgctatgccaactcaacagacttcttgctgaagacaggccaggatgataagatatagaaggtgaggataaggacagacatcaaggatgggggactttctttaaactaatttagcaggattcttacttaaactggattctacaaggatagagggaaacccaagatcaggtctcgtcgagcagaggcctcagaggagcctgaataagagagagtatttgttacaatatacaaatacatacacaaagccagtactttgcagttcagcacttcccatgttattgggtccacagaaacaagagactgttatggaatgggtctgtcatattgaagactaaagtgcatggagggagcagtaagaagctattatgatctttgggggttgcttatctcaaggaagattctgacaaagatgaattgaaacaataacagcttaacaagtacaggacaagacaaaaacagccaaattatagttaaacagacaaaaaattaccaaacattttttgaggaggcagatatagagggaaaaaaaaaacttacaaaagaaaatactgtcgcttctgaatagatgagataaccctgagagataatattaataacataggctaaagcatttggaatttgattgcatcttatcattgtaaaataaagactagtgactaggaaaaaacattaaaacaaattggtacaagtagtttgatggagtggaaaaatactttattagaagtcaagtgttgaggattcagactcaatgctacttttgtcacctgggtaactgtgataaatcactcggcttctagcgctgttttctctgctgtaaaattaagttagattaaatgatctttaaaattcattccagacatatttaatggttttgtatgtgataattttaacgattttatatttatatttgagaatttatatttgagaatagctttatatttttaatcagatacaaactataattatttaattaattggtactataaaatttcagtaaaaaagaaataagcaaaggctggggtaatgggggaggtttaggaaagatgtagcatttaaactatatagatcacagttgcttaaaaagctggctgggattttcataagcagacagaaaaagggtgacaaaaagaattctaataggaggaataactggagtgatcaggagaagtgggatggctagtagatgggccaataataagagcagcctgacagaaatacagtagacaatgacacatcatatggggattgtgtgatttaataatttatactagcatgttaaattcttgtagaatgtatttcaagacaaaattatatttcagcatttcaaaatgtatttcaaatcatgcaatatttgtatttattgtcattctttaatttaattttatttatttcaatagctttcagggtacaagtattttttggttacatggatgaattgtctaatggtgaagtctgggattttagtgcacccatcacctgagtagcgtacactctactcaataggtagtttttaatccctcatctccctctcaccctctcttcttctgagtctcctatgtctttccattataccagtctatatacttttgcatatccatagcttaccacccacttataagtgagaacatgcagtatttggtttttcattcctgagttacttcacctagaataacagccactagttctacccaagttgctgcaaaacacattattttattatttttatggctgattagtatgctatggtgtataccacatatatatcaatgtggtatatatatatataaatgtgatatatatatacaaatgtgatatatatatatatatatatatatatatatatatacaaacacatatatatcacattttccttatccactcattgattgatgggcacttaggttgattccttatctttgcaactgtgaattgcaaaagcacaaaatatttttaagtaaacagctataaattagaatattttgttctttccattagagtgtaagctccatgtgatcattgtctgctttgttccttctgtattcctaacatgtagaaaagtggctgaaatataagcacattttgcctatgttagagtgtgctttaaataagtcagaattggtttttacatcttgaaaaatgggatattttatgttaaaacaacctcgcaaaatcactcccatgtatagagagacataaggaagatacaattgctatgagcaaccttattttttcaaaatgagaactagacatttttgtagcttttcaactacgggcatttatgactgtatcctatgtattagcaaaaaacagatctttgtttttcaggtagaaatagtaactagccatccataacatattatttttctctcaggagactgtgttaaatatgagtgtacttatattgtaaaacaacatctaccactagagtaaaagccatttgaaagtcaatgcactacaactgctgtttgctatggaacactgtgcaagagagtactatttgaaatatttgaaacactttattacagcaggacaggaggtcaactgatagtaacagaatttatgtggacttcattttctgcaaacttggagagtagcctttctatttttccatgtgatttttaaagtcataattctaaatatgtcaacattcataatagatctagaaattatttacataatcatcaatactgaaaaggaaggggcaggcattctttggacacaaattagcatcatagaggattatgaaatttggccattctgtgtattaaatttccattttaaagtaatgttactagtgttgaatcttttcttctctgatgcatcaactattccagtcatctaaaattcatttttagctgaacaaatttccatgaaattattgtgacttctgacaactttattttttctagttattgcagtccaacaatcacataataaacatcacataaattgcatgaatttttctcctattgaattaataaagccatggagcaaattatattttctgatgattcttaggtaaggatttggaaatttctttttttttttttcttttttaattatactctaagttttagggtacatgtgcacattgtgcaggttagttacatatgtatacatgtgccatgctggtgcgctgcacctactaacgtgtcatctagcattaggtatatctcccgatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctctagcacctgttatttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctaagtcttacattttcattattaaggataaagaatcacccgttagcactggtgggtaggaaagcttccagttgctctgtccggagccctggcctgctgaagttgtagagtattctagctgcagtagcaaagcctacacctgctcattggtatggctgctgctatggcagtattatgggtgtggtaattggttcttccctacttttcacaagtgctaatggtcaccagagctggatgccagaaagaaaactcccctaagtatcccgaaaacatcctctacctctctgccatttctgtctataggaaattgggcttcatggtaattcacattgtagcaaactttcgtgaatatctgttccatatcaaaaaatatatgcactaaaaatacactttaaaagatctattgctttttattttaattggatatttattgcagtttaaagttgatttggcagttgattttattaatgagtagtcccttcaatgtaaaagtaataacacttgacttctactttgggatgtaatgtttgaggtaagttgaacaaaagaaattttatgatttttcttaactatttaaattagacaacaagcagtgtttttctgtttgtcccttgagtcagttgtaaaactttccattctagctgaaaagaggttaccatttgtgaactttgaaaaatataaaactgccaaagaatgaataactctagaatataatagctgttttaatgcattgttcctataactatattggaaggggaaaaatcatatttactttgggacatattaatcagctaggaataacagttagtacaacgcactacagagaacagtttggaggtttctcaaaacactaaaaattgagctaccatatgatccagcaatcccactcctgggcatatactgaaaagaaaaggaatcagtacatcgaagagatatctgtactcctatgtttgttgcagcattgttcataatagctaaaattcagtagaaacctaagtgtccataacagatgaatggctaaagaaaatgtggtacatataaacaacggagtactattcagccatcaaaaagaatgagatccagacatttgcaacagcatggatggaactgtggaactggagatccttatgttaagtgaaatagcccaggcacagaaagacaaacatgacatgttctcatttatttgtgggatctaaaagtcaaatcaattgaactcatggacttggagagtagaaagatggttaccagagactgggaaggtagtagggagtatgagggaggtgggggtggttaatgggtatgaaaaaatggaaagaatgaataaaacctgatatctgataacacaatagggtgactatagtcaataataattatatattttaaagtaaagagtgtaattgaattgtttgtatctcaaaggataaatgcttggaaggatgtataccccattcaccatgatgtcatcattttacattgcatgcctgtatcgaaacatcttatatacaccataaatatatacacctactatgtacccacaaacatttttttaaatgtaaaaattaaaaagagaaactaatcaaaatctaagcagagggaccttgaagaggtatcagagtgataattttacaaaggaaaaatgaacaggcagattttgtcactaaataatcaccagggtacccaagttaaaattctgcattttatatttagaagcaagttggcacagggctgaaacatcagaaattcagtatccaccagtaatttcttgttattgctaattctcattagaggtctaaccacaaattgctatctacctttgatatttagatcttgttcctccatgcatcttagtatcttacatatgagttttatttttctgtaagtactatatccatgtatgcagatctttattatacattgttttaatattctctatttacactgggaatcaggtaaaatcagtttgttactttgctgttatttagaagtgaggtctagaagtcagagagtttcttaaaaagttttagtatgtagctttggtaatatgagccaagctgacatctacaagagcataaaataaatatctattatatgcacaaatgacagcataatagtaaagttgaccgtattacgaacattagttcacaatcttagcatgtattttttttttcttcaactttattttaagttcaggtgtatattgcaggatgtgcaggtttgttacataggaaaacgtgtcccatggtggtttgctgcacagatcatcagatcacctaggtattaatcccagcattgattaggtatttttctggtgccctccttccccttccccctaccacgacaggccccagtatgttgttttcccccacgtgtccataattgtggtcccataattcagctcccacttatacatgagaacgtgtggtgtttgattttctgttcctggttaatttgctgggaatgatggcttctagcttcatccatatccctacaaaagacaagatctcattcctttttatggctgcatagtattccatggtgtatatgtaccacatttcctttatccagtctatcattgatgggcatttgggttgattccatgtccttggtattgtgaatagtgctgcaatgaacagaggcatgcatgtatctttacaagagaataatttatatccctttgggtatatatccagtaatgggattgttgggttaaatggtatttccgcctctaggtctttgaggaatcaccacactgtcttccacaatagttgaactaatttacactcacaccaacagtgtaaaagcattcctttttctccacaattttaccagcatctgttgttttttgaatttttaataatagccattctggatgacatgagatggtatctcactgtggctttgacttgcctttctctaatgatcagtgatgttgagcttcgtttcatatgttttttacctacatgtatgtcttctttggaggagtgtctgttaatgtcctttgcttactttttgatggagttgtttgtttctttcttgtaaatttgtttaagttccttgtagactctggaatttaagcctttgtcagatggatagattgcaaaaattttctcccattctgtaggctgtctctgttgatagtttcttttgctgtgcagaagctctttcgtttaattagatcccatttgtcaatttttgctattgtagccattgcttttggcattttcatcatgaaatctttgcttgcacctatgtcctaaatcatactgcctagattttcttgtagggcttatatagttttgggttttatatttaagtctttaatccacactgagttaacttttgtgtaaggtgtaaggaaaaagttctagtttcaattttctgtgtatggctagccagcactcccagcaccagttattaaatagggagtctttcaccattgctggcttttgtcgattttgtcaaagatcagacaggtgtagttgtgcaatcttatttctgagttctctattctgttccattagtctatgtgtctggtcttgtaccagcaccatgcttttttggttactgtagccttgtagtatagtttgaagttgggtagcatgatgcctccagctttttgatgtgagcatttaatgctataaatttccctttggcagtgtcccagagattctggtacactgtctcttcattctcagtagtttcaaagaacttcttgatttctaccttaatttcattatttacccacaagacattcaggagcaggctgttcaatttccatgtagttgtgtggttttgagtgaatttcataatcttgagttctaatttgattgtgctgagactgtttattattatttcagttcttttcatttgctgaggagtgtattacttcctattatgtgatcaattttagagtaactgccatgtggcaatgaaaagaatgtatattctgttgaatttgggtggagatttctgtagatttctattaggtccacttgatccagagctgagctcaggtcctgaatatctttgttaattttctgtcttgacctgtctaatattgtcagtacatgttaatgtccctcactattattgtgtgggaggctaagtctctttttacatctctaagcacttgctttatgaatctggatgttcctatattgggttcatatatatttaggatagttagcttttgaattgaaacttttaccattatgtaatgcccttctttgtcttttttaaatccatattggtttaaagtctattttattagagactaggattgcaacccctgcttttttctattttccatttgcttggtaaattttcctccatacctttatttgagcctatgtgtgtctttgcccatgagctgggcctcttgaaggcagcataccaatgggtttggctctttatccatcttgccattctgtgtcttttaattggggcatttagcccatttacatttaaggttaatattgttatgtgtgaatttgatcctgccatcatgatgctagctggttactttgtagtcttgtttatgtagttgcttcatagtgtcactagtctgtgtactttagtgtgtttttgtagtggctggcaatagtttttcctttccatatttagtgcttccttcaggacctcttgcaaggtaggcctggtggtgatgaattcccttagccttcgcttgtctgaaaaggatcttatttctccttcacttacgaaatgtagtttggtcagatacaaaattctgggttggaaatccttttcttcaagaatgttgaatattagcccccaatctcttctggcttgtaggatttccactgagaagtctgctgttagtctgatgggtttccctttgtcagtaacctggcctttctctctagctgcccttttaacattttttcttcaattttgatcttggagaatctgatcattatgtatcttggggttgatcttctcatggagtatcttactggggttctctggatttcctgaatttaaatgttggcctgtcttgctaggttggagaagttctcctgcatgatatcctgaaatatgttttccaagttggttccattctccccatctctttccagtaccccagtcagtcatagatttgctctctttacataatccatatttctcagaggttttgtttgttccttttcattcttttttctctatttttgtctgcctgtcttatttcagaaagacagccttcaagctctgagattctatgctctgcttagtctattctgctgtcaatacttgtgtttgcattgcgaagttcttgtgttgtgtttttcagctccctcaggtcagttatgtttctctctaaactagctattctggctaccaattcctgtattgttttatcatgattcttagcttctttgcattgggttacaacatgctcctttagctcaatgtagtttgttattacccacttcttaagcctaatcctatcaattcagccgtctcagcttcagcccagttctgtgcccttgctggagaggtgttgtggtcttttggaggagaagaagcactctggctttttgagttttcagtgtttttgcattgattcttcctcatatctgtgggcttacctaccttcaatcttttaggttgctgacctgtgaataagggttttgtggggtcttttttgttgatgttgttgttttctgtttgttttccttttgacagtcaggctactttactgtatggctgctgcagtttgctgggggtctgctttagaccctagttgcctcagtttctcccatacctgaaagtatcaccagtgaaggccatgaaacagcaaagataacagccagatccttcctctggaagctccatcccagggagatactgatctgttgccagcctacatgcacctgtaggaggagacgggatacccatgttggcaggtcttacccagtcaggaggaatgagataagggatctgcccctagaagctgtctggctgctttttggtagagcaggcatgctgcattgaggggctctcttcctcatctggactacctgaattctccaaagctggtaggctgaaggagctgagttggccaaaccacaaagatggaggccaccccttccactgcaagctccatcacagggagggatcagagctctattcatagtaccctggctggagtggctggagccccctcagagaggtcctgcccagtgagaaacaatggatcagcatcccacttaaagaagcagtctggccaccaactggcaaggcagctgtgctgcattgttggggggcccttccttatctggaccatctgtattctccacagggggcaggctggaatagctgagtctaccaaaccacagagatggtggccacccctccccccaggaattcagactcatctcaggcagactgcaatctgctgccattggctagctgggattccaagccagtgggtcttaacttgtgaggcaacaggaagtggggcacacagaacaatgctgcttggctcactggattcagcacccttcctagggatatgtgcggatggatttcccaccttactggtgatcccaaggccagagcatgtaaagttcctgggtgtctgtgtgtgtctgagtggctgctctgctgagactccacacagctctgtgtgtcagacccaaggccctggtggtgtgggctcatgaagtgatatccagatccatgtgttgcaaagatccatgggagaagtgtggtttttcaggtggggttgcgcaatcactaccacttcccttggatgagggtggggcttcctttggctccatgccactcccccatgggccatcacctttccccacttttcttcatttttttgtgggtcgagttgttttcctagtcagtctcaatgtgagaacctggatatttcaattgaagatgctgaattccctcaccccttcttattcctctccgtgaatactgtggaccacagctgcttctaattagccatcttggatcgtgttttttgcgacatttttaaaatacacctttgtaaactgttacttgttcttctctcactgtttaaatttatggaaacaactaaagcatgtttcacgaggaaaacttcaacaagtctgacatatattttgatattattaatgaggaatattcaacaagaaatgctaataagacagacctcagtataaagtggcactgttcccactatacagataacacatttttcctagctatcggtagtgtcaatggcagtaataacagattcatactgcctgattcctttctctctgaaataatttagagaagttaaacttaattttatgtaaaaatgtaaaattttccaatatttatttttggggtattttttaaactttattgagcataattgacaaaattgtttataataaagtgcacagcctgatgatttgatatatgtgtacattgtgtgactgttacgtcaagttaattaacacattcatcactgaaaatagttatcctttttttttctttttaatgagaacacttgacatcaactctcttagtaaatgtccagtctgcaaaacactgtagtcactatgcggtattttagagcttcagaacttattcatctgaatattcaactgaacatttatatcctttaaccaatgtctccccattttccacactctggatcctggcatccaccatcctattctgtttctctaagtacaacattatattttctttttagattccatacgtaaatggaatcatgcagtatttttctttctttgactgacttaaataagccatgtcctccaagttcattcaagttgctgcaaatggtaggttttcctttttttaattgctgaataatattccattgcatactacattttctttctttcttcattcattcattcattcattcatcaactgacatgttgtttccatatcttggctattgtgaatgctgcaataaacataagcatgcagctatctctctgagacactgatttcatttcctttggatatatactctgaagaggggttgttggatcatatagtagttctattttttaatttttttgaggaaactccatattgttttttcataacagctgtaccaatttatatccccaacagcagtgtgcaagtgttctctttcctctacatcctcaccaatacttgttatcttttcaaatttgataatgaccatctaaataggtgtgaagtaatatctgcttgtgattttaatttgcatttccctgatgattagtgatgctgagcacctttccttggccatttgtatatattctttgggaaaatgtctattcttttacccatttttaaattgtattatttggtttttgtttactcttgagttgtgtttcttatatattttagatattaaccccctacgagataaacattttctttcattctttaggttgcctcttcattttattgtttgtttcctttgctgtgtataagttttttagtttaatgcaattccacttgtttatttttgcttttgttgctgtaattttggtgtcataaaaaaaatcattaccaaaaccaatgtcaaggaacttttccccgatgttttcttctaggagtttttggtgtcagtttgtgttttttcactttgtttgtttgttgttgttgttgtttgagatggagtcttgatctgtctcctacgctggagtgcagtggcgcaatctcagctcactacaaactccacctcccaggttcaagtgattctcccacctcagcctcccaaatagctgggattacaggcaccccccatcatgcctggctaatttttgtatttttgtagagacaggctttcaccatgttggccaggctggtcttgaactcctgatctcaggtgatccacctgcctcggcctcccaaagttctgagattacaggcatgagccaccacacctggccaggtttcaggtcttatattgaagtctttatttcaagttaatttttgtaagtggtgtaggggtgcacttttattttgagggtcttgctatccagtttccctgacacagtttgttgaagagacaatccttttgccattgtgtgttcttggtgctctcatctaagattagttgactctatacatgtggatttatttctgggttctgtattctgttctatcagtttatatgtctgtttttataccagcaccatattgttttgtttactatagttttgcaatatactttgaaatcataaaatgtgatgccccaagctttgtcattacaggccaatatccttgatgaacacaaatgcaaaaatcttcaacaaaatactaacaactcaaatttaacagcacattataatgatcatacaccataatcaaatggaaattatccctgaggtgcaagaacagttcaacatacacaaatcaataaatgagatacactatattaacagaatgaaggataaaaattatagaatcatctcaacagatgcagaaaaacaatttgacaagctttaccaaattaggtaaagaaaaaatatacctcaacataatgaatgtcaaatatgacaagctaacagataacatcatactccagtgaaaagctgaaatcttttctgttaagatcaggagcaaggatgtccactcttgccactgctagtcaacatagtactggaaatcctagccagggcaatgaggcaagagaaagaaataaaaggcatccaaattgaaaagaagaagtaaaattgtctctattggaagatgacataatcttatatacacaacactctaaaaactctgccaaaaaaattactagaatgaataaacgaattcagtaaagtcacagggtacaaaatcaacagggaaagatcagatgcatttctatacactaacaatgaactctcaaaaggagaaattttaaaagcaataccatttacagttgggtattagtctcttctcattctggtaatatagacatacctgagattaggtaatttataaaggaaaaggtttaattgactcacagttcagcatgtcaaggactcaggaaacttacaatcatggcagaagaggaagcaaacacatccttcttcacatggcagcagcaaggagaagtgcctgtgaaaagggggaaaagcccttataaaaccatcagatctcgtgagaattcactcactgtcatgagaacagcaggaaggtaaccacccccattattaaattacctcccaccaggtctctcccatgacacatggggattatgggagctacagttcaagatgagatttaggtggggacacagccaaaccatgtcattccaccccggccccttccaaatctcatgtccttatgtttcaaaacaaaatcacacccttccaacagtcctccaatgccttaacttattcctgtattaaaccaaaagtccatgtccaaaagtcttgtctgagacaaggcaagccccttctgcctatgagcctgtaaaatcaaaagcaagttagttactacctacatacaatgggtcaacaggtgttgggtaaatacatccattccaaatgggagaagttggctaagagaaaggggctacaggccccatgcaagtccaaaatccagtggggcagtcaaatcttaaagttctaaaatgatctcctttgaatccaagtctcacatacaaggtgctgatgcaagaggtgagctctcaatgccttgggcagctccatccctgtggctttgcagggtacagcccaccatcctggctgcaataacaggctggcaatgagtgtctgtgggttttccaggtgcatgatgcaagctgtcaatggatctactattctgggatctggaagactgtggccctgttctcacggctccagtaggcaataccccagtggagactctttttggggcctcttaccccacatttcacttctgcactgcactagcagaggttctccatgagaactccatccctgcaacacacctgtgcctggatatccaggcatttacatatatcttttaaaatctagatagaagttcccaaacctcaattcttggcttctgtgcacctgcaggcctaacattatgtgtaagctgccaacccttggggcttgcaccctccaaagtaacagcctgagctatatattggccccttttaatcatggctgggacacagggcatcaagtcccaagactacagaaagcagcaaggccttgggtccagccaaaaaaaaaaaacatttttccccctaagcctctaggcctgtgatgggaggggctactgtgaagacctctgacatgtcctggagacattttctccattgtcatggcaattaacatttggctccctttttacttatgcgaattcctgctgccagcttgaatttcttatcagaaaatgggtttttcttttctatagcatcatcaggctgcaaattttctgaacttttatgttttgcttcccttttcaacataagttccaattccaaaccatatctttgtgaatacataaaacttaatgcttttaacagcacccaaatcacctcttgaatgatttactacttacagatttcttttcctggataccctaaatcatctctttcaagttcagagtttcacagatctctaaggtaggggcaaaatgccaccagtctctttgctagagcatagcaaaagtcacctttattttacttcccaacaaattccccatttccatctgagatcacctcagcctggacttcattgtccataccactatcagcattttagtcaaagccattcaccaagtctctaggaagtttcaaactttcccacctctttctgtcttcttctgagccctccaagcttttccagcctctccctgttacccatttccaaaatcgcttccacattttcagttatttttacagtagcaccccactcctggtaccaatttactgtattagtctgttctcacactgcaaataaggacataccagagactgggtcatttgtaaaggaaaaatatttaatcaactcacagttcagcatggctggagaagcctcaggaaacttacaatcatggcagaagtagaagcgaacatgtccttcttcacatggtaacagcaaggtgaagtgccaagcgaaacaaggaaaagccccttataaaaccatcagatcttgtgagaactcactcaccatcacgagaacaacatgagggtaaccaacctcatgattaagttacctcccactgggtccctcccacatcatgtagggattatgggaactacaattcaagatgagttttgtctggggacacagccaaaccatatcaagcaacatcaaaattaataaatttaggggcaaatttaaccaagggagatgaaagatctctacactgaaaactataatgcatcagtgaaagaaattaaagaagacattaataaatagatatcctgtgttcttaaattgaaagaattaatattgttaaaatgtccataccatccaaagcaatctatggattcagtgcaagtcctatcaaaatgccaatgttacttttcacagaaatataaaaaagaattctaaaattcatatggaaccaccaaggacccagactagccaatgcaaacttgagaaacactgttttgttagcaggtctattatatagttatcagagtcttgcctaagacttgttatttatattgcaaggttttatccaactcttcagctagaaagaatgcatgtcgtgttaacctgatggtgctatgttatattaatgaacaatatcatttcttatttgaaaccttagttattatggctgcatgaagatcaagatcacttaggaagaaaaccatgatgtaacgttacactattgagcatcacagtctttgaattaaaataatacttttacattatcttttctaattgaaaatgctcctgctaaagtgtggggttttctttccagattttcctccatcagcaggacttacatgtgctttgtttagagagctgacagtttgtactagagcatactacagctgtgcctctctggcctagcaacatgtggtgtcagatgatctttaatgactagggtacgggcttcaacacttagaatctttaggaacagcagacagctcttgaaaacaggagacatacataagggcagagctgaaggaaactgctagcgtttagtttaaatggtgccaaaccttacaatcatttgtgggtcactgagttttttatctttttacagctgtttttgagtatcagtgacagataatttgtaatagcattaacattttaacaatgcatgaaaaaaggaagtattttctttacttttgcattcagtaatttaatgtacattcagctctttaaaagaacagaggataaacttaaagttattggaactagaggaaagttacgacaatcctttattttaatgacttataatggaagtgggagataatataaaagacaatgcatgagaaagctgaatatggaataataatagaaattacagtggttaagaagattgtttttaatttatcctgtttgacagagtaagttacatttgagagcacacaagagtagaaaagttcattcatacaaacactgtgtatcacacaatgtattatttttgtatgtcaagcatgcaggtgggcccttgaaaattccatttttgacttctttttttttcctttttattcacagccaaaataacaattagaggccatgtacattagatgtgcaattcccagctctggctttgttgacagcagacattaggtagagtggagtgtcttctagacacacttgtgagttaaacttaatttatagaggagggaacaattaagggacttgacaatgaagtcatttttacaatttatgaaacctgatttctttgtcccagcttaagatgaattgactctccattgatgtttctttatatctatctcttaataaaagatcttgttcaattaataaaattctttaaacaactattagctatcactttaagaagttaaacattggcttacaagagaaaggaagtctattaaaaccatacatttgattttctctaatttttagaagcccacattttgtcagttgaaagtgtccgcaaaacagcaggggtttggtctaggttctgctactcactgcacagaaagccaatgactgagatgacaagtattaccaaggaggaaggaagaaggctttaattgggtgctgcagccaaggagatgggagctcagtcttaaatccctctccttgactgtctaaaattaggtttttatatagtggggaagaaatgtaacaatattagaagataggaactagagaggggcaaggaaacaatcatgatgaatgagggatctggcatctcattatctggatgctctgatctggtgagtttcagttctttgatttttttttttttctgagaggcctgaacatcatttcctgaggaaggaatgcagataaaacaaatataagtttcaagctttaagaccagaaggatcaatatctatgtttacccaaaaacaactgtctgtgggactattgggtcagtttcaagagaatgaatttcaagagaaagaatatttgatgcttttggaggcaaaattaacttattcagaatactatttcctagaatataaagagatgtgttattcaactaaagaatagtttgtgttctcactcataagtgggagttgaacaatgagaacgcatggacacaggcaggggaacatcacacaccggggcctgtcgggggtgggggctgggggagggatagcattaggagaaatgcctaatgtcaatgacgagttgatgggtgcagcaaaccaacacggcacatgtatacctgtgtaacatacctgcacgttgtgcacatgtaccccagaacttaaagtaaaatttaaaaaataaataaaataataaaattgcctttcaaaaaacaaaaaaagaaatattgaaaagctacccagtattttaacaggcacgtatttttaaaataaattttattgcataaaaaaaaagaatagtttgttgggtgaaagggaattaattttattttattatttttaaattttactttaagttccaggatacatgtgcagaccgtgcaggtttgtcacatagctatacatgtgccatggtggtttgctgcacctatcagcctgtcatctggcttttaagccccgcatacattaaatatttgtcctaatgctctccttctcctcaacccccaccccccaccccccgactggccccaatgtgtgttgttcccatttctgtgtccatgtgttctgattgttcaacccccacttatgagtaagaacatgcggtgtttggttttctgttcctgtgttagtttgctgaggatgatggcttccagcttcatccaaggagagatgttggaagggacctatttagtgtcattgttttctcccctttttttgtctgttaccagtgtgtagttgttaggatgctgtgaacaggctgtatgagaatgctctaagacaggggtccccaaaccgtgggccatggaccggtacctatccatggcctgttaggaaccaggctgcacagcaggaggtgagcagtggcaagcgcgcattaccgcctgaacttcacctcctgtcagatcagcagcgtcattaaattctcacaggagctcaaaccctattgtgaactgctcaaaggatctagattgtgcacttcttatgagaaatctagctaatgcctaattatctgaggtggaatagtttcatcctgaaaccattatccacccacccacccccactctccaaccatggaaaattgtcttctacgaaaccagtccctggtgccaaaaaggttggggaccactgtggtaggagaaggagataagcagaaatatttccttgtttccaactgagcgttcaaccttcccagagagctgacaaagtagaaaaaaggaagaccccccctagcaacatcatatgagtacaaattttaaatttaagagtactttattctgttgtctctatttatacagattaatatttaactttttaataactatattagcaggaacaacttagttgtacaacaaatctctcaaaataatactgcttgttataatttaaagagcatctttatattctcttctttcattaacaaggctgaaaggaaatattactctgattttagtgatgagaaatttatactcagagatttagccttttcacccagctaataaagggtaatgccagaacttgaacaatgtcttctgaatgcgagccatttgcttttgtttcacgtctggttctataaagtgaattgcagttttgagtagtgcagtgaattgaaaagcaagccttcaaatatgagttgatttttaagaatcaactcttcactgtaatagaaaatcttcacatttattttttaaaatttgattacacaacatagtagggttttttcctgcagagtggatttaggatgaaaggttaagttttctttatatttccttctgtgctgttttaatatttttttcaataggttcacactgttaagtacttatattcaaacaataaaataacaatagaaatatttcagatttgtaaatagtctttttctctcccaaaataccaccacatttgtaattttttctttagtttgttatcctgtctcacagttaaagcgactgagtcacaagcaaataaagagtgttggccaacgtctcatggctagtttgtgtacagcacaaatctcaggtttctgattttaggctagagctctttggacagcaaaagtgatttatttatttttctttcaaatatcccctcttttagtcttagcttaatttttctgaggctaataagactttataataatgcatttcaggtatgcttaaccatttatcattacatgttacagaatgacctgatgacatgaaaagtgtgcatgtatcttttaagaagttttttcaactccagaagaacttatcaatttgcaaatgtctaattcaccatgccacattgaaatattgcaataaaacattgtgatttataacaccatattgttataaatctaaaaatgggtgacttagtttagtcatattttgtaggttcaaatgcaacatatatgtataacatggaattattgttaatgttggtagacatcaatgcagcttagaactaaaaaaaggcacgtcttaatttctcttagaaagtccgaaatcttacttttagcaatgaagtttcacatcctaattgaaatataaacagaaaagatgtgtgttttctttcccagctcttttccatttgcatgattatagattctgacagacgcaaaatatttatgtattcagtgacacctcttttaattaaaacactatacagtatgagggtataataccagacctctcattattacccaaaggaatgtagttggtataaaaaatagttggttaaaaagtgattacctcagaaagggtggcttaattatatgagcatttgcttgactctggagaatactttgcaagcccaaggacaacatttacaagtataaccacaacttttcttgtaccaatttacactataaaattagtatccaaacaagtctttgctcactttatgtggattacttggaaaatagtgtcttgttagattaaaaaaaaagtgattgtttaaaaaagtagcatcacattagtaaaattcaagatattgtttagaatttactaagcgtcaaggtagtgaagatgatcaaagaaggatcaccatacgctagacatggtggctcacaccagtaatgccaacactttgggagtctgaaggtgggagggtcgcttgagcccaggagtttagaacagcctgggcaacatagcgagactctttctctacaaaaaataaaaaattaccagggcgtggtggtatgctcctgtgtcccaactactcgggagcctgaagtggaaggatcacttgagcttaggtggttgaggctgcagtgagcagtgactgtgccactgcactgcaacctgggtgactgagtcacccttgtctcaaaaaaaaaaaaaaaaaaaaaggaaaaaagcaaaagcaaaagggatcatcgtgtttggcagcatggcttggtggagagtgcggcctagaatcctgattccgccagttctttttatgtgacttgggtaatttattgaatcccactaaggttcagcttcctcatttgtaaaataagtaaaataatgtgtccggaattggttctttccggtgggttcttggtctcgctgagttcaagaagctgcagaccttcacagtgagtgttacagctctttaaggcggtgtggacccaaaaagtgagcagcagcaagatttactgcgcacagtgaaagaacaaagcttccaccacgtggaaggggaccccagcgggttgccactgctggcgagggtggcctgcttttattgccttatttggccccacccacatcctgctgattggtccattttacagagagctgattgatccattttacagaatgctgattggtccattttgacagcgtgctgattggtgtatttacaatcctttagctagatagaaaagttctccaagtcccctacccgattagttagacacagagccctgattggtgcgtttacaaacctttaactagacacagaatgctgattggtgtgtttacaatcttttagctagacagaaaagttctccaagtctccacccaacccagaagcccagccacttcacctctcaataatacctctcttacttggctttaatgaaaattagcaataagataaaagttcctagtgcagcacctcatagtgcagccgctcctaggcactgaataaagttagttctgatgattattctgcctttcgaaaacttcaggtgcaataaaaaatgatgcaacaggaaaatattcaggttctgcatctaaaaattaagatatagtgatacgtaccttactgaaatagggtgatatggtgaagcacctaacacaatgttggacctcataagctttcaatgattgttcattactttcagattttcaatgagctataaagacaaaatgcaaatgaaattgaaaggcattgtcaaccatagcgtcatgcagatgctacttaatataactttaaaatacatagaaattttaataagtttgttcccttaggaaaatagctaaggaaaaatgcataattacctgctctttacttattttcactatttaataaagcattacaggaaaggtaagagttgtatagctcaagtaagcaaagaaagctttcttttctttttgattttgcacttggggaatttttcttgatcttcttcttcaaaaggagcagagaattcatttatgtgtacctggggtcttgattattacaaaaaaaaagaagaaactgaacaactttgcatactttagtaaaacaaaataattcaattaagcttattcagggcatcttggtgttttagcaaagttgaaaaggacacttgactcttgttaaggggagctctgtagacatttatgtctgggggaatatgttactcagtttgcagcatgataataagctctaaaccagggaactatatcagttgcatagacaatgaatccagtctggaagataaattgttcactgagggtaaggtggctgaatttctgatataagtggccatataatcatgagagctttacctctaataaaaacatatatttggttcttaaaaaacagtcaccttatctttaatgagcaatttgacttttaggcttaatgcattagtctcttaagtgacaaatttttgtctgtgctaacaactagttggcagaattttgacagtgaacagaagctgtcagacaaacccataatatttcctccagtagctgatctgttcaatttcaagcattgaaagcttatgtaaaacatggagagaacttgttttatggtttctgggataatttttttatattgcttgataagctctaaatgaacaagtatctacatgtaagacatactttagaaataaaactacctgaaatggtggttgccagcatttgagagttggggtattggggagatgtttgtcaaaggacacaaacttttaattagatacaaaaaataagttcaagaaaactattgtgcatcatggtgagtatagttaataacaatatacttgaaaattgctgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaaggtctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccgttgcttgtttttctcaggtttgtcaaagatcagatggttgtagatatgcggcgttatttctgagggctctgttctgttccattgatctatatctctgttttggtaccagtatcatgctgttttggttactgtagccttgtagtatagttcaaccattgtggaagtcagtgtggtgattcctcagggatctagaactagaaataccatttgacccagccatcccattactgggtatatacccaaaggactataaatcatgctgctataaaaacacatgcacacgtatgtttattgcggcattattcacaatagcaaagacttggaaccaacccaaatgtccaacaatgataggctggattaagaaaatgtggcacaaatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatataactaatgctagatgacgagttagtgggtgcagcgcaccagcatggcacatgtatacatatgtaactaacctgcacaatgtgcacatgtaccctaaaacttaaagtataataaaaaaaaaattaaaaaaaaaattgctggtgacagattgtaagtgttctcaccacacaaaaaatgataagtatgtgagctaatgtgtgttaaatagcttgatttagccatttcataatgtatacatacagaaaaaccatattgcacaccataagtatatacaacttttttttttttttttttttttgagacagagtctcactctgtcgcccaggctggagtgcagtggcaggatctcggctcattgcaacctctgcctcctgggttcaagcaattctcctgcctcagactcccaagtagctgggattataggtgcccgccaccatgcctggctaatttttgtatgtttagtagagatgatgtttcaccatgttggccaggctggtctcgaattcctgacctcaggtgatccacccgccttggcctcccaaagtactgggattacaggtgtgagccaccatgcccagcctacaacttttacttgtcaattaaaaagtaaatttaacaaaaggaaaagtaaaattaacaggcattttgcaaaacctttatattgggtttatttcacatttgtatcagttctttattctgttttacggtaggagaaaactttttataaatctggaaaaaaatatttttttatataatagcaaagctttaagaatgttaaaatgtaaatggatgactgattaactgtatatcagtgtcagccagttatacatgatttatttttattaattgtagataaatctcaccattatctatacatgatttacttagatatttatatattaattatcttgagaaatatataaaagctctcattaaagaaaaatcatcaattttgtgttaagtgacagtgagtgcaaagtatagagactgttagaaattgataacctttgtggtgcaccataaatgggattagcagtgtcagtggtgtggttgtgactgttttgcaagtggtcagggtttgctcattgagaaggtagaatatggagcccacatttaatgtggtaagggattttgtcaagtaaatatccaggggaataatcttcctgcagagggaataactaagagttatataaaaacattacaggtatgttcaaggaatcgtaaggtgttcagtgtggctaaagcaacttgaactagggggcagtgataggagaggaaatgacagggaagatggtggtggcaagggagatatttggaaaggccttataagaagctacaatggcctgattccaagtaaaacatggagacatggcaggcctttgcctagaggcgtgaaataattttacttgggtttctttttcttttctttttttttttttgagacactttcactcttgttgcccaggctggagtgcaatggcccgatctcggctcactgcaacctccacctcccgggttcaattgattctcctgcctcagcctcccaagtcgctgggactacaggctcgtgccaccatgcccggctaattttgtatttttagtagagatggggtttctccatgttggtcaggctggtctctcactcctgaactcaggtgatccgcctgcctcggcctcccaaagtgctggaattacaggcatgagccgccacgcctggccttttacttgagttttaataggatcgctctggctgctattgaggatagtacatatggggtaatgatgcaagcagagacctactgtagtactcttcaggagagaatggtggcttgcacaaggatggaagcaatgaaggtggtgaaaagtggtcagtttctatatttattaggaaacacctaggatgataccttaatagaccaaaatgtgaaatgtaagaaaaatagagatgtcaagatgacacaaagatttttggctttgacaactgaaagaatagttactatcaactgtgattggtaagaatgcacatggatcaggagttcagttttggacgtcttaatcttaagatgtcaattagatatctatgtagagatgctgaatgggcagttggatataggaaattggagtttgggagagtggtcctggctggagatataaacttggtagttgacagcatatggttgttatttaaagacatgagaccggttatcaccaaagaaatgagtgtgtagatacaaaagggaagaaaccttagagacctccagcttttggagatctaggagaagggaagaaactagtcaaggggactcaggaatggctgtaaaagtaagaggaaaacctgaatgtgtggtatccagggagccaggtgaagaaagctagcaagcagggggaaaggatcaactgggttaaatgctgttgatagcatcaagtaagatgaagaaattgatcattgataaggtagtttactgacttgtgagaacaacatcaatatccaaatgaaagaagacacttaaatgctatcaataatagacagcttaagactgggagtcacaatcttatggcccactgcccacatgtagacagagatgggctttgagaggcagtctttaggaaaaaaaaattgattgtgaaggctattgggagatatgtactctcttattagccatagacccatcatgtcatattattttatatttgagggtctttacatatttattattttcttttcgttgttgtttttgagactgggtcccactctgtcgcccaggctgtagtgcagtggtgcgatcagggctaactgtagcctcaacctcccaggctcaagtaatcctcccacctcacccttctgagtagctgggactacaggcatgcgccaccacacctggctcatatttatgatttttgctaggctcctgaaacagcatggctgccttgaatttgtgacccctggttattaagtgtgtttttgctttggcacaggaaaaaaataaaatagatgtaattttgatagcacagttattttcattattatgtagatgtataagagacttggatttccagctcaggataattgaatttttcatccaaattgatgttcctcttcaaggccagacatactttctttcttctataagggtattgaatgatagactttttgttagaactcttggtttgctatttggcctttcctaatctctcttcaaaaaagagagatctgaacacagaggttaaatgtcttgcacagcaaatggctagctgtgatatgaccaagactcttaacttctcactcagccctgaagattatattggtcttctgatgtgaagtttactgttctttcttttatgctatctagccacttgttcagttagcttattcattaatcaccgatacatatgagacattctatatttatgccagtaatacatgtaaattgcagccatttttaaaaccaggaaatgcacttaaattgtgtgtttaaatttatcagaatcacatatggtgctttttaccacttatagtagtttttaagattatatttatccatattacctccgtaattatttgtgatcaggttagcttaagtgaagaaaagccatattaatgctccactttggttttgagataactactggtattcaatccattattcttatccattagaattcctcttttgtccagaaattgttcaacccttagaatcaagtatctgtacttcctcatttatgtttccctcactccaagtctaagtagacaccatgtctgcatcctttcctgccacactacggttgtaggaaatatatctatttagatataagttgcaagagtaagaaggttaattgtataaaattatcatagagttgtaattgaaaatctcttttaacaaataaaaagaaaatcacttctaattatatagtctgttggcctcttgtcattgctgtagcatggttgtttattttgtgtttttgcccaggtgcttaattcagccactgtcagtcttacaaaaatagataactgtacaaataaaacagcttctgactaagactagctaattttctttattgctagacccaaattattttcaatatgttaaagaaagaaataccccaaaccacattgacttataactgtatctatgcaggattttgtttcaatggcagtgtagaaggggcaaagacttctctcttgctttctccttagctatgagtgaactgagtcaatgagcacatgttaagcatttgtagtgaatatcctgatttcctagtgattcagaagtagcaggaacagtcagtctcactcatcactcaaagagaccttgaattcatcttctcttttttctcatttctccatgccataatttacaatgtcatcaccctttctcctacatatgatctaaaaaactggcatctcaacctaattccatcctaaatcatacatggccagcatagtttgtttcctttattaaacatttgaatgtaatacctgggggcagggtgagtgtgctgggttctgctttaaatttgcatgatttctgaggccttcaaaagcatttggatttttaaaccttccttagacagttgtaatccaggctcctaattgttttctccttcaagttgtaaattgtccctgtccaaataaccctccaccctttccccagattcagcaatctaagaaaacagttctgatcgtataaccctcctttgtaaatcttattcacttctctattgcatgaggggtaagatccaaactctaacatggcagatgagaagtttcatcactctgttccagtctgcttttcccagtccgttcttttccactttttgttaacatcctgcctccacaacatacaccaagagctgcagcagagcaagttatacctagtcccgttagcctgagtggtctttcgggtccctttcttatgactgtgcttttctctgcctatactcactttgactttctcccttacctggaaaatgcttattcttctactaagccccaactcatgtaataattcctatgtgaagagtttcctgagtctccggggaggttgattgtttttctgggctaccaatcacacttcgcacatctcttcattgtaacacttaccataatgtgtttcaagatttatgtgtccctgcctcactttgctgtacaggaagctctgtgataagcatggttagatcaaattcatttttgtattaacaacacccagtagtgtctggcacataataggtgcacaagggatgtttcttgaataggtgaaagaggaatctccctatttctccctacttatattctgtgggcagctgctatccccttgctgtctgtctgatcctcaatctcttcctcttgtccactcaaacttcctcatggtattttgcttattcatcttacatctttaccctctggtttttgagatggtgataaagacagggatcagggctcagggctctgtgattaatacttctagacatcgcagtttggtttggtgccaccatcaatgacagcagctgctatcatttttctcagtttccaggattcttccaatatttcagggcatagcctaattctagacctatctctgatgatttgaggtatatgatatgtgtaattcaatacttcatatctgcatttattattgtatatgagccttccacaagggcatttttgtctgtttaaaatgtaataataaatcaaatatgttgaattttctgtatatctgaatgcattgtaaaactattttaatggtgttcgagataaaattcagactgaacatatcatatactaatgacatcatgttaatatgcttgtaacaaacatgaacagggtatcagttgtgaatagataaccataataaaattcagtaggtttgttcttgagagtgaggtgtcacaaattctgtttggcaagatatggactatgaaactggcaaaattagccttctggggtttaaattaacctataacaatttcattgcttaagaatattaaggcaacttaatacttttgttaaagtgtaaatgcaagacaagaaagagtaacggcaggctgttttactttttatattgtcttctttaatgtatttccgcttttcctgcctgccaatgccattcatattatattctttttaccgtgaaaatggagcatataattttatagataaggaaacaaaagctcagagaataaaaatggcttgctcaaagagacacaactagttagtaacagggctgggactaaaattcagatcccttcactcccacactaaggaccttaacattattatatgctgttccccttcatttgacttgtttttctaatgttcagagtgtgtgctgttttatttactgcaaagagatgctctgtttctccataaagtgattacaaatccgtggagctacagtcatcatagatgttcctacaaataatttaaaagcaaaatattgaagtatgccttatcttcactgccaatgaaattatgaccaaatggtaattactgaataacaaaacagtcatatagcaaccaatccaattgtttaatgctatatctaaaggcaaacattttaaaaagcagtgagttaatacaattttcaaaaatttgactcatcaagctgtctcaacagtcaacagtttgaggattgcatcaaaaaatgggcaggcactgatgagattaccaaatgatatcttatctttaaatgccctagtttaaaattagcaagaatacgtttggtgtctaatttctgagaagtaaaaacagctttggctgtttaccctaagtttaggacaaaactcaattgaatgaaagcaagaagtggagtagaaattttagcattttaaaagctgacagctctaacctgaaccagagtatttatgttattaaaatagtcttggaatcctaggtcaggcaattccatctttctgaactgccctctatacacttctccaccagcaatactcagcacttctttcaaagcaaaggctctcaagctgacccaaagcaggaatgtttccttgaccaatctatatcacattttaatgatttctcgacagtattcacagctctttctagctctgtatcttttgatggatatcttagggaagtaatttcagcaagtgacaattttaaaaagctggagggttttttcgttttgttttagtttggtttggttttgagacaggatctcgcccaggctggagtgcagtggcatgagctcaagcaatcctcctgcctcagccttctgagtagctgggactacaggctcacactggctaaattttgttgttgtttatagtagggacaaggtctcactacattggccttgctggtctccaactcctgagctcaacagatcatcccgctgcgccctcccaaagttctgggattacaggcatgaaccaccatgcccagccccaaactggagatctgtatagagcattttatgttgctttgatgaaagatatgtaacacatgtcaaattataaaactgtattactacttttatatatttaaaaagaaagaaatgaatagcagttgaatttagttaatttgtcaattcagtaaatatcactgagtgtctactagttttgaagtcctgtgtgaggttgtacacagtgtatatattttatatatatatatatactgaatatatatatatatacactgaatatatatatatatacactgaatatatatatatatacactgaatatatatatatacactgaatatatatatacactgaatatatttatatacactgaatatatttatgcactgaatatatatatacattgaatatataaatatatatatatatatatatagtgagcaagatttgttctcattcctcaagaaactcacagtacagtggcagtcttacattttgtaaatatttaatagctaactcgacagtgctatgactgacaggttatgtgtgattttatctcactccccattcaatcattgaatgaagaattgattaaggaaaaaatgaaggagaaccaagttccatcacactggttcctatctgggctatggtttcaattattcaagaaaaatttggcttgtccttgccgaaattgtatattcaacaaagatttatagttgtggtttcctaagtgctctggaagtctacaatgatgcagtatctggttaaaaaaaatgtggctacctgataagtcccccactgcttgctgttgcaaaaaaatgattcattagaaaaaaaatgatttggaatcagaaattataggttattttctggatctaccacttaaccttttataccactgtattagtccattttcattgtgctgataaagacatacctgagactgggcaatttataaaagaaagaggtttataggacttacagttccacatggctggggaagcctcacaatcatagtggaaggcaaggaggaacaagtcacaccttatgtggatggcagcaggcaaaaagagagcttgtgcagggtaactcctgttgttgttgttgttttcttttttttaggtttcaatattttattcaagtttaagtgatgttaattacagcatttgaaggggaggatctaattccacagaaaatggaagactctaaaatgtacccattagactgctaaaaaacaaattgaagggtgagaatataacagaagtccaatttagattctgagtgttgtcaccatgtgattacaatcacacagacgcttccaagcttatagctggagttcctggaagctatttcatactctagtgcaagggctaaaaaacacaacacaggaaggaataagtcctgaattattggcttcatcacatccaccctctccaccccaaaatggcacaaaagaaagagtgaccacaccctgcagaccttttggtgtaaaagaggtaacgatgaactgggctgggaaaaggtcatgaagctctgtctaaaagagtcccattcaggtgagtttgtacacaccatcaagcagcaagcccctcatcagttagggttaggaaaccaaggttcgattctcaggaaatcacaatttcattcatttactcaatatgaacttacaaagcgcctacatattatcagcttccacttgcagccatttctagagaaaaaagacacctggcatctcaaagtggctgccaagttcccccaagtctaccactgaaagggccttttttggaaatgagtttcttctgtacctctgaaagggtaacatcttaaagctgaatcatctttaacctggaggggtaacatatttagcaatacttgcgtcccagacatacaacattaaaagatacactaaattctgaaggtagctatgctgcaaaatagtttaaaattaaacaattgtacagtattcatttatgcttgaaattccagtcctagaccaagcttgtggccaccagcattgacgttcttgccatccagaagagctgacagtgtcagtttgatacctggctttagggtctgagtgtatcctaaacctatcaggctggagttgttcactttagccaagaagcaggcttcagggtcaatcaaatacttggctgctattttgaaatgcgtgttactgtttcctgcttgtccaggtgagattgacagcagtctccaacttcttgttcactttctggtaaatgaggccgccaaactctgtcccgtcattcacattagtgtgaaattggaattcatcagtcttgcagccaactgcaaagttgctctgggtcactccggactttgcagtctcaaaattcatctggtagccggccagccagcccttgtaacccagcatcagagcagcccggatggaaggcccagcaatgtcgaaatctatgttgcagtccagggtaatgtgctcctgcttgtaacctgtcttgattttagcatcttttttcccccagtcttaggtaagaaggatgaatcgaaggtcagcttcagtccacgtgcaagctgatcttccacagtaatctcggtgcctagtgtattatccgtgttctatttctctgtaaacgtcaggccgtactcagtccatctgtacttggtttccagactgcccgtcactttggtggtctcagtgttggctgagcctgagcttgtaaattccaacccattctcagattttgttttcaaatcaagcattattaagccaaatccatagcccttagtgaagacatccctggcagacttgccaagattggcatacatgggtggcacagccatcttatgcttagaggtggtggcagtgggctaggaggtggctatggccggggctgctgtgcggaggcagagaactaagtggagccagctgcggggcccaactcccgtttttaaaaccatcagatctcaggagacccattcactgtccggagaacagtacgggaaagacccacccccctattcagtcatctcccatcagttccctcccacaacatatgggaattatgggagctacaagatgagatttgggtggggacacagagccaaaccatatcaaccaccaataaagccaatttaataaaatgaagaatatatgtgtatgtgaaaaatactatatgttataatctgtaaacaaaacatatcatagaaaattgctcatatttatagagatatttattatatatgtagactgtgttcttattgcgttattaatatctaaagttacattcgaagtctttagtttaatctggaaaatcatctcaatttactactgcatacttcatatgaaaattgcttttcagtttttttactacaaaatatacatctggatatctgtaagtcaatgatgttctttaaccttaggattattatagtattatttttaaatcaggggagactttaaaataaagtgaaatctgtgtggcatgactgtcctaatttttactctaccttattaaaaccgttttaatagatttttactcattagaatcatatcactccagaggttttcacttttttaataaatattctgctagcttttagtttcaacacctatgtatttattcatttttattagtttaatctctttaagaatatgtgtgaacttttgtcataatgttctttccttagttttttaaacattatttggtactgtttctttaatcaatttaaagatagttctttttatctacttaatgattcttaaaagttcttggagtaacaccagagctatttgttgtggctgttgactcttttctacggcaaattttgaactctgagctaatcttcagagataatttatctgtaggaatcctcttctgcctggattgaacattcctcctagacaagttttgagtttaccactgctaaggcaacccgggagtattaccttctggggaccactttttactttaatattttactttaggtatccgtggatcatgtgagtagtataaattcagaccataacctgttaaaatgaaaatctgcatttataagttctcaggagagcccttctcccgccccccatccagagaccagactaacataggcatagttccttggaatctcactgttctgatggcattttttaaaatccaacatatgtatgcttcttcaaagtcttggctttgttcaagggatctcatttccaaattcccacttcaagtgaacctaagaccttagccttgtgccttgtgttctttccttgcaattgaatcacaggccccttggtttgaggaaccataagtcctcccataacctgcacacccgccaccacaacatcatcactagggcaaccttgatgtcaggactttttttgtgctgttcctctaaggattgctttccttttcttatgatctaagtaatacacataaaggagtgttgctatattttcttcagcagttctatgggttttgtagcaggagagttttctggttatttttccatattaacagaaatggaaatctactaggttttacatgcttaaagtttaatttgtcaggccgggtgtggtggctcacgcttgtaatcccagcactttgggagacccaggcgggtggatcacaaggtcagggtttcgagatcagcctgaccaaccaccccatctctactaaaaatacaaaaattagctgggtgtggtggcgcatgcctataatcccagctactcaggaggctgaggcaggagaattgctcgaacccgggaggcggaggttgcagtgagctgcgatcgtgccactgcactccagcctgggtgacagagtgagactccgtctcaaaataaataaataaataaaaataaaaaataaataaaaagtttaatttacgacattcagggaaaaccatactcaaaccctatttttcccctggaggctttgcattcttcaaagaacattgccatattccaactgaaatggagattttgctgagatttttgtttgtttttgcttatatccggacttaacttttaaatacaaccttcttgtcttctttcctgtcttccaaactcatggatttaccatttcacagggaaagggtatgctttataaaacgagcagaaatccacatctagcttgaaatctacttcataggaaacttaaattaattcagaataaaactaagccaaatgctaagttaaatgctagtatggaaaattgtctttttaaaatgcatctttttttaaagagcttgaaatgtctggtagagacgcataattctttcacggaagggtttcatgaagcacagatgtttttcagcctcccacggggatatataccaccacagtgaggacaacagatgcctcttccctcactttcctatctggcttcattccttatgaatctatttcttttagtgattagctcagagaagcttatttcagcacagttaacctcaaccccttcttgaaagtagattttatggaatgaggtaaggaagaaatagaacaactcatttaaaaattctggcagtttcaactgccaatttttgggggataccattttcaattatacccactaaaatagtaaatatctaagaattcaaagtagtttagagaaataaagttaataaagatttaattgaattataaatgtgctaactttctattaaattatgtatgaatcaaccattttaaaattcattctttatgtatgtcactgatactatgttagtgtcaagatgtagcaactgagccatatttatgtgtatgtaagttttctattgctgctgtaacacggtatcacaaattagtggctaagaacaacacaaatctatcattttatatttctgaaggttaaaggcccaacagaactcagtggactaaaatcatggtgacaataggtttatttcctctggatcctttaagggagaagccatttccttgccttttccaccttccttggctcatgtctcttcctccatcctcaaagcgactctgcatttctctcacccttcttcacctcatgtctccctttgactagatctgggaaatgttgtccttttttaagcactcatgtgattagattgggcccacctgcctaacccaggtccttgagtctctccatctcaaggaccttaaccttaatcacatctgccaaggtcacttttgctatgtgagataacataatcacaggttctggaattggagctcagacatctttgggggccatcattctgtcttactatgttgtatgtaattaaaaccttgctctcagctgtctaaaagtttgcctgagcaaatgaattggcaatgtattcaatccaattcactccctaatatcatcatgataaaaaattaactgaaatattttagatagggccaggccaaaaatgaaaattgtctcctacaaaaggaatgatttaacattgtcttttttgaaatggagtcttcctctgtcacccaggctggagtgcaatggagtgatctcaagtgactgcaatctctgcctcctgggttcaagagattctcctgcctcagcctcccaagcagctggtattacaggtgcctgtcaccatgtccagctaatttttgtatttttagtagaaatgggatttcacgttgtccaggctggtctggaactcctgacctcaagtgatccacctgcctcattctcccagagtgctgggattacaggcatgagccaccacacttgacccagacatatttcttcttaatcaaataacattaaattgggttatattattaaacttaatgagtgtctactgcttaccttatgtctggatgacaatggacaggtgcttatttattttaaatctactcattatttatataaaagctttataatttctcaggttggtattttttaaagtttgtatttaatttatattacaaatgattcatactacccactatgaagattttacattgtatgatggaaaaatgcttcatacataatttgcctataataaatattaggaattttatggaaacattcattttcattttgagaaatacaacaagagtcattagaaaaaaagagaaacaaaatgtttgaaacaagtattaccatgaagtgactttttttttttttttgcatttcacaaaatgcacaaaatttgtgttaaggttcattttgaaagacccaatggtctttccaaaataatggtctattaaaaaactattgaaaattatttaaaaactgtaaaaaactctcacaaaaataattttatctggagagaaaccattcttattcatctttgtatctcccatgatataatggcacttttgttgttgtttttttcatttatgagctgtgaggatatcaaagccaattctttttagaagttaaaattttaaaatttaaaaccagagaaaaatcttggaatggaatatacctgtattatagtatagagctatgttcttttgatgagcaatactataatacatagcactattattataatattagattaattttctgtgtgaagtcggctcctttctcttccctttcctctcttttcttctattgtgtctctcctttttctttcccttctttccattcctctctttgaatcttctatgttctcttcctcttttttccatatctagtcctcccttctcctcatactgaagtaattcaaaatctgctactaggaattgttcagttaatatatcttaagacatgtgtcatgttgacatatattgttaacttaatgtgtcttcctctttgctgagggatatgttgtcttaatctttttttcccccaaacattgcaatttacttctctctctcatacaaataaccataaactagttatagcaatcaattcgcatgcagtaattacattacctatgataattataatatgtgtcacctggacctgtatttgttttaatgggaatcaataattctcaagtgggcagaagtgtgtagctgattatgtgttcaggtgatcagagattaggcagcatttgattaaatgaactgcctggatattttgcaattacttttgatcagtctgctatggccactgctcctggctgtcatgtgatgcagttgtcgaacactagtcttacatactgtggtagaggacacagaccagtgtagatccggaactcaatacaatcgcttagggttcttccaaagagaatgattatactactcactgtgaataagctcagctgtccaaggctacccattcttgggcttccaagaattcacttcttgattcaaatatatatccatttcacaggggaccaactggctgaaggaaccctaaattgggtttggttttctgcacctattaccttatatacccagactctccatcaccttcactatccaggaatctgctactagggtttaggcaggttttcaaaccacagtgggcctgatgagaacctgtttcattggacagtgtttatcacacatccttcagagggaggctacctgctgtgatactagaaggcctcaagaaagtccatccttcctgattcaatgttgcttacacttcttaagtaaaaaaagctactgtcattggattcccaacatttcttgtgaaaaaaaaaagaaaagagaaagaagaagaaaagaaggccaggctcggtggctcatgcctgtaatcccagcactttgggaggccgaggcgggcagatcacgaggtcaggagatcaagaccatcctggctaacatggtgaaaccccgcctctgacaaaaatataaaaaaatttgccaggtgtgttggtggaagcctatagtcccagctactcgggaggctgaggcaggagaatggcgtgaacccaggaggcggagcttgcagtgagcccagatcgtgccaccacactccaacctgggcaacagagcgagactctatctcaaaaacaacaacaacaaaaaagaataagaagagaaaagccaaaggaaacaatacagaatgtaaatttaagcccatgtgggaggtagtggcatgaaccctaactacagttatgaaaaaaaatggttgtatatctaatcaatttacgaaattttgatttcaaatgcatattagcatagtcaatgttctgagaagtccttacaaaaaaatagatttaactgtattcattcagcttcttggatctgtaggtttgtgttttgtttgccagatttgtaaatttttcatctattatttcttcagatacctttttagccctaccctctttcttctctccagaactctgaagaaatgaacattagatcttttgttataatcctacacgaacttcaggctctgttaatttttttataggctattttctttctgttgttcaaatagattaaatatgatttttttcaatttctttgattctttcctctccaaaagattctctgatcttttcctctccagaatggtcctctccattctgctgttaaacccatccactgagtttttatttttgttattgtattttttatttgagtttccatttgattcttttataattgatccattatgattatacagttttatagggtacaattttatgttttgatacatctataggttgtataatgatcaaattaggatatttaacatatttgtcacctcatacatttatcatttgactcttatttatatcttttgttttttctgggactttccatatctttgcagaaactttctattttttttttttcatttgtttcaatgtgtttgtggttgcttgttgggagatttttatgatggctgttttaaaattcttcccaaataattctaacaattctgtcattctggtgttggtgtctgttgcttgctttatcacttttacatggagatttccctgcttcatggtaggatgagtgattttcaattgaaatctggacattttcagaattttgttatgaaactccaaacttcatttaaattttctgctttagtaggccttatctgacaccactccagtgagaaagggggcactgcctcattatttccagggatagcggaaatcccaatttcccactcaacttctgttaacacacaggaggtgcaggggctcctacttactgctaggtggggctagggtataccttttttctactaggcctctgctgttatctgttgtagggaatggcagagtggcctcattactactcactacgtggcctccctgaactctggggggctagcctcactactgttgtgctgaagtgagggacctgacttttcactaagtcttctctgataccatctactctggtggggaggaagaagggcacctccttactacagggttgtgcctggcaataaattttgggttctccattcagctttgcacctgaaagggggagttgcttgtcattgctagcttaagatgggagctctggctttccactaggtctccactgatacttccttggccgagaagagtaagagtgactaattgctactttctgcacaatcttctctgatatcaacctgaagcgggggctgggggctaaggatccttgttacagtttggcaatggtagaagtctacaccctcctcttggctggtgtgtgttgggtggggctgcatttttttcctgtggtgtttggctggagttaaaaagttatcatctaacattctctcccttggtaagctgtctctttccaggacgtttggctactgagaacaggcttttgttaagactttctttttttttttttttttggtctgttggtgcttccaggttactggcttttccagtacccagtctgggatacataaggcaaaaagaaaacccagggagctcaccatcatgtctttccttgagttctgaggtctctggccaatgtctggctttctcttcacactgtgtttgcagaaatcactttctcttagacgttccaaggattttttctcttttttgttaatcctatttaattcttttttttttttttaagtatgtatcttggtgttggtaattctggattgatgttctcaggaacttggtgtgttatttcaatatgttgtttcaattttttttttagtttgcatttgttcagttatcttgttattgatttcttcctcagtgattcttgtgatttatatgttgacttgcgtttacatgctttcaacatttgacactttttattaaatcattatcatattttttaatttctttttttttgcatgtcaagaaatttcctctgtttgacctgtatctgttttgtttctttatttgtctattcctttgaatttagaaggaacatttttgaaattaattttttcttttatttccaattgttttgttagttgtcacttaagttttttttttaacaatatctaactctgctttatattgctctttcacgtattgtataattttcttaatgtctgttagcttatttttaaatagtaagtattcattttaatcaatttttatgagctggagggatgctattctgctccttattttttttttaaatcttatagtaacttatgtgagattgtcctcaataatattccattgctcatgcttatgtacaattaggtttcttaaacttccagatgaaggcaagatagttttgtagttttgtcttggtgtagtgccttgctctagaaggaagccctggctagtcattttcaaatgtatatcaatctacactactgtagtcgcttcagtcataaaagctgaccccttgagctcactgacttttggaaggggccaaacgcctctcaatttcagttactttctcgactttgcctactgtgctttcctgtgaacacttctttgctattttggcattcttgtgttttcaggttcagccaccctattgtgcctctctgctcatttccacactgaccttgataacgtcctggtcttgtggctatgggtggtgtttttctccaccacttgtgttttaagaatcatgagaacaccttgtcacctagtgcagttgtaaatattgtctctggttttttggtgttgctgtcaggttgctctgtttctctaaggagattctgggagtttcaaaaactgccatcaccatcatcttctcagaatcatcttttattacacttagtttgctcacagcttgagaaagattatcttgttttggactctcaacagccttatggggcaattatttttattatttctatattttagatgagacaactgaagctaagttaaacacagctaatatgtggtggagcaaggacttaggtctggtagaaattaaatcttatgcttttaactatcagatatcgcttcactactggtgtaaatggggtgtagtttggggcagagtttgggaggaataacctatgtttttgaattaaataatttttccttaagtccaacatttaatgagcacttacaatatgctagctattgggtgtagccttggaaatacaagagtgaaaaaaagtgatgagattcttgttatcaagaagcaataaaaatcattaaatcaggagatagcattggccacacaggttgtaccaatattcatttgcatgcataactaagcattttgaaaaccagtttagatctgtgtgcaaagaagaacataacacaccaaggtgaaatttgttgaagtttagagtcctttcagattaacaagtttgcaaaatctgtgttctctttaattagtttcccaatgtgatgtgttaacagtagactggtttatattttattaaaagtaattttgaacatatattacctagtgctttcagcggatgaacagaaattggaagagtatatcctttattaactttctcctcacctgtaaggctgtgttttatttcaaaaaatagaaaaaagctgctatgactatcactgttttgaatcatccttttatagatgagaagctgcaagttcaatgaatattatacatatttttaaaaatattaagctatgaattgtgctaaaattcatgttagactcttggcttttttctccccctcctttagagaaagagttggaggttagggatgcctctacattaaagttgtgtttctgggaagtaataaatttagaactgatgaaattagaaaaacctaattttctcagggcctgaaaatctgcaggaagactgacaaaactgctttaaaaggctgctttcgggaaataaaaagaaagggacctgttagggtcttcttccgttccccttggctgcaggagtaatgcttctttctggtaattggcctgacttcatttacacttacatttattattaatgtcaagaataacattttctgctgctgtgcttgttccatgtaaactgatcctctacagcattttgccaatcattatacagtgcttggttttttttaagtttttcttggtgaaggcggcagaggaataatacagtattttatgtcaataacaacctcttgtttttctttcttccagctttatgaggtaagatttaacaaataaaaattgtataaatttaaggtatacattgttatgttttgatacacatatacattgtgaaatgattaccacagtaaaactaattaacatgtaaattacatcacatatttacctttttgtgtttgtggtgagaacacttgagatctgccctcttagcaaatacattacgtctctagaatttattcctcttctaactgaaagtttgtaccctttcaccaacttcttctcattttcctcaccctcccagcccttggtaatgaccattctgcaatctgtttctgagttagaatttttagatttcacgctaagagaaacaatgtactatttctctttatgtctctagattatttcatttagtataatgtcctccatgttcatcaatgttgtcacaaatatcaggatctccttgtttttaagggctgaataatattccattgtatatatacattacattttctttattcatttatatattgatggacacttaggttgcttccatatcttggctattgtgaataatgctgcaaagaacatgagaacgtagatatcccattagcatggtgatttaatttccttaggaaattccccagaagtgggatggctgaatcacattgtaggtctattttcaaggtgtcgaggaacatccacactgttttccataatggctgtacgaatttacatcccccccccacagtttacaagggttccctattccccacatctttgctaacaattgatgtttttactgttttttataatagccaatctaacaggtaatggagtaatatttcatcatggttttaatttgcatttccctaatgattagtgatgttgcacacattttcatgtgcttgttagccatcatttttttgtctttgcagaaatgactattcaagtcttttgcatattgttcattggattattcggtgttttataatcttttaaaagtatttagttgtatgagttagttatatattttagatattaaccccttatcagatatgtgatttgtaaatatgtcctcctattctgtaggttgccttttcatttagtggtttcctttgctatgcagaaatgttttagtttaatgtagttccaattgtttatctttgcatttgttgcctattcttttggtgtcacgttaaaaaagaaaacaaaaaaacaaacaaaaaaaacactgctgagacaaatgtcaaggagctttcctctgttttcttctaggaattttacagttttatgagttatatttaagtcttaatcagttttgagttgatgtttgtgtgtgatgtaagataagagtctatctttcttctttttgaatatggatatccagttttcccagtgccacttattgaggagactatgctttccctattgtgcattcttggtacctttcttgaagattacttaactgtctatgtgtgggtttattaatggactctattctgttccattggcctatgtgtctgtctttatgccagtaccatactgttttaattactatagctttgtaccatagtttggactcaagtagtgtaatgcctccagctttgttcttcttcctcaagagtcttttagctattctgaggtttttgtggttccatatgaattttagagttgtttgtgttctatttccatgaaaaatgctattgggatattgataggaattgtattaagtctgtacattgctttggatatcatagacatggtaacactataaattcttccaatctaagcacatggggtatctatttatttgtattatcttctttttttttttttttttttttttttttgaggccgagtctcactctgtcgcccaggctggagtgcagtggcgcgatcttggctcactgcaagctccacctcccaggtccatgccattctcctgtctcagcctcccaagtagctggcccccgccaccacgcctggctaattttttgtattttttagtagagacggggtttcaccgtgttagccaggatggtctcgatctcctgaccttgtgatccgcccgcctcagcctcccaaagtgctgggattacaggcatgagccacaacacctggcctttttttttttttttttttttttgagacggaggttcagtctcctcacccaggctggagtgcaatggtgcaatctcggctccctgcaatctccgcctccccggttcaagtgatgattctcctgctcagcctcccgagtagctgggattacaggtgcccaccaccatgcccagctaatttttgtatttttagtagagacagggtttctccaagttggccaggctggtctcgaactcctgacctcaggtgatccacctgcctcggcctcccaaagtgctgggattacaggtgtgagccaccacgcccaacccttcttcatttttaaaaatcaatactttacagttttcagtgtacagatattgtacctctgtggttaacttatccctaagtacagttgacccttaaacaacacaggtttgaaccacacaggtttacagatacatggttttctttcacctctatcagacctgagacaggaaaccaaacccccacctcttccttctcctcttcagcctaatttatgtgaagatggtaacgataaagagctttatgataacccacttccacttaaggaatagtaaatatattttctctttttatgattttcttaataacattttctttaatctagcttactttattgtaagaatacagcatatgatacacataacatacaaactatgtgttaatcaactgtttatgttatcatcaaggcttacagtcaacagtaggcaattagtagtaaagattttagagtgtcaaaggtcatatgtggattttcaacagcatggaagttagtgcctctaacccccatgttgcgcaagggtccagctgtattttttaaaatttattgttaattgtattgtctacttaattacttttttaatagttagttgttagtatataaattcgcaactggtatttttatgttgattttgtgtcttgcagctttattgaattcctttattatttctaacaggttttggtgaattgttagtgtttttacacaaggtcatgtcacctgcaaacactgaaaattttacttctttctgatttggatgtctttttttttcttgtttaatttttctggcagggacttctagtactatgttgaatagaagtggcaaaggagacatctttgtcttattccttatcttagaggaaaagtttcaaattttcactgttgaatagaatgttagctgtgggtttgtcttacaagattcttattatgttatgttgagctatgttccttctatatctaatttattgaaagtttttaatgataaaagtatgttgaattttatcaaattttttctgcaactattaagatgattatatgatgtttgtctttcatcctgttaatgagttgtatatttattgatttgtatatgtttaatcatcattgcattccagaaataaatcccacttgatcatggtgtatgatctttttaatgtgctgctgatttcagtttgttagtattttgttgaagatatttgtatcaatgtttatcaggcatattgactataattttttttataatgtccttgtctggatttggtaacagggtattgctggtctcataaagtggttttggaggtgttctctcctctcttcagtttttaaaagagtttgtgagggattgcttatattgtagttttgctttaaatatttggtagaattcaccaataaagccatctgttcctggtgttttctttgttagatttttgattactgattcagcctcctcatgtgtaattaatctgttaagatttcctatttcttttctcgtttcttttttttttcttgagacagagtctcattctgtcacccaggctggggtgcagtggcacaatcttagctcactgcaacctctacctcccaggttcaagtgattcttctgcctcagcctcctgagtagctgggattacaggctcccgccgccatgccctgctaatctgtgtatttttagtagagacgggatttcaccatgttggccaggctgggctcgaactcctgacctcaagtgatctgcccacctcggcctcccaaattgctgtgaatacaggcatgagccaccgcacacagcaagattttctatttcttcataattctgtcttggtaagttgtatgtttccagaaattaatctatttcttctagttattcaatttgttggtgaataattcttcatagtagcctcttaagattctttgtatctttgtggtatccgttgtaatgcctggtcttttagttctgattttatttatttgagtcttctcttgttttcttagtctagctaaaagattgataaaatttgataaaattcaacatacttttatcaattttgtttatctttgcaaaaaaaaatcctcttaggttgtggatctatttgactctatcaatcatctttattgtttttttatcctatggtggtatttgttaattctacaaaagtctgaaataattttgctatatgttaactgtagtcttagtccatccagactaaccatttctctatgatatattctaccatgttgaacattatatttatacatttatttgtttgtatttaattgtccttttatgtaattttttcctctccatccaaattataagctcctataaggtggggctcgtgtgttatattttccaatattgtcactatgccgaatacagtagtaagcattcagtacatattcagtaaataatctatttcctgattgatagtatgtttgcatgtttcttttccttttattttattttttttgagacagtctctcactcatctcctaggctgtagtgcaatgatgtaaacacggctcactgctgcctcaacctccccagctcaaaggatcctcccacctcagcctctcaagtagctggcactacaggcatgccccaccatgtccaactatttttaaattttttttgtaaagatggagcctcactgtgttgccctggctggtctcaaacttctgggctcaagtgatcctcctgcctcaaccttccaaagtgctgggattacagacatgtgccaccatccccagccttaatagtatgtttctgtaaaagagcaatacagtaacatttcagttaactggtatgttggcaacaaatttattttgattaatggattttccatttaacagtttttattgttttattcagtgcagttctttaaagtgggttattccctgcctagactagtgggatcaaccaccaaaaccttcaaatatgtgcattgatatttgtttacactcttaattctgttattttttggaagacacctatgtttctcatgaaacttcaaccagagcaatatgtctggaaagaggccacatgaaaatgttcaaaattgttactaaaaatgttacataaacagcataaacttagaagaaaaaataaaatatttactctgaaatttgtatggtttaaaataatagagtcagtagagctttataaaaaaatgacagcttcctactttttaattgaagaataaacatataacactggctatactagatggagagactcagaggtagtcatggaatcagatggtgagaagaatgacccatttgtaataactaatctcattgctggtgtttattccaacaatctagcatggcatatttttctttttcattgtttcttctttatccctaccaaactgtatgtccctggattaaggctacatgaatagcttcacggcttgcagcagttcagagtaagcaggtgtaaagggacagccttaaaataggagtctaatttttaaaatggaaatataacattggctttcgtcgtcttagctggcaaagtaactctaggttaatgactgaagaaatggtgtttcactatgtatggggggtttaaaaacatgagtcaactggcaggcagacagattctactctcactaggtaagaaagtaacgattatatatgaccagggctggatcatacaaaccctaccctgaagttatactccttaattaaagtaattaatgaatgttattatgactttagtgtaaattgaatgtttcacctgaagatatcaaacagaccacatttgagtccaaatctttagttcttttggatttatattaattcctttgttccattttcacatacggatttgccaaggtgccactggactgggttctggttaaccgaagtattacagcatacaatgaaataaaatagtatttaatatattacatatttagtttctattgtatttaaagttatacctaagtacattcttatttccttttaaaaaattatttttgtgggtacataatgagtgtatatatctatggggtacatgagattttttgatacaggcatgcaatgtgaaataaggatgtcatagagaagggagtatccatcccctcaagcacttatccttcaagttacaaacaatccaattaaaaattttaagttattttaaaatgtacaattaagttgtgattgactatggtcaccctattgtgctaccgattagtagtcttgtttattcgttctaactatatttttacccattaaacatttcaccctcacccaagccccccattacccttcctagtctcaggtaatcattcttctactctctatccccatgagttcaattgctttgatttttagatcgcacaaataagcgagaccatgccatgtttgtctttctgtgtttggtttatttcacttaacataatgatcacaagttccatccatgttgttgcaaatgactggatttctttattttgatgtctgaatggtattccattgtgtatatctatgacattttttaaatccattcatctattgatggacacttaggttgcattcaaatcctggctattgtgaacagtgctgcaataaacatacgagtgcagaaatcttgttgatatactgatttcctttcttttgggtatatacacagcagtaggattgcaagatcatatgatagcacaatttttagttttttgaggaatctccaaactattctccctggtgattgtactaatttccaatcccaacaactgtatataagagttattttttctccacatcctccccagcatttgttattgcttgtattttggatataagctattttaactggggtgagatgatatctcattgtagttttgatttgcatttctctgatgatcagtgatgttgagcaccttctcatatgcctgtttgccatttgtatgtcttgttttgagaaatgtctattcaaatcttttgctcattttttgattggattattagattttcttcctacagagttatttgagctttttttttttttttttttttttttttgagacagagtttctctcttgttgtccaggctggagtgcaatgacgtgctctcggctcaccacaacctctgccaactgggttcaagagattctcctgcctcagcctcctgactagctgggattacaggcatgcaccaccatgcctagctaaatttgtgtttttagtagagatggggtttctccatgttggtcaggctggtctcgaactcccgacctcaggtgatctgcccacctcaccctcccaaattgctgggattataggtgtgagccagcacgcccagccctgtttgagctctttatatgttgtgattattaatctcttgcagatgggtagtttgcaaatattttctcccattctgtaagttattgcttcactttttttattgtatcttttgttgtgcagaaacttcttaacttgatgttatcccacttgtccatttttttctttggttgcctgctcttattgtctattgctcaagaattctttgcccagaccaatatcctggagattttttcagtgttttcttgtaatagcctttgactttggggtcttagagttaagtctttaatccattttcatttgattttggtatatggcaagagatagaggtttagtttcattcttctgaatatagggatccagttttcccagcaccatttattgaagaaactggcctttccccatgatatgttcttggcacctttgtcaaaaatgaattcactgttggggtgtggatttctttctgcgttctctattctgttccattgatctatgtgtctgttttcatgcaagttccagctgttttggttactatagctttgtagtattatttgaggacatgttatgtgattcctcaagttttgttctttcgcttagaatagctttggctattctgggtcttttgtggtttcatattaattttaggattttttttttctaaatctgtgaagaatgtcattggtattttgataggattgcattaaatgtgtagatagcttagggtagtatggacattttaacaacattcattcttccaatccatgaaaatggaatttttttccatttattggtgcattcttcaatttatttcatcgatgtttcatagttttatcatagaggcctctcacttctttggttaattactaggcaattaattttatgtgtggctattgtaaataggactaattttattttctttttacattggtcactgttggtatatagaattgctactaatttttgtatgttgattttgtatcctgcaactttactgaatatttttatcacttctaatagttttcttgtggagttgttaggttttttcaaatataagattatatcatattcatacaagaataatttgactttttccttcctaatttggattcttttatatttttcttatggctcattgctccagctggaacttccagtgctatgttgaataacagtagtggcagtgggcattcctgtcatgttccagatgttagaggaaaggctttcagtttttcaccattcgctgtgatactatgtattagtctttcatatatggctttgattatgttgaggaatgtcccgtctattcccaggttttttagggtttttatcatgaaaggatgttgaattctatcaaatggtttttcaggatcaattgaaatgatcatacagtttttatccttcattctcttgatatatcacattgatttgtttatattgaaccatctttgcatcccaaagataaatctcacttggtaatgatgaatgatctttcgaatgtattgttgattttagcttgctagtattttgttgaggatttttgcatcaatactcatcagagatattggcctgtagttttatctttttattgtgtcagtctggttttggtatcagggtaatactggacccatagaatgaatttgccattactccctccccctctatttattgaaatagtttgaataggattggcattaatcacttaaatgtttggttgcattcagcagtttagtcatggggtcccaggctttttttttttctttttttttgatgggagagtttttattatggcttcaatctcattacttgctattgatctgttcagattttggatttcttcttggttcaatcttgctaggttgtatgtatacatgaatttgtccatttcttctacattttccaaattattagcttagagttgctcatagtagtcactaacgatcctttgaatttctgcagtatcaattataatgcctcccttttcatttctgattttatttatttggatcttctctctttttttcttagtctgaataaaggttctcaattttgtctaacttttaaaaaaccagcattttttaacctatctttgtattgtatttttatcttaatttcatttatttgtgctctggtatttattatctcttttcttctactaactttggtttgatttgctcttacttttctagttctttaagatggattattacattattcatctgaagattttcctctttttggatgtaggcatttatagccataaactttccccttgatactgcttttgctgtattccataggttttggtatgttgtgtttccattatgatttgtttcaagaaatttttgaattcattcttaatttcgtcattgacctactggtcattcagcagcatattatttaatttccatttatttatataggtttcaaagttcttgttatttatttctagttgtatttcactgtggtcagagaaaatgccagatattattttaatttttttcaatgtcttaagacatattttgtgacctaacatattatctatccttgagaatgatccatgtgctaaggaaaagaatgtatattatatagtcgttagatgaaatgttctgtaaatatctattaggtccatttggtctataatagtccagactaaatatgatgtttcattgttgattttccgtatggaagatctgtccaatgctgaaggtctggtggtgaagtctctagttattattgtattgggaactatccctctctttagcgctaataatatttgctttatatatccaggtgctccagtgtacatatatatttaaaattcttatattcttttgtgaaattgaccccattatcattatatagtgaacttcgttgtctcttctcatagtttttgtcttgaaatctaatttgtctgatacaaatatagtgacccttgctcattttgggtttccattgtcctgaaatatttttccatcctttaattttcagtctacgtgtgccttttttttttttttttttttttttttgagatggagtctcgctctgttgcccaggctggaatacagtggcccaagcttggctcactgcaagctccacctcccaggttcacgccattctcatgcctcagcctcccaagtagctgggactacaggcacccgccaccgcgcccggctaattttttgtatttttagtagagacgggtttcaccatgttagccaggatggtctcgatctcctcacctcgtgatcctcccgtctcagcctcctaaagtgctgggattacaggtgtgagccactgcgcctggcctatgtgtgcctttttaggtgaagtgtttcttgtaagcaacagatcagtgggtcttgcttctttatccatgcagctggtttatgtcttccgattggagaattcagtctatttacatttaatgttactattgataagtaaggacctactcttgccattttcttatttattttctggttgtttatgatcttctctttcttttttctttccttcctgtcttcctctagtgaaggttattttctctggtgatacgattaagtttctttctttttattttttatgtatccattatatgctttttggtttggaggttactgtgaggcttgcaaatactaacttatatcctcttattttaatatgataacaacttaatactctttgtataacaaacaaaaagaaagaaaacaaataaaaactctatgcctcaacttagctcccccacttttaacctttttgttgtttctatttatatcttattgtactgactctgtcttgaaaagttgttgtagttattatttttgatgggttcattttttgcttttctgcttaagataaaagtagtttacatgccacagttagttttataatattctgtatttttctgtgtacttactattatcattaggttttgtattttcaggtgattatttattgcttattaatgtccttttctttctaattgaagtactccctatagcatttcctgtaggcctggtctgatattgctgaaatgacactgcttttgtttgtctgagaaagtcttcatttctcttgcatgtttgatgaatattttagctggatatactattctagggtaaaagttttttttccttcagcactttaaatatgtcatgccactctccccttgcctgtaaggtttccactgaaaagtcaactgccagatatattggagctccagtgtatgacatgtgttgttttctcttgctgcttttagaatccgttcttaactgttaacctttgagagtatgattattaaatggcttgaggtaaccttctccaggttgaatctgctttatgttcgatttctttcttatacttggatattgatgtctttctctaggtttgagaagttttctgttattatccctttgaattatctttctactcctatctctttctctacttccttcaaggctaataactcttaaatttgtacttttgaggctatcttcttgatcctataggtgtgcttcattttttttattcttttttcttttgactcttctgtgtattttcaaatagcctgtcttcaagctcagtaattctttcttctgcttgatcaattctgctaattaaaggatgatgatgcattattcagtaagccaattgcattgttcagcttcagaatttctgcattattattcataattattttaatctctttgttcagtttatcagatagaattctaaattccttctccgtgttatcttgacctttttttgagtttcctcaacacagctattttgaattatctgtctgcaaggtcacatacccctgttcctccaggactggtccctagttcttagtgagttcatttggtgaggtcatgtttttctggatggtggtgatgctagtagatattcttcagtgtctgggcattgaagagctagataggtattgtagtcttcactgtcttatctgtagccacccttctttggaaggctttccagatgtttgaaaggatgtgagtgttgtgatctaagctgtatcttctttagggggcactccaatcccattaatgctgtggttcttgcagacgcatagtggtgctgcctttatggtattaaacaagatccaagagatttctctggattatcaggcagagactcttgttctcttctcttacattgccccaaacaaacagagtccctctctatcttttctaacccatgtaaagctggagctggagtgacaataagcacccctgtggtcaccaccactatgaccctgctgggtcacacctgaagccagcacagtgctgggtctcatttaagacccactataactactccctggctacttcccatgtttgctcaaggctctggtgctctacaatcagcatgtgtcaaagccagccaagcctatgttcttcccttcatggcagtgaggtcccccagaccctatgtgcgtccagaagaactgtttggtagtcagggactagcatcaaaaaccttagaaatctacctaatgttttactgtattgcacctgagctgatattcaaaccacaagacacagttcttcccactctttccccctctttccaaaggcagaggagcctctcgccatagccaccaccacctcaggccatgacgtatactgccagactaccaccaatactcccttatgacccaaggtctcttaagtcaacttattgtgaatgctgcctgccctgggactcacccttcagggcaatggcctctcctctgactcaggtcaggtccagaaatgccacctaagggtcaagtcctataatcacagaccccaagagctcacttggtggtctactgacctccacccctgtggcctgatattgctgaaatcccacagcttttggttgtgctggtacctcagatgcaagacaaagtcccatttacttttctgtctgcttttctcaagcaggagttttgccccagagccaccatatctgttaatgcactgagcctcacctggagccagcccatctcagagactgaccaagaccctcaatgtagtacctgggtattgctgctggttatgcagggccgaagagctcttcagttagcagacgataaaagctggcaggaatgggtcctttccttcaaggcagcaggttcccttctggcccagggtgtgtctagaaatgtcatctggaagctaaagcctggaatggggggcctcatgactctgaccagtgccttatcctgctgtggttcaggtggtatcctagatgaaagacaaagtccttcccacccttccttctcctctcttcaagtggaagaaaggggtgtctttcagtgctgaaagctgtgcagcctggggttagggtagggatgattctaacactcccttgacttctccagctggtgcctcagtatgccaggtttcttcagttttctgtctctgggcctagttcagcactaggactcacatacacgttgcaattcttatggcctagacagcctttcaagtttactttgagacagagtgtggtagcctttgatggtgaggtttgcagacactcaggtatggacctctggtttcaagggatccttctctggctagggctgatttaaatgctcctcctgtgggcgggggtcagctgaatttgctctggttttgctttctgctttaacaggacagcacttatttcagcgcctcacgattgctgtgttttctctccttcggtgtccagagaagctctctgcaccatgccaaggtgggggagtggtagcatcggtaattctacagggtttatttcttcagtgcaactttaggacatatgaagttaaaactaggtactatgagtgctcgcctgatttttgtttcttatgaaagtttttttttttcctgtatagatagttgttaacttggtgtccttgctggggggcaactataggtagagctttctattctgtcatcttgctctgtctcccttgtatatttcctgctctttccaaattaatatgttaatttttcttattttatctttcttaatgaaataagttttcattattacttatgagtgacacaaactattgtactgatcaaaagtaaagatacacttactggtgaagggatgccaatatgttttctttagatatcaggtgaacttgagcaaaatgcttgttactccactttatagataacctttgatgcttaggcactgataaagaaatcggaacaaacaaactcaaaataaaatgagcaaactcatcccacaaatactttattttatagaaatagcacttttagccaaatgtgaatacaattgcaatagctgtgtttttaagaaaatcagcaaaattttatgtgctccattttagtaactatatttgaaatatctaaatttattcccattattaagattggacattgttatgattgcgtttcctttcaaaagatgtattctagctcaatttccctagcttccaggtaagaataatagaaatattaaaatagagctgtggtttgctataattttacagggtattttgtggtcaagttctaaaattatcaagagcatatttttatgtttttgaactttaagtttttaacaagatagtctatcctaaatcttaaatatattaatcagcaacaaaatggcatagaatgagaacagtgttaaggaaaccttgaaaataataaaaagtatgtggcttcttacatatgacatactaaggcaatgccattatcatgctgtattacaaataaaatgtaaattacaatgcaatgaaaataatttcacaatcattttattgttttaagcataccaatatcttgaaatttttcaggaaagaattgctttcagaaagatttgccttctcaagattgaagcacattttatattgaattaactgatatgctatgaaacccaggccccttgataaaaaacagtgactgttgcttttttttttttttttttttttttttgagacagagtcatctctctctcccaggctgcagtgcagtggtgcgatcttggctcactacaacctccgcctcctgggttcaagtgattctcctccctcagcctcccaagtagctgggattataggtatgcaccaccatgcccggctaatttttttgtatttttagtacagatggggtttcaccatgctggtcaggctgggctggaactcctgacctcaaatgatctgcctgcctcggcctcccaaagggctgggattacaggtgtgtgccaccttgcctggcctgttgcattttcactaacttatgacttctctagtatttatataaaaaacagagacaatatctctacaaatcaactttatataattattttaacaaatcctttgattatatataaccaaactgttctgtgcacatggaaaaatgaatatgataggaatatgattctcaggtgattaaaaaataatattctctttcatcaaaataagcaaatacctacttgtaaggaacaatgcaaagaaaaagaaatatttttgcaaatgatcaactgtcatttaaaatagatagcatctaagttgccttataccccaaatgtaaatggaccttcatattttgaacagtgaagccaattacagaaatttgtcatcattcttgtcatctgggatgatcattaaaatatctttagtgattacatctctcatttttcttcttacttatcatgtgtttacagacatagccaataatatgacttttctacctagaattattataaattcatcacaatgaccggtacgtaggtactgttttaccccctcagagagttctttcattacctcattaattcataatccacacagttttccatgtgtgcagaacagtttgatcttatatattcaaaatatttgattaaataattctataagatggatatgcatagatattgtctctattttttagatgaatactagataaatcataagctagtgaaaaagccataatcactatttttttttctgacttttaggttcaggagatacatgtgcaggtctcttatatgggtaaattgtttgtcacttgggtttggtgtacaaatgatcccgtcacccaagtagtgagcacagtacctgatagtatttcagtgctcactctcctcctaccctccccactgtagtaatacccagaatctattattctcatctttgtgtccacatgtactcaatgtttagctcctacttataagtgagaacatgagatatttggattcctgttcctgtgctaattcacttaggataatggcctacagccacatccatgttactgcaagcggaatgattttattctttttatggctatgtagtattccatggtgtatatacaccacattttctttattcagtccacagccaatgggtatctaggttgattccatgtttttgctattgtgaatagtgctgtaatgaacatacacatgaatgcatctttatggcagaacaatttatatttctttgggtatataaccaggaataggattgctggattgaacagtatttctgttttaagctctttgagtaatttccattgctttccccagtggctaaactaattgacatttccaccaacagcctataagcattccctgttttctgcaacctcaccaacatgatattttttgactttttagtaatagccattccaaaaagtcactatttttatccaagtgccccagtttcatagcatatcacttaattcaatgtaaaatgtgtttcaattttgacgaggcaaatattcctgaaagaaaatgtgttctaaatttgttgcttgaccaactgtcttatttcaagtggtgaatataatacaagaagtatagaaaagaatgtttatggccttgaacgattttacaaatttgaaggaagagcaaacaccaaaaacatatcttcttagtggatgtcatttcccattttcccaccctgatgccttgctctataagtcaaattaggtagatatacagattgatagaagatagaattgttgataaaaacagcaagaacattgatacttagattttagaatcagcattacaagagatcctgaaaatcatttagtggaaaccagagtcttatagaggaagccactaaaatctggagaatagtgacttgccaaaaatccaaaattttgtttcagtgttagagccagtctcagaatctaggccttctttccccatgtagtagttttttatatatttttaatttattctaatgaatcttctaatatctaagaggcaattcttgttttatgtgatagttttttcaaaagtcaatcttgacatatggggccattacagcaaactaataggcaaatctagcatatatcctttgtactttaaaaacattagacacaacttgattcttcaggttatatgaaaataatgaagtggtggtgaatacatagaacagatgtgtgttcataaagaccatgtggttttttttttgtttaatgtagtaatgttttgatgtgctgctgaggggcttatcttagggagatagcaaaatggcagctggttttaccctagaagacctcttactagataaattccagctgtgaatatatgatgtttccttaaatgggcaaagagaagttatcccatatgtaaaattattctcaacatctgtgctgctttaggaaccatattctctttgtaattggcttctgtaagaggatttttttcccttaaaaatgtagagaactgaatttgtacaaaatgtttataaataattcgaaagaggactttaaaagtactttttgcaagtttgttcttcttgcaagtataaatgtatacaagtataaatatatttgaacagatctaagtacaatcagtgttaaacaagtagttaaagtagtatgtgcctcacattataaaatctctgcctaaaatgacttgtgggtgtgcaaaggtagacctggtacatgtccataattctattggacaaaagtcttttggattttgtaaaaatactatggaagcatgctccagagattttgtgggtttgatttcagaccactgcaataaaacgaatattcaaaaaagtgagtcatggaaattttttagtataaacataaaaaagttatgtttatgctatactgtagcttattaagtgtgcaatagcattaatgtctaataaaataatgtgcgtcagccaatatcatactgaatgggcaaaaactggaagcattccctttgaaaactggcacaagacagggatgccctctctcaccactcctattcaacatagtgttggaagttctggccaaggcaatcaggcaggagaaggaaataaagggtattcaattaggaaaagaggaagccaaattgtccctgtttgcagatgacatgactgtgtatctagaataccccatcgtctcagcccaaaatctccttaagctgataggcaacttcagcaaagtctcgggatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaagtaaaagaggatacaaacaaatggaagaactttccatgctcatgggtaggaagaatcaatatcgtgaaaatggccatactgcccaaggtaatttacagattcaatgccatctccatcaagctaccaatgactttcttcacagaattggaaaaaactactttaaagttcatttggaaccaaaaaagagcctgcattgccaagtcaatcctcagccaaaagaacaaagctggaggcatcacactacctgacttcaaactatactacaaggctacagtaaccaaaacagcatggtattggtaccaaaacagagatatagacccatggaacagaacagagccctcagaaataatgccacacatctacaaccatctgatctttgacaaacctgacaaaaacaagcaatggggaaaggattccctgtttaataaatggtgctgggaaaactggctagccatatgtagaaagctgaaactggatcccttccttacaccttatacaaaaattaattcaagatggattaaagacttaaatgttagacctaaaaccatgaaaaccctagaagaaaacctaggcaataccattcaggacataggcatgggcaaggacttcatgtctaaaacaccaaaagcaatggcaacaaaagccaaaattgacatatgggatctaattaaactaaagaacttctgcacagcaaaagaaactactatcagagtgaacaggcagcctacagaatgggagaaaatttttgcaatctactcatctgacaaagggctaatctccagaatctacaaataactcaaacaaatttacaagaaaaaaaacaaacaaccccatcaacaagtgggtgaaggatatgaacagacacttctcaaaagaagacatttatgcagccaacagacacatgaagaaatgctcatcatcactggccatcagagaaatgcaaatcaaaaccacaatgagataccatctcacaccagttagaatggcaatcattaaaaagtcaggaaacaataggtgctggagaggatgtggagaaataggaacacttttacactgttggtgggactgtaaactagttcaaccattgtggaagtcagtgtggcgattcctcagggatctagaactagaaatatcatttgacccagccatcccattactgggtatatacccaaagggctacaaatcatgctgctataaagacacatgcacacgtatgtttattgcggcactattcacaatagcaaagacttggaacaaagccaaatgttcaacaatgatagactggattcagaaaatgtggcacatatacaccatggaatactatgcagtcataaaaaatgatgagcttatatcctttgtagggacatggttgaagctggaaaccatcattctcagaaaactatcgcaaggagaaaaatccaaacactgcatgttctcactcataggtgggaattgaacaatgagaacacatgggcacaggaagtggaacatcacacaccagggcctgttgggggtcgggggagtggggatggatagcattaggagatatacctaatgttaaatgacgagttaatgggtgcagcacaccaacatggcacatgtatacatatggaacaaacctgcatgttgtgcacatgtaccctaaaacttaaagtataataaaaataaataaataaaacatttcatgctgcaaaaaaagataaaataaaacaaaataaaataaaataatgtgcgtatcttaatttcaaaatattttattgctaaaaatgctaacactcatctgaggcttcattgctttgaaatctttttttttaaagaaagaaaatggtggactttaatctttatttacaggacactgtgagatatgaaattccattgaaatctttttgctggtgaagggtcttgccttgatgttggcaatgaggtatggctaatggggtggtggatgctgaagtttggagtagttgtgacaatttcttaaaagaagatcatagtaaagtttgctacattgattggctcttcctttcctgacaaaaatactctgtagcatgcaatgctgtttgatagcgtgttacccacagcaaaacttctttcaagatttcagtcaatccttttataccctgccactgccttatcaagtaagttcatgtaatattctaaatcttttgttgtcatttcaacaatgttcaccgcatcttcaccagaagtagattttatctcaagaaaccacttttttatcattcgtaagaagcaactttgtatccattcaagttttatcatgatattgcaacaattcagtcacatcctcaagctccacttgtaagtctagttcttttgctacttccacaacatctacagtggcttccttcaatgaagtcttgaacccctcaaagtcatccatgagtgggggaatcaccttcttccaagctcttgtcaatattgatattttgacctcctcccatgaatcatgaatgttcttcatgggatttagaatgatgaatctttttcagaaccatttccatttgcatttctcagattcatcagacaaatcactaactatggcagctataaccttatgaaatgtagttcttaaatgataatacttgagagttgaaattactcctgattcatggactgcaggatgaatgttttgttagcagtcatgaaaacaacattaatttccttttatatctttttcagaagtgttgggcgaccagttgcattgtcaataagcaaatattttgaaattaatctttttttagcattagggatcaacggtcagcttaaaatatttaatacaccatgctgtaaacagatgtgctgtcatccaggctttgttgttgtatgtgtagagcacaggcagagtagatttagcatcatccttaagggccctagcattttcagaatagtaaatgatcattggcttcaatttaaagtcaccagctgcattaggccctaacaagagagtcaatatgtactttgaagctttaaagccaggtattgacttctctgtagccatgaaattcctatatagcatcttcttcctatataaggctgcttcatctacactgaaaatctgttgttcagtgtagccaccttcattaattatcttagctagatcttccggataacttgctgcagcttctttataagcacttgctgcacttttatattatggagatggcttctttccttaaacctcatgaccaacctctgctaacttcatttttttttttcctgtagctttctcgcctctttcagccttcgtagaattgaagagtgttaggaactttttctggattaagctttggctgaagggaacgttgtggatggtttgatcttctatctagacctctgaaactttctccatattggccataaggcagtttcactttctatcatttttgtgttcactggagtagcactttcaattttcttcaagaacttttcctttgcattaacaatgtggctaactttttggcacaagaagcctagttttctgcctatcttggcttttggtatgctttcctcaataaacttaatcatttttagcttctaatttaaatgagagacatgtgacttttcctttcatttgaacacttagaggccattttagcgtcattaactggcctactttaaggagtgttgtatctcagaaaataggtaggctgaaggagaaggagagatacatggaaagggccagttcacgtcgcagtcagaacagacaggacattcatcaattaagtttttcattttatatgagcaaggtttgtggattcccaaataattataatagtaacatctatagccaaaaataattaaattgtacattttaaaataacaaaaagtgtaactagattgtttgtaacacaaaatataaatgcctgaagtgacggatactccatttaacctgatgtgactattacacattgcatgcctgtatcaaaatatctaatgtaacccataaatacatacacctactatgtacccacaaaaattaaaaattatgaaaaagaacactgatcacagattaccataagagatataatagtaggtggggcacggtggctcacccctgtaatcccaacactttgggaggctgagatgggcagatcgcttgaggtcaggagttcaagtccagactgggcaacatggcaaaaccttgtctctataaaaaaaaaaaacaaaaaacagctgactgccgtagcgcatgtttgtaatcccagctacttgggaggctgagacatgagaatggcttgaacctgggaggttgaggttgcagtgagctgagaagccaagatggtgccacggcactccagcctggatgacagagtgagactctgtctcaaatatatatatagagagagataataataacaaaaaagttttgaacattgcaagaattaccaaaaagtgacatagagacacaaagtgagcattggctgttggaaaaatgaaaaatggcaccagtagatttgcttaatgtagggttgctataaaccttcagatttaaaaaaaaaaaagcaatatctatgaagcacaacgaaatgaagcacaataaaatgagctatgtctgtattgagtcttgttaatgttgttcatggtgattaacacaaaatagtaaatattcagactttactagtttgtgaaatatctgcataccaacaaccataacaagcagccaaatggttaggctgagagaactagatgctttagtagctactgtatttggcatttatttgtctcattcttactatctgctgtcatagctgatgagaggttcctcataaagatgactggaaaaagattatctgaaaccattatgtattggctgagtctcaatcacaaatgataccagagtttgtttttcaagcacattagacaaatagatgtcaataaaattgtgtagatatattttgttttaaaaaataatgataatttaagaaaatagttataagaacaaaaaatcaatattaacatctgcaaaatcttaaatagatataattaatgtatgttgctaagtagagcattttttaatgataatgttaacagttttttaaaaattgaccaggatgtgtagagtcaaaaatgccactgccttgttaccagttatctttgaatgcaatttctaattaaatattccaaaagtggtctgaacaatggtagcccacttgtgagtaatgaatacagcctctcaggacagctatctggaaattaatggcatttgtctaaatatgtatgttctgataagtttgttaaacaccagttgtattaatatacagccatgcttcatatagtgtctaattatgatgtgatactaattattatctttctcattgatcccatgtgatctaataattatttgtagagccatgtaggtgtttgcatgtgtacacacacacatacacacacattgcccattgaaaatgaaaaagaacagtctcattgcctgtgttctaggcacactacaccttcgtttataatcttacatgtatcagaaaaaactttatgctataaatccggagtcagtaaactatgaatcctgggcacatacaacacatacaatctttccaggagctacagattttttttttttaacatttttaagtgttgaaataaatcagatttagagggtaagatggctcaatagacacaaccaggtggaacagctaacactgagggatcgagacaactggcacacttctaacagatcttcagtggtaaggcactgagagtggatggaggaaagtcacagaagctgggctgaagaggaaggaagctggaaacactgcatagggctacttcacaccaggactcattcttggcccccagtgaccccaggagaacaggcgagttaaactgtcaaggagtaacctgcttttgtcaagagcctctggaatcccagcaggaggagacccccttgaccccactaacagtattacacacatcattgaggcagaacatttgcaaagatattcaggacctgaacttaacactatatcaagtggacctgatagacatctacagaaagttccattcaaaagcaatattatatacattcttctcatcaccacatggcatatactctaaaatcaaccgcataatcagacacactcttcagcaagtgcaaaggaactgaaattataataaccactctgttggaccacagcacaattaaatcaggaatcaggtctaagaaattttcttaaaaccatacgattacatggaaactgaataacctgctcctgaataactttcaggtaaataatgaaattgagccagcaatcaagttatttgaaactaatgagaataaagatacaacattcaagaatcactgggacacagcgaaggcagtgtttagggggaaacttatagcactaaacgcccacagcaacaatttaaaaggatctcagtggggcagggccaagatggccaactagaagcagcagagatcggaggttgccatggaaaagaaccataacagcatgcaaatccagaaccggcaagtgaggtatccaggttctgtcatcaggactgactcggcagctggcgtggtccatggagaggaaggaagaacagtgtggtttgacggcccacccaagagccacatgaggcaggggagcccccagtcccaagccaagggaggcagtgagtgaatgtgctacccagcctgggaaaccgtgctttttcactgaactgtgcaacccatgaaccagaagattccactcatgagcccatgccaccagggcctaaggccccaaccacggagctgcatagattctcaaaagccactcagcacaaaatggcttaagcctgccagtcttcccgtgggagcgcagccagcatcacagctgctgctgtctgctgtctaagtcatttgagctccttgtgggaggggtggcaaccagcattgggactaatagctgcctaacactaagctcccagggcaagggaagggcagcagccatctctatagctccaggtcatgctttttccctgctggagccagggaggctggatggcttggtcccaagaggtatcccccacagcccaacacaccagttgtggcagactgcggccagagcacctcctcagacctgaccctgacccattcttcctcattgggcagggcctccctgcaggaactccaactctagccccaggaactcaggaacagaagtctgatctctctgggcctgagttcctagcaggaggggtggcctcagtctctgtggaccagcagacatagtctttcctcctgctagttctgagaaatctgggaagcccagatgagtaggattccccccaataaaacacactccctccaccaagaaacagtcaaagtgctttgttaaacgggtcctgctccccatgccacccaactgggtgagaccctccagaaggggttgtcagacaccgtattcaggagggtacatattggcaccaggtcagtgccccttagggtcagagatcccagagggaggagcatgcacccatctttgctgttctccagcctcctcgagtgacatctccaggcacaggaatgaaccagatgaatagggcctgaagtgaacccccagaaaaccccaacttccctacagaagagggacctaaccattgaaagaaaaacaaacaaacagaaagcaacaacaacagcatcaacaaaaccccatccaagggtcagcagcctcaaagatcaaaactggacaaactcatgaagatgagaaagaatcaatgaaaaaattctgaaaacccaaaaggccagtgtacctcttctccaaatgatcccaacgcctttccagcaagggcacagaactggttggaggatgagatggacaaactgacagaagtatacttcagaaggcactgagctaaaggagcattttctatcccagtgcaaagaagctaagaaccttcataaaaggttacaggagctgctaactagaataaccagtacagagagaaacataaatgacctgatggagttgaaaaacacagcacaagaacttcgtgaagcatacacaagtattgatagctgaatcaatgaagcagaagaaaggatatcagaggttgaagatgatcttgctgatataagatatgcagagaagattagaaaataaataaagaaatggaacaaacaaaacctctgagaaatacggggcaatgtaaaaacaccaaacctacgattgattggagtacctgaaagagacggggagaatgaaaccaagttagaaaacacacttcgggttattatccaggagaacttccccaacctagaaaggcagggcagcattcaaattcaggaaatacagagaacaccactaagatactccatgagaagatcaaccccagaacacataatcattagattctccaaggtagaaatgaaggaaaaaatgttaagggcagccagagagaaaggccaagtcacctacaaagggaagcccatcatactaacagcagatctctcagcagaaaccctacaggccagaagagagtgggggccaatattcaacattcttaaagaaaagcattttcaacccagaatttcatatccagccaatctaagcttcataggcaaaggagaaataaaatctgttccagacaagcaaatactgaaggatttcatcatcactaggcctaccttgcaagagctcctgtaggaagcactaaatatggaaaggaaaaatcagtaccagccactgcaaaaacaaaccaaaatataaagaccaatgacactataaagaaactgcatcaattagtgtgcaaaataacgagctagcatcatgctgacaatatcaaattcacccataacaatattaaccttaaaggtaaatgggctaaatgccccaattaaaagacacagactggcaaattggataaagagtcaagacccatcagtgtgctgtattcaggagacccatcccacatgcaaagacacacataagctcaaaataaagggagggaggaaaatttaccaagcaaatggaaagcaacaacaacaacaaaaagcaggggttgccatcctagtctctaacaaaacagactttaaaccacaaaagatcaagaaagacaaagaagggcattacataatagtaaaggattcaatgcaacaagaagagctaactatcctaaatatatatgcacccaatacaggagcacccagattcataaagcaagtccttagagaactacaaagagacttggactgacacacaataatagtggaagaccttaacaccccactgtcaatattagacagatcaatgagacagaaaattaacaaggatattcaggacttgaactcagccctggattgagtggacatctacagaactctccaccaaaaatcaacagagtatacaattcttctcagtgccacatggcacttattctaaaatcaaccacatgattcgaagtaaaacactcatcagcaaatgcaaaagaattgaaatcataacagtctctcagaccaccgtgcaatcaaattaaaactcaggattaagaaactcactcaaaactgcacaactacatgaaaactgaacaaactgctcctgaatgactcctgggaaaataatgaaatcaaggcagcaatcaagaagttctttgaaaccagtgagaacaaagagacaacataccagaatctcttggacacagctaaagtagtgttaagagggtaatttatagcactaaatgcccacatcagaaagttagaaagatctcaaatcaacaccctaacattacaataaaaagaggcacagaagcaagaataaacaaatccaaaagctagcagaagacaagaaataattaagatcagagcagaactgaaggagatagagacacaacaatccctccaaaacatcaatgaatccaggagctagtttttcaaaaaaaaaattaacaaaatagacagaccactagctagactaataaagaagaaaagtatcaaatagacacaataaaaaatgataaagaggatatcaccccgaccacaaagcaatacaaactaccatcagagaatactataaatacttctatgcaaataaactagcaaaccgagaagaaatggataaattcctggacacatacaccctcccaagagtaaaccaggaagaagtagaatccctgaataaaccaataacaagttctgaaattgaggcagtaattaaaagcttaccaaccaaaaaaaaagcccaggaccagataaattcaaaactgaattctaccagagttacaaagaggagctggtaccattccttctgaaaccattccaaacaattgtaaaggagggactcctccctaactcattttatgaggccaacatcatcctgataccaaagcctggcagaggcacaacaaaaaaagaaaacttcaggccactatctctgatgaacatcaatgcaaagatcctcaaaaaaatactggcaaaccaaacctagcaggacatcaaaaagtctatccaccacaatcaagtcggcttcatccctgggatgcaaggctgattcaacatacacaaatcaacaaacataatccatcaaataaatgaaccaatgactaaaaccacatgattatttcaacagatgcagaaaaggcctttgataaaattcaacattccttcatgataaaaactctcaataaactaggtattaatagaacatatttcaaaataataagagctatttatgacaaatacacagccaatatcatactcaatgggcaaaagctggaagcattccctttgaaaaccagcataagacaaggatgccctctctcaccactcctattcaacatggtgttggaagttccagctggagaaatcaggcaagataaataaataacggtattcaaataggaagagagaaagtcaacttgtctctgtttgcagacaacatgattctatatttagaaaacaccatcgtctcagccccaaaactacttaagctggtaagcaatttcagcaaagtctcaggatacaaaatcaatgtgcaaaaatcacaagcattcctatacaccaacaacagacaagcagagagccaaatcatgaatgaactcccattcacaattgctatgaagagaataaaacacctaggaatgcagctaacaagggatatgaaggatctcttcaaggagaactgcaaaccattgctcgagaaataacagaggacacaaacaaaaggaaaaacattccagactcatagataggaagaatcaatatcgtgaaaacggccatactgcccaaagtaatctatagattcaattctgttcccattaaactaccattgacattctttacaaaattagcaaaaactactttaaatttcatatggaaccaaaaaagagcccttatagccaagacaatcttaagcaaaaacaaacaaacaaaaaacaaaaaacaaaaaaaacaaagctggaggcatcatgctacctgacttcaaactatactacaaggctacaataagcaaaacttcgtggtactgacatacaatggaatagaatagagacctcagaaataccaccacacatctacaaccatctgatctttgatgaacctgacaaaaataggaattgggaaaaggattccctatttaacaaatggtgctgggaaaactggctagccatatgcagaaaagtcttgattaaagacttaaatataaaactcaaaatcataaaaaacccaaaaagaaatcttaggcaataccattcaggacataggcatgggcaaggacttcatgatgaaaacgccaaaagcaattgcaacaaaagccaaaattgacaaatgggatctaattaagctaaagagcttctgcacagcaaaaaaaaaactatcatcagagtgaacaggcaacccattgaatgggagaaaatttctgcaatctacccatctgacaaaggtctaatatccagaatctgcaagggactcacacaaatttacaagaaaaaaaccaaacaaccccatcaaaaagtggacaaaggatatgaatctgcaaggaactcacacatatttacaagaaaaaaaaacaaacaaccccatcaaaaagtggacaaaagatatgaacagacacttctcaaaagaagacatttatgcagccaacaaccttatgaaaaaaagatcaacattgctgattgttagagaaatacaaatcaaaaccacaatgaaataccatctcacaccagtcagaatggcgattattaaacagtcaacaaacaatagatgctggaggctgtggagaaataggaatgctttgacactgttggtgggaatgtaaattagttcaaccattgtgtaagacagtgtggcgattcttcaaggatctagatctagaaataccatttgatccagcaatcccaatactgggtatatacccaaaggaatataaatcattctactataaagacacaagcacacatatgtttattgcagcactgtttacaatagcaaagacatggaaccaaccaaaatgcccattgatgatagactggataaagaaaatgtggtacatatacaccatggaatgctatgcaaccataaaaaagaaggagctcatgcaggaatatagatgaagctgggggccattactttagcaaactaatacaggaacagcaaaccaaatatcgtgtgttctcacctgtaagtgagagctaaacaaggagaacttctggacacatagaggggaacaagagacactggggcctactggaaggtggagggtgggaggagggagaggatcagcaaaaataactaataggtactaagcataattcccgggtgataaaataatctgtacaacaaacacccatgacacaagtttacctatataacaaacctccacatgtacctctgaacttaaaagttaagaaaaaatcaaaagaaggacaatgttttgtgatatgtgaaaattaagtgaaatttcagtgtccataaatgaagttttattagaacaaagccacagccattcatttatgtaatgcctattgctgctttcacactacagtggcaggatgactacttgcaatagaaaccatatggttcaacaatcataaattatttactatctgcctttttacagaaaaaaaaagccaactcctgctgtagatcactcacactggaggaatgtgtggctaaaagaggggatacatttcccataagactcaaggaacactcattatccattcttaagagaaaatgataggggtttaacaagtgatgtgaatgaaacaaaatagtatctatggattcccttttggaatttggaggaagaataattttccaattttaggcattaaatccctgtgagcatgtgtttctgagtactatggttcttatgtcaaacattgcataagggtagggcacaggtagaaaggagaaaagaaaacttttactctattacctgttttcttctccatgtgtcatgtgagaatagaagctatatctccttcaagatgaacatagttattacctgggggttctattccctgttccctgattagaaggtaaatgctgggaggaaaattgctactctgatgccataaagggacgcttctagactaaaaggaaagaattgtatccacttgcaatttagcctatctttcttcatcttttgccctgtcttctttgggaatgtgaatgtgatgactgtttattctacacaatcataagggatacatattgccattttagtggctatgttttgcattttgttaaggtacacgttttaaatttcttccttgtgctaaaatatccagtatttgtgtgtatgtgtatatatacacacacacacagcacccacacacatagtgtatgacacatataatgtgccttatttgcatattatatttatgtatgaatgtgtctcaatgatagtgtcatttttataataatatgataatatattggtatgatctaataatttagcttccttatttcattggaatacaattaccaaggggcttattggcctgtaaaagaaaactcctagtcgggatctaaatgcatttacagtagccaaatttacatctaccagctatctagacgtcaaataatatagaacatagggggccgaagcaatttttactgattgtttcttaactgaaggataggacatatgcagaacagttaaatagccctagggtccatgtttattatggccaagaaagagaaacggtagtcataaattaagtttattacatcttatatatagcatagcaagagaagcatgaaagtaataccgtatcactctccttttcaccaatgcatgaatattagatttatgaattatgcttagtagttagtccatgcataaaaaagcattataaaatacatataatattgcaatatagctgcaaaaatatagttaagtatctgaaattcacttatataaacaaaactataataatccagtgggaactgacttaatattcaatgtttcagccaggacacgagatctaagttattgttacaaatgtgtacatgaccattgtcatgtcattgaattgcaagaaaattcaatttattatgtcattttctttccatctgaattaggcatattttatatttgatgttttcttgctaaaaagcatttataggctttctccatttgactttattttctttctttcaatttgtcatagatgagtccatactgtgaactttttaattaaattttttaatgatgcttgtcccagctttctaaatatctaatcttacccttaagagtttaacttaccatttaagtttagagttttctaaatattattatttaattgtcttatagtggcaagtgtaatgctccctgcatagtcagtgtcatcaaaagcttattaactaagagaaacaaaggtaagtgttaaaatttaaagatcacacagtgagggaagtcttggaaaattggcagaaacctctccaaagtatatctgtgggtaatattacatacttcatattctgtaagatggtgacagtaaggattaggacagatttgaaggtttgatccttatttataagcttcttgcttgtgaatagaagtcagacctacaatttattaacttaccttcttcactatttctacactggtccaagtcaccattatctttcacctgaattattccaatagtctctataattgtctcctgttttcacatcttctttatcacactgtcttctcaatatagctgggagaggttctattaaaggaagtcagctaattcctcttttcaaatctccaaagtctgcttctcatttagagtaaaacccaaggtccttacagtggtctacaaggccctacgagatcttccttcaggtctaccatttcttttcctactactttctccctcactcaaactagcttctttgctcttctctatgaattgccatttataagtgattatcacatttcatttttaaaataccatgaagcccagatactcatgaattactctctacttgtttgccctctgaatactttctctaggactcaccaggtacaaacattggtacaaaggaggccaaaaacacagcaataacagaaacagcaaagacaagctctctttgttctccttctgagattttttgctaaaactgcaaattgtgccaggttggaaggaagaatcaatgacccatcatgagcaatgtacacacactcttggttttgccattttcttgtctttttgttgggccagaaggataccattgaaaattactgcttcagtgctttaaagagttaatgtagcttccagaaaggcttattacactccccaggagtagcttatgcattatgagaatgtgactcagtttgttggcaaaatgcacatctgctacaggacagggacaactgctgattaaaggagacttcagtggccctagtctttaagagcaagttgactgatggcaaagttttcgaagattatatctaaagtccagtgtcccttttatcaccacctcccgtgggtaatgattgaacataattagcattattttatatgctcgaatccttctcccattactgttaactgtctttctatcgcagtttattggattgccactgaactcaatttcactttgggcattcaagtgaggctgaaatttctccctctttctagttaaaatatgtgacatcatcagaagttggaggaaatcaggcatttataatgaatatgagattgtagagctcccaatgtaattaagattcttttgtcaaaatttatctaaattcaccagatatgaaagactaccacacacacttcctttagtttaccaatataatcctagtacaggtgagttgttgtttaggcttatagtagcatatgctgttttaggaaactttttgcaaagaaatgggggagagggagtacatttcaaaattgttttgaacattaggtagtacaaaatatttctaaaaataaagagaagctttttggattttagaaatgttgcttaatgaacattgcatttgaacataatttttcataatttaaaaccttattatatcacctattacataaagagaaatcttaattgatttgtccatttcagatgggggtgttgattgatattagaaattcaggccaataagacgcaaagagaaacaataagtagatttcaacatttcagttaagatatatttcaatcttttttgagatggagtcttgctctgtggccaggctagagtgcagtggcatgatctcggctcactacaacctccacctcccaggttcaagcgattctcctccctcagcttcacaagtagctgggactacaggcatgtgccaccatgcccagctaagttttgtatttttagtagagatggagtttcaccttgctggccaggatggtctcaatctcttgacctcgtgatctgcccgccttggcctctcaaagtgctgggattacatgtgtcagccatcgctcctggccaagctatatttctaaatagtaactgagtggttttacaatattataatattttctggttgggcaaagattttttattttagtttttttttaatttttaatttttgtgggtatatattaggtatatatatttatgaggtagatgagatactttgatacaggtgtgcaatgcataataattacatcaaaatagggcatctatcccctcaagcacttatgctttgtgttacaaacaatccagtttcactttacgttattttaaaatgtactatttaattattattgactatagtcaccctgctgtgctagaaaatactaggtcttattcattctttctattttattttttacccattacccatccccatctcccccaaccctcgaactactctccccagcctctggtaaccatctgtctactctcaatgtccatgagttcaattgttttcatttatagatcccacaaagaagtgaaaacatgaaaagtttgtctttctgtgcctggcttatttcacttaacccaatgatcttcatttccatccatgctgttgcaaatgacaggatctcagcctttctatgattgaatatcattgtgtatatgtatgactttcttttatccattcgtctgttgatggacacttagattgctttcaagtcttggctatggtgaacagtgctgcaacaaacatgggggtgcagatatcacttcattatactggtttcctttctttggggtatatatgcagcagtgggatggcgggattgtatggtagctttatatctagttttttgaggaacctccaaacttttctccatagtgattgtactaatttacattcccactaacagggtacaagagttccctatactccacatcctaaccaacatttgttattgcctgactttagatatttcattttaattggggtgacattatatctcattgtagttttgatttacatttgtctaacaatcaacgttgagcaacttttcatatacctgtttgctatttatatttctggtttttagaaatatctattgaaatcttttgcccatttttaatcagattattagattttttttcctatagagttgtttaacctcctcatatgttctggttattaatcctttatcagatgtgtagcttttaaatattttctcccattctgtgtgatgtctcttcacttggcaaaatgttttctttgctgcatagaagctttttaacttgatatgatgccatttgtccatttttgctttggttgccttggcttgtagggtatgactcaagaaatttttgcccagaccaatgtcctggagcatatcttcaatgttttcttgtgttcatttcataatttcatgtcttagatttaagcctaattcattgtgatttgacttttttgtatatggtgagagacagggatctagtttcattcttctgcacatggatatccagttttcccaacatcagttactgaagcgactgtctttgccccagagtatgttcttggcacctttgttgaaaacgagttcactgtaggtgtatggatttatttctcggttctctattctgttccactgatctatgtgtctgtttttaatgtcagtgcatgccatttttgttactatagctttgtagtaaaatttaaagtcatgtaatgttattcctccggttttattcttttttctcaagatagctttgtttactctgggtgtttggtgttcgcatataaattttaagatttttaaaaattatttctgtgaagaatgtcattggtattcttttagggatttcgttgaatctggagattgcattgagtagtgtggccattttaacaatattcgttcttccaattcattaacatggaatgtctttccatttttgtgtcctctacagttttttccagcactgttttataatgttcattgtcttgatttttcagttcttcggttaggttaattcctcggtattcacttttatttgtggctattgtaaatgggcttacttttttttcctttttacattggtcactgctagcatatagaaatgctactgatttttccatgtttattttctatcctgcaattttactaaatttgtttaccagttgtacgagtgttcttgtggggtccttaggtttttccaagtataagatcatatcatcagcaaaccaagataattttacttcttcctttccaatttggatgccctttatttctttctcttgtttaattgccctagctaggactttcagtgctatgttgaataacaatggttaaagtgggtatccttgttgtgttccagatgttggaggaaaggctttcagtttttttcccattcagtatgatactcaatgtgggcctgttgtatatgccttttattatattgaggtatgtttcttctatctctagttttttcagggtttttatcatgaagggatgttgaattttatcaaatacttttctgggatcagttgaaatgatcatatagttttgtccttcattctgttgctatgatgtaccacatcaattgatttgcatatgttgaataattcttgaatccctatgataaatcccacttgaccatgataaatgatttttttttttgaggctaatgcaatgacggctcactgctgtctcaacttcctgggctcatgtgattctcccatctcagcctcccaaggaactgggactacaggtgttcgccaccatgcctggctacatttttgtagctatagggtttctccatgttgcccaggctggtcttgaactcctgggctcaagcgatctgctcacctcagcctcccaaagtactgggattttaggcataagtcactgggcccagcaaatgatcagtttaaatgtattgttggattaagtttgctagtattttattgaggatttttgcatcaatattcatcagaggtattggcttgtagttttctttcttcacatgtctttgcttttggtatgagagtaatactggcctcatagaatgaatttggaagtattcccttctgctttattctttggagtagtttgagtaggattggcattagttcttctataaatgtttggtagaattcaacagtgaagccattgggtcccaggccttttttttttttttctagaaacttcatattattgttttgttcttattacttgttagtggtcttttcaggttttggatttctgcgtgcttcaatgtttgtaggttgtatgtgtctatgaattaatttgtttcttctaggttttcctttatagacacagagtagctcataatcctttaaattagtcctttaaataatcctttaaattactgtggtttcagtcataatgtctcctttttcatctctgattttgtatatttgtgtcttctctctttcttctcagtttgcctaaaagtttgtcaattatgtcttcaaaaagccaacttttcatttctttgatcttgtgtatcatttccttatttcaatttcatttatttctcctccaatctttattatttattttcttctactaatgttgagtttggtttgctcttgtttttccagttttttaagatgcatagttaggttatgtatttgaagtttttctttttctttttttttttaaatgtaagcacttacagctataaactttccacttaggagtacttttgctgttcccataggttttgatatgttgtgtttttattatcatttgttttaaaacatctttcaattttcttcttaatttcttcattgactcactggtaattcagcattttatttaatttccctgtgtttgtatagttcccaaatacctcttgttattgatttctaggcttatcaaatggtgtttttagaagatgcttgatatgatttcaactttttggatgtttaaagacccattttgtgacttaaggtatggtctatccttgagaatgatccatgtgctgaagaaaaggatgcgtattatgcagctgttggatgaaatgttctgtaaatatctattaggtccacttgctctatagtgcagattaagtcagatgtttaatttgctgcctgaaagatctgtccagtgctaaaagtggggtgctgaagtctccagctattattgtgttggggtctattactctctttaactctaatattttttatatatatttgggtgctccagcattgggtgaatatttatttactattgttatatcctctttctgaattgactactttatcattatactataaccttctttgtctcttttttcagtttttgccttgaaatccattttgtctgatatcagtatagctactcctgctcttttttggtttccgttgacacagaatatcttttttcattttgtaaattttcagtctgtgtgtacgtttatagatgaactatgtttattgtaatcaacacatcattgggaattgctttttttatccattcagctgttttatgccttttgaatggagagtttagtctatttatattcaatgtaattattgataagtaaagacttactccttcctttttgttattggttttctgtttgttttgtggtcttttcttccttttcttcatccttcctgtcttacttttactgaaggtgattttctctggtggcaagatttaatttcttggtctttaatttttgtatatccattttagtgttgttttttgagattaccatgaggcttgcaaatatcatcttataacccattattttaagctgataacaccttaacattgtttgcataaacaaacaagcaaaaataaaactaataaaaactttacaccttaactttgtttccctagtttttaacttttttgtttctgtttatatcttattatactgtcttgtaattattatttttgagtggttaattgtttagactttctacttaggataacagtagtttatacaccacagttacagtgttatattattctgtgtttttctgtgtgcttactgtcaccagtgagttttataccttaggatgatttcttcctgctcattaatgtccttttctttcaggttgaagcattccctttagcatttcttgtagcacgtatctggtgtttatgaaattcctcagcttttgtttctctgggaaaatatttatttctccttcatgctccagggatatttttgccaatttttgctattatctggtaaaagttttttccttcagcactttaaatatgtcctgactatctcttctggcctgtaaggtttcgactgaaaagtttgctgccagatgtaatggagctttgttgtatgttatttgtttcttctctcttgctgcttttaggttcttttccttagaattgacctttgggaagttgattattaaatgccttgaggtagtcttctttaggttaaatctgcttggtgttctataactttcttgtacttgaatgttgatatcactctctaggtttgagaaatttcctgatattatccatttaaatatactttctacccctatctgtttctctacctccttttgaaggccaataactcttatatgtgccctttcgaggttattacctagatagcaatagctttcaagtgtgctttatgctttcatattcttttttcttttatctacgttgacttttcaaatagcctgtctttacgttcactaattatttcttctgcttgattaattctgctgttaaaagagtcgatgcattctttagtatgccaatttcaattttcaactccataatttctgcttgatacttttaaattattgctatctctttgtaagtttatctgatagaattctaaattcatactctgtgctatcttgaatctctttgagttttctcaaagcagatattttgaattatctgtctcaaagggcatatatctctgtttcttcaggattgatctgtgatgttttatttagttcctttggtgagaatatgttttcctggaggttactgatgctcgtagatgtttgtttatgtctgtgtattgaggagttaggtgtttattgtactcttcacagtctgggattctgtttcccatctttcttctgatggtctttgatatggtttggctttgtctccaccaaaacctcatcttgaattgtaactcctacaattgccacttgtcatgggaggaacgcggtgggaggtgattgaattatgggggcaggtctttcctgcactgttctcatgattgtgaatagtcttaccagattcgatggttttaaaaatgggagtttgcctgcacaatctctcttctcttgtctgctgccgtgtgagatatgcccttcaccttccaccatgattgtgaggcctccccagcctcgtggaattgtaagtccaataaacctctttcctgtataaattgtgcagtcttgggtatgtctttatcatacccaagcatgaaaatggactaatacagtaaattggaaccagtagagaggtgcgctgctgaaaagatacccgaaaatgtggaagcaagtttggaactggttggcagaggttggaacagtttggagggctcagaagaagacaggacaatttgagaaagtttggaatttcctagcgacttgttaaatggctttgcccaagattctgatagtgataaggacaataaagtccaggctgacgtggtctcagatgaagatgaggaacttgttgggaactggagcaaaggtgattcttgttatattttagcaaagggactggaggcattttgcccatgccctagaaatttctgaaactttgaacttgagagatatgatttagggtatctggtagaagagatttattttattttatttcattttattttattttaaattctgggatatatgtgcagaaaatgcagattcattacataggtatacgtgtttcatggtggtttgctgcacctatctactcatcatctaggttctaagcctcgcatgcattagctatttgtcctgatgctgtcgctcccctcaccccctacctcccaaccggccccagtgtgtgatgttaccctccctgtgtccatgtgttctcattgttcaactcccacttatgagtgggaacatgtggtttttggttttcggttcctgtgttagtttgctgaggatgttggcatccagcttcatccatgtccctgcaaaggacaagatctcattcctttttacggctgcatagtattccatggtgtatatgtaccacattttctttatccagtctatcactgatgggcatttgggttggttccatgtttttgctattgtaaatagtgctgcaataaacatagtgtgcatgtatctttatagtaaaatgatttatattcctttgggattcctttggttggtcaaatggtatttctggtcctagatccttgaagagttgccacactatcttccacaatggttgaactaatttacattcccaccaacagtgtcaaagcattcctatttgttcacagcctccagcatctattgtttcttgactttttaataatcatcattctgactggcatgagatggtatctcattgtggttttgatttgtatttctctaatgatcagtgatgttgaggttttttttttgtatgtttgttggccacataaatgtcttcttctgagaagtgtctgttcatatcctttgccccctttttgatggggttgtttgtggggttttttttttttttttttttttttgtaactttgtgtgagttccttgtagattctggatattagacctttgtccagtgggtagattgcaaaaattttctcctattctgtaggttgcctggtggaagaaatttctaagcagcaaatcattcaagatgtgacttgggtgctgttaaaggcattcagttttataagggaaggagagcataaaagttcagaaaattcagagcctgacaatgtaatggaaaagaaaatctcattttctgaggagaaattcaagcgggctgaagaaatttgcacaagtaacaaggagcccaatgttaatccccaagacaaaggggtccagggcatgttagaggtcttcatggcagcccctctaatcacaggctcagaggcctaggaggataacatggttttgtgggccaggctcaaggtccccatgctgtgtacagcccagggacttggtgccctaagtcccaggagctccagccatggctgaaaagggccaacatggaactcaggccatggcttcagagggtgcaagcctcaagctttggcagtatccacgtggtatagagcctgcaattgcacagaagtcaagaattgcggtttgggaacctctgactagatttcagaggatgtatggaaatgcctggatgtccaggcagaagtttgctgcaggggcagcgttctcaagaagaacctctgccagcacagtttgaaagcaatgtgagaacatgagatttgggaagggccaggggtggaatgatatggtttggctgagtccccacccaaacctcatcttgaattgtaacacccacaattgccatgtgtcgtgggaggaacccagagggaggtgattgaaatggggacgggtctttcctatgctgttcttgtgaaagtgaatgagtctcaggagatctgatggttttaaaaatgagagtttgcctgcacaagctctcttctcttgtctgctgccatgtgagacttgcctttccccttctgttatgattatgaggcctctccagccacctggaactgtaaatccaataaacctctttcctgtataagttgcccagtcttggataaatctttatcagcagtgtgaaaatggactaataccactttccaggtcctaaaagagacttgaaccccaagcccaatactactgtcatccatggagactcatagaagcactgccttcgtggtcttgtaaaagatttggaagaattaaagttggaggcaccaacactgtgactgtgcttgggcagacctgaaaccagcacagcactgggtctcacccaaggcccactgtaaccactaccaggctcctttctatgttaactcaaggccctagggctctacaatcagcaggtgggaaatccagccatgtttgtgacctcttcttcagggcagcaagttttccaggccctgtgcaggtccagagatgctatctgggaactaagaattagagtcaaataccttaaaaatctacctggtattctattgtactatggctaagctggttcttgaaccacaagacaaagtccttctcctcttctctccccttttcacaggcagaggagcctctcccagtggacaccaccaccaccagcccacagggatttctgccaggccactgctaatgttcacttaaagcccaagggctgctcagtcagcttgtggtaaatgctgccaggcctgggactcacccttcagggaagtgggctcccctctggcccagggcacgttcataaatgttatccaagaggctaggcctggacttagggaccccaagagcctgctttatgctgtaccccactgtggctaagctgatacctaaggtgtaagaaaagttccctttgcttttccctctgcttttctgaagcagtaggagtctttcatcacagccaccacagctgggaatgtgctgggtgtcacctgaagccagcatgtctcacaatctcactgaagtcccaccatgtactatctggttatcactgatggttactcagagcctattgaattatgccacaattgtgtccttcccttcaaatcagcagattactttctggcccagggtatgtctagcatgtcatccaacatccagggcctagaaatagggacctcacaactctgcctagtgccctatcctattttggctgagctggtatccaagatgcaaggcaaagtcctctttactctttgctctcctctcctcaagcactgcctggggctggggggattggagggggaagttgacacaagcactcccttagtttccccggttgatgtctccctaggtcacatgttgctctggtcccctggctctaggcccagcccagcactaggacatgcttaggaattttagtctttgtgcttttgactgcctttcaaatttacccaggatctcagagcgctttaccccatggtggcaaggcttgatgagaaactcaagttccaaccactgggatggggaattcccctctggctagggctggtccaaatgttcattctgtgggtgggtgatggctgagcccagcaagactttgctcaccactgtgacagggcagcactgagtccaatgccaagtcctccagtcgctgttgtttctctctcccaagtgcaaagattctctccttgcatacagccactgccagcgatatgggaggggtgacatccatgatacacgactgtctttcctagccttctcagtgcctcttttggtgatatgaagttaaaaccaagtaatgtgattgctaacctgatttttgaccttatgacattgctttttttgtgtgtgtagttagttgttagacttttatgttcctgtcaagtggacaatcagtggaggcttctggttggccatttttctctggggtgggacagagattttaccaaagactaattaatgcattttgaaaattggataaatatttcctcattcaatagtttcagaatttcattattaagacaaaactattgctacatgttttgaatgttttagaaattgctgattatgttattgattatatctaaaatctcaatatatctgcacatgaaaaaaagagaaataatgctacttttttatttacctaagacataatattttacatatttatgggatacttgtgagtatttgtcacatgtatagaatgagtaatgatcaagtcagtgtatttgaagcatccatcaccttgactatttatcatttgtatgggttggtaacatttcatgtcctcttttccacctactttgaattatacaatatatttttaccaactatagtcactttagaatgctacttattcttaattttgccactcctccttcaacaaagtatagaattatggtgacttttaaaacattacgttttgaaaagtatgcatattcatatacttgactacaaattataaaacctaattaaaattattttcttatacaatcaccaaatctatactgttctgtattgtattgttctacggtaagagagtttttgtgtttcagtcttgatactttgctcacgataatccaatgcaaatcagtacaacacaaactgactattcaaacatgtagtgttttgaaatcacagcccaagatatatgcttcttcctaaattttcacattaaaaacgtcaatgtaaggtgacatgtattggtagttagatcagaaaagaagtaaataattctgagttctattccttgaacttctaatgattttaatacaccatgtatatgtttagcaggtgcaaaaaaatgtatgagtaccacacaaatattacagtttaaaaaatagcctctaggctgggcacagtggcttatgcctgtaatcccagcactttgggaggctgaggtgggcagatcacgagctcaggagttcgagagcagcctgacaacacggcgaaaccccatctctactaaaaatacaaaagttagccgggtttggtggcatgtacctgtaatcccagctactcagggggctgaagcaggagaatcgcttgaacccaggaggtggaggttgcagtgagctgagatcgcaccactgcactctagcctgggtgacagaccgagactccatctcaaaaaaacaaaaaaatagcctctatattcattttgatcttatagtgagacatgggattattgataaatcaattttaataaatagtataaaatcctaaaacaactaaagtatctaaatgtaatttaacttttaattacagtattatgtgataagaatacgagtgtgaatatttcccatgcaatccattaaaatttaatattttattaaattaagaaacaccataaatagcttgatatcttaaaatattatattattaaattaaaatatatcatgaaagataatgtcacattcttcagtgaacaatcagaaatccttgtcttgaatgaattatcaactaaatatatttacttttattaaatacatgcataaatgttaatagaaaattaatctgtgttaaatgaatgtgtctttctgaagatttctgtacatcatattatatggctcagattaagacacacactttacaaaatctagcatttctgagtataaaatcttctgacaaaattttttttcttatgagcacctaccatgtgattttagagtaacatacatgcattaattttctctcaatgaactacatttagctatttattggctacttccaaatacacacaaataattatttgaataaagattatagctcaggaagctataaagttgttgcttttttttttttttttttttttttttgagagggagtcttactctgttgcccaggctggagtgtagtggggtgatctcagctcatgcaacctacacctcccgggttcaagcgattctctgccttggcctcctgagtagctgggattgcaggctcccgcccccacacccagctaattttttttgtattttttagtaaagacggggttttgccatcttggccaggctggtcttgaactcctgacctcgtcatccacccgcctcagcctcccaaagtactgggattacagacgtgagccaccgcgcccggccgttgctcattttttaggaacacatttctgtgattttcagtttattataccgttgtaggtaacctaaaaatagctgtgcattttcgatatattagatatttttatgttgttattgaaggaaaaaaacctagctttctacttgaaagagatgatacttgttcattaatatttatgtgttttaaaagtgagggagaatattttttcaaaaattaaatattgcctcttttggcatattggcacataagcaagccagcacttaataatacaaataatttctttaacatattttacttttcttgacttcatttcagttgaaattacattgcaatttctgcaattagtgatcttagctttactgttttccctgtcagttcaatgaagtagtgattggacaaaatgtggaggattgggctacaaaacatttaatctatgcataactgaaagcctaaaagatctctagcagatttcctgggttgttatcccataaggctcataatttctaaaatacaccaaagtttatgtttaggaatacacattttttacaaaataaatacactgatattctcttagtctttcatcaaagtactaaatgatctttgcctttctaacttccatgggccactggtccttggtgatggagccatgacctggagctaaaaaacaaaatgaacatatccagaaatataatgtcttggctgctgtaacttacaaggaaatgttcactgtatgaaaaacagcttcacagaaatactaagttgtcaatttatcagtcaaaattatgtgtaaccgccagtgtacgatcatatacaaatcctaatataaaattttaatttgcctttaaatagcttgaatttcattgacaaacatcctaccacaggcataactttcttgaagtttaaaatagcagcattaatgtattaattataatcttgcatttttagatgattgatagagttaaaaagagatattccaactcatttataatcttgcgaggctgaaatactaagtaaactattagttcaacttgtcactttaatataagtacactgttgaaattcctaaggatatagtctagctgcttggcaatggattgcagtgaaattcattgagagttcattgaacatggaaaggatgtaatttatttaaatccttcacttattaaatcaggatttgaatttttttaatattttatttttttccaactaatgaaatggacttgaaaagaattagcaaaatctttgtagagttgtgacaaagtaattctgatgactatgttgtctactaaagtttttactgataagcgctgaaggctgaattgagatgaatacattcactgttgtttagaggatttgtttttattttgatttgttttacagaaagatattcagttttaaataccttatagaatagtcttgcccatatctccctttccatataaataataagatcgtattcttgcatatttaatgagcatatagattaacaaaaagtttacaaaggaactcctgtgtttcttaataaataatcatataagtaacagaaggtaaaatttttccacagctttattaaattgattagtaagtacagacttttgaagcataaagttttaaatatgtaaaaatttagcttctgattttgtgtctttgtctctacctccctcatactttttgatttcatggggttttttgttgttgttctttgcatttaagttatgcatttgctctcagccgtgctttcatctattcttttgagatttcaaatattaaaaccttaagtgtgatctttgcaggtgtattgtcaagataaaattcatgaattctctctaagagaaatgtctttagacttagtaaagggttactactatagtgttttctgattgatgcaagtactgtggagcttaaaagtcaaaatggtagatatgaaaatgagttttttggggaatactttatttgcatcaaataatgtgtaagatatattggcacatctgtatgattatgtgtcctcagccctgtcatacccatcatttctttcactgaattacagaagggattcctaaggagaaaaccacataattcctaagtttgtaattggcaattataaggaaagacaagctttaaattaaatcttgataaaaactgatcatgctctttctaaaatgacaacatagactttttctctcctcctctgctctaataaatgaattaggcacaactgtagatttcaagacgttcatgatgttttagaagcttagggagatagaaagatcaattacacctggtacctgcccttagggagcttgtagtcaaattagtgcagataagaaacaaaggcatataattataaactcaggaaaaaactgattccagaatgaagataaagtctggaccacaggataccagaggaaggagagatctatttagacagaaggattacagtgcaggtggttcttaagcaggttgttgaaagatcaaatttagatatgtgggtcatcaggaaaaaaaggtgtttcagaaataagaacaggactattaaaggcactaacacaggaaatctctggtgtacactgatacaaatcaaatagttcagtttcatcgggttaatgtaggaaacagagttgttacaaggaaatttgaaatgtttgatttggatcttggatgccaggtcaaagagttcagttgacatttacaattttggggattgagagtcagaacaacactttcaggccaggcgtggtggctcacgcctgtaatcccagcactttcgaaggccaaggcgagtggatcatctgaggtcaggagatcgagaccagcctggccaacatggtgaaaccccgactctactagaaatacaaaaatcagccaggcatagtggtgtgtgcctgtaattccagctactggggggctgaggcaggaggatcgcttgaacctgggaggccgaggttgcagtgagccaagattgtgccactgcactccagcctgagcaacagagcgagactccattacaaaaaaaaaaaaaaaaaggaacaacactttcagaagtttattttggcagggattccagtaaaaaatctgtctctaatatgtttcactgtatttctaaccattgctactaaaaatacaccaacgatggtgtgctgcagccaacaagtacccgcttgtgagagccaattgtgcatctctttccaattctatctagtgatatcatgttgttagcttgaaacaggaaatagtgggagtatttatgccgcataaattggcaaatcctacaacagggtgtttttcacctcttttgagaattggtcattaaatttttgaccaatataccactggatggacacaacactctctatgttagtgtctactggtgatttttaagcatgtaggttttatttctcatcagacctttcaaattggtaatagactctctatgaaaaataggagtattatcactgtggctttaatataaaagggaaatgataatctaccaaacgcaaaattatagtttgatcctccaaggatttaaagaccttccaaaatataatctttggaaagtaccatctatttcttggagcaaattaactaaaaactaaaaacatgtgttgtttgttttacattgatattggcactgttgtaaattctttttgttttttgctccacatagtgtgtgttggctgatccaaaaataaaaaaagcaagacaggggtgccaaggaaaatagtactatttttttttttatctgagaagatcaaatgagcaacataaatgcctaaaaaattactagaaagacaatgcaaatactttattaaactgagtaaaatagcaccatatttatagatgatccacattatagtcaattttagcaaaacatatccttcattactattagaaatacaaaaacttttacaaaaatcttgactcaaggctcttctcaaatatagttgtctccaacatactttcccatgggattaagtggtgttacctttgtatttaaaacattgtataatctgtatagatttccctttgagctcacaaaattcaattaagaaaaaacattaacaaaggggaaaccaaatatccacctatgcatacacatgcttacatgaaaaaataaaatctaaaatacaaaaggggcaaagagcaatggtttattttctcttctttaggatatatcttgagaggagtaagatatttttgtaataataccgtacattttaatggtgtttaaacacacactatctcctttgcataatatattaatgtgaagtataaagatttagaaaatatacacaattgattatcgtattaatactgtatcatttatatttggcaataatttatatttcacatttctccatttatattatttgaaatgtaaatatttttgttccctgttttctatgggtgtaaccagtaaaaactagggttctactgcagtgattctttttatgccttgatagaccttgttttatagggaggaactgagtcaggagcagtgaaattgatagagcctccagctctttttgccaatcaaaacatttaagatgattctgttatttatgtactttagctttgagcctttgcttagctatatttaaactttaggatgtgatgctattgggctatttattgaaagctgacatatggcacagtgaaacctaaacagaaaatatttatggcttaaatttccaggttaggtatagaaaggtgaacagcattttctactttttgttgttgttgtttctaagaagtcagagtaaatagtttccccatcttctcatctttcagtcagaaatttgaaatccattgtggaaggaatacagaggcatatttttggaagtctaatttaggaacatgcacacaatgtattttccagcagtgagaaggttttagcaccccagaaaaaaagcaagccttatccagctcaatgaattgtcaaaatcaaagtagctatatgcacaggagccactttggattacccattccttttatggatgagctttaagtgcacaatggaaagctgcctgggagggaaaagaatatttgcattctgatgtctgggaggtaaaataatacttgctgatgacttttttcaggtcaggctaaagtaatgacatttgtatcagcattagaagtagaagtacttagtaatataccatgtttgtggatgccttaaaatgaaggaatttcatggtttagaagaaatgaccagtagtctaacttactgaggtttggagaagacatgatcttccaggaacacatcatttcaaaatacaaataattcttgattacctattgatataaagcttttcttttgaaaaaaaaaaaaccgactttctctctcttcctcaacatttatcttctcagtttggttatgttcaaagtgtcccttctctcaaatactcattatttaaaactttgagacgaaagaacttccattttgtaagatatggctcaaagtaaatgaaacaaaaaagcttttatttaaagaataagctatctagtttcaatgagtaaatgcaaggcacctaacattgataagccagataacgaattaccaaacaattcaaaacttagttatattaattactgaaaaagaatatacttcgttctttttacatagctacttatcaaaagaagctaaatgtggcaaaaagtctgaattttaataaatgatttagaggaaagtaacactctttggttgaaagtgctacgtgttaaatgtctattagaaaaataaattcattctgtggcataggtagctcatgatttctcatcaaatacagttgttgatgaaaagacttaaactccgtatttgaagagatttattctgagccaaatatgagtgaccatggcccgtgacacagccctcaggaggtcctgagaacatgtgccccaggtggatggggcacagcttcgttttatatattttaggaagacataagacatcaatcaaatacatttaagaaatacatttgtttggttcagaaaggtgggaaaactctaaatgaaggcttccaggctaatggtaaatttaaacattttctggttgacaattggttgagtttatctgaagacctgggatcaatagaaaggaaatgtttaggttaggataaaggattgtggagaccacgttttacagtgcagaggaagctctcagatagccaacttcagagagagcaggttgtaaaatgtttcttattggacctaaaaggttgcctatctcttagctgattatctcctggatctggaaaggaaggaaggaaagcaaaggggaaaggggattctctgtagaatgtggatttttcccacaagagacattgcaggataatttcaaggtatgcaaggaaatatattttggggtaaaacattttgtttttttctcttgttatgcttgttatgccagagtcagattggaaagtaagtcagtcatgatatacaaggttaaaggttaactaaaacccatctgataagaatttatggtttgtagggcatgactcccctgaccccttagaaggaaatttgggcaatataaaaaaaaatcacagcttagtcctcacagttttagaggatctcctgtggaacttaaggagagtcacatcctttcttgaaaaattaattggaattttaattttagtaagattgaatttagcctttgaaagattaaaattgtatttatggatagaaaaaaatagtatctgtagataaacaggtattttaattaaaaataaatattctgtaaatattttatactaaggtaattctcccttgtctagttagtatatttttatactttattattacaaaattaagtttttcttagcaccaatgattgtcagcgttgttttttgtttgtttgttttttcttgacatggagtctcgctttgctgtccagtctggagtgcagtggcacaatctctgctcactgcagcctctgcctctcagtgattctcctgcctcagcctcccgagtagctggggttacaggcacccaccacaatgctgggctaattttttgtatttttagcagagacggggtttcgccacgttgggcaggctggtctcgaactcctgacctcaggtgatctgcctgcctcgggctcccaaggtgctgggattacaggcatgagccaccaggcccagctgtcagtgtgttttaatttccaaatgtaacaaaatatttggcttaaaaatagaggtattattgacatatacataccaatattttggtgaccctgaaacccacattgattcattttctgctttcggttagcggtacaagcttgtattacatgaaaataaaattacctttacttcttagaaaagctggcattcatacttcaagaaaaatattttcagaagataagttaggtattgatgtaaattgaaggttttttgttgtatttcatatcatcttattggtatgaatataaaggatagtagaatgattttccatcatgaaattcataatttactggaagcatgttttgatgctgtccatttatttagtattcactaaagattgcagtatatgtacagtacactttttaagagtatggattctggagctagaccgtctgggttcaaagtcttacactttgacactctctaactgtgtgaccttggacaagttaactaatcattctgtgcctgtttctgtatcttctaaaatggagacattcatcatgagcttttcatataagatagttaacctaagtaccagcaaagtaggttgtaaactctttaagtgtaacatatactttgtggcatacacacctttatattccgagtacctaggatagtttctagcagacagagttaacgaataatacatatttttaataaaactaaatgttccaatgcatgttgaaaattgattataattcccttgcaagttttggttctgattgcactggaaccccatgtagctccaagttggacaaagtcagctggtttacatctcaatgtaataaatatttgttgaaagaactgtatggcatgatgccccctttgtgtctactcacattgacttcaataaatgatattctctttcttgatacaaaaatctacaaaagtttattcatataaatttctatactatgaaaattagcattccacaaattctataaaccaaatcatgagttacaggattgatagattgagggatagagggatagatgaacaagtgcatcaaatgaaatatagttcgaaagcactattacccattcaattccaagcactaaaccattaagaaacttcttgcggttctcttcctttccttagtcggcatatgataaatctttttgtcctaatgtctctttcatgtttaatttcccagtgttggtttacaagtgttactctttctcttcactattggaaattggatgattcaatttatttttaaacttttaatgttaaaaggcattggcacttcaaaagagaaaatgtatctcctaggtttgtgatatgagcagtgatatagcaatgatttcaaatacagcatgctttaaattccaagctggtggaaatgtacctgtatattaattaggtgtttactatttatggccagaaacaaaatatcatgaattgttgagatacatgtacatggagagattatattcttatttctacagtactagtaacaatatagtgaaaaatatacaaaactacattcctttatctttgtacatgggaagatttgagagtgcatagagtttcatcactaagattgtatgatattagtctcaatatatcttcaaagaatcaaatgggtgtgaagtatattaaaatttggtaaagtgttagtgagagcctgggtaaataactctaggcattcaggttaataataaaaagaaaatttttgatagttttaatggttgtacaactgtctgaatatactgcaaactaatgaatttcatgttttaaaaggtggacagtatgacacttaaattatatttcaataaagctggtaaaatgctcatacaaatagtttttgaaatgtaaataccattgtgaacactttcaactcagttatcatacagtatattttctttagtctccatccagttccagcaaatgctactacatgcacactgagaagtaacaaaaaggtaaaactctgttttcattattctccctaatttgctcctcaaatcattcttatccccatagcaactcagaggagttggaatgaatgtcccatccccatttcttctgctttagtaaacttgaatatttaactagtatgatctgacccttggtttgaaatttagatgccttatgactacagaaactataataggcacaatatttgtcaaaaatgttgaatactgcaggaaaaacaaatgcaatcccaataaagtccagttttaaaattagctttacatgtaagtgagttttgtgggaatgggatcagaatgggtgatactaagtcattaaagtgctttgttttacaaagaatggataaagttgtgctgattttcaagtctgcattgattgacttgctcttttaatgcattataaatcacagagaaataaaaatcatggtgaagaaaattatttaaaaataccataataataagtattgtccagttataattatctaattcattttctctctctttctctgtctctcaacttacttctgcatttatactaagagaagatacacagaatagacactaaccttgcagacacaaacattctataacatcctaattaatctggtaggtgggattaatttttttctttccaaaccacaagaagcattatatgttaacatcatcaattttcagatatattctatatacttgtaatatagttgaacttcatcatatgcataatttttattctctgaaaatatagcactttccctagaattcttagcattttcctctctaataaggtttcttgaagtagacactatcaaaactttatgaagtaagaaaattgtattatttactattgacttcttgtttgaattaaagtcaaaaaataaatttcaaaataaagtcattacatttttgttgctggaaattagaagcagaaatatttcctcagtacgaaaaaagatctctgcatatttagttatttaataaatgttcattgaatgtaaaacacatcttttattcacagttcttatttcatgtattctaatgttaattattagtactattcatgtatttacatatttaagttatcatataaatttagaaacttattagaaacaattttattacatttcaggtgtttctccaattgcctgtgtgctttattgcactagcagaagacaatttttattttactggcatacgaatacaggctttacgtgtatcctgaggcacagggtcccaaactgcattagttcaacagacagcagcatgataataaaccccagggtgtcaacctattagttttaaaaatagctataaaattgactttaaatctgatttgtaatattttgcagtcttcatagtagtaattcataactacctatctatactttctttaattatttaaaaattcataatactatcatcaagaatgttctgaaaattgtcaaacccaagaggtcaaaactatcattttttgggttactatgtttcaaataaggaaaataaggagcagcggaagaactgacattgaactgagtctttttttttttttttttttaagacagtcttgctctgtcacccaggctggagtacagtggcacaatctcggctcactgcagcctctgccgcccaggttcaagcgattctcctgcctcagcctcctgagtagctgggattacaggcacccaccaccacacccggctaatttttgtatttttagtagagacggcgtttcaccatcttggccaggctggtcttgaactcctgacctcgtgatccacttgccttggcctcccaaagtgctgggattgtaggcgtgagccactgcatctgtccaagtctggtattttttaaatgtcaggctgagtgttgtcatctgctcttgacatgtcatttaattttcaacatggttgttctcagaactgttatccccatttttcaaatgaggaaatgaaggctaagaaataataataaacgtggccaagatcacagaactcatgcttagtagaacctcagcccatgctcatgtattcctgattccatttcacaatcatttaactgaagatactaacatttcaacacccaacattgccatggggataatctgaagtgtgccaagagcttatataaatgcctcattaattgctaaatcacttacaaattgtaaatttggcttaagtttatctctttatgtctacttgggacctagaagcaaagcagggtaaatttagcaaggaatggacaagatcaatgttcttgtcatttcccaattgtgtaacctttttaaaatcactttacttatttaagttgaccatggaaatgatatatttccaactcacagttttgtcagaatccaacaagatattttatgtgaaaatttttacttcattggtcaaaacctgataaataagaaatttttacaggattccatgtttaatagagtcattgcttcttcaccagaagttcaaggaagaacttcttggaattaaaaagtaaccacagtgtgtgcctggcacggtggctcacgcctgtaatctcagcactttgggaggcccaggcaggcagatcacctgaggtcgggagttcgaggccagcctgaccaacatggagaaaccctgtctctactaaaaatacaaaattagctgggcatggtggcacatgcctgtaatccaagctactcgggaggctgaggcaggagaatcacttgaacccgggaggcggaggttgcggtgagctgagatcgtgccattgcactccagcctgggcaacaagagtgaaattctgtctcaaaaaaaaaaaaaaaaaaaaaaaaaaaaaagaaaagaaaaagtaaccacagtgtaatgtttaatttagcctttgaaactgaaaacacatgtgacaatcgttgaaggaaaccagttgctcaaaagaagttataaaactataaatatatactttagagaaaaggagtttgctgttcaatgaatatggaatacccattatgtggatatctagagtacctggtaccctaatgcctgaacttcctattccaggaaaggcagagtggaattcttaaaatactcttcactttaacttctcctaaaggaaagtagacatgaagagcaagtaggcatactgggatatgtggccatgagatgtcctggataatgtgcctgaataaaatttgaactgagttcctttattttactttcctttatactgctacttgatacatagtagtttacaggttgcaggattatttcattactatgtttctcttagaaaaagagcaatttaagaaccatccaatggcattcgatttataattgtattaataaacagaaagtcactattgaaacaaaccagacactgggcaaagttgcctgtaggagaaacctggaatgaaagagagactatgaatcttcttttaaagctcatatatgctacttgaaatactagcaaatatcatatttcgttgctatatatattcatatgacatgtgtttggggctttacataagagccatattagatttatttacttattttttttaacttttaaattcagggtacatgtgcaggtttgtaacataggtaaacttatgtcataggggtttgttgtacagattatttcatcacccagatagtaagcctagtagccatttctctggatcctttccctcctcccacccttcaccgtctgataggccccagtgtgtgttgtccccgctatgtgtcagtgtgttctcatcatttagctcccaattataagccagaccatgcagtatttggttttctgttcgtttgttagtttgctaaggataatgacttccagttccctccatgtccctgcaaaggacatgaccttttttatgactgcatagtattccatggtatatatgtaccacattttctttacccagtttatcattgatgggcatttaggttgatttcatgtctttgctattgtagtgaacatatgtgtacacatgtctttataatagaatgatttatattccttttggtatatacttagtaatgggatttctgtgtcgaatggtatttctgtctttaggtctttgaggaatcaccacactgtctgctgcaatggttgaattaatttactctcccaccaacagtatataagaattcctttttctccacaacctcatcagcatttgttattttttgactttttaaaaataggcactctggtgtgagatggtatttcactgtggtttggattggcatttctctaatgatcagtgattttgatcatttttttcatgatggttggctgcatgtatgtcttcttttgaaaagtatctgttcatgtcctttgctcactttttaataaaattgtttgtgtggtttttttttgtaaatttaagttccttatacatgctgtatattacacctttgttggatacatagttggcaagaattttctcccattctgtaggttgtctgttaactctttgattgtttcttttgctgtgtaagagctctttcatttccttagatcccagttgtcaatttttgcttttgttgcaattacttttgacatctttgtcatgcaatctttgcccatgtctatgtcctgaatggtattgcctaggttgtcttccgagattcttatagttttggactttacatttaagtcttttacccaactagagttaattttttacacttatttaaaattatatttatgtatttagacttaacttttaaaatttatatcttattctaaattttaatcaacttaaaatctgttttttacttaaaaagaaatagcacatacacacacatgcaggaatttaatattcttcacttatatgtaaaaaacattatttgatgttttccgtttcaagatataacaatttattttcacttttatgtgcatttatattattatataggtttttaatttgtgacctaactcttcattctggacaaagataactagttgcatctttagatgtaaagttacactcaagtgcaataaagtgagtcctcaaaatgacaaaacaaacaaacaaaaaacaacaaagcagacactgaagtgaggagaagggaaacgtaatagcctattatgcaaaaataacttcatttaagaaatcaaccaagattagagaaaaatatgagtatccacatggggattatatgggtatattggcatctataattttaaagatggtttatgaatcattgttttgaatcagattggaggaccaatctctactctttataatgaggcttctttctgtcctagctaagtgggagctataattgatagtgtatatggccacgaagtggaacagaatgctgtcataggagttttctacgtaatgtgattaaagctaacatgcagtacatcaaaaacactgtagtccgtctgacagtctttagcagtgggcatctaatattgaagtttgatttacttcaacatttgaaaactctgttaccttaatatctttcaaggacttcaaatactttttgatttattccaagctttcattttattattgaactggaactaaaacttccaaaatgcaaatgaaataaatgaaataaagatcattaatggtgcttaattcagttatcagaatatcagcatagtgtgagttttgcaaattggtttctcaattctgaatttacattctgtttgccatgtgttcaacttgaacttacacaggatgactcatttttataaacttataccattcatataacttgaggaaaagatttattgcttatctttatagacaagtaacttgagtatacagtcactctttagataatagacattttactcattatgttgtggattcaattctgaagccagttattttgctattagaattgaaattattcattttaatcacgatgataatagattcacagccacgtataataaaattgcaaagtctacttgatttgcctttaatttcttccctttctatgttgctcttctcactttattgtccatcttggttactcaagtcttgggacaaaacctcccagtgatctctcctcacttctctcaggcctattttaactcagtcctctagagcctcatggttgatggagacagtcacatggctggatatattaaaattatctaagatatctacctttctgtttttattagtgcaactaatacctaaaagaggaaggactggtggtgcaagatgacatagtttctggaaactatttctgtgcagactccaaaaaggggaaggatggaaggggattgaggagtgagaaattacctgttggatacaatgttcactatttaggttgtgggctcactaaaagccaaaacctcaccataattttcagcatatccatgtaacaaacctgcacatgtaccttctgaatctaaaataaaatcgaataacaaaaaaccgatttttggactatatttcataaacctaccaatatggtccataagaagttgcaaatgctatgaataaaataaattatataaatgtaaaatcgtatctgcttgtatgtatttgtttaatcctcatagtatgtgtaattcatttctatatacaagtacatgccatggtatttacacaatacatatggtcaaatagttatgtgctcataaaatattaaaaattttggatgaagaaagagatattgtacttagtcattgatattgacattgtatttcataattccagtgcagtaatgcatgtgtgtttatgttgataaatgctgatcagaattcagatttacagtaaaaaaacagaaccgaataaatattcagattcaaaatattgatattatttcaatgctgtatttttctgtgatttatattctcagaaattgtggtgggaaattgaatttgatattgtggttcaaggtgcatagattcctctcttgtcaatggtttacattggtcattaacagtggcaggttgttgcagaggtgaggaaattacatgttcccaagtgtttctaaaatataaaaacccaaagagttgaattaggttttgcatctaagttaaactgaagcttgtgatatgatgcttccacagagctattaaaagttattaaaatcctgattctgtgtgtctaataaattttggctgtatgatatgaatgcattaattttgtgcttaaaagcaaaagggctgataaaaagttccagttaatatataaacatagtagaaatttgatacatacttcttgatgatacatattgtgtgacagaaaacctaactataataatgataccaactcatattgtacaggactctttcatatattacattatttgatcctcacaatcccatcagctaggaaaggcagactttatgaatttctatttaaagatgagaaaatggaaattcaaggaggtatttgagttttctaggattcagacataggtctagtaatatttttcagtataccatattgcttctgagtactcagaatctcattttcaattgtaacagttgtaaaaggcctgtatatgcttacaatatgtgtgcagagtgtagatatgaagcctcaatggtgagaacaaccttacatatatcaaatggattctaaaccaaagaaattccagcaactaaatatcctaccttggttccttatatttttaacgtgtaaaaattcacataaatatcacatttggaaaataatgcagatttatatcatacctgcatagaagaaaatatggcacactgatttttatgacggggaacaaagccgggcttttgatcctagaattacagtcctgtaatttagacctccttaatgtaatagttttatgataactctgcaagcctaggcatcactgctacttaatctttctgcttacctatttcacaggtatttaatgcccatttagtcatcatttgaaaaacttatatatatattaaccaaagctaaatttatctactctgcttatatatgcagcttgacacacacaactaatttaatatgtaggtgctttccttgatccaattaggttcttctgttttattcataggtatagattgttgcaagcactaaaattatacccataaaaaaaagtttgcatctaaaaacaggattagctaattgcttggcactttgagaaaattccatccacaatctgatgaactcccaatttaaaaatacaggaaaatgatttaaaataaacatttctgcttttattctgttctgtgtgtcataaatgtaacataaaataattccataggaaacgggatggtttctctaagtttcagatgactttataagtaattttgttttattttgtttctttctttgattcctggggaattaatttttttgcaaacttttattttaggttcatgggtacaggtgcaggtttgttataaaggcaaattgcatgttacaggagtttgctatatgaattgttttgtcactcaggtaataagcatagtacctgacagacagattttcaatcctcagcctctgcacaccctccaccctgaagtagatcctggggtgtctgttcttctcttctttgtgtccatgtgtactcaatgtttagcttctacttataacatgcagtatttggttttctgttcctgcataagttcacttaggataatgacctccagctccatttatgttgcttcaaaggacatgatctcattctctcttatggctacatagtattccatggtgaatgtgtacaacattttctttacctagtttaacattgatgggcgtttaggttggttccatgcctttgctactgtgaatggtgctatgatgaacatacatgtgcatgagtccttatggtagaacaatttctattcctttgcgtatatacccaatcatgagattgctgggttaaatggtaattttgtattaagttctttgagaaatcgccaaaccactttccaaaattgttgaattaatttgcattcccatcagcagtgtaaaagtattgccttttctccacaaccttgccggcatttattattttttgacttattaataatagccattcttactggcatgcaatagtatctcattgtagttttcatttgcatttctctaataattagtgatactgaacattttttcatatgcctgttggccacatgtatgtacacttttggaaagtatatgttcatgtcctttgcctactttttaatgggattgtttgatttttgctcattaatttgtttaagtactttgtagattctggatataagacctttgtcagatgcatactttgaaaatattttctcccatactgtaggttgtctgtttattctgttgatagtttctttttgctgtgtagaagctcttgagtttaattagctctcatgtgtcaacttttgatttatttcatttcctgttggcgaattgtaataaaatctttgccagagcctatgtgcagaattgtattgcctcaattgtcttccagagttttcatatgttaggtgttacatttaagtctttaattcatcttaagtagatttttatatatggtgagaggaatgggtccagttccggcaccatttattgaatagggagtcctttctccattgcttgtttttgtcaatttctggaagatcaagttattgtaggtgtgttgcgttatctgggggctctgtcttctgttccattggtcagtgagtcttttttgatgccagtaccatgatgttttagttactgtagccatatagtatagtttgaggttgagtaatgtgatgcctccaactttgttttttttacttaggattgccttggctatttgggttgatttttttgtttgtttgtttgttttttggtttcatataaatttaaagatagcatcttctaatttgctgaagaatgtcattggtagtttgataggaatagcactgaatctgtaaattgctttgggcagtatggccatttaacaatattcatccttcttatccatgagcatggaatgtttttgcatttgtttgtgtcatctctgatttctttgagcagtgttttgtaattctcatagtagagatatttcatttctctggttagttctattcctaggtatttcattctttttatgcctattataaataggattgtgttcttgatatggctcttggtttggatgttgttggtgtatagaaatactactgacttttggacatgatttttgtattatgaaattttgctgaagttgtttatcagatctaggagctttggggcaaagactatggggcttcctaggtatagaatgatatcacctacaaacagagatagtttgacttcctctctttttattaagatgccttttatcttttatttatttctattgtctgatttttcttcctaggacttccagtactatgttcattaggagtattagagtggtcatctttgtcttgtttctgttctgaagaggaatgcttctagcttttgctcattcaatatgatgttggctgtgggaatgtcatagatagctcttactattttgaggtatgctccttcagagcctagtttgttcaggatttttaacgtgaaaggatatgaacagacacttctcaaaagaagacatttatgcagccaacaagcatatgaagaagagctcatcatcactggtcattagagaaatgcaaatcaaaaccacaatgagataccatctcatgccagttagaatggcgatccttacaaagtcagaaaacaacagatgctggagaggatgcagagaaataggaacgcttttacactattggtgggagtgtaaattagttcaaccattgtggaagacagtgtggcaattcctcaaggatctagagccagaaataacatttaactcagcaatcccattattgagtatataaccaaaggattataaatcattctactaaaaagacacatgcacaagtatgtgtgttgcagcactgttcacaatagcaaacccttggaaccaacccaaatgcccatcaatgatacactgaataaaatgtggcacatatatgccatggaatactatgcagccataagaaaggatgagttcatgtcctttgcagggacatggatgaagctggaaaccgtcattctcagcaaactaacacaagaacagaaaaccaaacaccgcatgttctcactcataagtgggagttgaacaatgagaacacatggacacagggaggggaacatcacacaccaggcctgtcggtgggtagggggctaggggagggatagcattaggagaaatacctaatgtagatgatgggttgattggtgcagcaaactaccatggcacgtttatacctatgtaacaaagctgcacattctgcatatgtatcccagaacttaaagtgttaaaaaaaaaaaaagctatgcattcaaaatttttaaaaaaataaaaattaaaaaaattcttaaagtgagtttttagctctatctgatcagcttggttctttcttaaaacagacatttcatgtatctcctgggttattttattgtattccttagatttcttggattgcatttcaagtttctcctgaatcttgatggtcttcatttatatccacactctgaattctatttctgtcgttttagccatatcagcctggttaagaaccatttctggggaactagagcagttatttggaggtgagaaaacactctggtttttgagttgccatagttctcacactagttctttctcatctgtgttggctgtttcttctatctttggaattgctatcctttggatgagaatttacttgtttcttctttgatgcctttgggggtttgattgtgatataaggttgattcagttgactggctttgtttctggacgattttggggcaccaaggctcagctcagcactcttgggctgtgtgctctaattctgggaggcaggtattgggcccccagctttgttttctggcctctgcaaattaggaatctgctgtgctggagggactgaaacattccctgtctgcagccacaacactctgatgggttgtactggctaaaacactttcttggggtggtgacagcagaattcatgcttgctcatgtgtaccagtagccatggcagcacagcatgtgtatttgtatttgtgcatgtgtatttgctggggttgggtactggtaggagtgggacattggtgttcttgggtgaacttgtgtaggtggtgtggtgggggtgggggactggcaggggtagggttgcctgtgtccatgcttgcacttgtaccagcagtgatggcagcatgggtgggtcactggtggtttcaaggatgctgccctccatgcacacatttgcattggcagcagtgatggcctcattttagttataaacttttttaaggacatattaacatacattttattttttgttcttctaaaaatctaactttatagtttacatacaatacaatgcaccaattttgattgtacagttcaacatgttcagaaaaatgtatacacccatgtaactaccaccacaatcaaggtatggaacatttctatcaaatccacacaaatgaaaaataaataaataataaataaataaataaataaatagttttgtcatgttactatgtggtcagtctttcctcttccctgttccaggcaactactactttgttttctgccatgacatgataggtaagtttgcttattccagaatttcatttaaatgaaatcacaaggtaattatagatttatgattttattataattgagaaacttattagttctaaattggacagtgcaataaattttttgttgttttttgtttttctccccgggagaggcagtttaatgagctcggggccaatacaaaagatcaaatttctctccatggggaaatgcaggaacccacagaacactacgcttgctgggaaagcgggtagcttctcatttagttgcaggaggaggagatagctcccagggctttcagaggaaagcatggccttcagcatcagggacattgggggtgcactccaggatctgaggggtaaacttcaggaggctgagggtggacccaaggagctgcaggatggattccagaagcttacaggtggtctctgggaggctgggcattgaaccccattgcctgagggtggatccctggggctcgtgggtatgctcctggggcctgggggtaaactacaggggctgatggatgcacaccatccatgttgttgcaaatgactggatgatctcattctttttttatggctgaatagtaccccattgtggataagtgtcacattttccttattcattcatcccttgatggatacttaggttgcttctaaatcttggctattgtgaatagtgttgcaacaaacatgggagtgcggatatcactttgttatactgcggatatcactttgatacacttatatatcccttttggatatatacccaatagtgagattgctggattttatggtaactttatttttagtttttttgatgaacctccaaacttttcttcatagtagttgtactaatttacattcccaccaacaatgtacaaaggttttcttttctccacatccttaccagcatttgttattgcctgacttttggataaaacccacttaaattgggtgatgtctcattgtagttttgatttaaatttctctgaggatcaatgatgttgagcactttttatatgcctgtttgccatttctattcagaaatgtctattcaaatcttttgcccatttttaattggattgttagattttttttcctctagagttgtttgagctccttatatattctgattatgaatctcttgtcagatggatagtttccaaatagtttctccctttctctgggctgtctcctcacttagttgataatatattttgctgtgcagaagctttttaacttgatgtgattccatttgtccattttgctttggttgcctgtgcttctgggatatgactgaagaagtttttgcccagaacaatgtcttagagagtttctccaaagttttcttgtagtactttcatagtcttagatttaagtcttttcattgattttgatttgatatttttgtaaggtgagagacagagatcaagtttcattcttctgactacgaatatccagtttttccagcatcatccattgaagaaactgacttttctctagtgtatgttcttggtacctttgtcaaaaatgaattcactgcaggtgtatggatttgtttctgagttgtctgtgctgttccattgatctgtgtgtctttttatgctggtaccatgctgttttggttattatagcttcatagtataatttgaagtcaagtaatatgattcctgtagtgttgttccttgtgatcaggatgggtttggctattatgagtcacttgtgattccatataccttttagaattatttttttttccatttgtgtgaaaaatgtcattggtattttgcattgaatctgtaaattcctttgggtagcatggacattttaacaatattggctcttgtgattgatgagcatggaatatcttgaatttttgtgtcctctttgtttcatctgtgcttcatggtattaattataaagatccttcacttctttggataagttaattcctaggtatttcattttatttgtagcccttgtaaatgggattacttttttatttctttttcaagttgttcactgttcgcatatagaaatacttctgatttttttggcttaattttgtatcctgcaactatactgaatttatttatcagttctaattgttattcggtggcgtcttttggtttttccaacagtaagatcgttatcaactgcaaagataaataatttcacttcttcctttaaatttggatgccttgctgtgagcagtggctcaggcctgtaatcccagcattttgagaggccaaggtgagcagataacttgaggtcaagggttcaagaccagcctgaccaacagggtgaaaccccttctctactaaaaacacaaaaattagctgggtgtggtggtgcatgcctgtaattccagctacttgggaggctgaggcacaagaatctctcgaacctgggagatggaggttgcagtgagccaggctcttgccactgcactctagcctgggtgacagagtgagctctgtctaaataaataaacagacaattaaaagtaaaaataaatttggatgtcctttatttccttctcttttctgattgctctagctagcacttctcatgctatgttgaataatagtggtgaaagtgggtatccttgtcatgttccaaatataagaagtaaggctttcagtttttccccattaactataatattagacttaggtctgtcatttattgctattattatgttgagatacgttccttctatacctagtttttgagggtttttatcaggaagaggtgtttaattttatcaaatgctttttagcatcaattgagataaccatatggtttttgtccttcattctgtcgatatgacatatcacattgatttgtgtatgtggagtcatctttgcatccttgtgataaatcccacttggttatgatgaatgctctatttaatatattgtctaattcagtttgtagtattttatttaagatttttgcatcaatattcaggagagatattggcctgtagtttcctttttttgatacgtttgtctggcatcttcttttggtatcagggtaatactggccacgttgaatgagtttggcaacagtccctcttcctctattttttgaaaagtttgagtagaattggtactagctcttctttaaatgtctggtagaattcagcagtgaagccagcaggtttcaggcttttctttcctgggagactttttctttagagcttcgatcttgttacttgttattggtctgttcaggtttgggatttcttcatgattccatgttggtaggttgtatgtgtctaggaatttatctatttcttctaggttttccaatttaaaggcatgtagttgctcacagtaaccactgatgattctttgaatttgtggtatccattgtaatgtctcctttttcatctctgattttatttatttttgtctttccttttcttagtcgggctacagattagtaaattttgattatattttcaaagaaaccaacttttcgtttcattgatcttctatgttgttttcctcatttcaagttcatttaattgttctgatctttattaatttcttttcttctataataagtttgtattgagtttgttcttgcttttctagttctctaagatgcatcactgagttatttatttgaagggtttttgtttgtttgtttttatgtaggcatttacagttatcagtctcccccttagtactgcttttgctgtattccaaagattttggtatattgtgtttccattttcagttgttttgagaaatttttaaattttcttcttaatttctttattgacccactgactcactgatcatttaggaacatattgtttagtttccatgtgtttttatagcttccacaattcctctggttattgatttgtagttttatttcattatggtcagagaagattcttgatagtactattattattattaagatggagtctcactctgtcacccaggctggagtgcagttgcatgatcttggcttactgcaacctctgctttccaggttcaagtgattttccagcctccgtctcccaagtagctgggattacatatgtgcaccaccacgcctggctgatttttgtatttttagtagagacggggttttaccatgttggccaggctggtcttgaactcctgacctcaagtgatctgcctgcctcggcctcccaaagtgctgtgattacaggtgtgagccaccatgcccagctagattcttgatattgtttcaattttttgaatgttttaagactagttttgtgacttattatatggtctgtcattgagaatgatccatgtgcaggggagaaaaaaatgtgcattctgtagctgtttgatgaaatgttctgtaaatattagttccatttgttctactatgcagattaaatctgaagtttctttgttgattttctgtgtggaatatctgtccaatcctgaaagcggggtgaagtctctaactattattgtattagggtatatcactctcttcagctctagtaatacttgttttacatgtcttggtgtgccagtgttgggtgcatatatgtttacaaatgttaaatcttcttgtggaattgacccctttatcattgtataatgaccattattgtgttttatacttttcgtctttaaatctgttttgtctaatgtcactatacatactcctgctcttttttggtttatattggcatggaatatctttttccatctttttttttagtgtgtgtttatctttataggtgaaatgtgtttcttgtaggcaacaggtcattgggtcttcttttgtttaatcagttcagccactctgtcttttgattggagagtttattttatttacattcaatattattattgataagtaggtacctactcctgccattttgttatttattttcaattattttgcggtctttttttctgccttactgtcttccttttctctggtggtattctttaacttcttgctttttagtttttgtgtatccattgtatgatttttgctttgagattaccatgaggcttgcaactattatcttaaaactgatattatttttttgagacaaagtctcgctctgtcacccaggctggagtgcagtggcacgattttgactcattacaacctccacctcctgggttcaagtgattattttgcctcagccccgcaagtagctgggattacagacatgcactaccatgcccatccaatttttgtatttttagtagagacagggttttgtcacgttggccaggctgatctcaaactcctgacctcaggtgatctgcctgcctcggcctcccaaagcactagccaggattacagtcttgagccacagcaaccaacctgattttttaaatggataacaataacactgattgcataaacaaacatgcaaaaaaaaaaactaataaaaactctacactttaacttcatccccccattattttaactttttattgtttttctttatgtcttattttgctgtgtcttgcaaaaatgttggagttattatttttgattggttcataatttattctttctatttagagtaagagtagttcacacaccaccattacagtgttatactcgtctgtgtttttctctgtacttactattaatattccccatgagttttgtatcttcaagtgatttctccttgctcattatcatccttttcttttagattggagatttccctttagtatttcttataggacatgaaatccctcaggttttggttgtgtgggaagggctttatttctccttcatgcttacagaatattttcacaagatatactattctagaataaaaattttatttccttcaacagtgtaaatatgtcattccactctctcttgtcctgtaaggtttctactgaaaagtttgatgcaagatgtattggagcttcaatgtatgttatttgtttcttttctcttgctgcttttaggatcctttctttatccttaaccttttggagtttgattattaaatgccttgaggtgatctccttcaggttaaatctgcttggtattctgtaactttcttgtacttgagtgttaatatctttctctaggtttggaaagttttctaatattatccatttgaatatactttctacccctgtttctttttctacctcctctttaaggccagtaactcttttttgttgttgtttttgagatggagtcttgctctgttgcccaggctggagtgcagtgacgtgatgtcagctcactgcaacctctgcctcctgggttcaagtaattttcctgcctcagcctcctgagtagctgggactagaggcatgcaccaccacacgcagctaattttttttttgtatttttagtaaagatggggtttcaccatgttggctagagtggtctcaaactcctgacctcgtgatctgccaaccttggcctcccaaagtgctgggattacaggcgtgagccactgcacccggcaaggccagtaactcttatatgtgccctttttaggctatttcctagatcttgtaggcatgcttcatagttttttattcttttttcttttgtctcctctgactgtgtatttttaaataacctgtcttcaagctcactaattctttgtctgcttgatcacgtgtgctattaagagaatctgatgcattattcagcatgtcagttgcatctttccactctagaattgttggatttatctgataaaattctgaattccttctctgtgttatcttgaatttctttgattttcctcaaaacagcttttttgaattatctctctgaaacatcatatatctctctttctccaggattggtccctggtgcctcatttagttcatatgatgatgtcacattttcctggatggtattgatatttgtaagtgttcatcggtgtctgggcattaaagagagttagatatttattgtagttttcagtgtctgggcttgtttttccctatccttatagggaagactttctaggaatttgaagggacctgggctccaagtctaataatgctgtggttcttgcagactcatagaggtacctctttggtagtcttggataatatctggaagaattcttggaatcaccaggcagagagtatgctcttttctcttgctttctctcaaacaaatgaagtctcttttcctgtgctgagctgtctgcaactgggggtgtggtgatgcaagcacctctgtggccactaccactgggactttgctaggtcattcctgaagccagcacagttctggcccttgcccatggccttctcttcagggtggcaagttcctataagcccagtgatgctttcttagagccagggattattctattctactgcggctaagcttgccctcaaaccacaatacaaagtccttcccactgttctcttccctttccacaggcagaggagcctctccctgtggccagcagtacaccagtccatgggggatttcttccaggccaccgcttatgttcccttaaagcccaagacctcttgcatcagcctgtggtgaatgcagccaggcttgaactcaccctttatggcaatggactccctctggccaagggcatgtctagaaatgctgtccaagagcctaggcgtgaactcaggaaccccaaaagactgcttgttgctctaccccactgtggccaagctggtatctagggtgcaaaacaaagtcccttttgcagttcccactgcttttctcaagcagaaggagttttgccctataaccaccactgctgatagtgcgctgagtttccctgaagccatcacatctcagaggctcactaagaccttcgtgtagtacctgggtatcactgctgattattcagagcccaagggctcttcagttaacaggtgataaatgctgacaggactgcatcctttccttcaaggcagaaggttcccttttgacccaggatgtgtctagaaataccatgtcggagctaaggcttggaatgagaccttcttgaatgtgcccagtgccctgtcctactgtggctgagctggtatctatgatgcaatacaaagtcttctttattcttcattctcctcttgttaaacagaaagtaggagtccctttcattgttatgagccacactgcctggggtagggggtggcatggtgcaagcactcccatagcctcaccagctagtgtctccttaggacacatgccactctgttcactggctctaggtcgagcctagcacaaggagttccctaggaattgcagaccttgtttcctagactgcttttcaagtatatcaaagatcctagagtacattagcttgtggtggcaaggcttgatgggaaacccaagttccaacaactgggatggcagattcccctctgactagggctggtccaaatgctccttctgtgcatgagtgctggctgagttcggcatttatttatttactgtgacagggtagcactgagttcaatgtaaagtctcccagtcactgctctctgtcttcccaaaatgcacatattctttctccatacctcgtggccacaaccaggggctgggggaagggtggcatcagtgattcaagactgtctcttctgccctcctcaatgcttctttccaggttatgaagttaaagccgtgtactatgattgcttacctgatttttagttcttgtgatggtgcttttctgtgtgtagataaaatttggtgttgcagcgggggaaatggtaagtataggcttctattccatcatcttgctctgccttctctttacaactgtggcaatattcgttgcagaagagtgtgtattgtccttttactttaagcctacgctgaaaatgagagagacaattctcattccatatctaatacaatgagtggaaactggaaagctaactggtaaaaggagtgagaataagataagatatcttaccatgtttcatccaccttacctaatttatagtctctaaatatctgcagagcatttatacaggaacctggaggcaatggaagagcaatatacttgtatgtatgaatatatgcaggatagattttcagatgaataggtaactgatggtcattgttgaatgggtcagttctttaggggtagtaggagtctaaatgaggcaagtagcacctttaatgatgagacagttaatccggatatttcaacaaggatgggggtggtttgttttgtacagaaaaatagttaaatgactagaatactgggaggccgtacccattttggaattgtaacaggagaatctgatttagactcatccaggtaggataaaagctggctataaacatgtgtaggacaatgtcaaggtgctgtttgcaagtgtttcatgtgtgcatgatagaatacaatttgatgctcaccaagttcatttattttcttttcttatgatgcatcatttacacgtggtcattcaaagatgctttgtttccattagatatgtttataaaagcatgattttataataatctgaattagaatgacctggggagcatgttaaaagtaaaatgttcctttaggtggctcttggatccacaataagaaatatctatctctttaattcctttttgccaatatgctactttgtacataatacttctgtaatgaaagacatttttagaccaaactgtcattgggcattggaaaagtacaaaaacgatggcagtttttctatattctgataaagtgaagttaaagtgagaccagattaaaagatacgattcagtttcatatagaaaataaggcttgtggtagtaaagttagacattttcagaaaatgcaaatgaatttatttatgtctgaaaatgaagaggaaaaacaaacctccatgtttcctattttacacattcatctagttttaaaagctataaatatactagtgcatctttaatcatacaatttttttcttagtgtgcttcaatactcatttttatgttatgtgaaaaaaaaatttgttctattcattcacctattgaccactcaatttagcttataggaaaatatagatatttgtgtgaaactatagttatagagacagaaatcagagatggaaacaatgcaacagatcatttcattttttaacagtcaatattttttcacataatacacttagagaatttttcttacccaatatttaatttcatgagtaatgaatcatttattaatttgtaaagtgttaattccagctgaaattgtcattttattttctctatttagataaattacttttctttttttttgttttcctttcttaatattattccatcgctcaaaattctatctatcctggggttaaatgcaatgtgtgtgctatatcacatacagagaatttaccgacaatagcagcctttccaagccctgtctctgtaactaaccactccatgggtatagagctcacaggtaaaaattgatataaggaatgaagcaaaacaaagttgcacaatatttgcatggggatacttttattcttagtggtaattacacagagggattgtgttctccttcttgcaatactggattctagattcaaaaatacttgaaatgctttttctggtttctacctgcatctcacgaggcctctattggaattctataataaccagccatggtatttccgtaggtcagtgggtctctgaaacttttagtgttcaggaaactcatctgaggctcttgaaagcatgttgatttcaaggttccacagctagaaacagcaatttggcaggtcagaagtaaagttcaggaaactacgttgttaacaggtacctcagcacctttgaatgcaggtggcttttgaacttagctttgagaaacactgatttcagctatgcctaccctgagcaaatacctagtatgggatttttatttgaatgaacaaatcatattcacctttgtggcatacagtgtgttgaattgaaacaaagaagcaaaatgagctttcataaagtgactcagactaggtattattttaatgactttttacaaattatgtgagcaatcttcagtttgttcaagggtattttagttttcttggacttaaataaagtttctatttcagaatcattctgcttctttaaaagaaaaactatccagatccacaaaatttactcgtaagaactgaacaagtttcaatcacctttttaatctgattaaatcctcacaaaaattcagtgtgaataactatcaccttttcattttacacatggggaaattgagctctattatgatcaatttccccaagacatgcatttagtaagcacaaatcctgcctcaaatatgtttacttcagaccataacttgttttctttccactgtactaggcagtagtgtacaaaaacatcaagcataatacctagaggctgtggaaaggtacttcttgttggtatgccatgccttaataaggaaatgaaggtatagtaagactttggtaaaattaattgcattggaagagatgcctgaactctccttgtgattgcaattatttatctgagtgggcatgggagagacagagaaattggtagtaaaagataaagagaaaaaattccgtgtaaggaaatatgttagccgctagcccaaacattctttcaatgacagcaggtttatggtctctaaaaaaggtcttgcatcattttacttgaattctttttataacattttgcatgtctctgagagaaaaccaatgagagaccacagcaattttttgtaattgttatgatcaagtgaagatgtgccaaacttcctagtgcaatgtagtgagaggccaatgtttatcacccagaaagggaagcaaaagactcagctatagtttgttcagaaatccttccagtaaggtctgtgatcgattaaatagtttctctgttgggttttactgagatcaaactttgatgctcacaatgtagaatagacgtgttaaatgggttgggacaggataagaatcataaaggcatgattacaccaaaagggacaaataaccaaaattccatagcttttgtgggactgagggtaccctcatcaaatatgtaaaatctttaagttatgttatttcagtaaatccaaattaagtcatttatttttaatggcatttggcttttttgtttcctgacagttaatacaatattctgagttgaatacataaatacaataaaattgacttctgcccagctgggtttattcaaaatttctagattctcaatttttattttctggcaccaaaaatacataaaaaatctttgtgtattcaaatgatctcttaaacactaatttagacctagcatgctggaagtatgtgttaaaatcatttgtgaagaatgtacttatttgataaacaaagccttcttcacttgaaatattggaaataatttctgagttccaaaacactgacattcaatgaacattgcctttcattacttttgttaatacatctttttatacacatcatttgtacaacaaaactgtatagcatctatcatgggccaagcattgtgctaggtgccagggaataatggtgagcaagacaaaaatggtattggccttcacagagtttatactaactttgaggacaaagaggtaagccagccccacaaccacagtaaactttgaaggtaacctgatttttttttcatagccttcacatgatacccggaaagtagtaggcaatcagtgtatacctgttgcatgaatagaggaaaacacagtatagctgaaggaacacccgagcagacgtaaggaaatattaatcctagctttaactctattgttgaatgaccatgtagtatatgcaaaattgtttccacttcatgaacttcagtttgctttaatgtagaattagagtagtcaacattatgaaatttatttcatgctacttccaacaatatataaccatataatactgaaaatatcattttaaatatttgaataaaggcatttataattgcttgtacagcaggcctcattcctgttatctgcttatattaaatgtttcaaaaaagaaggaaggaagggaggaaggaaggaaggaaggaaggaaggaaggaaggaaggaaggaagcacagacatcaattgcaaacaaactcatcacaaatctcacttcaattatatagtgtataaacttctaaaagtaagaaacatataggagtattcctagactagtttcttgagggaacttaaactaaagctcagatctaaatatttccagtttggcaaattcagaaatacctttatttccattagtatttttgacctcccaaaacttaaatgaatatttcacaaatctttcattatagtaatgaaaaaggttaagttgttatttgtgatcagatttagactgtcatattttgagtgtctcggtagggaaaataagtgcttcataaagaatattactgttattattagccctatgcttgttcctggaaacaaaatggagtagtgtttccctgtggactcaatagactattaaaactattgtggccgtcttctgcatacctgttatcaccagttataaaaaaaaattgtctctttattgaaagttgaacttcagggcttttttttttcttttaagatgaagatactggaagacttggcatctttacaatatttcagtttaaacattccaaaggaactgctcatgttgcaaaatatttataaaatgttttatctaatgtaattaaatcccaatagtacagaaagcttaaatctttcttcatttttcttcttcattttttacttttacagagaatatatgcattttaggcaacttttgctctactttttgaaactcaacattagatgtgtgtatacaagttttgttcatttaggtaagttttcttgaaacacgcttatgatatttgcagggataacatcttcaagtcattttaagagtgctaatcagtgattcttaggatttttggcagaatgagggtagttataaaaaggagcagcaacactgtttgtatagcatggtaccactctctcgattaacagtactttacattaaaattttgctcagctgagcagctgactatgctaattcttcagagttgtgttaagccttactcattttttttctaagcctacttgccaggaatagcatgagaaaatgaacattttcaaggtcagtgaaaataggatcacatggctgcttcgttgatattgtcactcagtgtatttttgcatgtttatttctctggaggtcttgatctgattgtaggtgtttcatgatttgctatgcacacacatactctctcacacatgcctatatagaattgtcatgaatatccatttatcataatacttgtttattgttcaattccctaagttataagagcccaaggaatctgcttctctccccagaaaattaataacagcaaaaattatcaacttatgatttgaagacatctgtatctgcttcctgttgcaaatgacaaatgtagtcatttgtaataaatggctacaaacttagtggtttaaaacaacacaaatttacagttctggaggttggagatctatagtgggcctcactgggataaaatcagtgtcagcaggcctgcatggtgcattgtacacagtgggtgcttcacagatagagttgattttcactatttgaggattctgtatttgcaaatgccgctactctctaaaatttacttgtaacctcacaatcaatattcatgaagcttttcagtcattcacagacatggacagagcagcaacaaatgtgatgtgcctcatgctcgggtttccagctgagctccagcaaggccctgctctgccctgttccagctctaatacagaaatgaccagaagatagagatggcaggaaacagtgcaatgtagtgcaagaagctctgactgagacccccttgaatgggatttaaatcccacctctgatatctgttagtgggtgtcctcaggcaagtcacttaaaacttatgaaggccattttctcttttctaaagtaaaaaaaaaatagattctaccaggaaaagtttttttaggctttaatttgataatctatgtgagatatgtgtacatatgtacatgtttcccctaggagcaatgttttagtaaattagctaattcatagttcacagctacttcatagaacatgactacttcgaataacaatagccaactgtatctgttgaataaaggaatgaatcactgacccagaaatattattatttatggtatgaccttgttacatgaattgatggtaacggttgctcagcgatttcccaaaggatgttgtggtaggcagaataatgcccttccccaaggatgtccacatcatctgtggaaaccatgaatgtgttagattacaaagtgaaggaggattatagttgcagatataattaaggttgctagtcagttgaccttaaagtaaggagattattttcattatcttgatgggccaatataatctcaagaactcttcaaagtagaagaggaaggcagaggaaggtgaacaacgacttggcccagcatgctggctctgaggatataacaggaccaagattccaagagtgtagctgacctgtagaagctagaaaagggagggaaatagattatctcccagaatctccagaaaggaatgcaccctgctgacactttcatcttatcccagtgagacttacagatttctgacttttggatctgtaacctaggaaatttgtgttaagtgacaaagtttgtagtaatttgttacagtagcaataggaaacaaatacagatgtctccaaatcataagttgataattgttgctgttgttgatgttgtattactcggaatgtataaaaattaacccggtactaaaaaagagtcaaatgagaacaataccttagctaaaaagatttgcccttcaatatcatttgagatcatggggtaaaaaagactggaaatgacagcacaaattgggaattttaccaggagcaactgctggatatagaagaggatttaacttgatcctgtaggagaggcaaaattttgcccctaccttcttagggatttttggcttcgggactgagaattatacccatgtaagacagataaacagaagaaaatgatacaagttttttcaatacaagttttatgtggcacaggagccatcataaagaaatgaagacccaaagaccctgagttatttatatgctgaattggacaaagtgtaataaattgtgaaaatatgacaaggcaaagcggctttggctaggttagttatttgggtggagaagtaactggatagataaagttaatttaaccaggtttgtttgtacagatttttctcagtctcagtttcctgttcttggtgataaaaatgtccttccagtatagggaagacatctttcacatggaaatttcatatcttccttttaagaaacagaatgaaagtcagaccgatcatgcacctattatttttcaagtttctttagttcaaaataattcttagcacaaagtggcatactttggagcagtgtgttttgaattcattcaatactaataaaatccacaccacatatttcaagctccagagagagttggatctaccaatgtatcacatgggtcacatgattttgtaaaattgcaaaaatgatattagtaaaataataatagtaagatactaaagagtccccctcatattaaataattttcagggcacagaaaacctagctctgcccctgcttgaatacctttcaggaaacttgagagagatctgactccaaaatgaaaacatgtgtctcatgcacagctgtacatgtttccctccccagaacacattttccattgaggggaattcatatgacaaggacatatgaggagtgagatagggataggaagtagtagcaattacataattcatctcctgttgatcaattaagcacttactatgtggctaatcattgtaggctacaatgagatctatgactcattccaatttcactaataacttgaagcttaattgggaagatgaaatgcacatggacacatcatcattagtattatgtaatatacaattaggcactaataaataaggtactggaaactagagaatagcacaataaaatacaactttggctgagccaataacacacacacacacacacacacacacatacaaacatacacatatatgcacacataactcaatattggtttcatagcagaagtgagaacttgatttgatctcaaggcatgatgattatatgatggttatttaatttgcagcagtggctagaataatagcaaaatagaccaaaaatatgttgttttataaatactgaatggaatggctttattacagaaaattaaagtacccaatgggctgagtaccttacatcatttatttcaatttatctttacaacaatactctggggtaggtacagtttattatctttgtttcactaatggggaaactgagacttagaatagtttaacaattttttcagtgatgtcacaaatccattatgtggcaaagccaagactgaaacccaggcctacctgacaccacagtctaactcttatgcacttaaggagttgggatgtagagagaaataaaattgaataggttttaaacactaaataaaggttttagtttacagataagaatacttctatatgaagcataaatttgcatatatgctcacctagactttgagatcttataatttcttcaacagattaaaccatcactttccagaaggctaccatatttctttgacataactagtaaattgctgaagtacacattgacatctgaaatcatttgtctgaatgtcaccgaaatgaagtgaatagtgtgataggttttgctcttgttgtcacaaggataatacggagtatttaaaaatgtgtgataagatgggatagttgtattaaattaaaaaccttttaaatcatactaataggatgaccaatgtgctttattaagaagcaaagaagtatcagagatgcttaaggcaaatgggcagatgacttgaattggagtcatttgactgcatgtgaaagctagtacatgactaagagcctacaaaaatatgtattcttatttaaaacttaaatatgaaatgctttggaacagtatagcaaatttcattaagtttgttaataattacagaagcattaacatgatggcatgtactatcaatttcaggttgaaaatagctggaaaaaacatattttcacaacaagtggcttctcttggctttccaactgttgcttcattcaccttaaaaaaataagtattaattctacaaatatttaaatttaagtaacacaattattgcaggattgatagaagatgcagtagaattttataatatattcaaaatatgtaactgtgagtctgtaaactttgatgtgtgatgaatttgagcctgccatgtttattctgtcaaaaccacagcagtgcttagatgacagacccctagttatggttgacagcctagatcctattaacactgtgaatcatcacagttaaccctgtaatattgtaagattagaaatgagtatcttgtcagaaataatacatttatctaggaaatatatggttggatggaactgtgtcagagcaagcaagagtcaccagaaatttatgtaaggcacacaatactttagcttactattttatttatttttgaattttactaagggctgacactgtgtcacatgaaaatcctacagtaatggtatcttggctcaccctactggttaagagaagagcatttccaccttgaatgctgcacctaaaacttaagatgtgtgcttccttaaaaacaatacaacataaacccaagaaataaattggagtgaactacaaaattacaactttaaggaatttatgactttgagaactttctctgcattttttagactacagaaaaaattatagcactttattttaaatatgaggggaattttcaaatagtcatgtaaactgcaaagtaaaaaactacatattttaaatatacagtttctttacacagcactgtttcttaaagctgcattaacaaagttcaaaagacctctaaaaatgtgttttaccatcattttgggttgtgttaaacatgatatcaaactcaagttgtccttctcaagacccaaattaaattttgttttacttaatgaataattttaaaatctggatatatgataactataactctataaaaagcatcttagagccaggcacggtggctctcgtctgtaatcccagcactttgggaggctgaggcgggggatcatgaggtcaggagttcgagaccagcctgaccaacatggtaaaatccgtctctactaaaaatacaaaaattagccgggtgtggtggtgcatgcctgtaatcccagctactctggaggctgaggcaagagaactgcttgaacctgggaggcagaggttgcagcagtgagccgagattgcaccactgcacttcagcctgggcaacagagcaagactccgtcaaaaacaacaacaacaacaacatttgatcaagaagctaccaactgaatagcttactttatttatgcacgttactagaccatttttgttaagctcaccgttttagtaatagtctagtttttgaaaatttggaagagttcgggccgggtgcagtggctaacgcctgtaatcccagcactttgggaggctgaagagaatgaatcaactgaggttgggagtttaagaccagcctgaccaacatggagaaacccggtctctactaaaaatacaaaattagctgggtgtgctggcgcatgcctgtaatccctgctactagggagactgaggcaggagaatcgcttgaaccagggaagcagaggttgcggtgagccaagatcgcactattgcactccatcctagccaacaagactgaaacacagtctcaaaaaaaaaaaaaaagaaatagtctaattttaactaacacttcctaaagatcaaaaaagtttacttaaataatttacacataatattgagaaagattttattacacttctacaaaaactctgagagtgcagctagcatgtagtacttgctcctctagaggatcacaagcacttggttggactaccagtgttagactacctcttgacctttagagggttgggctacctcttaatgttagagagctttttaaagagtgattattatacaatgtgacatcactggatataattttagttatgattgtaaatgatcttaggctactttcattaatacagtctgagtcaattattcatttcatcacaggcttctttattgatataagagaaatatgatttgttacatgtagctctaattggttagacttaaaactgttggaaaaaaaaataactttagacaaattaaatttagtagttcatttcagcaagttcatgaatgaggcggcactcagaaccagaacaggttcagagaactctgcatagtagtgtggacagtgagctcttatagtctgaatacaaaagcagagtaatcacctgattggctagagctagatgactgcctcatttggcatggtctgatcagtttgctgcttgtgattgactgaagctcagtgtcttgtgattggctgaaacttcgctctttgttacaaaatatacatctaaattgggtttcggttggtttatatactaaaagaggttgtagtttgtggtttgtttggtaggaattcaaagtacggaaacagcctcaatccaataggctcctgcttatttaatttaacaaaattaacctttcattgggtcctgactactcgatttaaacctccctgtttgactcttcttatgttagaaattcattccctaaaagtcttttcttaatttggttgcaaaaaaaaaaaaaaaaaaaagccacccacatgccatggctgcctgtgttttttcaccctggaattctgccattactgaacagtatgtgctcagctatgctaaagcttttacaacccccaccgtcatattatagaagcaaaaaaaaaaaaaaatgtccaaagaaattctaccatctggcatattgagacttcaaagactaaagaaaaaatgttaagttatggttagaacattttttttcttcccaaataacacctatgcaagaaagaaaggaaaacaaaaatatcacagagctggaacttcatgggttttatgcacttacatctatcaaaagtaaaacaccattgcagacatattctatgcctatgctgtctagtacagtaactagtagctatgtgtgactttaaagcacctgacacatgactagtctgaattaagatatgccgtaagtatataatacataccagattttgatcacttactatgaaaaagacaatgtaaaatagctcattgataaaacattaatattcacattggttgcatgttgaaatttgaatattttaggcatattggattaaataaaacagataatttcacctgatcgttttggcttttacttttactgtggctaccagaaattacttatgtagcttgtcttaaatttttgttgaaaacccctcttttataccaaacttagtaaggaagattttgactgaagtttacttaataccaatacatttgactttcttgtttcttatggtataactgattaaaaatattgtttaaaataataataaaaataaaataaaaatataataaagatatatcatttcaggaattgcatattaaatattgatatgaaattacaaacattgtgaataacctgcatattaacattaaatatgcatggttataaacagttaaatccagaacattgacccttaattagagactccacttctcctcacgtctttgaagtggaatattctttgggctgcagaaatggtaataactgcctaattgatagtgtttatgaaaagtttgtctattgaagataaaaaaactatctgtacctcaaagaagtaaaatgtatagcacaggttatctaagcaaactgctaaataaagaatagatataagttccataaagtttatggttttgtgcaatagaggacatacacccttgtatttcatattttattgcacttaaaaatacaaaactttttttgatgagaaagacaatgacacagatgtctttattttactatattaagcatattttttgacagtgttctgtgtgggagacacatgaggggagacgaaaaggcacacacaatacttttaagggtaaacagcctttatcccaagtatatggcaatacagatataataagcaaatcatataataaacaaatgacataataagcaaattgcaattggaaggggaaaagagaaaagatatatatatatatatatatatatatacacacacacacacacatatatatatatacacacacatatatatatatatactcaccagactgtggaggaagcatcaccagactgggaagcaacagcctgagctccatggttggtcacctgttcagcacagatgaggagaggtctcatgaagctttagggtggtctgggtggtctgggaccctagctcttttttatttgtttatttttttgagatggagtttccctcttgttgtacaagctggagtgcaatggcacgatctcagctcaccacaacctctgcctcccagttttaagtgattctcttgcctcagcctcctgagtagctgggattacaggcaggcaccaccacgcctggctaattttgtattttttagtagtggcggggtttctgcatgttggtcaggctggtcttgaactccctatctaaggtgatcgtgccttggcctcccaaagtgctgggattacaggcgtgagccaccgtgcctggctcctagttctttttgtaagttgtttggcatgaggcccagtcacaaggacccttcacgactgggctcaaggaacacaaaaaggtcaacttgttttttgctattctgttgtctttcaataactaatatacaagaacagattgagagagcgatatctccgaaacagtgctggatgaatgcctcaaggggctcactcaacctgttttgggacttggtgaccattgtctgtgtccagttgagtttaattttaatatttaacttttcctccacacacagacaggtttgtacgtaattcatatctaatcaaatcatgataatcgttttcaaatgcttaactttccctttatcatttaatgttgaaattatgacccagcaagctaaaaatggaattcattttatatcatgtcggatatcactttgccctccaaatatgtactcgtaatggcaaataatgagttatgctgaatgattaatctgagttaaaaaatgctgattttacttagtttgaaaattgcttatatatttatataagatatatatttcttatatatataagatatatatataagaaatatatataagaaatatatataagaaatatatataagaaatatatataagaaatatatataagcaatttaactgcatataaggccttgatcactttcgttatcttaaagtcccaattattttgagtgtgagacttccagttatactacattcttggaaattaaagttattacagctatatccagtagaattaagtagggaaatatgtaatcattataaaaattgcatttaaaatgaagagattatatagatttaataaatttacagtgataggatctttaggttatataactctgagcaacacatttttgctcttgaatattttttcaattgctttaatagctgtagcagtttattctcatttttgttaacaaataaaaataaacacaccataacaataattatgtcactgttttagataaagtattagattttttttttcctttaaggaattctcttttttaatgctttgatccatgtatccatgtcctgggaaatcattaggaactcatctatatgtctgttcatttagttggtccttgaattatctgataattctcattttcaataagtaggaaatgggttgtaagaagagaaattacttttgcttattacaattcatcaaaattatgctccaaagctcaaaaacacttctgatttatcagcaagttttgattggaggagccaacacacatctgggaaatacagattcaaataagaacgcccaaatagggatctccctactgtaaagtacgtttctttctgtggaatgaatacaaaatcccccaataaccttttaggtcattttatttctccaagaattggtttttctttccttctactgccttagaaaaatttattgtttggcatatccactggttttggagactattgtagtgtcctacaaaatactaccatcttaaaggtaaaacattcatatattatttcttaatatttcacgttgttatactcaggtagcagaaaagaagaaattaccaaaacaaaacaaaacaaaacctaagataagttgtttaactctagggaggaatggagaatgaaattgttcttgggatgtagaaacatctcatctgtgaatctgaagtcaatttcctgttactgggcagtatacaataattatttcaaatatttacaggtatgttatacctaatgttcagaagaagcataaacattctgattttctaattttacaccttgactataaaacatttgcaagacaattataagttgtgatataactatacatataatatagaagacacatgttttaacataaagagaatgatgatatccattcattaaaactgaggacagagagtcttcccaaataatgaccaatctaaatataacaatttgatttcggaacagtctaatctgtgtagatgttaaatcattattgctcacatagtcatatataattatatgctattagtttcattgaatttataaataaatctctcatggtctcttgaaattagctttatgggaggggaatatctgaaataaaataaaaacccacattctacattcctttaggagaatggggacataactaccataagtaaattattttttcctttattttctttttgagatggagtttcactcttgttgcccaggctggagtgcaatggcacaatcttggctcactgcaacctcctcctcccgggttcaaacgattctcctgtctcagcctcccaagtagctgggattacaggcacatgccaccatgcctggctaatttttgtatttttagtagagacagggtttcatcatattggtcaggctggtctcaaactcctgacctcaggtgatccaccctcctcggcctcccaaagtgctgggattacaggcatgagccatcgtgcctggcagtaaattggtttttaaaccttttctgcttgtttagaaggaaatctccattgcagcaggtgatgtgaggtttgattaaataaattgacagactgctcagaggctgattcagtattttaataacattgcaataaatcttttgcaatgtggtcccatttttcctcaagatgatcatccttattttatttaatattggtgtaatcgaatacctacttcatttaacttttctacagtctacattttgaactacattttgaaataatagattccgttcatgaggaattatgattgtgtggcattgctaagagttgtaactgttggaaacgtcaagatacactgttgcatgtgaaaagagctttacatagaattgatgctatcagatacagtgccatctttttattgagggcatgataggctaatgataatgaaatttttaagagttctgcataatagcaagatttttaataactagagcagaatgatagaaatctcttgtaaaagtgggttccaaaagatcttagagttagttgattgtttaaatttataacctcattagtagtatagacagattcctgcatcttagaaactcttaggaaaatgccagttttgattcatcaatactccaactttagcttcaaatggaattgccctcaattttaaaatgacatgaattttaataaaaaatggaaactagagaaatagttacgtgaaggaggcatatatgggaaagtggaggctaggccttcaggttttacagaagcaagcatttctaacaaacagagacagacttgaaacaggctagagaacccttaagtaggaaatacgcataacaagttgttttaattgctaatgcatttgtataaacagagcaatctatgacaattgtgctgtcaataatctctgagatatggttaagttataaagcaacaagaaatgatattgacagacaaatggagatccagtaattgtctgcagcatcaaactctcatgtataatgacttttgaaggttgaagttcatgagagcagttcattatgtgtttcaaacaaaactctattttgccattcttccatcaactggagcagtaagcactacagctaaaattctgcctaagggaatccatgtataccagttggttaaccttgtgacattccactaaaaagcaccaggctcttttgtaatacataattcatgaaccactctgattgtttagcattgatcagcacttgaataaattgagttgctatcatattaacataagtagcaatgctttagtgagattttctttcttcctttcttttatgatttatagttcttaaaacaggaagtcagtttagaagactgcagagttatgtatccaactattacttttgaaccaacctaatacaatgataacagaaggctgtgaagtacattctaacaactgtttgcatattccatttaaattcccagatttgactgccagtatggatttgttgtcagacttcctgtcttctctgtggtcagacatgcctatctttgcatttttcaactctatatgtaattattcttgtctaccaaaagagtcaaactctctaaaatatttgaagagatttattctgagccaaatatcagtggccatggcccgtgacacagctctcaggaggtcctgagaacatgtgcccaaggtggtcggggcacagcttggttttatatattttaggaagacatgggacattaatcaaatacatttaagaaatacattggcttggttcagaaaggtgggacaactcaaagtgggggcttccaggctattggtaaattgaaacattttctggttgacaattggctgagtttatctgaaggcctgggatcaatagaaaggaaatgcttaggttaagataaaggattgtggagaccaagttttattgtgcagaggaagctctcagatagcggacttcagagagagcaggttgtaaaatgtttcctattttacaataagacctaaaagagtgcctggctcttagttgattatgtcctggttctggaaaggaaggaaggaagacaaagaggaaagaagattctctatataatgcggattttccccacaaaggatggctctgcagggccatttcaagatatggcaaggaaatatattttggggtaaaatatttttaatttcttccttgttattcccgagtcagattggaaagtaagccacgatatacaaggttaaataaaccccatttgatggaatttatggtttgtagggtgtgagtgactccccagaccccttagataggaatttgggcaagataaaaagttagagcttagtcctcattctcaaatctaggtagtttgatgtggttgtataattgcccaatatctcagcaggcaaggaactgcaatttatatctttcagaactttacaaggtaatacactgaagacaccagccttactctaaggaacacaaatgtatatagtagtgatctctgtgtgatgtgaactctgaaaatttgagacaagtcttagttattttagaaagtttatgttgccaaggttgaggacacacgcccataacagcctcaggaggtcctcaaaacatgttcccaacgtagtcaaagcacagcttggtttagtacattttagggagacatgagataccaattaacacatgtaagatgaacattagatcggttggaaaggcaagacaactcgaagcaaaagcaggatgactccaggggagagagcttccaggtcatatgtagatatgagacaaacgtttgcattattttgagtttctgattaacctctccaaaggaaacaatcagataggcatttgtctcaatgagctaaggggtaactttgaataggaggcagatttgccctaagcagttcccagcttgacatttccctttcgctgagtgatttcagggttccaagatattttcctttcacagagatgtggtttggatctgtgtccttgcccaaatctcatgtccagttgtaatccccagtgttggaggtggggcctggtaggaggtgattggatgatgggggcagtttctcatggtttaccaccatcctccttaatgttgttgtagtaattgtgactgattgagttattgcaagatctggttgtttgaaagtgtgtggcaccccacccctcactctcttcctcctcctatggccatgtcagaggtgcctgcttcaccttctgccataattgaaagtttcctgacgcctccccagaagccactatgcttcttatacaacctggagaatgctgagccaattacatctcttttcattatgtattacccagtctcaggtatttcttcacagcaatgcgggaacagactgttacaaggtgtatatagagaaatgtgactattgtgtggtgagagggtacgttttcatcctcacatgctgaaaagtgagaagaggaatatactcgagaatgtattttgatacataaatattatttcattgcttttcccttttagcataatttgcacattttaaatcatgtaaccatttcagagagaaaactatattaattatgagatagttttatctacagcttgaactatagaagaaatttattactacatcagtgtgaaccagaccgtatttaaatagattatttaacgtatggacaacagggttccagagtagtggtaagaattccctaaggaaattacctttattcttggcatatattttgcctagtaaaaagtgaataggcacaaatgtctcctatgattttatacctaatcactgttccctcttgagattcatctatgcatgctcagcccttctactgctattttttcaggaatttatctgtatgaaaagcagtagcctgagaaaattagttacagatttgccaccaagaatgacaaatgtctagtggagcagaaaagaggcatagaacatgctcagactcatcacggaaagtgactcaattttccagtgtatcatcatttgtaacacaaatatatagaatataaagtgatacgcaagagatgaactctccaaacattttaaagtgtcatttgggtattatacatatttaaatgtccacatttctcatttaatttggttattacaagatacaaatttaatatgcatttactgaaactcatgacttctttttagtcctaaatctaactgttttcattaaacacaaattatatatgaattttttattcataaagcttcattcctttttacctatttatattttgctatttaaaaatatccagcaccacacaaaaaagtaatatgtgtgtgtgtgtgtgtgtgtgtgtgtgtgtgtataaaccattaaattaaaaaataataatatctagcatggttgttttgttgacatcccatacactggtttaaataactgaaaaaaaaatggacaacagcattttatcatgacttttctttgcaaaccatttgaattattttataaaatgagtagagataggttacttatcattgcagaatctgtttctttagatattagaaatagagatttgattttgagccataacctcttgcttaaaagtattcttatgccctatgatatgcaggtgttattcagatttaactgtttatctctatctttgaggatatacaggtatatatgaggacaagcccacttgttctcttttcctaaaggaatacacaaaaaatcagggtgtagaaaaatatcttatttctccctcattttatacactaggacaatgtgagacatttaactgctctatcatgtccactactaggctgtctgccaattggatgatcatactttccaattatcctagcctctagtacttcagtgtttaggacagttggattttaacaacataattcactaggacaatattctatgccatcatgaataccttctgtctttggggaaaaacaacaacaactgtagtgctttttatttacttggagaatattttgaaataagtaaagtattaatttctaatatctagaggtttagaaaaacatgaacatccctctttaatttgaatgtttatgatgtcactccacaaacacacatattattatcaatatttaaattacattaaagatatatccaagaacaaaggcccttcattgcagtatgcatggtaatatatgcattatcaactgaagaacatggggcaacaagtgaattctgtagagatttcagctaataaaaatgcaagtccaaatcccaaatccaagtcctcctatcccctaacccccaatccccagctgtggtgaaatttccagcacaaaaatatctaggttgtcattagtgtttcaacaaagctaatgcatttactcttccattgctcactaattttcaggctttttctgcatttcatatcctctctttgtctccttacctgctcttttcttctttggttacttttgtgacattttgtaccacatgtccttagaattctattcctaatattatgtttttttctccaaaaatacttttcaaatgttcttcacaatgttctagtttgttgtttagaggtaggtacccctgaataagatatatcttttaacgtatatttaataaaatgataatatttcattctggggctactatggcacatcccaaaggaaggaatttgcatttctctctcatactgtaatttttattgagtttctcatctagaagtaacctccttttgatgttgtcgtcactatagtcctaaattaagcctacttcaaagctttaaacaataaaaaattctaattcaggcagaaagtcaccaaagatacagtgaacatatgctataagcatgaaatttgaacaatctgtaatataaaaatatatggcatttaaaccttatgtcctacatatcaagggtaatgactttgctttttagtaattaaatttgtacacgtagtgaaattgctaatggatattgattgacaaggcaaaaatcttcactttgggaaatcttccattttcctagaaaaatcttagagaagttatttaagtggcaacagagttgattctgaattactttttgctattcaagttccaagacgaagagaatcattgagcacttttaggccaatcatcatgcattttttcttttagaaacaaagttaaggtgttcaacatctttagacacgttcttgaatatactgtcacaattattaaagattataaaactgcaaataatagaattagttacttatgttgttatcacagtgggcatcaaagacacgatgtttcccttacatatatttctgaaggaaagtaaggttagattgaaatgttgtttgatattttccaaaatgcaagtcacttgctgaagatcaatctgccttcacatttcagataatcaagggagagtctgtctaccttattcacaaactgaataaatatagattcattctgaatgatatatgcaggccccttttccctttatgatttaatatacaaggcactttgaacacatgggacattatcttcacttgctctcaggaggactatgtaagaggactgaataaatagacaagtttatatatagtttaggggccctaagtcaagtgtatgtgtatgtgtttgtgtgtgtgtatgtgtgtgtgtatgtacctgctatatatgaatatatacacatatcatattgtatttgtccattttcatgctgctgataaagacatacctttatgtctgggtaatttataaagaaaaagaggtttaatggactcacagttccatgtgctggggaggcctcacaatcatgttgtaaggagaaaggcacgtctttcatggcagtaggcaagagagaatgagggctgagcaaaagggaaaccccttataaaaccatcagatctcatgaaacattaagtaccacgagaacagtatgagggaaaccacccccatgattcaaatatctcccactggatcactcccacaacatgtgggaattatgagagctacaattcaagatgaagatttggatggggacacagccaaaccatatcacatacatacacattgtataaaatgatgtacaaagtatgtgtatgtatgaatatatgggaaaacttaggattaaagtggaactgagcctaatggatctgtcaaactcatgtcaatatttattagacagagatgttcatctggtgatggtgccattttagctaataagaaggtataaactattgataatcttgcttacatttctctttaattttgtttgttttctcctctaagattagaaagcaaaattgaaaaagtcagggaccacgcatggtggctcacatctgtaatcccagtactgtgtgaggctgaggtgggagaatcacttagcccaggagtttgagaccagcctgggaaacataccgagacccatctctacaaaaaaattaaaaaactggccaggtggcgtgcacttgtggtcctaggtacttgggaggttgagatggaaggattgcttgagcccaggatgtcatggctgccttgttgtgttcacaccactgcattccagactgggaaacagactgagcccttgtctcagaaaaaaaaaaaaaaaattgaaaaagttctcaggaaagatgcggggaaatatatttttttcattacaccattcccccacacaaatatattttatttttttcttttcatttcctttctaagtctttgcatctctaatgatggtgtacattcatatgaaaaatttgatatttagcagaattaatactcagttaatacataaagctatagattatagtttgataagtaaaaatgagttatgaattatgcagaactccatagaatttcaatatatgaatcctcattttatttatgtatctgctatatatatgtatatttatattcagtcctcccttggtatctttaagggattggttctagcacccccgtaataccaaaatccttagatgctcaagtcccttatataaaatgatacatcgtatttacatatagtctacacaccttctcctgtatattttaaattatttctagattacttataatacctaatacaatgtaaatgctatgtaaatagtcattatactgtattatatatatttgtattactttttattgtagtattgttatttgtattgggctttcaaaatatttttgatcctcagttgcttgaaatcaagaatgtggaacccgtggatacaaggtgccgactgcttatacatatatgtatgtattcaaataatgaaattcattcctaaagcatgaatattttagggaaaaaaatgaggtagcagacgatatcttattgatcctagggatttcttattttattttttcttcttgcaccaatgtttcctggcctacactaatctaagtaaccaaaactacattttatgttgtgaggttgtgtggtcagaaattgagcccaagaactaattaaggtggaggtagattcgactccaatgatagggaagctcccactaaatgtatttctacagcaagacacaaaactaataatgaacatgattgtgataccatataccctcatttctattttgttttaattaaataatataaattctttcataaataaacatacggttggtcatagaaaccatcaggctaaaccaaaagatgatgtttgaatttgctcataattttgttcttcccttaagacactagctaaaatctcatctgtggttaaagcacaggcatgattctcaaaatgttcttggtattgccagaaatccactgagctggttgtgcttgtccagtgaagctccaaatgctctttttttttttttttttttttttttttgagacagagtttcactctttttgcccaggctggagtgaaatggtgtgatcttggctcacagcgacctctgcctcctgggttcaagcaattctcctgcctcagcctcccgagtagctgggattacaggcatgcgccaccatacccagctaattttgtatttatagtacagatggggtttctccgtgttggtcaggctggtcttgaactcccaacctcaggtgatcagcccacctcagcctcccaaagtgctgggattacaggcttgagccactgcacccggcccctgaatgctcttttaattaatcattgtaaatacatatggatctgtgtgttcctaaaagggtaatgacatgccatactggccacatcaagtatgtttacaaagtataggctagtaactcataactattttaccaaaacatctctaaaaactgctctcctgtcttaatcatattttgatcttgactttttttgtaacttttctgttagaattatctattcacaccttggctcagtatgtgctttgtgttgttaataatttcatgtctatagctttttagaaacttttactgaaagtctgtatttgcgtggaaatgaaaccaattaagaaatacaaatgacatttctttccagcttgtcagaaactgtgagagagaaattaatgacaaaagtttattgctgtgtcttcttttcagtatgcttccttcaaacttcatggcagtaaatgccaaataacctcatgtatcaaacttaaagcaagctgtgagccaggtgtcttcaactgcaggtcatatgctgagctacattcatcattttaatcttttgaattaaattctctaaaattgaataaacctcagtgagcctgtggttgctaagaaattctttaattctctgactcctgaattctgtaatatcttctgcctagaataaaaatggagaaagaataaggggcaggttttggcccatagaaagcaaacaatacatgttttgagtcaatttagtgttagcaacttgagagcagggaccagagccattcttttacacaaaacacaaaaatttagttcaatttttgtatatttcactgctatgtatcctgctgtcattcagtgaaattctgcttgtatttatatgctaaaaattgttggggaaaattactccttttggtagtaatcaaaaccaattcaatgtgcactacggtataatgtttaagtggaaagtagtaatctcaataatttctctgaaaatcaactccaagtttcaagcagccaaggatgaatgatggctgctctctatatattaatcaaaataatcattaaagaaaataaagaacatatatttaaaagattccatcatattgacagaacaagcatttacagcacttagcagaatatgtagttcatatattttcccttaagtgtttttcttatgggtttttaattttttaaatttattttggggatttttaatagatgatgtattcaaatgatttaaaaattaaaaccatgtaacaaagtacacatgaagaagcctttcttccaagcttgtcactatttcttccatatatccttcctttcatgcacgtccctgtgaagagaccaccaaacaggctttgtgtgagcaacgaggctgtttatttcacctgggtgcaggtgggctgagtccgaaaagagagtcagtgaagggagataggggtggggccgttttatagcatttgggtaggtaaaggaaaattacagtcaaagggggttgttccctggcgggcaggagtgggggttgcgaggtgctcagtgggggtgtttttgagccaggatgagccaggaaaaggactttcacaaggtaacgtcaccagttaaggcaaggatcagccatttacacttcttttgtggtggaatgtcatcagttaaggtggggcagggcatattcacttcttttgtgattcttcagttacttcaggccatctggtcgtatccctgcaagtcacaggggatgtgatggcttcgcttgggctcagaggcctgacattcctgccttcttaataagaaaaataaaacaaaatagtgttgaagtgttggggcggtgaaaatttttggggggtggtatggagagagagtggacgatgtttctcagggctgcttcgagcagcattaggggctgtgtgggagcctagagtgggaaagattaagctgaagggaggtcttgtggtaaggggtgatattgtggggatgttagaagaaacatttgtcgtatagaatgattggtgatggcctggatacggttttgtatgaactgaaaaactaaatggaataagaaggagaaaaacagatataaaaggtctaagaattgggaggacctaggacatctgattagagagtgcctaaggagattcagcatagtcctgccagcaaagattatttatttacttcaagagttaagagtagcggtttggggatagcacgaggagatatcacctgtgatggcttggagaaacagtgtaaactggcagtgtaaacaagagcagggcatgtatgagtagttgagaatggagaataggagtatgactagacagaaaatagtagggatgacaagtttttttgggggcacagtctaagttggtctggtgtctggaatgagactggggcctaataaaaaggagcatctatacaggagcttaaatgggctgtaccttgtagcattccgaggacaggcctgaattctgagaagggaaagtgataaaagtattgtccagtcctttttggtggctgagcttggtgaggtgtgtttttaaaagacctttagtccattctacctttcttgaagaaggaggaccgtaagggatataaaggtttcactgaatactaagagcctgaaaaactgcttggtgatttgactaataaaggctcatctgttatcagacggtatagaggtgggaaggctaaactgaggaattacgtctgacagaagggaagaaatgactgcggaggccttctcagaccctgtaggaaaggcctttactttattcagtgaaagtgtctatttagactaagaggtattttagtttcctgactcgggcatgttgagtaaagctaatttgccagtcctgggtgggggcaaatcctcgagcttgatgtgtagggaagggagggggcctgaataatccctgaggagtagtagaatagcagatggaacactgggaagttatttccttaaggatagatttccatgatggaaaggaaatgagaggttctgagaggtgggctagtggcttgtactatagcatagcctgactttgctggtatgtggcgattaggcctggtggaactgccatcaataaatcaagcgtgatcagggtgaggaacaggaaagaaggaaatatggggaaatggggtgaatatcaggtggaccagagagatacagtcgtgggggtcaggtgtggtatcaggaataatgtgggaagccagattgaagtcctggccaggaacaatggtaattgtgggacttaagaaagtgtgagtacagctgaaggagccggggagcagaaagtatatgcgtcaggtatgaggaagaaaatagattttggaagttatgagaaatgtagagagtgagttgagcatagtttgtgatttttagggcctctaaaagtattaaagcagcggcagcctctgtacgcagacatgagggctaggctaaaacagtaaggtcaagttgtttggacagaaaggctacagggtgcagtcctggctcttgtgtaagaattctgactgcactaaccatgcctaggaaggaaaggagttgttgttttgtaagggattgaggtttgggagattaatcggacacgatcagcagggaaagcacgtgtgtttttaggagaattatgccgaaataggtaacagataaggatgaaatttgggcttgactgaagtaatgggggctgtctgtgaagccttgtggcagtacagcccaggtaatttgctgggcctaatcggtgtcagggtcaatccaagtgaaagcgaaaacaggttgggatgaagggtgcaaaggaacagtaaagaaagcatgtttgagatctagaacagaataatgggtagtagagggaggtattgaggataggagagtatatgggtttggcaccacggggtggataggcaaaacaatttggttgataaggtgcagattctgaactaacttgtaaggcttgtctggttttaggacaggtaaaatgggggaatggtaaggagagtttataggctttaaaagcccatgctgtagcaggctagtgttaacaggctttaatcctttcaaagcgtgctgtgggatgggatattgccgttgagcggggtaagggtgactaggttttaatgagatggtaatgggcatgtgatcggttgccagggaaggagtagagatgtcccatacttgtgggttaaggtggggggatatgagaggaagactcgaaggaggctttgggttggggagaagggtggcaatgagatgtggctgtagtccaggaatagtcagggaagcacataatttggttaaaatatctcggcctaataagggaactgggcaggtggagataactaaaaaagagtgcataaaagagtgctgtctaagttggcaccagagtggggggagttttaagaggtttagaagcctggctgtcaatacccacaacagttatggaggcaagggaaacagacccttgaaaagaaggtaatgtggagtgggtagcctccatattgattaagaaggggacgggcttaccctccactgtgagttacctaaagctcggcgtctgtgatggtctacggggcttctgaggcgatggggcagcatcagtcttcagccggtaagccgagaaggagtcagtcagagagccttgggccagagttccaggagctctgggagtggctgccaggtgagttgaacagtccgattttcagtggggtcccacacagatgggacgtggcttaggaggaatcctgggctgcgggtgttccttggcccagtggccagatttctggcatgtgtaacaagttcctgggggaggaggttctggaggaacgcctggctgctacagttcaggtgtttggaagttcttgtgtgctggagatgtggctggggtttgtctcacagtggtggcaatgaattgcaacttttttctgttattgcacaccttgaaggtgaggttaattaagtcctgttgtggggtttgagggccagattccagtttttggagttttatttaatgtcgggagcagattgggtaataaaatgtatattgagaataagatggccttttgaccttttagggtctagggctgtaaagtgtctcagggttgctgccgaacgagccatgaactgggctggatttttatatttgatgaaaaagagcttaaacgctatctgatttgggataaagaaaaaggagcattaacctagtgcctttagctccagccacctttttaagaataaattgctggcaggtgggggagggctagtcacggaatgaaactgtaagccggagcaggtgtgaggaggggaggcgataaaaagattatagggtggaggagtggaggctgcggaagaattgggacctagctcggcctgtcaaggaggggagaggtcagatgggtctgtagaaaaggaagattagaaagactcagcgacgcttggggttgggactgaggggacaggcgggagggaaagaaggaagatttgggaggagttgcactgggcacagagactaggaggggactgatgtgtaaaagaatgcctggacgtcaggcacctcagaccatttgcccattttacaacaagaattatttggatcttgcaggatggaaaaattgaaagtgccgttttctggctatttggaactactgttgagtttgtattggggtcaagcggcatttcagaagaaaataagacgcttagattttaggtcaggtgagaattgaagaggttttaagttcttaagaatagaggctaagggagaagaaagaggaatggaagctggaagcatagtgaaggaggcaagcccagagaaaagagtggagacacggagaaggagtggggttttctttccctccagaaaagcagagaaagggttggggcacagaaataagggattggggtgcagagataagagattggggcgtggaaataagggattgaggcacagagataagaggttggggcgtggaaataagcgattggggggttcttgccccctaggaaagcgggacttgccactaagggtgaaggagaaggggttgaggggtacttgcccctgccccaggaaagagggacttgccgccaagggtgaaggaccaagtcaggcatccctgcgtggtctgacacccttgaaacgtgagtgtataatcagagaggtgtccctgcaatgattaaacaccaagagaaggctgccttcccagtccgtgaccggcgccggagttttgggttcatggataaaacatgtctcttttgtctctaccagaaaatgaaaggaattgaaattaagagaagggagagattgaagtgtggttccaagattgaaaggagaaagaggttaagggatagtgagggaggttggagaagagagtaaaaagaggccgcttaccggatttgaaattggtgagatgtttcttgtgctggtcggtctgaggacctgaggtcataggtggatctcacggagcaaaaagcgggaggacaggggattgatctcccaagggaggtcccccgatccgagtcacggcaccaaatttcatgcgcgtccgtgtgaagagaccaccaaacaggctttgtgtgagcaacatggctgtttatttcacctgggtgcaggcgggctgagtccgaaaagagagtcagcgaagggagataggggtggggccgttttataagatttgggtaggtaaaggaaaattacagtcaaagggggtttgttctctggcgggtaggagtgggggtcgcaaggtgctcagtgggggagcttctgatccaggatgagccaggaaaaggactttcacaaggtaacgtcatcagttaaggcaaggaccggccatttacacttcttttgtggtggaatgtcatcagttaaggtggggcagggcattttcacttcttttgtgattctttagttacttcaggccatccgggcatatacgtgcaggtcacaggggatgcgatggcttggcttgggctcagaggcctgacacttccctctacagttaatcattcttattagtttctcaaatatgtttccagagtttccatatgtagatataaacaaatatttgtaggttatctcatagctgttataaacagtcccttatacatggatattgggacttattttcagctttaaaatgataaaatggtaaatagtgctgtaatgaaaaatctttcacacatatcatttatccatatttctagaaatgggattgttgaatcagattaacgttagaatcaatttatctagctctaaaaatgttgctgttcttgttggaatcacactaattttgatgttaacttagagagaatcatcagctttatgatgctgaatccttctacccaagattacatcatgtcttttcttttattccatcctagatttttgtcctaaattatgttaaatatttttcttatgactattgaacaattctggctatgtttactcagacgttttgttctttttcatgttgtttgtgtatgttcttgccatcttagcaaagtaattattgcaaatttttaaaatatgcgaatatggagcaaaattggaagtaacacagtatatatttttatcaattttgtgcaactccagacactttgtgttaatcattaataaatatttattttactaagtttttgatatctactatttgatttggcattcctcaaatacctgttgattaaaatattataaaaacttcctactgggaaaaatttttaaaagccatattatcatttattggtttatcttttttaaataattcaaatactgaattaactctatagttaacaagatatcacttacattttctaagatactctcttggatttagctgtgtggcactattaaccaaaaataaattctaaggccatccaatcatctaaatggacccctcctcttggccaagggcattccacagttaacctgaaaaaccagttcaggacatgacagaagaggggaaggcacatgcctcactatacatcccaccagcattagcatcaacacagatcttaaatctgataagaaacatttacaatctattctctcagaagcctattacttggaggcctcctctgcatgataaaatcgaggtctccaccaccccttaacttaatccaaacattgctttctattgataactctctttcagccaattgccaatcagaacatttttaaatccatctatgatctggaagccacccttcaatccccctcctcaatcccttcatcactttgagttagtctgcccttccagatggaacgaatgtaaatcttacatgtgttgattgacgtgtgatatctcctcaaattatgtaaaaacaagctgtaccctgaccaccctgggcatattttcagggcctcttgaggctgtgtcatgggcatgtccttaaccttggcaaaataaacgttctaaactgattgagacctgtctcagatacttttgagttcacaaatttgagagctgtcttaggtacttttgggttcaaaacaccctttgatgttaatggaatccattgtctaaatcaccaagaggctgggcgcggtggctcacgcctgtaatcccagtactttgggaggccgaggcgggcggatcacctgaggtcgggagttctagaccagcctgaccaacatggagaaaccctgtctctactaaaaacacaaaattagcagggcgtggttggcacatgcctgtaatccctgctactcgggaggctgaggcaggagaatcgcttgaactcaaagcccccactttgagttgtcccacctttctgaaccaaaacaatgtatttcttaaatgtatttgattgatgtgtcatacttccctaaaatatataaaaccaagctgtaccccaaccaccttgggcacacgttctcaggacttcctgagggctgtgtcatgggccatggtcactcatatttgactcagaataaatctcttaaaatactttacagaatttgactcttttcaacaacaatatgccaatatgtataggaaatcactagtcaaattaatttatcagtgctatttgatagtttgtgaaatatctttgtatataaacaatatgaactgataaagaaaaaatatagttctgatataaagaagcagagttctttgacaagctgagtgaagagaatttaatcatgaaggatccttggatattatttagtttttagacatcatgtagtccaagatctgttctgaaaacatacctggttcaaaatgcagatttcctcaaaatgtctacatcagtatcaaatgaaatatataacaatgttcattggtttcttcttctttatgtcattaagttgcttcaatagcaatagactggcaagtgcattctgccaccttggacttgtgattcactcaggagaatttaacactgtgattaaaaaaagtaaaagggatttagtatttctaaggctgactgccttggcaagacactgtagttcaaatcagcatgcatccattttgaatattaagtaggaaagtgaaataaatttttggtagaggcttagaaaaatataaaacactgtcattctgaggttagttttcagctccattgatttttgtcttttatacctcaatatgattaaaaaaaaagctttccctaaatctgtctatataatgtttcaccattatggtacacatataatataatgcagactactctgttttccactctgacctttactacatagctggtttttgatagaagaatgtgggaggaaatactttttaaatagaattccaataatgcatctgtaaacataacctctcatcctttgaaatacgaagtgttaaccttgctgtaggatatattattccttttcgttttgataagccgtaagaggtagggacatagaattaaaatgcatagataactatggtcaggattacctaatattaacctaaattatgtcctgttaagcattgaataatgttaagtaaaatgttctattatcattataagttttgtaatactgtaaccgcccaacgggttcaccttgcccgctgcctagacagagacgatttagtaagacagggggactgcaatggagaaagagtaattcactcagagccggctgtgtgggagactggagttttattattactcaaatcagcctccctgagcatttggaggaatgcttggggattggagtttttaaagataacttgggccaggcacggtggctcatgcctgtaatcccagcactttgggaggccgaggcgggtggatcacctgagaccagcctggctaacgtggtgaaaccctgtcactactaaaaatgcaaaaattagctgggcgtggtggcaggcgcctctagtcccagctactcgggaggctgaggtaggagaattacttgttgagtccaggagacggaggttgctgtgagcctagatcatgccactgcactccagcctgggcaacagaggcagattccatctcaaaaaaaaaacattaaagataacttggcagtaggggcttgggaagtgggaagtactgattgttcggactgaagatggaatcataggggggtcgaagtgaggttttcttgttgtcttctgttcctgggtgggatcacagaactggttgagccaggtctgggtggtatcagctaatccatcaagtgcagggtttgcaaaatctctcaagcactgatcttaggttttaaaatagtgatgttatctccaggatcaatttggtgaggttcagactcttgcagccagaagctgcatgacccctaaacgtaattcctactcttgtagctagtttgttagtcctacaaaggcagactgggcccaaagcaagaagggagtctttttgggaaagggctatagtttcgtttcagagtcaaaccataaactaaattccttcccaaggttagtttggcctatgcctaggaatgaacaaggacagcttaaaggttagaagcaagatggagttgattaggtctaatctctttcactatcataatatcctcagttataatttttgcaaagacagtttcaagactaggaagttattttttgaagatatagttattgaataaaacagtgtgtaatttagctattgaccgatggagctgcaatttttctcagcagttaatcttttctttaagttacttcataattgaaatagctacttttatagattgattagtccctaaatataaatcaatcgtatatttaaaagggtttttattttaaacttatccttgaaagattgtgaataaaacaaattagaaggtctatgaaagttccagcctattgaaaaagagatttgtattgtatagactaagtaattcaattggaatacataaatcttaggctcttacaaagaaagagaaaaataaaatcttagactaagatttcacagtaccaatgccaatatagacaagatacctaaacaaatcaaagaaaaagttttgaatttcagtagacactgtcaaccgaggaaaatgacaagcctcaatcattttaggagatttatttgccaaaattaaggatgcacccgggagacaggtctacgcctttctccaaagatgattttgagggctccaaatttaaaggggaaagggtgggatattgagaagcacacagtttttacataaacaagggggggcagaggaaaaatgtgaagaatctgcattttacctaacacagacaaaatgggtaaggggaacaatcagctatgcatttttgtctggcaggctgggtgactgcacctgtaaagataagctatcaatttgcatggccatggagaagtttttaacagctcaccaggaatttccttgtgggcaaaatatgggggaggcgtgtagcctttcatctggtagccatctcatcgaggaaccaaaagggggaggcaggtttgtgtgactcagttcccagcttgacttttccctttgggtaaatgagtttggggtccaaaaatttaatttcttttcacagcacaccatattcttgatagttccaaatatccctttctggctctcctttgttttcttagaggaaccaggacatgctgataacctttcttaagttatgttaatatgtaaatgcagtcaacatctggggtattctaggcctttggtagctccacgaacagcaaatactttcacctggacagaccttctaaatacttggcaaaggaaagattattatgagccttatttagtttagtctgcagcagtgatattttattaccagcattctctgtaggtttggagaatatgaaagtaagctctgtattagccttaaactttctgagctggatttgaatcacctaacgctaaaaaaaaaaaaaaaaaaaaaaaatcagagtcaactactttctaagcatatgttttcgcaatacagatgaggttttatcagtagttttttacaagtctgtctagaaatttcatattctactcaatgcttctagttattaatgagaaatgaattttttcatgaaaatgtagttgcccttctattagaaactgttcatatgagctgtatctactcatcttaaataaaaatgtaatgctactcgattaaaataaatttcctcaaattaatatttcattttttaaaattttaaggtagaatgtaaaaaggaaaatgtataggaaattgaaaaaaaacagcatttatttatccagtttcctttagtcacagcatcactaagttgaaagagctgtagaagatatagtccaatgtcatcattttacaaaagtgaaaattgaaattctgaaatataaaatagtttcccaagtcacatagttaatgacagaactgaggctatttcacaacccaactctaatgctcatttttcttttatttatttatttatttatttatttgagacggagtctcactctgtcgcccaggctggagtgcagtggccgatctcggctcactgcaacctctgcctcccgggttcaagcgattctcctgtctcagcctcccgagtagctgggactacaggcgcctgccacctcgcccggctaatttttttgtatttttagtagagacggggtttcaccgtgttagccaggatggtctggattccctgacctcccaaagtgctaggattacaagcgtgagccactgtgcccagcctctaatgctcatttttctaaactgcactgatgatcacacaaccaggcataccaaaaaaaaaaaaaaaaaaaaaagaaggtatcagctataagctataacctttgctcttatggagcttataatttcataagaaagagtatacaagatgaacagctttgtatgatcaggacaggcaagatacgacatgcgctatttgtgcagaagacagctacatcatagcaggcaggctcatagatttgagagaggcttggcaaacagatagtatctgggatagggtgaggttctggtaaaaaaaaaaaaaatgtatagtcatcatagtgtcctactgttttaaatttttgaaacaaattctttcccaaagaattcctgaaatgtttggtattttgatatttttctcttaatggaaaatgcaaatgagttaaactattaatgattttcatcctataattgctacctactgtcatttgtgtggacaatttcaataggcatgttcactttttagatagagatttattataatgttttcttgtgacaatttgatatcattgtgttgtttacttatattcattttaaaattattcacttatcttttattccaccaagataatccatttatagatttaattcatcatgaggctcctaataatgagtttatgattaagaaaattttgctattagtttgttcagccatttttcaatttttttttaaatcatggcacctgagtcctaattataattaattgctaaagttgatcatttgaagcttctttgaagaattactcaagttgtttcagtgtaaattaactctaaaaaaggcagtgatttatattttctattttgggtgcaagagattaacaccagtgctagattatatttaaaacacttagtttattgattaacttccctgaagaacatatgaccttattttttcttaaaactatttgcagatctgaaatatttgaggaaggtcagtgagtgtataggggttagattcaggggaaggaacagtacttctactttaaccataatacctacctttttatctattttttttttttttggcctcaaaaagtgacatttattcaaagaaaaaaaatgacaagtctatcccttggctcccttcactcccctctcctgctgctcctcagcacccccgagattgagccctggctggggctgggcggcaggacagcccctcagatgaggtcagcaacattgggggcatttcctcaatggaggtgttgtagaagatctcaatgtcttgaagagtcctcttgtcttcttctgtcaccatgttaatagccacacctttacggccaaaccgtccacctcgactgattctgtggatatagttttccctgttggtgggaaggtcatagttgatgactaaagaaacctgctgcacatcaatgcctctggccagcaggtcagttgtaatcaaaactctgctagagccagaatgaaactccctcatgatcacgtcttgctccttttggtccatatctccatgcatggcggagacagtgaaatctcgagcatgcatcttctcagtgagccagtccaccttcctccgggtgttgatgaagatgacttcctgggtgatggtcagggtttcatacaagtcacatagtgtgtccagcttccactcctcttgttccacgttgatgtagaattggcggatgccctccagggtcaactcttccttcttgacaagaatccgaatggggtccctcatgaacttcttgatcacctcaagcatatcagaaggcattgtagctgacagcaaaactacctgggtgttgctgttgagcttttggaatatgtcatagatctggtccttgaatccacggcttaacatttcatcagctttatccagtacaaacatcttgatgtatttgggagacaggtatctctggttaagcatatcaaacacacggctaggggtacccacgatgatgtggggagcttccatctgcagtttctgcacctcagcacgcatattggtgcccctgacacaggcatgacaggaggcacccatgtagtctactagtgccatgaccaccttctgtatctgctgagccaattctcgagtgggtgctaggaccaaggcctgggtggcttttagatctaattcaatctgctgcagaatcgatatggcaaatgtggccattttcccagtcccagatcgggcttgagcgattacattataacccctgatacaaggtagaatggcttgctgctggatggcagagggcttctcaaaaccataggcatagatgtcacggagaagggactccgagaggttcatgtcatcaaagctgtcaacaatctcattccagttactctcaatgacgcattcgggctccatcccatcggggccattgtctctggatcaggaatcctggctcacagacatgatcctgagaaactagcctttttatctattttctatattgtggctttgattctgttgaatttccattaaaaaggtggagaggtgtattacaaattgtaaacttttctaacttttaaaaatcactttcctaaaggcaaagatcaaagtctttcaaggttctttatatcccaattatagtttctgcttcttcttcctttacacaaagactttgtctcatccaaacttattttctgaacattgtctaaacataccttgtggtttccttgctccctgacttgcataaacttgcagcttccatcttggaaactctcctctcctaccctgcacccctactggatcaaaagaatgtcacctgtcctttccatttatttatttatttatttatttatttatttatttatttttgagacggagtcttgctctgtcgcccaggctggagtgcaatggcacgaactcggctcactgcaacctctgcctcccgggttcaagcgattctcctgtctcagcctccccgagtagctgggattacaggcccccgccaccaagcccggctagggttttgccattttggtcaggctggtctcaaattcctgacctcaggtgatccgccctcctcagcctcccaaagtgttgggattacaggcatgagacactgtgcccagtccctttccatttttgaagttaaactctccccatgaagtcttctaattcataacaactggaactgacctctctatccattgatctccaataccaattatcatttattcttaccactactttatattgcagttatctatgtagactagatcaacatgactgtatttgagcactcaataaatatgtgttaaatgaaacacatatttattgtgaggtactcatagaccacaagttttgcagagtaataaagtttaattttattcttctagtttccagcagaaagaaaataatgaaaaaatatgtatttaactagaaggagactgtactagtcagggttttctagagggacagaactaacagtatatatgtatatattaaagggagtttattaaggagaactgactcacaggatcacaagatgaagtcccacgatagactgtctgcaagccgaagagctaggaagccagtagtggctcattcagagtcccaaaacctcgaaagtagggaagccaacagtttagccttcagtctgtggctgaaggcctgagagctcctagcaaaccactggtgtaaatccaagagtccaaaaactgaagaacttggagtttgatgttccaggacagggagcatccagaggaagactcagcatgtcggcttatcccaccttcttctgactgccttttctagctgcgctggcaggtgattggatgatgcccacccagactgagggtgagttggcctttcccagttcactgactcgaatgttaatctcctctggcaacaccctcacagacacacccagaaacaatactttgcatcctgcaatccaaacaaattgacacttaatattaaccatcacagatttctactactaagtctctctcatgtaacatagcttcagtggaattatattctcagatccatagtttctctgagcgatagttgcccataatttaaaatgtaaagtgtatactctgcagcagcatgtttgtaaggtgtgtaaatgtgagtgttttagttagctcaacacttagcttttaatgcttagaatgacatacttgaaatatatttttaatttttcttgagactttgaccagaactgggattaatccattcagacattattttggtattcatagatcatcttgaaggtatgttttattaaatagcctataatatttatttaattcaaaactgatttctaacttttaaaatttactcatggtggcatattaagttattgagctcaacagagaatcaaggaacaaagagtaacagctctttctaccatcttcttagattttcagattgatccaatacaacttttaatagcattggaggccaaaactaatattaatacattagcattaatgccggtgtagacagatgtagaaagctccaagaaaattaaattcttagataatctttctggctgttttcttattttagcaaatgtatttttattttatttattgatttatttatctattattatttttggagacaggttctccctctgttgcccaggctggagtgcagaggcacaatcacggctcattgtaactccccctcctgggctcaagcgatcctcactcctcagcctcttgagtagatgggactatagtcatgtgccaccacgcctagcaaatgttttgtatttttttgtagaaacagggtctcactatgttgcccaggctggtcttgagctcctgggctcaagcaatccaccatcctggacctctcatagtgctgggattacagacatgagccaccgtgctcagccagcaaatttattttataattaaaaaaaatcaatgttgggttagcagtgttatatagtatgtagaataccatcctgaggattaggaaaccttgttaggaattagttgtgtgtttttgggaaggcctcttttgcaatatgaacctgaacatgtttttctataaaatgagggttcagaacttggggatttctaagatttcctccagctcaatccttttatgtctttaaacttgtaaagggtagggaaaaagccctcaaaaagtaatactgtggtaggcatggtggctcacgcctgtaatcctagcactttgggaggccgaggcaggtggatcacctgaggtcaggagttcgagaccaggctggccaacatagcaaaaccctgtctctaccaaaatacaaaaattagccgagcgtggtggcggacacctataatcccagctacttgggaggctgaggcaggagactcacttggacctgggggtggggaggttccagtgagcggggatcgggccactttactccagccggggtgaaacaccaaaactccgtctcaaaaaaaaaaaaaaaagtaataccatattcacgcaaatactctctttattctcttgaagaacaaataacaaagggatatgtatatcctagtgtaagtgtttctttgagattcactctcttatttcctcatacaatgcaagggaaaggccatagactaattttttattaaagtaaatacaagtaatttttaatctagaggtttatttctgtagcagtagaaattcttccacattaaatacaggaaggaaaaaaaatgcttcagaagcacatttgaagagagctatattcaatttcacaggaaagactcaacatcaagtaacccctgggtcccttcaatgtattgctctaatttatacatcaaagtgagaacaagcttgctgaaacataaggcctgaaggaacaactcaatgtttctagcaaaatgtaattcagcagtcacacagtccatgaaatgctcattaacaagctgaggcaatatgtactgagtatacaagttcacctttgcatattaaggagcaatgtgtaataacatttatggctcttgctgttccacatgcagagaacacggaaattagagccgggctgtataaatgtcaaatgtatttatggtcatgcatgcatactgctgttttaaaacagtagtcttaacggccacaaatgtttcattcatatgcaggtagttggcagccaccttttttcttgagccacagattacttctgctatagaattccatcctacaacacagatctaccaccaacagttctatgaagccatatgcccttcagaaacactgcagttttggttttcccttcataataatgtacattatcttaatgtttcataaaaatatttcatttaaaggcagcaaagtaagacatcaggaaaaaaagatgcaactaacatgtaactaaacgagaccctaagccccagaattaaaatatggttttctgctgtactagcagcatgagatctcttcaccataaaatctccaagctcacaagaagggaagagggtggaatatatatatatgtattgactcattccaaagcattcttaaagaccttaaaaccagaaaacaatgaaattaacatgtcagctttcccttccacttctaggaagtcttgtctgactggcttaccctcacagccctccctcacatatgctttagagtataaacacgtatcttttcaaattaatagttctattagtattttttttcagatttgactcattccaaaatttattgcattttaatgcaaactaagcatgcatattattggtttggttataatgcagtcttttttttttttttttgagacggagtctcgctctgtcacctaggatggagtgcagtggcgcaatctcggctcactgcaagctccacctcccgggttcacgccattctcctgcctcagcctcctgagtagctgggactacaggcacccgccaccacacccagctaattttttgtatttttagtaaagacggggtttcaccgtgttatccaggatggttttgatctcctgacctcatgatccgccctcctcagcctcccaaagtgctgggattacaggcgtgagccaccacgcccggccagtataatgcagtcttgagataatctgataaattatttatttatttttaattttaattttttaattaatttatttggttttttttgagacagggtctctctgttgcccaggctggagtgctgtggtgccatcatgggtcactgcagcctccacatcccaggctcaagcaatttttcccacctcagcctcctgagtagctgggactacagggatgcaccaccacatccagctaatttttttaatttttggcagagatgaggtctcattatgttgcccatactggtctccaactcctgggctcaagtgatcctcccacttggcctcccaaagtgctgggattgcaggtgtgagccaccacacctagccattgattaattacttaaaaatcaaagcaatatgctattacagaaccagaccttataggcaacaaattacccatgtcacatactttttgaagtacattattgggtatagatattccacattaaccaaaagtactttattagaaagataggaaattgaaaaaatggagatggaattttgggagtccctaagcaattcaataatttctcaaaacaaacttaactcattagtaataaaacctatggttttccattattattttcattattttattatttctattatttctaaataaactaatttacataatgcatgtattcaagccaagctgaacagctagcacatttcttaccaagcagtgtgtgctcttaaatgcatatagaataagacacatttacgcattttctatttttattttacacatttaattgtttatctgtgaggtaaatcacattttaattttttgcaaaattaaacaagaggcttttacccaatagcattttggtctacctgtactttttgagagaagaaatagctttgtagtcttgatacatattgtcaggtactttaacatgatatttcataacagtttcaaaacacactgttagaatggaataagctaaaagggggcaggagtgatatgccatgatatttttcatgtaatacaaagtcatgcctataccatccatcatatgaactatgtagtaaagttgatgacttgtagaatggaatggcaccattttctaacttttcttttattttttttttttggagacggagtctctctctgtcaccccagttggagtgcagtggcgtgatcttggctcactgcaacctccgcctcctgggttcaagcagttctctgcctcagcctccccagtatctgggattataggcacctacaaccacgcctggctaatttttgtatttttagtagaggtggggtttcaccgtcttggccaggctggtcttgaacttctgacctcgtgatccacccacctcggcctctgaaagtgctgggattacaggcgtgcgccaccgcgcctggccaccattttctaacttttctaagatgtgaaggtaaacaaagagataagtatggtgaaaatgcagattcaaaataattagaaattcacttttgataaagtaattcaaatgctaattgtcaaattcatattttacacttttgatcattagccttgtatttttattgtgacatcatagtgaaagagtgatgccttttagattcatgaagaaagcagacccatacatgggtggaagctaatgtcttggtgcggaaaacagcatgtctttcacaaagcgacaattacaacatgactgcaatagtagttgacaatacaccttatttgaacatgtttagtcttctcaggcataaatgatttagactgaacaaaattaatagcatagggttctccaaaaacacttatctatagtgtatgcactatggattttgacatgttttaatcataaagtcttttctactaataataattattttagaggtgtggcagatattcatgtagtggcttcctttttctggtttaggcaattattaaattatctgactatgttttattctcttagtagtataagtatgtagctgagataaacaaacatctattatttttatgaaaattaattatgagttatgtatttttacattttagtagcatgatcattcattttaatcatagcttctaaaattttttttgttttgttttttatcttttttcttttttttttttgagacagagtcttgctctgtcacccaggctggagtgcagtggtgtgatcttggttcactgcaacctctgcctcttgggttcaagcgagtctccagcctcagcctcccaagtagctgggattacaggcgtctgccaccatggccagctaattttgtatttttagtagagatggggtttcaccaggttggccaggctggtctcgaactcctgaactcaggtgatccacccgcctcggcctcccaaaatgctgggattacaggcgtgagccaccacgccccagcctaaaattgtttttaatccaatctaagaattagcccagttactcccattgagtaatttaggtatttgtaaacatattatgttgagtcactagggtgtcttgtgccatcagtgcacacttgtcctcatctaatatgtgtgtactctgtcacacaatgcttctcctatttcttggaccgtattagcaataattgaatagttgaagcaaaaatttttaaatgtaaacaaagatgatatcaatttttcaatttttattgattttactttatttatttatttatttattttttgagatggagtctctctgttgccaggctggagtacagtggcgcaatctcggctcactgcaacctccaccttccgtgttcaagcgattctcctgcctcggcctcccgagtagctgggactacaggcatgcaccaccatgcctagctaatttttgtatttttagtagagatggggtttcaccatgttgagcgacagagcgagactccctttcaaagaaaaaagaagcagtcatttatgttttttttgttttgttttgttttgttttttgaaacggagtctcactcttgttgccgaggctggagagcagtggcacgatctcagctaactgcaacctccacctcccgggttcaagcttctccttcctcagcttcccgagtagctgggattacaggtgtctgccaccatgcccggctaatttttgcatttttggtagagatggggttttggcatgttggccaggctggtctcgaactcctgacctcaggtgatctgtccacctcagcctccaaagtgctggaattacaggtgtgagtcactgtgcccagccacagtcacctcttgaaaaaccaaatccaaccacaacgttaaccacaacattattcctatccctgaaataaatataatgaaaccatttgggaaacaacttttgaaattattgagccatgaactggttggtgttttcatgaccagtttctaaatggcttctatgataagtctttagttcataatgtgtgtttctttctgtcatacttaacatgcctattatatttatgaaacttactagaaattcctctacaaagaaaagaaaaaaataaaagaatcgatggatgtcacattaaatagtggtatagtgagaatgaaggccaagtgatattcttgagtacttaatgtttacatttaagaaaatcgtaatctgggccaggagcaggcagtggctcacacctgtaatcccagcactttggtaggccgaggcgagtagatcacctgaggtcgggagtttgagacccgcctggccaacatggtgaaaccttgtctctactaaaattgcaaaacttacctgggagtggtggtgggcacctgtaattccagctactcgggaggctgaggcaggagagttgcttgaacctgggaggtgaaggttccagtgagctgagatcatgccactgcactccagcctgggcgacagagtgacactgcatctcaataaataaatttaaataaatacatacatacaaaaataaaatcataatctgaatgtattgccctccatctaccctttgctttaaccatttaccctatgctttaactacggcaactatggtttctggagcatgaacactgtcctgtatcacattttggggaaagtttattccttacctgaaattcctgtcccaatcctcacccactacatgttggcctatgtaaacttcttctgtaatgccaaccaattttctctaccaagttgtctttgattttctctgcctagataaatactactttccttctgtaactcaccacagcatgttcttattactactcggttcatcacaatctagtgatttttgtatatattagaagactgtaagtttcttgtgggcagtaaccatacaatttatcattgtcacaccacctactcaacctgtaagtgtcgtttctcagaggtcagtactaggccaccatctactttttttctaagacctttctcttgatggtatcatatcctatggtattaaataccatttctatgcatatgactctcctttttctccaaacttgtgtctctaactgcctacgctgacataagtcacaggcatcttaaattttaatagcttttctgctgcaccaaacctagttccttcttcatcatctctatttcattaaatggtactaatactggcccagtttctctccttatttcttctactccaacctagattcagtccctcaccagactctatttattctgcctccaaactctgtcatactcatcaacttctctccatctttactgatatcacactaaatcaggccgttggccatccaccacacactcttgtatcagtatcctagagtctcgcaaactttcattctcacatctcatcaatcacattcttctcagaatagacagaatgatattcaaaacctaaataataatgtcttcccaatccatttagaataaaactcaaatctttacaatgacctacaatatcctgcctgatttgactcttttctatgtcattccactttcctccttgcttactatatattccaggcacactggtctccatttttaatttttatcaaataagggaagtgctgtcctgcctctgtgtctttgcccttgctctgttttctgcctaggacactgccacacccaccatacttctcatacttcaagttgcagcttaaaagtcatttccttagagatgctgtgtataacactactatctattaagtcagttctgttgtgctaccttattcttcttttcctctattttatgtgtcacatattataattaagatatacttcagtggttacaactcaggtgccacgggagccaaggcaggtgaaataaatgggtaaaataggcctagtacaagccaggtgtggtagctcccacttgcaatcccagcactttggcaggctgaggcgggcggatcaactgaaattggagttggagaccagcctgaccaacagagagaaaccctgtctctactaaaaatacaaaattagctcgacgtggtggtgcatacctgaaatcccagctactcaggaggctgaaacaggagaatcgcttgaacctgggagatggaggttgcagtgaggtgagatcgcaccactgcaccccagcctgggcaacaagagcaaaactccatttaaaaaaaaaaaataggcctagtataataccgcaagaggtgtgactagcactggagatgacattctggatctaaaattggcaatagctatttagtcccaggccatttgggagtagggcctatgttgaaagcatcccaaggttttcaagacaaacagggaatctgaatgttaatgtaaatattccatattttttcatgttgtaaaacaattaatatatttgaactaaaatgcagaccaaacaaaacatgtctgctgaacatttctgtccctgggagtccaatttgtgatctctgatttatttatgcatttgtttgtttgttgcttatctttcctactaaattgtgagctccatgtgggttagggaacatgtctgtctcgctcatcactgtatttctactgcctaaggaatgtctggcacatagtatgaactcaacatgtgttgcatgaatggatgaatagatttaaattttatgcacatactgtttcatcgtgctttctgattgaaagaataacaaatgcaatttaatattgaattattagaaaataatagtataggagaggcaggcaacatttagttctataatccattaaggaaagttccaatcaaatatgaaaatatattaacatgataatgcttataaatatagtatcttcaacattagtgatattatgtccttttagtcaaaacagtggcattaaaaaattacaatggtaatgcatgcaataaagttattcatattgattatatgtattttaaattcctataaaggtctcaaaaatttgacattgccgcaggcatagtcttccatatccaaacacaaatgggagagttttgtttgtcattgttacacaaggtctaactaaaagtaatgagactggttttgatgacttagttttgatgacttagttattatctgtctcattgcttcataggtacattatgtaacagtagacaatagtaattattgtgagttccttatatggaactttcttgaagtgaactaaattatttttgacctcatgataaatgtttgcccttttaaggatgttactaatatttataggacatttgctagactttttttgtttgtttgtttttgttttttatttttttattttactttaagttctagggtacatgtgcacaatgtacaggtttgttacatatgtatacacgtgccatgttggtgtgctgcactcgttaactcgtcatttacattaggtatatctcctaatgctattcctcccccctccctccacccccctacatttgctagtcttttaaaagtaaacttgaggctgggtgcggtgtcccacgcctgtaatcccagcactttgggaggccgaggcaggtggatcacctgaggtcaggagttcaagaccagtatggccaacatggttaaacctcgtctctactaaaaatacaaaaatcagctggtcatggttgcatgcacctgtaatcccagctactcgggaggctgaggcagaagaattgcttgaacccgggaggtggaggttgcagtaaaccgagattgcaccattgcactccagcctgggtgacaagaatgaaactctgtctcaaaaaaataaaataaaataaaataaaataagattataaactgtgttttctgattagttcaagacagcaccaaagtaatccttaacaattgaagaggaattgttgctttctaagcacatatgcatttatgttctcctactgtttaatacatcatgacagtcacaaatgttttaattaaacattgaaaatataaaaatgttctctcgccgggagtggtggctcacacctgtaatcccagcactttgggagactgaggcaggtggatcacctgaggtgaggagttcgaaaccagcctgaacaacatggagaaaccctgtgtctactaaaaatacaaaattagcgggtgtggtggcacatgcctgtaatcccagctactccagaggccgaggcaggtgaatcgctttaacctgggaagcagaggttgcagtgagctgagatcatgccattgcactccagtctgggcaacaagagcaaaactctgtctcaaaaaataaaaaataaaaaataaaaaaataaattaaaataaattttaaaaaaatctcttttttgattttaaataaattttttaccagattgaagatatgtggggagtgtgtgtgtgtgtgtgtgtgtgtgtgtgtgtgtgtgtttgtgtgtattagattgggttttgaggggaaaaaatttaaagtatgggagaatctaattttaaaaataatataattgatgttctcagaggaatatgtatttcttacctttgtttgaaatatgttaaaaaaaaagtttcattgccaatgatgtcagtatttcaccaatggaagctgatttttgttgcctaaaagcatgatttttattaaattcactgtttgattcagttgtaattcaagacaagtctttcctttttcattttaatctttcttaatgagcatatctagtgcagaaatgttcataagtgtttgaaaactcatcctatgtaaataatgaaaatgattttaggatagtatgaaaaggagagatatatgaatctaattattactactagtaaacatatatgttttatctagtgtatttattgccaagcccctatgtatattgttaaaatgtatagttattaaattatatgttataaatattaataggtgctgtaatatgccatgtcatttattggtgttttcattttcctctaatatagatgttaataatgagtgctttccgtaccagccaaaaatttgaataccccaattcctggattcatttgctttattccctccactgttaaattagattgattatagtatttggttataattatgctgaaattgtattttgagaattgaaacagcagtcttaaatcctttttgaaatttgtcagggtttaaataaataatttaagtatcacatcagaagcagccacatagttatctttccgcccactttttttttttttttttttttgagacggagtctcgccctgccgccctggctggagtgcagtggcctgatctcagctcactgtaacctctgcctcccaggttcaagggattctcctgcctcagcctcccaagtagctgggactacaggtgcgtgccaccaagccaggctaactgttttgtattttcagtagagacggggtttcaccatgttagccagcatgatctcgagctcctgacctcatgatccgcccacctcagcctcccaaagtgctgtgattacaggcataagccaccacacccagccttacccttccccctttctaagagtcaaataactctacccaaacctaaaatatcaatttaatgcaaagctattggttttatgttactgttatggtgattattgaataagttagactatggttgaagtggggagctagttattacaaaacagtaaatagccaaaagagtaattttgtctcagaagcagacattttggttagaattagcttgattctctatttggtatgtgaagatttgtaattatatgtgtaaaatttctattattttaattctttcaccaatggatgcaagtaaggtgctacagttaattataatgaatgtggaagcaatttgaaatactagtaaatgctttacaaacgtaaaacagtcttctgatgggagtatgcactaagtggtatttactgaaagagaaaataaatcattgatcttacatctctacactcactctccttggatttcagtcagtatggaatacacctgctgaaaaataatgttctaggaattgtgccttggacagaaaagaaagacacaaataactaaaaaaaaaataggactcttgcctgcaatctctcagcattagccttttttttttttttctggagactgagtctgcctgttgttgcccaggctgaagtccaatgatgcgatctcggctcactgcaacctctgcctcccgggttcaagtgattctcctgcttcagcctccagagtagctgggattacaggtgtgcgccaccacgcctggctaattttggtaattttagtagagacgggggtttcaccatgtaggccaggttggtctcaaactcctgacttcaggtgatctgcctgcctcggcctcccaaagtgctgggattacaggtgtgagccaccacacctggcctcagcattagttttataagatgattcctgtttaatcagaaaataattttttacaaattaaaaaaataaatgaacaaaaggcagattatgtgtcaaaattgattcatttcacattttctattacaataatttcgtattaatagaagaggttttctcaggtgatataattaatattatagcagcataatgttctggacatacctaggaatgcaaacatatacaggacattataattattataattttcattgttgaaatggatgtttgccatatatatcaagaaaataaataaataaataacaattaagaattcttatttttattcagttttcacctggaaatgaataccataaatagtgtatatttctaattaatttccttaacattgtaggggaggggaaaaagtcttttcccaggccaggcacggtggctcacgcctgtaatcccagcactttgggaggccgaggcaggcggatcatgaggtcaggagttcaagaccagcctgaccaacatggagaagcccctgtctctactaaaaatacaaaattagccaggcatggtggtgcacgcctgtaataccaactattcacgaggctaaggcaggagaattgcgtgaacccgggaggcagaggttgcagtgagccgagatcgtgccattgcactacagcctgggcaacagagcgagactccgtcccccacctccgtgccaaaaaaaagtctcttccttctacccattttaggtttattgcctgtggccccataaaccaaactgacaaaagactaattaaaaactgaaaagcatacaaatttatttagtataagttttataggacaagggagacttcatgaggaaatgaaatccaaagaagtggttaagcctgagtgtttttaaactaggcatgaggaaaggtggaatgttgtagaaaaatgctatatgaccaaaaaggtatgcgctaaggctagtaaaatgagggaaacttagaaagacctgttttctcagattcctgtaggcatccctcccttctcttaagagagaggatacttctttccttcaggggtagggagggctcacataaggatctcatgaatagctccatgggagacagaaaggtcagagaggtctttctgtacctgtcttttttcaaagttcttccacataaaatattcaatatgccaagatgctgtatttgggggtagtgtgtttttaaccccaacaacatcattctgtgagatagtttgtacttttcgtgagtaaatggcttatacgcgcacacacacacgcacacgcacacgcacacatacacatttccaaatttaggatctgatttttcttattgtaatataaatccctatatatgtatgtttaaaatatctgcaatatatgcacatataaaatacatgtaatatatgcacatatgtaacatcaggacaatcagaacaacatttttaatattggtaatctattattcattaaacaaaaatttggcacatattgacaaaattcttgctttctgttattattgtaaagtatttcacttatttactcctatattttcatttcttacaaaaattccttgactagccatctagtctaactatgttttagcatgtttctactagatcagtagaaaaactgctagcagtttacatctttaaaaaaaatttattattgagtccgggcatggtggctcatgcctgtaatcatgccagcactttgggaggccaaggtgggcagatcacctgaggtcaggagttcgagaccagcctgaccaacatggagaaaccccatctctactaaaaatacaaaattagccaggcgtggtggcacattttgagtagttccagctactcaggaggctgaggcaggagaatcgcttgaaccagggaggcagaggttgtggtgagccgagattgcgccattgcactccagcctgggcaacaagagtgaaactctgtctcaaaaaaaaaaaaaaaatctattattgaatcagtattaatattattaaagaaaaaagtaggtctttaaatttttcttgggatacttaattttatatctgtatcacattaattgcaattacaagcacattgctttgtgataagaatatataattttatgttaatggaacccattttatatgattattgtttgatatactcgacattctttttatggtacagtaggtacaatgacctagaaagaatattaactcattttttgcacagataccctgctactacttgaaaagaatatccatggaaatatgtaaaaaaaaaaaacccatatacaccttctcattttaggtgtttgttggaatgcaacttcctgagaaaatttcagttatgggtacaaaacacattaccacttaacaggatgccctcataatattaaagacaatatactctgaatcatgatatacacttgaatgtacattactgaattattgcctgaacaagatggatttctaatgtcttagattccatttaaaaaatgaatagttttattctattaactgtgattgatatttacttagcttaaagatatgtacagtgttgattttacctttcaaagtcctaaagtgaggacattttttatgggtttgaatttttatggatttgaattttaaatcaagagatagaaaaagaaaataaatgttaaggaggatttacttacgtgaaacacagcaagagttataaactttcccttgagtcaggtgaggaaataacttaattttgttcccggaccaaactgagggtcgggctgctatttctcgcagcccaataaggggatgcagatgaattgggaaggaagagagttttatttctgcaaccagttacagggagaaggcgtggaatttatctccacaccaactcaaaattacaaagttttccagagcttatataccttctaagctatatgtctacatgtaagtgtgcatccatttaaagacataagtgattaacttcttttgatctatgagtaaggtctgagtcctgaagatcttcctctagagcctcagtacatttacttaatccaaatgggtccaggtgctagggtaattacccttatcttgtctcctgctaaatcacggaggtttggggagttcctggaggcctggggagtttcttcagacccccaataaaatcctaaatgggccttgttaagaattcctttgttattttgtcatgttttaaggcctaggaaaggcctaggcaaaactcttggtgggcttttgttacattccagactttgtataagggcactggcttttttagcttttaatatttaacttgtggccgggggtagtggctcacgcctataatcccagcactttgggaggccgaggtgggaggatcacctgaggtcaggcgttggagaccagcctggccaacatggtgaaaccctgtctctactaaaaatacaaaaaaaaaaaaattagctgggcgtggtggtgggggcctgtaatcccagctactcgggaggctaaggcaggagaatcacttaaacccgggaggcagagattgcagtgagccaagattgcgctattgtactgcagcctgggcaacaagagcaaaactctgtctcaaaaaaaaaaaaaaaaaaaggtcaggcgcagtggctcacgcttgtaatcccagcccctctttggtgaggccgaggcagttggctcaagaggtcaagagatcaagaccattctggccaacatggtgaaacctcgtctctactaaaaatacaaaaattagccgggcgtggtggtgtgtgcatgtagtcccagctacttggtaggctgaggcaggagaatcgcttgaacccgggaggcagaggttgcagtgagccgagatcacgccactgcactccagcctgggcgacagagtgaaactccgtctcaaaagaaaaaaagaaattatatatatacacgtatatatatatacgtgtatatatatatatacgtatatatatatatatatatatatatgtatatgtttaacttaactgcttagtcagtactgaaacagctgttatggaagcctgcgttattgagacctggcctgccacagtatcacatgagataatttttctttaattttcagcatcattcacagtttgttctaatctaaataattaacagaaaaataaactccattggattaacaagaattcaaatccttttcaattaataattttaaattctgacatttcgtaatatttaaaaatgccatcaaggaagtacatgtttagaaggaaaacaacacaaaattcaatattcatgactagtctttttaagaggttcttaaatggaaaactgcattttaaaattttaaatttcatgtaaaataattttataattaatgacattgcacattcgtttatatatgaagagaatataatcacatcaagtagattttagactttaaaaatgtggtaattagcttacaaaaatgtctaatgccattatgctaactagttctgacatcctttatgaatcgtgaacgataatttatattttgctattatcaagtctgaatgctttgttcacattagcctggataaaaattcaggtacttttaggaaattattttgaaacttttcacagatacctggaatcataagcaactgtggctttttgctgtttattttttttctttgtttctttgagacggagtttactcttgttgcccaggctggagtgcaatgggacaacctcggctcaccacaacctctacctcctgggttcaagcgattctcctgcctccgcctcccgagtagctgggattgcaggagcctgctaccacgccaggctaattttgtatttttagtagagttggggtttctccatgttggtcaggttggtcttgaactccccacctcaggtgatcacccagcctcggcctcccaaagtgctgtgattacaggcatgagccaccgctcccggccaaatgttttattgtttatgagaaaccacatatcttagaatacaaggacaatacaaatggactgtgcatagagagggacagactatttcaagagggaaaaaatacacatgtattctggaaatggattgtaaaccaaaaagtatctgagacaggtctcaatcaacttagaaagtttatcttgccaaggttaaggatgcacccatgacatagcctcaggaggtcctatgccatgtgcccaaagtggtaggggtaccgcttggttttatacattttagggagacatgagccttctatcaatatatgtaagatgtacattggatcagtctggaaaggtgggacaacttgaagtggggaggggactttcaggtcataggtagataagagacaaacaattgcattcttttgagtttctgattagcgtttcacggaatgcacaatttacaggaataatcatttatgcctaagtctaggttagtgaaacaatagggtaaaggaagcaatcagatatgcatttgtctcacatgagcagagggatgactttgagttctgcctgtcctttgtccacaaggaatttccttgtgggcaaattgtgagggaggtatgtcgttttttggtttgtttgtttttttaatttttgtaactatcatatttaggaataggatgggaggcaggtttgcctgatgcagttcccagcttgacatttctttttagcttagggattttggggtcccaagatttcttttcctttcacagaaagatgttttcttcttaatgaaactaattactttgacaatatgttttacaaaacaagcaaaaaaaaaaaaaaaaaaaaagatgagagtatgtttcattgccaggaatgtgttaccgaaaaggcgtctcgatccagacctcaaaagagggttcttggatcttgtgcaagaaaaaatttggggtgagtccatagagtaaagtgaaagcacgtttattaggagagtaaaggaatacaaaaatggctactccatggacatttttatggtaatttcttgattatatgctaaacaaatggtgggttattcatgtgtcctctttttcgagcatatagggtcacttcctgatgttaccacgtatttgttaactgtcatggcactggggggaatatagcagtgaggacaaccagaggtcactcttgttgccatcttggttttggtgggttttagctgacttctttactgcagcctgctttatcagcaaggtctttatgacctgtattttgtgcccacttcctatctcatcctgtgtcttagaatgccttaaccgtctgggaatgcagcccagtaggactcagtctcattttacccagcccctattcaagatggagttgctcaggttcaaatgcctctgacaacaggaaggactatttctagatattacaaataaatatatatatttggaaataaaaataaggtcctagagagagagtgttttcattgtattaaaaatggtagtctgttggattttagttccccattttactatgaactaatgaaacagcagctttaatgcattttatagtggaatcatgttattcgtcttctctgagttcagagttttttatcctaccttctgttcctctcttcagtatctcttaactaaaagggcaagtagcatcattcattgtctcatcacatccattttgtcacaatgatagtgtaataaagtccattatttctaagaaatgaatatcccatccaggaatgaataatttcttcaagtatagtaacagcactctttattgtataggccatgatgattttgtacagtaaaagattctatgtggtaggcatgatttctttttttggtgagaggaaggaaggtactacatttcattaatattctgttttattattctaataggagtgataaaatatgtccctcaagtgctggtgcaagaatagggtttatgtttcattataaatattattgtgaacactgcccaaggaaattattatatgtcttcttggagagagtataatatgctaataaaaatcaagctgtacagtaccctgtagctctgactttagtcctgtgatcattatgtacatagaagtgtgtgcgtgtgtgtgtgtgtgtgtgtgtgtgtgtgtgtatggtggaatacatgaagtcaattggaggatctgccctttgtgtataattggaatgaaaattattatcttggtgaagaaaatctgagctgccaatcttcgataatgagaaagtaatagcagagtcgagaacacacatactgtaatttaaagatgacatatgcaaaaaaaatgtcattatctctaaacaaaaatatttgggagagagtgatagattgctcacttgtaattattcagtcaataattggttttcatttgcaaattacaagcacatggcaagaaagtcttatgtgttcaaattaagacactggaatactaattagtcccatattagctgttaagcactattcattagcaaagcaaagaaataaaagtcaaacatcttgttgaaattgtaggtgacttctgagcaaagatttgaaagacttgagggagtaatcatgtggctatttgggggaagcttattccaaacagaaggaacaaaaatacaaaggcactagatgtacgtgtgacgtagacagcaagaataccagaatctctggagcccgaggaacaaagggaagaggaataggagataaggtcagagagacaacaggggatcagatcttgtagagtaggagtcagcaaactgcacttatttttagatacctcaggagataagaataatttttacatgtattaaatggttaaaaaataagcccaagaaaaatgttacttcacatgtgaaaatcttgttgaattcaaattttagttccataaataaaggtttattggaatccagccatgctcattctttttcatactgcctgtggctgctttcatcccacaggggtataactgagttgttgcaaaagacatgatggggccccatgaagcctgaaatatttgctatctgttcaattacagaaactgcctactgacccctgttgtagatagagccttgcagggcattttaagagctttaacttttaatcagtgtgacgggaaaccctttggtaggtgctgagcagaggaattacatgagctagttttctctttaaacaggatcactttatctactatctgctatgataataaatttgggaaggggtaggaagtggatattttcattttccctaaaaatttttaccttcacaataataaatcaaatctaataggcctgcaggttttctctactcgtcatttttgtttcttttttctttttttttttttcttgagacagaatctcatattgttgcccaggctggagtgcagtggctattcaaaggactaatcatggctcactgcagcctcaaactcctggccttgagggatccttccaccttagccttccaagtagctgggactacaggcacactccactatgcccagttagtcttcttatactacaagcaaatatatacatagacaacagtgtatacatatacacacataccattagtatgcatattaagtattattataaaataaacttggttgatttctgttaacctatagaataatggaaacatagtctttttgtcccttaaaaaagtcatcttgcagagcttacaatttaagttgaagaatgtctgctgtagcaaagctcaacttcaagcagctttaatggctgccaagtactatgttgtccttagttctagcaggcaatgaagcatataggtttcttctaagatgccattaaaataagaaaaacgttttcatatttgttttagtatataagatccttttcatggcaacagagtcattgggatataaatcacataccatacaattgacccatttaaagtgcacaacaaaatggcttttagtatattcacagcattttgcaactaccactacaattaattttaaaatatgttcctcaaccccaaaagaaacactatacctgttaaaagtcacccccaatcctaccattctacccacctgtcaacccagctcctagcaaccactaatctttctgtatcaaaagatttgcttattcgggatatttcatataaatgaaataatataatatgtgatattttgttactggcatctttcacttagcataatgttttatttatttattaatttattttgagttccagggtgcatgagcagaatgcacaggtttgttacataggtaaacctgtgccatggtggtttgctgcacagatcatctcttcacctaggtattaagcctagcatccattagctattttttctgatgctctccgtcccccctcctctccacccccgacagaccctagtgtgtattgttcccctccctgcacccatgtgttctcactgttcagctcccacttataagtgagaacatgcagtgtttggttttgttcctgcattagtttactaaggataatggcttccagctccatccatgtccctgcaaaggacatgatctcattcctttttatggctgcatagtattccatggtggatatgtaccacattttctttatccactctgtcattgatgggcaactgggttgattccttgtctttgctattgtgaatagtgctgaaagcataatgttctataaaggctttttttaatggtatgttatgaaaactggcatgtcctcagttttactctagcatcagaatatattttcattattattttccataaattatggcagcataaatatagtatgccattaaaattctataatttaaaaattaaagaataaaaatactttaaaattaaaattaaattaaatataaacaaaattaaaattaataattaatggatattttcctcaagtatgcattaatatgtgcattggaaatataatatcaaatataatatattctctgaatattgtaatagcctagggtatcaaagcacattgtaattattagttcttatattagtcttgacttaaaaagtgtccaatgtatcagagccctaaaattaaatgaccattcagtataatcataatgtgcaatggataatcatttgtagtattatattgagatccaaatatttagtttcatattattctactgaattagtgtcttttatcagtttcataatgtattgaacagtatttgtatacagaaataactacatcagaattccaatttcctaatacttttaggagtatacaaaaagaaatctcaaagtgaggccttccatcaacattatgtttcttaccaccaactttcctaggcttcacatgtacacaacacattttaattttattggacagaggagaatgttcaatctaggatgcaaatgttttggctaattgttaatggcaatagcagggtgtatgcccttgaaattgcatttacatatagattattttcacctctcctctttgattggtaatgtaaataaacattttaatttttcatgaaattcagttcatttttcttttcctttagtaaatacctggtattatctacagataccatttggaatgttttgaaaaaaaagtcaattttactctaaaacaagtctttttctttttctttctttctttcttttttttttttttttttttttgagatggagtcttgctcttgtcgcccaggctgaagtgcagtggcatgatctcagctcactgcaacctccgcctcccaggttcaagcgattctcctgcctcagcctcccaagtagctgggattataggcacccgccacatttttgtatttttagtagagatggggtttcgccatgttgaccagggtggtctcaagctcctgaccttgtgatccacctgcctcagcctcccaaagtgctgagattataggcatgagccacccctctagggctaaaacaagtctaatcaaaacgacagtagctgcacgtaaatgtacttcactcaaataaaatctgtagtttttctttatgaactatttatccatgagacaacaataagaaactttatcagaaagataatctattcagtgttgctgtgagtcatttcacaaatgttgtgataatttgttaatagttgataattaaacataatatacaaacaagggtttaggtggtatgattcagcagagaatgtgacatacataccttcattactaaaatgctattatagtgcctgggatctatcaataaagaagggactatttttctatattctgcccagttattcatatttatattaacatagcacatttatagaatcacttctaagaaaggattaaaattacctactgtccatgcccttctatccttccttttttttttttaatttcaaggagaaaagtgaaaggaggtaagaatcaagattaacagattgtaaaaaaaaatttttaactatagacataaataaacaatattttcaaaatttctaagtatatttcaaaagcagaattttgaaatatacagtattaatatatattgtgtatatttttaaaatgatgtgtgtccccacacatgtacatgtgaatgtgtatacatatatatgtattttatcatacatatgtataaaaaaggaagaggcatttatgagtttgataattatttcaaaagctattttatcagtattgatttttagttcaacatctaagtagacttgtaatttaatctctcttcaaaaatttttaatatttactaggctatgttatagaatatggttaactttatgaaaggctgtttgtaaatgactagtagctatagattttatttaggagaggcacagtaaaaatatgttttccaaaactgttgtgcaatttacttgagaacagtacataaaataaaacggtatgtaaaaataaagttatgattgtgcttttgtcactttttcctaactttgaagtaaaggcccttttacacctttttcttgtattaaaaacccaccaatgaaaatcacaaatcttgaaaaataaaaacatttacatataaatttatagaataaatggctttttttcaaaattatttgtcctgtgaatttctacctgccaacccacttatagcaaggtttgtaaaaacaaccagctctctgctgtaaagactcgttgctcaaaaatgtttatttagtgttagaatataagtggcttgtgtttcatcccctcatttagcatccaatctaagaggtacctgagagaatttatggaaatgaagacatactaataaatatgtattttgctttcatagttacagataaaagttgacgagtacataaaaaagctataaaaatgtctatataagtgttatacatttttatttattattaatctatcattaattttacatggggatgggacaggatcattcttctccagttgtgtctgtatacaatgccaccctctataggattgttattgatattatttaaaaaagaggaaacaggtggagagtagaaaactatacttactttattttagtccatttctcttaacattcctctcacagaagtgaattaatagcagcttgatatcaatggcatgcaggattttattggtaatcagtaatattgaatgttatatagtttttaaaaattctatattccatttttcattgtttatgttatttacctaagtgttaacattgcaaattagtatttcattattagtatgggcccataccttgtctgactgctgggtcagcaagtggaaattgcaacatgattaattacttagtttatttagaaaacgtaaaaagcaaaacaagagaatactgttaaaagatatcacatcataatttaagccaggcaaagacagaactattttaaaaagtgatgctataggttacattgaagacgaagctctttcgcttccccagtttaaattccatattgtttgtgagatacttgacgaaacagaaagatcatttaaacctaatgtttttttccaatgccattttcttcctcatcagttatgttgctatttttatatttataatatagccatgtgctttagtttaaccaattaacgatgcttatcctgtaattatttctaatgcaatatttttataatacatctattatgtgtatagtagtcacaactggtaagttaaatggcagaaataggtattctaggaaaacttgatatagttaattcccaacaataactctatacttaagaacatgtttctgattccctggaattgagatattctacttgttctaaatcatttgtgagttttaagatggaactattcaccccataaagttctgtatcattgttgaatattgtttcatatatgttattgtttgagtaaatcttatcagacaaggcagatgcaatttatacaattataagcttaatgtacattgtataaattaagttggattaattttagagatgatctcgaatttgtcagatagttgtaaaacacccttactctaatattgccatgtagactaggtgcttcaggtaaacaagtgctaaattcttttctttttttttttttttttttgagatggaattttgctcttgttggctggagtgcagtggagcaatctcggctcactgcaacctctgcctaccgggttcaagtgattctcctgcctcagcctccctagtagctgggattacaggcatgcgccaccatatccagctaattttgtatttttagtagagacagttggtccatgcatgtgcgcacaaacacacacacatctacacatacacatatccatgttggtcaggctggtcttgaactcctgacctcaggtgatctgccggcctcagccttccaaagtactgggattacaggcgtcagccactgtgcccggcccaagtgctaaattctttgtaggtcaaatgcagaaatagggattgaatgggtctattctgatgactgaggtaaccaaagtacaaattggtaagctaaatatttaattgttcagctactacttgtgaattacacacagttgcacatgcacacacacacatacagccattcaaagtattttattcattttacaaatacgggtaacttgtatttttttctgccatagatgaaggatcatctactatccttctttactgtgccttaatattttagtttgacaaccttatataagatggttctaatctttttttttttttttttttttttttttttttgagacggagtctcgctctgtcgcccaggtgggactgcggactgcagtggcgcaatctcggctcactgcaagctccgcttcccgggttcacgccattctcctgcctcagcctcccgagtagctgggactacaggcacccgccaccgtgcccggctaattttttttgtatttttagtagagacggggtttcaccttgttagccaggatggtctcgatctcctgacctcatgatccacccgcctcggcctcccaaagtgctgggattacaggcgtgagccaccgcgcccggcctggttctaatctttattgaaaatttttatccctaaattgtgtgtgtatatatatatacacacacagacacacacatacacattgatatatatacaccacacacacacagatgcatgcacatacacacacacacacacacacacatctacacatacacaaacctatatatgcatttaaaatgtttacaatgttctccagccaggcacggtggctcacgcctgtaatcctagcattttgggaggctaaggtgggaggattgctttggcccagaagtttgagaccagcctggttaacatagtgagacctctatctgtctaaaaaaagaaaaaatgtagctagatgtggtggcacatgcctgtagtttttggctactagggaggctgaggtgggaggatcatttaaggcagggaggtcaaggctgcagtgagctgtgactgtgaaactggactccaaactgggcaacagagtgagaccctgtcctaatgtcagtcctgaagaccacggggaaaatatctccaggccatgtcagagactttcatagcagcccctcccatcacaggcccagaggcccagaagtaaaaagtggtttcatgggcctggtgcagggttcctggtgcagggttcccatgctgtgtgaagcctagggacttggtgccctgtgtcccaacctctctagtcgtggctgaaaggggccaacgtagagcttgggctgtggcttcagagggcggaagccgcaagccttggcagcttccacgtggtgttgagcctgtgggtgcacagatgtcaagaattgtggtttgggaatctctgcctagaatttagaagaagatgtatggaaacacttggatgcccaggcaaaagtatgctgcaggggcggggtcctcatggagcacctctgctaaggcagtgaagaagggagatgtggggttggagcccccacacagaatccctactggggcactgcctagtggagctgtgagaagagggccactgtcctccagactccagaaaggtagatccactgactgcttgcaccctgcacctggaaaagccgcagacactcaatgccagtccgtgaaagcagccacaagggaggctgtaccttgcaaagccacaggggcagagctgcccaagaccatgggaacccacctcttgcatcagcgtgacctgtatgtgagacctggagtcaaaggaggtcattttggagctttaaaatttgactgccccattggatttcggatttgcataggccctgtagccccctttttttagacgatttcttccatttggaacagctgtatttacccaatacctgaacccccattgtatctaggaagtaaccagcttttgattttataggctcataggcagaagggacttgccttggctcagatgagactttggactggtgggcttttgggttaatgctgaaatgagttaaaactttgggggactgttgggaagccatgattggttttgaaatgtgaggacatgcgatttggaggggccaggggcgaaatgatatggtttggctgtgtccccaaccaaatctcaccttgaattgtatctcccagaattcccacgtgttgtgcgaaggacccagggggagatcattgaatcaactgggccagtctttcccgtgctattctcatgatagtgaatacgtcttatgagatctgataggtgtatcagggttttccgcttttgcttcttcctcattttcttttgctactgccatgtaagaagtgtctctcacctcccaccatgattctgaggcttctccagccatgtgtaactataagtccaattaaacctctttttcttcccagtcttgggtatgtctttatcacccaatacttaactttcaggtttgcctcctcctatactaaaatcctgtatggccagctatcctgatgtcattagtagtagactttcataggtttacataatttagctctgaatttttctttattcttcttcaaattgatgcagagggatgaaggaataacgttcacaaccattagaaatttatgcattgttaattttctcatgtatgatggcaaactgatttaatcatctgacctttgaactggatctacaaaattgcttgttgcatatacaaaatctaaatgatatggtgtcagtaaattatgtataaatgtcctgggggagctgccagtgtgaccatcctcctcaacagttattcttctaagtatactgttgatccatctatttggattgctttgtctattaaaaccattacaaaattaccatagtgtcagtttggttaataggcttgtctttcaaatgaacataacctgtagacagtgagatgattgtgcaaataaacaagctgcttgtatttaactcaagtatgtatacaatggctctaattttgtattcattaagtgtaaacaaagggactcagaaaaatgcgaggacagtcccaccacagattaaaaagggttgggactttcagagacgtattgctgcagtcatttggtgaatatttatgagcccaaatatctacagcttttatttattttcttttttatgatttattttgctttgtatggtctgtgagtagaaaactataaggcttcatggaaatcacctgatagttcatgtaaaggcaacattttccagagacttaagaaagtaataggaaaggctctggtattgaataaaattactttgctttataaatggtgcatgtagaagacagctaagttatattatttagaaaagatatagctgtggcaagaaaaatgtatgcattttattaggaaacagcagatttaaatttatttttaatattgtcagttataacagtaccaaaactcttagggttaatcagtgccagatatcttcaggcactcaaaatttgcaaataattaaacaaatggatggatcttattcaattaaactattaatataagaatacactaatttccttgaaaaatagaaacatgaaaggtttaattttgtatagttccaaaatttgtccaccccattgggcttttccacacttcatgatgacttagtaatgtttttcatctgttctatgatctctccaaagatgtttcagttccactttcttagaaactatttttcaaatataagtgtcaagctgttccaaagtttattttttcttattgtataatatatccatttagagaatgcaaaagcattaaattgttgcactgcctctggcctattgtcttgcaaatgtgctttgcacataagagacaacctctgaatatttttctttcatcaaaatcataaaacctaggagacattctatagaactgccatgagtaatattttttcataaacatcatatatatataggatatgttagcatactcctcttttcttcctgcctacgagaaagaatgggccaataaaaactgaactattattttgaaatttaattttgacaactgagaatccctaaagacattccagtcaggtacaacaatctttcctttctccctgggagtctattacactggaaacttgtgctgttgcatacaactgcttgcttttggggggtgggggtgagagggagcatacagtcctcctgtatgtgcaacttgtgcaatagctaagagtcaaaatgcctcccatgaggggcaatatggaatactggtttttgttctactaattaaatcctttatattctataagcacatctttccgttttctgcaaaacatcattaagcatttgggggttgacttttggacttttgggatatctctgagcaagtcagtattgcagaattaccctgatatttctttgtttgatgcctaaatacattcttaaaattgtaaaagacctgtttagtgtatctataaatgctacatagaatttgaagtttggataatttggaagttaaactacaacttgagtaataaatactcaaacatggcctagtgcagtggcttacacctataatcccagcactttgggaggctgaggtgggcagatcacctgaggtcaggagttcgagaccagcctggccagcaaggcgaaaccccatctctaataaaaatgcaaacattagccaggtgtggttgtccatgcctgtgatcccagctactctggaggctgaggcaggagaatggcttgaacccaggaggtggaggttgcagtgagccgagatcgcaccactgcactcaagcctgggcaacagactgagactccatctcaaaataaataaataaatactcagagactgaagctaatagatgtaacagaatttgatatgaggttacatttttatttatcttaaatgggaatgaaataaatagctcagtagaaacattattattattattattagtttactttcagaaagagggaattgaaatatggaaagtttaattcttcaaaccgttagcagaaacaaaatcaagaatggaactgtccaactatgtaaaatgtaattatttgtctttttaaatgaagatacaacctgacaaatttatttctcttatttgatcacaatctctaattgcaacattttctcggtatatgcccattgtgtgattttgtcttatgtcttcagattttttaaaaaaacttttacacattttattcccagggatcttcttttcagtgatcattctaatgtatgtttgaaaggaaaacgtcttcactgatttgagccagcaaaagttggcagtacagtgacaaataaacaagggttagagataagcaaaaggagagacttttatgtaaatcttactatttttaatcaattggcaagatgttctcaggtctttctaatatccagcagagaactcgattgaagtttaacttcttttgacaataaatcagtgattaatctgctacacacctatgtattaagaggggaattaccaagattgccaaaggcaggtagacaactttgaagcagaacattggaaaactgtctgacctgtgaccttttctctcctaccatgtagtcacactcctcgtttactgaacttctttctttcttttcctttcttttcttccttccttccttccttcctttctttctttctttctttctttttcttttctctctttctttctttttctttctctttccttttctttcttttctttctctttctcctttcttccttccttcattcctttccttctttcccttccttccttccttccttcccttccttccttccttccttccttccttccttccttccttccttccttccttccctccctccctccctccctcctttctttctttctttctttttcttttctctctttctttctttttctttctctttccttttctttcttttctttctctttctcctttcttccttccttcattcctttccttctttcccttccttccttccttccttccttccttccttccctccctccctccctccctccctccctccctccctccctcctttctttctttctttctttctttctttctttctttctttctttctccctttccctgtctctttcccttcctttttttttttttttgagacagagtcttgctcaggctggagtgcagtggcacaatctgggctcactgcaacctctgcgtcccaggttcaagcgattttcctgcctcagcctccgagtagctgggattacaggcatgcgccaccacacccagctaatttttatatttttagtagagacggagtttcaccatgttggccaggctggtctccaactcttgaactcaagtgatccactgcgtgggtctcccaaagtgctgggattataggcctgagccactgcgtcggcctgaatttctttctaatataaaggaatagcacctatgatagaacacattagaactgcctacttagcacagatagtgtagcataggcacatctaggcttacataaaataaattattattttgtttaaaatacttgctcctcagccacttaactgtttttttctttataagatcatctgcaagcataatttcaggaactggccttggaaacattgacatacatgtgtacttatatgtttatatatatatatatgtgtgtatatatacacacacacacacacacacacacacacacacataaatgttttttggagtgaaaatctggatcttagaaagttaatgctatatctggctttgtgtgtattgcatactccctttgtttagataattaatgctaaagaatttgaagaatcatttccaataatttccactgcaatacattgagctgggagtcagaggtacagccatagatgatttccctcacattatattttgtacaattagtagttttgatgttgctgaaaacattatcgaatgtataaaatatacttcaactttgccatcttcatctatcagaaacaagtgtatctgtatcgtaaaacatcaaccctataactgtgggtctgaaagttgcctgacaaagcagatgtgtacttttcccaattccagttgtggataactgagctcagtaattataattatgaaggctaggcctggcatagcaactgaatcagatttagagtgctaatgtctattttttgttccaatgtagagaataaatgtgcatatttagattgacttactgtgtctatatcagagaaagattagcattataagaactatatacttttcataaaattcagacaatccatttgtgacaagaatataggctggaatgagagatctctctctttctctcactctctctctatgtgtgtgtgtgtgtgtgtgtatatatatgtgtgtatatatatatatgtgtatatatatatatatgtatatatatggcataatcacaaaccaaattccaaggcataatcataaacacaatttcaggaatttttaataagatttgtctattgaagtgtaattgaagcacaataaactgtacttattttaaaattcaaaatgtacaatttgctcagttttgacatacgtgaaaacattgccatagtcatgagaattaacatagttgtcataactaaaagtttcctcatacccttttgcaatactttccttcttgccttcaccctgacccaaacaaccactaatatgtgtactgtaagtatatattagtttgctttttcaagaagtttatatcaatggaatcacacaatatgtgattttttggtatgtggcttcttttacttactgtgaggttttcaaggtttatccatgtggataaagtagcctgtactttattcctttttattgctaaataatattcaactttatggatacaacacagttcatttattcgttcatccattgataagcatttttgttgtttcctttttgtctattatggataattgatgctataaacatttgtgtgaaagtttttgtgtggatgtgtcttttcttttctcttggaaaaatatgtaagagtggagtagctggatcatatggttggtgtacatgtagctatttgagaaagtgccaaagtgtttttcttagtggttatgaaattttgcatttctcaccatcagtgtgtgtgagtgccagttccttcacatccttgccaacatttggtatggttgtctttttagttgtagccattctaaatgagtttgtaaaagtatgacattattgcttaaatttacattttcttaatgactgcagatgtcaagcatctcatggttatttttcatccattttttttttttggtaaaatgtctgtttacttttttcccatttcctcattgagttatttgtcttgctattaagtcaaacaagttattgatatattctggatacatttatgttcattcttaatgaacacttttgattcctgtagctttataataggtctcaggtttaaagagtttatgaattccatggattttcataggtcctttgcatttcaataaaaattttaagattggattttcagtttctataaaacaccatcttcctgatagtgagccttccaatccatgaacatagtatatatattcccatgtatttagttattacttaatttcccttggcaatattttatagtttttcatgtagaaatcttaaacaactttattagatttattccaaaaggattttatgttgtttggcattaatatgaatggttttgttaaatttcacgttccaattatttggtgctaatatgaaagaatacaaccttatatcacctaatctcactaaatttatttattaattattgtaattgttttgtggttcccctgtgatgtttcatataaaccgttatacttctgttttgtttgtttgcttgtattttgctttattcatattgctatcccttttagggaaatgttaaacaaagtgacaagaaccagtatccatgctttcttcctagtatcaaggggaaagcatttagtctttcaagtatgaatttagctctaaattttttttatattctttttcagtttgaggaatttacccgtcatttctagtttgcttagaatttttatttttattttatttatctatttatttatttatttttgagatggagtctcgccctgtcacccaggctggagtgcagtggcgccatctcggctcactgcaagctccgcctcccaggttcaagccattctcctgcctcagccttccgagtagctgggactacaggggcccgccaccgtgcctggctaattttttgtattttcagtagagacggggtttcaccgtgttacccaggatggtctcgatctcctgacctcgtgatccacctgcctcagcctcccaaagtgctgggattacaggcttgagccaccacgcccggcctagaatttttaaaaatacgaatagatgaattttgtcaaacgtattttctacatttttgaaatgttttttctctattttgttaattggcatattatatttattttcgaatataatttgtttttgaaattaaaattataatctatcttaattctacggttctttttcagagataaacaaaaaacttcacattagtatttattattatcgttacatatattttatttcatcatgtttgtagatatgactaaatatattttttcatcattatgaacaaagtttagttcatttacatattaaatcacaattattttattaattcatttaatttctatgtaactatttctctgtaaacctaagtttaaatatggctgaaactacataattttaaacattgtagatctaaaattttaggaggcaaatgtcaaaacaattaaggataagatactatagtaactagaggaagaaataagaaaaccatataagtaaggaaaacaatatatttgtgtagatgtactctaaaaccacacctatgtttggcacttatatcttttgacttcagtattccaatttttgaatgggccttctgccatactaacagatgtgtcgattgtgtagacctgccaaggaaacagaatatacataaaaacagtaaaaaaagaaattgtgctggcaattaagaagacttcattgtgcgcaagtgccttgccaaacatcaatgtatgcatatttatatttgagtagttccatccaacactgaagtcagaaaacaaaatcattttatgccagtaactgaatgaaatattactttgttttggtttatttttagtattagtcagatagtccagtcaatataattttatgtacttttcaattataatgcaaagtagtagactctttccccaaattaaaaaaaaatattaaatcaaatgtatattttcttgtatagcttcagttatccttcatgaacacttcttgattacttggagcactaaacttgttcatatggtgaaaggaaggtcattaagacaatgtactttagaattgcactttaaacttttgtttcaagagtctttgcttatttaaaataaatgaatatttttatgtttatgcatatatgcattcacaaaatactgatagaataatcctgtgaagctcacttcagaatgacaaagttttcttcattagcaaaaaactaaagtattaaacatttaaaattgtaatttaaaaatttaaaaaaatattttctatatttttattttatgtatgtatgtatgtatgtatttatttatttgtttatttattttttgagacggagtctagctctgttgcccaggttggagtgcagtggcgtgatctcggctcagtgcaacctccgcctcccaggttcaagtgcttctcctgcctcagtctcccaagtagctggtattacaggcacctggctaatttttgtatttttagtagagatggagttttgccatgttggccaggctggtcttgaactcccgacctcaggtgatccgcccaccttggcctcccaaagtgctgagattacaggcgtgagccaccgcacctggcctctttcgatactaactgctgataagacttagttaaattttttttgaaaacaggtttcccaagggggtatacttagcacattaaaacatgtatcacaaaatctgacaatcgacctacaggaggatgcatctgtatagttcctttgtctgaaattttaactttaatttttatgaaacaaatctaactggaataaaatgccaatcctattacagattgcaatgccatcttatattacatataaataaataaatacacacacacacacacacacacacacacacacagagaagacaatcctataaaacagagccgcactgagttttgtatttagcctagaaataataattaattgcttgtcagtgatttatagtggtttactttttatcaaactgacaaactaaataatgtaatagtaagtttaagcacagttaggtgtttattgaaatgtgaagtggtttcagatatttctcctgtaggtgattattttacttagagaatggaggcattttttatgttgcctgtatgtttactaatctttcaaaattgtatatcatttttattatctaaaggatttctctcattcactacactggtaggtgaagaagaagcaggcattcattgagatggtgagcatggcaggagcaacaagaattctatcatcaaggaaatttaaagttttggtaaagactatatattttaatgccaatgctaattctaaggaaacaacagatgtagcagcagttacgataaaaaccaagtgctcttgtctgttaagctgttttattgcaagtttctgtaatatttttgatgaaaacaaataacaaaggaggataaaagcaccattagcaacaagcaacaacaaaaagatagttattactggtagaagaacgccaaaagttaatgcctgtggaaatttttttaaatatgagccataaatgagcaggctaaatacaaatatagcacaaaaataggttgagacaactttgtaagagctgaactgtaaattgaattcaattttgatgaatgaactctgctgtgatgaggtgtgtatatgtaagtggaaatcagtctacctatctattgattggaaaggagggcatttgaccatcagttttttcagatttcattccattattaatcaagtttattatttaatgacattatataatgtaagtgatttaagatacttcaggataagatatttaaggcatttcaatatggaatctcttctatgccattaagaaaaaatcactttggtacatgacacatgagttaaattcccagtagttactctttgtcttagtctaattttgtcagtttttctgggacaatctggtttatgcacattattattgatacggaagtggggcagggaaactctgcgtagagaaaagcatgtccctggctagggctccaccccaaaggacctaggtgaggacaggcactcctgctttcccgcccaaatgttgcattttccaagaccaccctggcccaccatgcctccatcctgggcctataaaaacccgagaccctagcgggcagacacacaagcggctggacagcgtgaggaacacatcggcgggagaagacacaagcggctggtcatccagagcagatggcaaaatagctcgcccggcaggccattgactagtggaacaacacagagtctggccagagccgtcggagaaaagtccggtcaccgagcggcccgattccgggggaaaactatctcccttctggctcccccatctgcccagacctactcctactcaataaaatcttgcactcattctccaagcccacgtgtgatccgattcttcccgtacaccaaggcaggaaaccccgggatacagaaatccctctgtccttatgataaggaagggggtctgagttggttaacacaagccacctatagacagcaaaacaaagagcaccctgtaacacatcccaccggggcttcagctgtaaatatgcaccgctaaacactgccgtggtgtcagagccccacagcctgcccgtctgtatgctctcctttgagcatacagtggggcactgaagaagagagccacacccccatcgcatgccctgcgagagggacaggggaaccttgcctgtttaattatgatatgatatattaatactgacattcactctcaagaccgtactggttggattatcaatcctatagtctctttatctattattttctcattaaaaaatgctgctggagatgacccaaagatttaccatgtggagaaagcttaactctagttttaaattgaggttaaattattccattcctattccaaattaacattttactatcaaacctggtgctttaacagttttctttatctcaggaaatgttaataccatctttccacttcctcaggccaaaaaccttggcattgtcttttttctttcacacactttggctcttttttcaaaatatacctggaaacctctcgctccttatcacctctaccactaccactctggtccaagcctccattgactgtcacctcagttacttcaatagcatttttttttttttttttttctttcctgagacagagtctcgctctgtcacccaggctggagtgcagtggcgcaatctcggctcactgcaagctccgccgcccgggttcaagccattctcctgcctcagcctccggagtagctgggactacaggcgcccgccaccgcgcccggctaatttttttttgtatttttagtagagacggggtttcaccatatttgccaggatggtctcgatctcctgacctcgtgatccgcttgcctcggcttcccaaagccctgggattacaggcgtgagccaccgagcccggcagttacttcagtagcttcttaactgctctctctgcttcccctcctgtcccctccatgtcaagtctcaacaaagcagccagagagactcagatataactgagatcatggtatttctccgttcagaacacactatggtttgtcaatttacacagtaaagagcaaagacttcaagatcgttgagggcctcccctgtgacattttttatgacaaaataataaataaagagaccataggattgattatccaacaagtacactcttaagagggcacaacctgcaccccctccagttacctctcagacttcatctcctatccgccccgccattccttgttcacatagtccccttgttgtctcttgaagctgctgggtgtgctctttccttaggatctttgcactgactgattctattgcataaatatcacatgatatttatacgatgcaagttcttaccccttcaaatctttgcttaaatgtcaccttttcagtgaggtcttccctgaccatcctgttaaaaattgcaactatcctcccacacacatcaaacgcactccatataatctttccctgatctttttcagagcactagtaccatctaacataccatagtatttaataatttctaacgtatgcatttcatcctttctccctaactaaaatcactgtgaatgcagacatttctgtattgccagcacctagtagaatgtatggcctagaataggcactcaataaatgaatgaaggaatgtaacttataccccgttcttaacaattctagcatattagagttgttaatccattccagtaggaatttccattccttgcatagtttaatttgatatactaccatttatatactcattatgtgtttgtatgtatgtggaattggatggttaaaatcacatacaaagaatcacttcacacgtgtgaagtaaacatgctaacatgctttctgcataagaagtcaaaagacagcagtggtacttatatttaatttcaacttggataggcttaaaatgaccttcataagagagatttgaatacactttaactaaggcaggaggtttatgtagcaaatccattaccacttccaaaaatctgtcactggaatacaaaatccaatggttgcggtctgttctatgccaaaacataggtttaattattcagaagaccgttagagcacattttctaaacctaaaactcggcaaagaaattctacctaatgtcccttagctttgggagctatacactaaggcaccttcctggtgtgcaggattgtggcttttatgaacgtctgaattaaaacagttacctattagagagctaaagtcccctgttctgcctcaccttaaatttatcaaattgtttatcttctactattcctctggtgatcatggtaaataatgatttaattgcactgttaacaacctacaaatagtgtataatttttttattcctactgagtattaatgtaatttgcctttcattattaggaaagggttaaagtgaaggatatagatccatttaatggcaaaaggatagaaggattagtcaataaaccaaataaaaatgacagagtgtaaaagaaagttgtttcaatacatggtgagtcactataagaaaatgattttaaagcacgtcagggatatatttaaaatgaggtggttctggcaatacgttagtttttgttaaaatgacatttacattaaaatgaataaataattgttatagactcaaatacacttcatttgctctcggtcacattatcagtatccacttagaagctcagtttgaatttaaacacattttattcttacaaggtttgtgctttcatcatcaagattttcttttagaattttttgtgttaatttttataatatcaataaacaaataatatcaattatagtatttaatcatgttcttatgacatggaaaaaatcaattatatgttgaaaatcagtttatgaaagtctttctgctctggactataaaatatatgaaagtctttctgctctggactataaaatatcaagaaggccggtcgcggtagctcatgcctgtaatcccagcactttggggggctgaggtgggtggatcacctgagttcaggagttcgagaccagcctgactaacatggtgaaaccctgtctctaccgaaattacaaaaaaatcacctgggcgtggtggcaggcgcctgtaatcccagctgctggggaggctgaggcaggagaattgcctgaactggggaggcagaggttgccgtaagctgagattgtgccactgcactccagcctgggcaacaagagcaagactctttctagaaacaaaacaaaacaaaaatcaagaatacttttaatagttaataattttaaaatgctaaatacttgcacttcataagaaatgtatttattagatagagcctggccaacatggagaaactccatctctactaaaaatacaaaaattagctgggcgtggtggtgcgtgcctgtaatcacagccactcaggaggctgaggcacaagaattgcttgaacctgggaggcagaggttacagtaagtttagatcatgccactgcactccagcctgggtgacagagcaagagactgtctcaaaaaaaagaaaaaaagaaaaggaaatttatttaatagatagttgactccttactttgtctttgtatttattaactttgattttaagattgccgaatggtaatgttttctagtcttttttcagaatatatatatatttttgaaacagagtctagctctgtcgccaggctggagttcagtggtgggatctcggctcactgaaacctccgcctcctaggtttaagcgattctcctgcctcagcctcccgagtagctgaggttacaggcacgcactgccatttccagctaatttttgtatttttagtagagacagggtttcaccttgttggccaggatggtctggatctcctgacctcgtgatctgctcacctcggcctcccaaagtgctgggattacaggcgtgagccactgggcccagcctagaatagataatttttatatttagcaaactacacttgctttatttgtctgcattgttctgcactgactctaagattttaagcacaaaaataagtacatattacaaaaatatcttaatatctcatggattttgtagctactgtcaaattggcatgctaataattcttgctcttctaatataaatattaaaaagtaaagaaactttagcaggaatataaggtaaatattatagaagaacatatgaaataataatgagaaataaagtttggaagtcctagttaatggaatcatatgtaggtagaatctctcagtctgctgtattttcagatgtggatgtaggaggtttgctgtgttctctctcatgtgacccactgcaaaaattcaacatgtattgaatataaaaaaatattctacatagtggagaagaattcacatctatgaattctttgtatagtgtaaactcattatattatcattttaaaaatatattatcattttttaaagattccatagtctgagtaacggccagtatagtttagtattacaaaactcctgagaaagggttatgatactcaggagaataaaaaacacaagtgtctgtatgttttagagtataaagggaaattttctagaacaaataaaaaggtaattggtggtaaacttaacctcattgggattaaaaaaaaaaaggcaatttaagagtgtcaaaaaccaaattacaatgaatttagtttaaagacataattgacttttattagtgattctagaatcaggcaacatctcattctataaaacagaatgagtgctgaacagttgtttttttaaagtgcaaacaaggaaacagattaaaatgtggagtgacatcaggttacctcattttttttttttttttgtaagggttaaagctgagaggacttccttgttttgctggctcaggtttactgggccctcttcaattgtttgttatgaatctcctgttttcaaaaaaaaaaggtttggggatttacctgcttccttaatgtttcagtttgattataaggcacttatcatgagtgactccattttggtttgctctactggggccttagtgcaggagctcagcccaaaacaatggccgttcatacattttatttaacagggaatggttttatttatttatttttttgtttgtttgtttattttggtctgtagctggctggctctactggccagctttttttttttttttttttttttaatttccataggttattagaaataaccaggtggtatttagttacatgagtaagttcttttgtggggatttgttagatttttgtgcacgaatctcccaagcagcatacattgaacccaatttgtagccttttatttctccctcccttcccaccctttccccctgagtcccaaagtccgctgcattattcttatgcctctgcattctcacagcttagctcccgcttatgagtgagaacataggatatttgattttccattcctgagttacttcacttagaatcatagtctccgatcctatccaggttgctgcaaatgccattaattcattcctttttatggctgagtagtatcccatcaaatatataccacagattctttatccactcgttgagtgatgggcatttgggctggttccatatttttgcaattgtaaattttgctgctataaacatgcatgtgcaggtattttcaccagcagtatagaagtgttcccttttcactgcatccatgacaacatgtattattttttgattttttaattatggccattcttgtgggagtaaggtcgtatcgcattgtggtttttatttggaatccctgatcattagtgctgttgatcagtttcttatatgtttcttggccacttgtatatcttctgttgagacatgtctattcatgtccttagcccactttttgctgggatttctttttttatttcttgttaatttgagttccttgtagattctggatattagtcctttgttgtatgtatagattgtgaagattttctcccactctgtaagatttgttctttaaagaggttatgttttaatgtgtttccaggatgtgtttcaaacttgatagctccttttagcagttcctgtagtgctggcttggtagtggcaaattctctcagcatttgtttgtctgaaaaagactgtatcttttcttcatttataaagcttagttttgctggatacaatacttttggctgataattattttgtttaaagaagttaaagatagggccccagtcccttctagcttggagggtttctgctgataaatcggctgttaatctgatatgttttcttttttaggttacctggtgttttttcctcacagctcttaagattctttccttcatcttgacttttgataacatgatgacaatgtgcctagacatgatctttttgcaatgaatttcccaggtgttctttgagctttttgtatttgaatgtctaggtctctagcaaggccggggaagttttcctcaattagtcccccaaatatgttttccagacttttagatttctcttcttcctcaggaatgccaattatcttaggtttggtcatttatcataatcctaaacttcttggaggctttgttcattttttaaaattcttttctctttgtctttgttggattgagttaattagaaaaccttgtctttgagctctgaagttctttcttctgcttgtctgattctattgctgagactttccagtacattttgcatttctctgaatgtgccctttatttcctaaagttgtcattgttttttatttatgctatctatttcactgaaggtttgtcccctgatatcttgtatcatttatttgacttcattaagttggacttcacctttctctggtgcctccttgattagcttagtaatcaactttctgaattctttttcaggtatatcagagatttattcttggtttgtatttattgctggtgagcaagtgtgatttttgggggagtgttaaaaaaccttgttttgtcatattatgagaattatttttctggttccttctcatttgggtgggttatatcggagggaagatctggggctcaaggttgctgtttagatttttttttttttttgaaatggagtcctactttgtcacccatgctggagtgcagtggtgcgatctcggcttactgcaacctctgcctcctgggttcaagcaattctcctgtctcagcttcctgagtagctgggattacaggtgtgcaacaccatgtctggctaatttttgtatttttagtagagatgaggtttcaccatattggctaggctggtcttgaactcctgacctcagatggtctgccttccttggcctctcaaactgctgggattacaggcgtgagccaccgctcctggacattgctgtttagattcttttgtcccatggggtgttcccttgatgtagtactcttccctttttcctaaggatgtggcttcctgagagtggaactctaataattgttatttatcttctggatctagccatgcagaagggctaacaggctttgggttggtactggggattgtctgcacaaagtcctgtgatgtgaagtgtcttcggtatcctcagctgtggataccatcacctgctctggtggaggtggcaggggaatgaaatggactctgtgagggtccttagttttgattgtttaatgcactatttttgtgctggttggccacctgccaggaggtggtgctttcaagagagcatcagctgtggtagtatagggaggaacaggtggtgcgcagggccctagaactcccaagaggatatcccctttgtcttcagctaccaaggtgggtagggaaggaccatcaggtgggggcagggttaggtgtgtctgagctcagattctctttgggcagggcatgctgtggctgctgtggtggatgggggtgtggtttccaggtcaatggagttatgttcccaggaggattatggcagtctctgctgtgtcatgcagtttgtcagggaagtaggggaaagccggcagttacagacctcacctagctctcatgcaacccaaaaggcctgtctcactcccaccgtgccccccaccaaaacagtgctgagtttgtttccaggcagtggggaagcagggctgagagcttgccccaggctaccagcctccccacagagaaagcaagcagggcttttgcacctccccacctgtcgattctgcataccagattcacaccctaccctgagttctggccaggagacttcgcatttggttggaattgttacaaagttcagctggaggtttccttctccctgtggtcttttcccagttcctctggcagccctccccaaggacccctgtgagacaagtcagaaatagctaccctggggacccagagagcccacagggctttttccgctgcttcctctacccctgtatttcacttggctatctaaattgactcagttctagatgaggtcaaatgcctctcccgtgatttagaccctcaggttccccagtgagggcgtgtgtttgggggcagacaatccccctttcccactgtcacagcttgggtactcacagtatttgggctgtctcccggctcctgcaggagcaatccacttccttcagagggtctgtggattctcttggctttcttggtatatttctgtaggagttctggagcaaaggttcacgatgcaggtctccacacactgctctgtctgtttgagctggaactgcaagctagtcctgcctcctatccaccatcttctctctctgcaccagggactggttttcatattttacaacttcaaaataatacaaagttttagtcattttacagttaaaaaaatgaaataatctaaagagactgtactttgcaaacataaatgactcatcttgatgcatagattaaattttaattactgtattatgttgccatcaagaattattgtttttcaaatttaactgacatttatagggaaaatactttttaattagaattatcatctggtttccaagtaagctgcagtgatatctccatcttgctcaaagttggaagtaacatttatgacacgggcttcttcttactgaaatataccaataatgagctgattctcttttgttattttttgttgctatttattttgttttactaaacagaatgactttattgttgagtgagatgttggacaagtacaggtttgctgatataaagagggtgaagtagaaaattgttaaggaggaatatgccaccgtctaaaaaacaatcaatgttgtgaaagccctaagataagtatttcttcttggattgtcttctaatgagaagtaattctattttgttgtatattgtttcactagaaatcatctgaggtctggcaggaataacatgtattcatgaatgttcttgaaggcaaggtttgaagtaaagtgtgcacatacatagacaagcagtgaaaacgtgaataaaattcagaacaaaggctattgcttaaaataaatactaacacatgtaactgcaaagaatcctggagttaaagagtgtcattttttaaatgtcattttttttttgtaattctgatgcaagaattctatatatattatcatgatatggtttggctgtgtccatacccaaatctcatcttgaattgtaagtcttagaattcccacatgtcatgggaggaacacggcgggaggtgactgacttatgggggcaggtctttcctgcactgttcttgtgatagtgaatgagtctcaagagacctgatggttttaaaatgggagtttccctgcacaagctctgtttttgcctgccgccatccatgtaagatatgacttgctcctccttactttttaccttctgccatgattatgaggcctccccagccatgtggaactgtaagtgcagtacacctctttcttttgtaaattgcccagtctcagctatgtctttatcagcagtgtgaaaacagactaatacatacagtatgctgcttgacaaattattttcatgatggtattataggattaagagtaattgactcattgattggatacaaataaattaataattttaaggtatcataaatagagtttaaaaagatcattcttggcatatattgaacaccaagagagtcttattgcagcctcaatgctaaagctttataatttaaagatgctctgataatcagcagtctccttgtgtattttgaaaagtgaaagttgagatcacaatccagttttccattttattgacaaagaacatggactcactcaaagcagtctctgcaaaactcttaatgtattaccaaagccatctttcctatgggattttattgtctgtacagggtatttgtaatcacaaaacctatctttttttctttgctctattacatacgtaagtccccacttaaacagaattaggcagtgcaagtgaaaaagattcaattccagaggtcgtgggctttgttgtaaaatcccatgactgtaaccataattatatacaaccctacattacttctgatgtttgataattatgaccagtgatatatgttattgattttaaagcaatttaaaactggtccatgttcagatttcagtagctatgtgcactgtaattgctttcataatgtgtctgtatgatatttaaatgcttaaggatgactctccagctaatgaaaaatcattgtttgcacttttgcatttctagtacttcctgttataaatgaatctgccataggaggggatagttttcatgaaattcctgaaagcattatgggactattactagatacacaggatttgcaaagggaatttggctaaaaaagtgaaactgacaaggatatcatttgcattacataaagtttccataggttaactctagccgaagggtatttttagtgagcatattgatagggattgtgaatgacattacttctattgtgtaaacttaggaaaaatcagtcttcaataatatacatatagtgaaatatagtgtacagtaatattaatatttaaatatagctgaccactgttttttattttttcacacaataatgaaatatattttcaatacattaaaagagaaaaatatttctcattagtatctattcatatgatattaagtgttcagaaaatatactctttacatctgtttgttgatataattttttatcaatctactataatcttatttttataaaatagtattctacttacagtttatttctgatgtgtaatatttttgagtaaatatagtaataactatgactttggatgacagaaaatagttcctaatattattcacgctttatttaaaatgttagttttccagagacttcacaatcctatactttctgtcatatttcacatggagtgcttgctaataattgccatttatatcatctaagcaatatccatatatcaagacagattatgtaagcagaagttttaaaatataacatattttagcaaacacagaatttcctgtaacatgtctgtcataaggaattcatctgggccagatgtgatggctcacacctgtcatctcaaaagtttaggaggccaaggcaggagaatcgcttgagcccagtagttggagaccagcccagtcaaccgaggaagacattgtttctacaaaaattttaaaaattagctgggcatagtggcatgtgcttatagacctggctacccaggaggctgaggcaggagaatcatttgagcccaatattttgaggctgcagtgagctatcatgatgccactccactccagcctggtggacagagtccccatcacttaaaaaagaaaaataaattcatctaggcaaaaaggcaattagttggctgaatgacaataggaaatgtcaccaatagctgcaaactgatgattccatcctttatcacgttggcaactctccttattatgaacattaaaattaatactttcctgtaatttaaacctgcacctgcatttctttttgctaaaacgtactatcctcaattatattctataattttacttgctaatttttgcttccttttcctcactgaatatgaagtgctatattaatctttaaagtatatttttaaaagattatctaaaagctataaaactggaagttatattgctgacagcgaatcttctcttaagaactttaaaaatagacattgagctcacgcctgtaatcctagcactttgggaggccgagacgggcggatcacgaggtcaggagatcgagaccatcttggctaacacggtgaaaacccgtttccactaaaaatacaaaaaattagccgggcgtgttggcgggcgcctgtagtcccagctacttgggaggctgaggcaggagaatggcatgaacctgggaggcggagcttgcagtgagccgagatcgcgccactgcactccaacctgggagacacagcgagactccgtctcaaaaaaaaaaaaaaaaaaaatagacattgaaagacactgcagatgaacagtttgagtctagtgcaaaaaaacaggcaaactaggggctatcaaaccatagaattattagcgaaaatatttacttttgtttcaattgaaaatgccacataataagatttattttagtaattttttgtgtgtctcttctataggcaagtatcttaatgatatttaatttcagggaattgtgtggctcttgaaagagtcaaaatcaaaatttatgtgccagattttgcctctatctatgttatttgtctctctaactagtaattttccatgttgttttagagtgaatacagaacaaagttatagaatatagttagtgatatttctttacttttcaatggtagattactttggccatctagttaaactactggaaagatcttgctgtctattttgttattttgtagcttcttaccacaattgctggccatgaattttcttctttttctaaaactgagggaattggcaaaatttggaaaatatgatgtcactatgattgatcaacattataaatgtatttttagaggaaattattcattgtataatagaaaatgtgtaagtacacatcctatgagtcctgattgggatgattgttactaagaaagaaaacaagatagccttgctgatatgagaagtagttcagcctgtggtataaaggttaactgttttactttgccaacaaatttagagtgcacaagaatcctttttctggagtgcggtggcgtagtgtcggcttactgtaacctccgcctactaggctcaagtgatcctctgacttcagcctcccaagtagctgagactacaggcatgtgccaccacatctggctagtttttgtatttttcgtagagacagggtttctccatattgcccaagctagtcttgaactcctgagctcaagcaatccacccacgtcagcctcccaaagtggtgggattacaaacatgagccaccacacccagctgacaatagtcctttaaactatataaatactggtgggggtgatggctcacacctgtaaacccaccacttcggaaggccaaagagggaagattacttgagcccaggaattcgagaccagcttgggcaacatagtgagacctcagctctacaaaaaataaaaaattagcaaggtgcggtggtgcttgccagtcagctactcaggaggctgaggtggaagaattaattaagcccgggaagtcaaggctacactctaacctgagtgacagagtgaaactctgcctcaaaaaaaaaaaaaaaaaaaaaaaaaaaaaaaaaaaaaaaaaaaaaaaacccaaaacaaacaaacaaaacatgaaaaacccccaactatataaatgccaaaatcttggcagaaaattaataaataaacatgtgtgtcttttctttgtgattaaaaggatgaagaattagttttccattgtttactatagaatcattgagttgtaccattgcaagttattttagatatcatctatccaaaaatctcattttaaaattgagaaaaactaggctcaaagagatgaagtgacttcctaagttcacacacttgggcatagctgaactagaagcaaagtcccagtttcatcaagttagtatactttctggccattataaggtctgctttggagctagcttcatcggtatgacaattttccctcaaatattcaatgtttgttaatagcacctttcctgaattatatatatgtgtgttttctaaaacaactatttaaatcagatggcatacgagttttactaatgaaaatccagaaaatcatgtccttaattcttttctttggattgaagagattatatacacaaatactttctcaagatgaatgagtggggaagacttcctaaatgccaccattttgtggaaagaaagtgtttatagggacaaaacccgaggattttaaaattcattttcaatgtagacctaaattttgttcagtgacttggagcattgtgagaagtatagacctcaactgagctttatcactctccagtgagtaaaataatatagtccccattttttttcagagcttacaaaaaaatgctttatctccaaatttatacagcaaaatcatatttgagctaagactgaattttaggggcattcttactcttctgaatgttttcatccacaatcctgctcccaacagatggagactgaaacacaggagagtttcagttttataggaaaagagctagtgctcctcttggatttaagttttaattcaaatgataaccattattacatgggtcctcacccctcctatataattccagtaccaataactctagaaagagactctattatttattctctggaattagcctagccaatttgatgaataaatgactgaatggtttcttagtctaaccactttcctctattttgtcttattgaggcagtagaatatattatattctgtttaagttccagaaatatttattgggtgcttattataagccaggaactgtgctaaacagtaatgacatcaaattactaccacttaggactatatttgtgcataacaaatactcagaaaaaatgtatgtactgatgatacaatgactaataagacacacttcctacctccaaggacctcacagtcttgtgcggtgtacaaacttacctacatataggttaatattaactgtaatagccactttttatagcatcagggtatgaacagaaggccatggaaatccagaggcagtagcaattaacttagtctggaaaaatgcatacaaagtagctttcagtctagttattctgctactaacatcacattatttaggataagatatattttgtataaaaatatggagatagaagtaaaataaaaatacttccctctatttttcattaccataagcctacaaaccccctcaaatttgaactgaaagttgtatttttaatctgagaatcccaagaaactcaggacaaggatgaataaactatttcactatcttctctcacttaatagtactaaagataaatttaagggaaaatattaattttatgaatgttttaggattcatctatgcttgtctggccaaacagtattatatatttcaaatatatgtatatgaattatgcatctacagaaatttagctctgctgttgaagaacagaaagcttaagattactgaaagagagctcaaaaaaaaattggaaaagaatgagaaaatatagtagtagttcctggggtagaatcagttcacaaaccttgttccaggtatggagaaaagaaaattttcaaacatacaggaaagatgaagaattttaccatggacaccatataccaagatcactcaaaaacttaatttctatttttttgaaatctttttaattttagagacagcatcttgctctgtcatccaggttggagtgcagtggtgcaatcacagctaactgcaaccttaaactcgtgggctggaacaatcctcctgcttcagccttctgagcagctaggactacaagtgtgtgccaacgagcctagctaatttgctttttttgttttgtttttttgttttttgtttttttttttgagatgaagtctcactcttgtcccccaggctggagtgcaatggtgctatctcggctcattgcaacctctccctcccgggttcaagcaattttcctggctcagcctcccgagtagctgggattacaggcgcctgccaccatgcccagctaatttttgtatttttagcagagatgggatttcgtcatgttggccatgctggtctcgaacgcctgacctcaggtgatcctcccatcttggcctcccaaagtgctgggattacaggcctgatccactgtgcccggccaagcctagctaatttttaagttttacttcttttgtagagacggaagtctcactatgttgcccaggctgctctcaaaacttttggcctcgagcaatcctcctgcctcccaaagcagtgagattatcagtgcaagccactgtgtcggcctaaaaacttgatttttaggggttattctttgtgttctagaagccctttcttatacagatactcatttatagcactgaggacaggaactatactcattttacaaacaaggaaactgagattcagagctagttatgaatcaagtgtccagcacagttatctgccctaaaagtgtgtttcccaacattggttgtgcatgttgtttttccaaaattttaaaaaatactgataccttgtttctaccccagaggttttgatagaatttgtttttatttttcaagacttttttggctattctgggttccttatatttccatatgaattttagaatcagcttaagcatatcaatttctgcaaaaaatgatttttttttcttttttttgagattgagtcttagttgctcaggctggcgtgcagtagtgtgatctcagctcactgtaacctgtgcctcctgggttcaagctattctcctgcctcaacctcctgggtagctgggattacaggcatgtgcggccatgcctggctaattttttgtattttagtagaggtagggtttcgccgtgttggccaagctggtctcaaactcctgacctcaggtgagctgcctgcctcagtttcccaaagtgctgagattacaggcatgagtcaccgtgcccggcccagtttgaatttttgtagggattatgctcaatctgtacataagtttgaataatgttgccatcttgacaatattaactattctgatctatgaacatggtacgccttttcatttatttagaacctctttatttcaacactattttgaatttccagtgtacaagttttgcccttcttttattacattcattcctaagtaaatatttatccttttatatgctattgtaagtagaattgtattcttaaattttatttttggattattcattgctactgcatagacattcagttaggattttctatatataagatcctgtcgtcttcaaatagagatagtcttacttcttcctttgcaatatggatgctgttcatttctttttcttgcttgattgtcctagctagaacctccagtacaatgtttaattgctgtgtaaaagcatatatcctcttcttgttcctgatcttagcaaggaagcattattctttcaccattaagtttgagttagctgcagttatttcatagatgtcctttatcaggttgaggaattttctgtatattccttgtttgtttattgattttatcaccaaagttttttgttgttgttttattttttgtttttgattgtctgtttgtttgtttttgttcttttgttttgagacagggtctctgttgcccaggctggagtacagtggcaaaatcatagttcactgcagccttgaactcctgggctcaaggaatcctcctgcctcagcctaccgagtaactgggactataggtgtgtgccaccatgcccagctagttaacaaatttttttttgacattagattatgagtaaaactgccccattgctcaagattcagtggaaaggaagcaaaacaaaacaaagaaaccttatgagcaaaatgcttaattcagcacataacagcatatagtttctattggttaaagaagaacatttatatggggtcctagataggctccaaggaaaccaaattacttgaagaagcctgagattattcttaaagaaatatagatttccttgtatgtttacaatgaatgagtcttatttttacatgcatggaagtatcacagtcactggacactgtataatgaaaacttacaagttctcattttgaacaagcttcctttttccttagttgacaaaattatccaggtttcttttagcatgttcacaatttcagattttatacaattacaaactgaactttccttataaactgattgttatagctaatttttcctaataaaattcaaattaagacagcacctgtgaattctatttagagttctattgatactcaatgtagccaatcactgccaacatgaatcaacctacgtatgtaaatttagtgaccaatataaaatagtctcatcgttctttactacgctttggagaaacttagtcattaatgttaatcactataatggttcatatttattcctgctagttctaaagttctgcttcctaattgcattattacaaagataaaaaattcaaagcaacatgtatagaatagaatgtgtgtgggactgtgtccagttattagacattataaattactatttgctttttaagcaattaaatattttaataaaaacaaattgtgtttatacctgctgtaaaatttcttgctttatattttactagactaaaaaacaaaacaatatattttaatccactgttaatcagcaggatttaagatagttctgagaaagagggaaattgatattactgaccctcttccatattggtacccctaatgactgtcagaaaatgcaggatgagaaccatttttgctgcgaggcaagcccacttttctttttagaagcttttaaggaagctaaaattgtgtacaaaaatatttctactgcctacaaatcacagtttatttttatgtttgaacagaatattttctaatgtaatatatagattttatttgtgggaaaatctggcaccaactttcaacggcttttttgcagaagcatctaaaaatgagctggaactctagggtctagtacataaaacattatattttcacatatgggactgcattttaaatttaatctgaaggacttgataagatacgccaaattgcttagaaacaatttgtgtagctagtgaactgtggcatctggaagcccatagacattaaaagcactttttcccactttttccctctgtttttgcctcctaatcactgcagacagaatacatgcaatctatactgatattgcaatgaagacacaagcacagatgctttttattgtgatgaaagatgacttttattcagtgcccagtttattattgttattattgttgttatgatattagcaggcaatatgatgcagacgtgctggcaaaatctatgatactagtcccacatcattatagagtatggattttctgttagactgtagaattttttttttttttttttttttgagacggagtttcactcttgttgcccaggctggagtgcaatggcgcgatctcggctcactgcaacctccgcctccagggttcaagcgattctcctgcctcagcctcctgagtagctgggattagaggcccccaccaccatgcctggcaaatcttgtagttttagtagagatggggtttctccatgttggtcaggctggtcgcgaactcctgacttcaggtgatccgcccgcttcggcctcccaaagagctgggattacaggtgtgagccactgcgctcagcctgtagaaaatttttataaaagtagtaagtcaatctgtgtgtgtaataacatatgtgctttaggtttgaattttgtcagggaactaaaactgaaaacaaggaaacatattgacaaattatttattattctgtgcatatataaggaatagccattaattaaagattgctgagaccagctcggtcatggagaccctaacccagtggccctagaggagttaaagacgcacacgcagaaatatagagtgtggagtgggaaatcaggcggctgacagccaggaacagagatttacccacatatttattgacagcgagccagtgataagcattgtttctatagattatagattaatgggaaacaaagggatgggccgaaacaaaggaatgagctctggctagttatctgctgcaggaacatgtccttaaggcacagattgctcatgctattgtttgtggtttaggaacacctttaagcggttttccgccctgggtgggccaggtgtttcttgccctcattccagtaaacccacaaccttcagcatgggcatcatggccatcacgaatatgtcacagtgctgcagagattttgtttatggccagttttggggccagtttatggccagatttgggggcttgttcccaacaaaagatcatcatggctaaagataaagccatcacagctttatcacgcctacgtaatttttgctttgcttctcatcaatgagcccaggaaaaaattatttaatgttggtgcatacaaatattccagcatttcacagaagattcagaattatcttttaatttaggggtattaaaagttaacagaatgtccagctgacattttgaaaaataaagtgagaagttaagcattgttcctcttaaggttttaaataaaattcaaaaagtaaaaaaaaaaaaaaaaaaaggaaaggaaaagcaagcagatatagtacaaagaaagtgaaaataaaataaaataagataaacaaaaggaaaatcaaataaatacaattcaggtctcttccttcaaagagaccacttatttcattctagattaaatgggctttcatatttttgaactgatgactagatgaagtaagttctactaaatggtctcactagttccaattttggagattatctcttcaaggatttagtttacttattaaatgctactgaaagatggaaaaagaacaaagtagctacaactgaaaatctggaatagaattatatagcaagaaggaattataatctataaatataggttctcctaaaatgatctcacatctacaaacatgaaagtattttaaatgataaaaagaagtctttctccagtttgtaagatgggaataataatcatacttatctcactgggttattgtaagttttaagtaagtgaatattaaataagttcatgtatctaaaaatgatttaaacagtgcctggaacatattggtgccatgcaaagtttatatattatcgttattattaatgatagtaatagtatgattcaatacactgtatttacgtgactttaagacaatgggtgccaaactagtggtttgttgttggaattgactgtcagtaaaaaatagaatgtgaaaatagtgcttcttttctcttatttattttatattttattttattgtattttactttaagtttcaggatacatgtgcagaatgtgcaggtttgttacataggtgtccatgagccatgattgtctgttgaacctatcaacctgtcatacaggttttaagcccacatatattaggtatttgtcctaatgctctccctccccttgtccaccaccccctgacaggccctggtgtgtgttgttcctgtctctgtgtccaagtgttctcattgctcaactcccacttgtgagtgagaacatgcggtgtttggttttctgttcctgtgttagcttctttttcacctctcccagaatacctctcattcagtatccaccgttggcattctgtcttcccactacagcatttaatgtgctcattcaatcaaccagcaaccctgatactagtgttgcactgtcctgtacgatccagcattatttggacattatcctggaacctagaattttcttccttttcttttgttttaaactttcctaaatcaacattttcttatgcagtatattatttctttaggcttcgcacactaataaattgatagctagctaattctactaaaatagatctgatatggtttagctctgtgtcccacccaaatctcatgttgaattgcaatccccaatgttgtaggagggacctggtgggaagtgattggctcatgggggcatatttctctcttgctgttcttgtgatagtgagtttgttcttacgagatctggttgtctgaaagtatgtaacactttccccttcacactctctccctccttctggccatgtgaagactgtgcttacttcctcttccccttctgccatgaccgtaagtttcctgaggcttccctagaagcataagcctgtatagcctgcaaaactgtgagctgaataagcctcttttctttataaactacccagtctcaggtagttctttatagctgtgtgagaacagactaatacacgatccatgctactgcatttaatgtatcactatggaaatgcattttctttttagatgcagagactgaagaaaccaaaattaatggccatttgtgggaattttagccctgttcaagaggtctgctatagtttttcctttctgtagctagtaggttcttatactaccttttaggaagaaatgttctactattatgaaaggaccttaagtcacttggagacactgaggtcactacaaattttgagttagttatttcttttttttttttttttttttttgaggcagagtcttgctctgtcgcccaggctggagtgcagtggcagcctccacctcctgggttcaagcgattctcctgcctcagcctcctgagtagctggtactagaggcatgtgccaccatgcccggctaatgaattagttacttctaaggctgtatcaataaattccagacttaaaatatctgtttatttttactgttaatcaaggtaggacatcatttctttgcacatgccttggtattttcattggttaaattttattgtcagtatggaaaaataaaaatcagaggaaatgtattcagtatttctgtgatttgttttaagaatttaattatagattttaatcttgatgtggtttttttcaaaaacatgtaccaggttttatatcatcccagtaaataattttgtctgaaggtcaaatgtttttaagagtgtttcatggaaatgaatatattttcttaattttataattgaccaaatttttataatgtaaaagagaaattaatgaatgctgtattgaaaggtaatcactctgcagttgatcccgctataatttctatttatttaagaattatgaatcatcaactaaaatactgaaaatatttgttttaataatagactatgaatattttgtattttagtaaattttgtattggaactatcaaatagagtcacaacttcacccgtttcaatttttatggttgctctttattgagtgcataaccattctatttgcagaaattccttcaagatttatcactgagtttttattcatatgattaaaaatatattaaaatataagctattactattatatgcgttatgaaggattacaaagaatttcagatcaggtatttaaaatcacattggaatcatatatctactgtcttctcaatagacgcaatatacagcacaccgaggttgaatatttattcaagttgttttttctgttggaaatgaggctcaattattccaacttgttaaagcaagggctaaaacatagcttctgaagcatcataaaattaaataactatattttcatgatttaaatgacaactccatttatttcagctttcacttataaatgagtacttacgcactgattaatatgaacaaatgtacttaaaatggaaaagttaaatgtgattttaatacattttagtaaattaagggctgagtactattgggttagaacaagagggaaaacaaatttacatgtgaacattgtgaggatgttcacatgtaaataaatagcaaaccactgttatgactaggtcagatacttcaactcatttaaaaaatccaactatgtttttactgtgtagactcagtaatagtaggaacaatattgcctaaaagcataatttattacacagacaactatttgctttttttcttttaagtaactaatgcagatcataattttcatatgaataatttcatagaaatatctgtcagcttacttaacaaatatttcccaggaaagcttatcatttgctcatattttcctaaatcatatttactatatttttaaagaaagtaagtcatagaaaggaatctgaaacatattagtttaaaacacttcttttatataaggttaatagtgggaatgatagaggtaacatttaaaattgttaattatagctgcaatttcgatcaaatacttttttatcagctacagttttatgataatgcaactgttcttatttatttgacttctaataaaacaattatgaatcaaattagtgagtactaattataccttcatttcttattcaccttccatttgtatgtatgtatattagggatgatcagacataaaatttgctaatttttacaaccttttacatcagatggttatttttccatcatgattagagagaagttagaatcagtgtatcactttcacggattcactcggcagttaaaacacatcgttaaagccattcaatgaaataaccagaaaggagcaattgacttttaacatttggctccacagaatgtgttttaaccaggttccacttcctaaataacacatcatgccatcatttcagaatcataaacaacagtcatagcaaagatatgtctagtgatattatagaaagcatatcagcatgttgacttgtggaaaaatcaaattcactgttcgtagaagtggaaaatcaagtgtttgaagaaattatcctcttatgttgtcatgtttgtctaaaatatgtttaatattttgcaatgaataaacagtggcataactaagtgggcaaatattttcaaactagataaataaacctgattgaagttattgggcccttttcatcaatcacgttatttcaggaggcaaagttattgtatagtatttgtacttgtatattagtaacaatgcaccaccatgtatttcttttaagtaacaagatttataattacaagatttataaaatagtttacattgaggatgtagttagtggatgaaagatgaactgagaaacatttattttcttttgtctttttttttttttttttttttttgagacagtgtctctctctgtaactcacgttggagtgcagtggcacatacatgactcactgcagcactgaccttctgggctcaagggattctcctgcctcagactcccgagtagctgggaccacaggtgtctgcaaccatgcccagctattttttgttgttgttggttttttgtagagatgcagtcttactatgtttcccaggctgttctggaactcctgggctcaaatgatcctcccacttgggcctcccaaagtgttgagattacaggtgtgagccacttcgcccagcccagaaatttttcatttgttaaagcatactgatacattattttctttccaaagatttttttcttataaaatactataaagtctatgtgtgtttgaggagaagaggcatatatcctgtatcctgtatatacatttggtaactgtaaataattaaacacagtttcagaaaaatattcccatttgttaaaagcatagaagttttaccctcctaccatacagaagggcctcacagatggataaaccatgtttgtaactttttaggttcagtaaattacaacacacatcttctgtaacccaattccaactttttaacgtctgtgcatggaattaatataggttaaaaatgggtatgaggtcttaagcgagcaaaatgaactatctaattactctgttgcttaataatatattaaagattattagtttttagttctgttgtgtgtttcctacttttgaacaagttccataagctataactaaaactatatgcttacttttcatctttggaaatgaaacagagtgtttatatacttgaatgcccagagatggaaaagtcatatgttggacaagagcatcagacacatgacttatagccactgaaatactttcaaatcatgacttagtctaccatagggcattatgaaaatgtaaagactctgtctcaaaaacaaaaaaaaagagaaagaaaaaagaaaaaaaaagcatgaacacaaaagcaaaaaataattaaaataattcattgtctttatccattttggagactatttggaaaatcagctctgaatagaaagaatgcaaaatgtgaaatgcatcactttggttgttagcaggtggtcacatgcaatccaataaaatgtggaccatattatactgggtactatatgtaatagttacaacctaatatgcataaagtatatagttaatcttgtctttctggattatggatgcaaagtcatttaaattttagaaataatgaagtgactgatctcgtttcatcaatgtgcaaagacttctcaaagtctgctgcagaaaaaaaaattattttggaaaaaaatattttgaatgtcataacaatcagcaggtaactttttaaagaaaagaacagaacattcataaattggaagtatccttaatgtttttgcatgttgctggaacattttacctgcacacttgttctttaaatgttctcactctcattttataaatacttatgcaagcttttcatgaaacgcatttctacgtactacctgctggttcagattatgtcttgttctattttattgaaataattcaggagacttttaaaattaggtatatagagggtgattttttaaaatgcctctcttaacagtagaatgaaactgtcatttactgaagccacaacctcctgagaaggaaaataagaaaagtcaaaaagaaaacattcaaggaagatgtctttctaccttttgctatgtaatctttctgttggtgccctacaccactgcacacctccctgccagcacatacacagaatcacacacagttactattgggaacaatagacaaagaaaaaaatgtttttattttttattggtattcaaagaactgagatgtagaggaaaaagagctgcagtgaaagtccagcaatgaattattcaattccttcaatttgttgaccttaacgaaatgcaaagtgatttgaactaaaagtaattaacaagagagagtgtgcctagtaaaaccaagaaagaatcatatttgtttcaggaatcaataacagccagtgactgaaggtcataaaggaaccattcaggaaaacaaagagccttttgccaaggcagttgtcatgctgtatatgtgtgcacatatgcagggattttagctgtgaccgtgtactaggaagatttaattacatgaaaatgtcttctacagaaaataaagtgaggagaaaaatgaactaagaggcacatctcagtgacactaaaatgtcatttttgatgtcaagtttaacagaaaattgtttctgaggactggcatccaatgcagtttttcatttaaataaaatattccagtgtgactaaaagtaaaattaaaagcaacactgaataaaatttaatgaagaactttggaatgataatagagttctataacatagaactaaagctgtgggccaggcacggtggctgaggcctgtaatcccagcactttgggaggccaaggcgggcagatcatgaggtcaggaaattgagaccattctggctaacaaggtgaaaccccgtctctactaaaaaaaatacaaaaaattagctggcgtggtggcgggcgcctgtagtcccagctactcgggaggctgaggcaggagaatggagtgaaccagcgggcggagcttgcagtgagccgagatcgcgccactgcgctccagcctgggcgacagagcgagactccgtctcaaaaaaaaaaaaaaaaaaaaaaaaaaagaactaaagctgtgaacatgttccaaagactattttggcacgcagaagcacatctttgtctcttctgttacgaaatctcaatgaaaaactcttgagcttttcccaaattgaaggacattctataaaatacctaactagtacttctcaaaactaccaaggtcatcaaaaacaaggaaaacttgacgaactgtcatagtcaagatgcgctgaaggagatatgatgactaaatgatgtaatgtggaaccctagatgggatcctgggtcagagaaaagacattaagaaatagaaataaagtaaaaattagttaataatagtgtatagatatattggttcattagttggggcacaatgtattataataatgtaagatgttaacaacagggaaaatgggtgtagagaaagactacctgtactaactttgcaacattttttgaaatctaaaatgattctaaaatttattaaagattctgaagtttattttattcatttattcattcatttatttatttattttgagatggtgttttgcttttgttgctcagtttggagtgcaatagcatgatcttggctcactgcaacttccacctcccaggttcaagtgattctcctgcctcagcttcccacgtagctgggataacaggcacccaccaccacgcccagctgaagttttggatttgtagtagagacagggtttcaccgtgttggccaggctggtctcgaattcctgaactcaggcgatccacccatctcagcctcccaaattgctgggattacaggctgtgagccactgtgccctgccaattctgaagtttattaaaaacattagagcattttatcctggtataaattccagcaatattattggcttttattccaatctatcttaatctctttgaaatatgctcattaattaagaagacagctatacaaaacattacaataatcaacaggaatggacatttccattttgtttatacattttaggagctgtggtcttggggaaaaacaagaggacccaaaatgactacaaagataaattttcataaatgattgtcctggagctgctatatgctagatctcatcaagaagagcttagggtttcacttgtaaaataaaagcatcttctcagagaactgctgtttggagattcataaaaataaatagtaattattggattcaaggccctagagaaacatatgtgtgtactctttggtgagcaaattgctattattatcttgaatttaatacaatgaagcatcacacattgtaaaactaagggagtcacagaaatttcaaagttatctatttctacctcagctattttaaactctcttctagaagccaaaatagtaaatacttaaaaagaagtaatttatagtatttgttaactaattggaataactagataaatgtagtttcatgaatggttaagaaaacttttactgaaaccaaaagtattgagaaaatcatcgtgaatagtaacttaaattttgcaaagggtaaatgcaaacagaatatgactcatgaataatatggtaagcactgaactgtaagtaatcgtagaactgagaaagtattaaaatgatataaatctgcccaaaagttaagtatatgtgttatttatattggtcatgtctaaaagtgaacaaaaactaaataaactgaataatatagttgatttttctatattgatcttatatcctgcaaccttgctggactctcgttatttctaataatttttgcagattccttagaatattctatatacaggatcatgtcatctgcaaatagagatagttttacttcttcctttccaatctgtatgaattttgtttcttattgttattatcatttttgttttgcataattatcttggctaggtcctccagtgcaacacgttagaaatgagcaagagtggatattactgttattttcctggtcttcgtgagaaagcacccaatctttcatcattaattatgatgttagctgtgggtttttaataaatgcccttcattaggttcagaaagttttcttctattcctggtgtgttgaatattatccccataaaagcatgctggattttgacaggtgtgtttgtgtgtgtgtgtgtgtgtgtgtgtgtgtctattaaaaagatcatgtgggttgggcgccgtggctcatgcctgtaagcccagcactttgggaggcctaggcgggaggatcacctgaggtctggagttcgagaccagtctggctaacatggtgaaacctcatctctactaaaaaaacacaaaaaattagctgggcatggtggcatacacctgtagtctaagctacttgggaggctgaggcaggagaatcgcttgaacccgggaggcgaggttgcagtgatccgagatcgtgcctttgcactccagtctgggcaacaagagcgaaaccctgtctcaaaaaaaaaaaaatcatgtgcattttgtttcttattttattgatttgctatatgatagattttcctatggtgaatcagtcttggatccctggaataaatcccacttgattatggtgtataattatttttgtacgttgctgaatttggttcactaggttttttttctaaacttttatcttaggttttggtattcatgtgcaggtttgttatatagataaattgcatgtgacaggagttaaatatacagattattttatcacccaggtagtaagcatggtacctgacaggtagtttattgatcctgaccctcccccgacccaccaccctcaagtaggcaccgatggctgttgtccccttctttgtattcttgtgtactcaatatttagctcccacttataggtgagaacatgtggtgtctggttttctgttcctgtgttagcttgcttaggacgatggcgtccagctccatccatgttgctgcaaaagacatgatcttgttcttttttatggctgcatagtattccatgatacatatgtaccacattgttttaatccagtatactattgatgggtgtttaggtagttccatgtatttgttactgtgactagtgcagcaatgaacatccatgtgcatgtgtctttatggtagaatgatttatattccttgggactatacccaataatgggattgctgggttgaatggtaattctgttttaagttctttgagaaattgccattgctttccacaatggctgaacaaatttgcattccatccatcagtgcataagcattctgttttttccacaccctcaccagtatctgttattttacaactttttaataatagacattctgactagtgtgagatggtatcttattgttgttttgatttgcatttttctaatgattagtgatgttgaacattttttcacatatatattccttgcagattatggatattagacctttgttggatgcattgtttgcaaatattttctcccattctgtaggtggcctgtttactctgttcatagtttcttttgctatgcagaagctctttagtttaattagatatcatttgccaattattttgttgtcgtaattgcttttgatttctctgttataaaatctttgccaggtcctatgtccagaatggtctttcctgggttatcttccagtgtttttgtacttttaggttttatatttaggtctttattccatctggagttgatttttgtatatggtgttagaaaggggtccagtttcaatcttctgcatatggctagccagttatcccagcactatttattgaatagagagtcctttccacattgcttgtttttgtcgactttgtcaatgatcagatggttgtaggtatgcggctttatttttgggctttctaatccattgcagtggtcaatgtgcttgtttttgtaccagttccacactatcttggttactgtgtagccttgtaatatagtttgaagtcgggtaatgtgatgcatccagcttttttcgttttgcctaggattgctttgactattagggctttttggtgccatatgaattttaaaatagcttttctaattctgtgaggcatgtctttgttagtttgatggaaatagtattgaatctgtaaattgctttgggcactatgtttgttttaacaatattgattcttcctatccattagcatggaatgcttttccatttgtttgtgtcatctctaatttctctgagcactgttttgcaattcttgttatagaggtttttcaccttcccggttagatgtttccccagatattgttctctttttgtggctattgtgactggaattgcattctttatttggctcccagcttggatgtcattggtgtataggaatgctaccaatttttgtacattgattttgtatcctgaaactttgcttaagttgtttatcagatcaaggagctttttgacagacactatggagttttataggtatagaatcatatcacctgcaacagggacagtttgacttgctgtcatcctatttggatgccttttatttctttctcttgtctgattgctctgtccaggatttccagcactgttttgaatagcagtggtgagagagagagcattattttcttgttccaattttcaaggcaatgcatccagcttttgctcattcagtatgatgttggctgcggatatgtcatagatgactcatagttttgaagcaggctccttcaatgcctagtttggtgagtgtttctaacatgaagggaagtttaattttatcaaaatccccttctgtatcttttgagatacaaatgagaattttattttcggttctgtttctgtgacagatcacatttattggtttgcatttgttgaaacaaacttgtatcccaggaatgaagtctatttgatcatggtgattcacttttttatgtgctgctgaattcagtttgctagtattttgttgagaatttttgcatctactttcatcaagtatatttgcatgaagttttcttttttttgttgtgtctctgccaggttttggtatcaggatgatattggcctcatagaatgagttagggaagagtccctttttctccatattatagaataatttcagtaggaatgttcccagaccaaactgaggttcgggctgctatttcttgtggcccaataatgagatgcagatgaactagggggaagagagtttttatttctgtaaccagttacagggacaaggcctgaaaaatattgccagaccaactcaaaattacagtctttcagagcttatatactttctaagctatatgtctacatctaagtgtgcattcatttaaagacataagtgattaacttcttttaatctgtaactaagatctgagtcctgaagaccttcctctggagcctcagtaaattgacttaacttagatgggtctagctgctggggtgattacccttatcttgtctcctgctaaatcatggaggtttggggagttcctttagtccccagtaaagcttgtttgtggaggcctggggagtttctccatactcccaataaaacttatttaatcctaaacaggtcctgttaagaattccgtcattatcttgtcatgctttaaggcccaggaaaggcctaggcaaaactgttggtgggcttttgttacattccatcctgagtggttattaaaagctgataggtaaagctttatcagcttttaataaccactcagtcaatactgaaacagttgttagggaggtctgtgttagtgagacctggcctgccacaggaatggtactagctcttctttacatatctggtagaaactcactgtgaatctgtctggttctgggctttttctggttggaaggctatttattactgattcaattttggacctcattttttatttgttcagggatccaatttcttcctggtttagtcttgagaggttgtatgtgtcaaacaagttatccatttctttcaggttttttagtttgtgtgcatacatacacatgttcataatagtctctgctggtttttgtatttctttggggtcagtggtaatgtcctctttgaaatttccgattgtgtttatctaaattttctctttttttctttatctagctagcagtctatctgtcttattaattgttttcaaagaaccaactcctgcattcattaatgttttttatggtttttagcatctcaatttctttcaattcagctctgattttggatatttcttttctgatagctttgtggttggtttgctctagtttctctagctcctctagttgtgatgttaggttgttaaattgagatctttctaagtttctgatgtgggtgtttagtgctataaacttccctcttaacactgttttagttgtgtcccagagattctaatatattatatctttgttctcattagtttcaaataatttcttgatttctgccttaatttcattgtttactccaaagtcattcaggagcaagttgtttaacttcatgtaattatatggctttgaatgattttcttagtattaatttttatttttattgcactgtggtccgagagtgtggtttgtgtgattttttaaaatttgctgaggattgttttatgtctgatcatgttgtcaattttgagtatgtgccatgtgcatgtataaatatatacacctactatgtacctacaaaaattaaaaattaaaaatagattcattgctgggatactactgtgttaatttagatgtaagaagacactctggctttttgagttgccagagtgcttgtgctgtttctttctcatatgtgtgggctgatttttcttcaatcctttccttcaagaagttgctattctttgttttgttgctgttgttgttgttatttttggtttgtttgtttgtttttcggagtcttgcactgtcacccaggctggaatgcaatgacacgatctcggctcactgcaacctccgcctcctggattcaagtgattctcctgcctcagcctcccgagcagctgggattacaggtgcctgccaccatgcccgggtaattttttgtatttttagtagagacggggtttcactatgttggccaggctggtgtctaactcctaacctcgtgatccacctgcttcagcctcccaaagtgctgggattacaggcatgagccactgtgcccagcgaggaattttcattattatgattatttgctttttcttttctttgacatccttgggggtttggtcattgtataaggtgggttcagtttactggcttcatttctggtacattttggtgcaggcaaggctcagctcagcactcctgggctgtgtggtctaactctggagggctgctgttgggcaatggcacagtaggatgtatgtgcactcttgtgccagcaagtgaaggaaaggcaaagtctacttgcctatgtgtgtgccagcaaaacaatgagagtgtggctgtgggcaagtgcttgctggcaaagagacataagggaggctgcagtggggagagggtgcagttgggctggtgccagtaggccagggccacgatgctggagctctccgacagtcagctgtggtcttcctgtgcaggagctatgatgcgggatcctgcaggcaccccatttgagtattggaggctaaactgcaagtaggcgtggccagggtggggacccaggagaggttagcagacaggaggcgctcagggtggactgactggtctcctgggcaagattgttctgctgtgttctggtttgacagtttccctaagtctagagtgtcctgaggagcatggcgagccttggggaatgggcgtccctggcagtacttggctgcagatgttcccacaccaaaccttctgggctccacataggctggaattctgcccagccttaaaaatctttaagcagttcttgctgctagctcaagtgcccatggggatcatggggtctcctgctaccaggattccagatgtccgtggcgaaagtgaatcactcctcacatgttcaatgcatccctttcctaggagtctgggttcactttttttgtttttttttgttttttgttttttgttttgttttttttttgagaatctgtgtgtttacattccagatatgattctgcagcttccttttcttgtgttgtctttgcctggttctggtgccaggaaatcatggcctcatacagtgaattagaaagtattccctgactcttctattttttaaggggagaatttgtgaagaattggtgttaattatcctttaaacgtttggtagaattcaacagtgaaactaactggtcctgaactggccgacttctctgtgtgtgattctcctgctttaggagctgagtgcttagtggaggtaacaaagtcgtcagtggtagtagcttcagccattctttggccatgaaactactgcattacaagtgaaggcaaggcagattgggacgctagtattcttggttgtatcttttccaaggtagaacctccatcacttgaatgggggctgggtagaaaagaaagccctcacctctcagctgcatttacctgaaacttagcctcaacaacaggaagttaggggcagggtaagaaattctgaccttatgatccctaaaaaagataacactcccactgggagtcaggtaaaagggaatgttgtgttcttggctgctctcgtgtgtaacggagttgtagtcttgctgacctgggaggagaaaggaaggcacaggtcttcatacgaataccacagactctcgctctttttgtagaattttagtagattttcttgaacaagtatatcttcatttgctagatgctctaagatcattttctgacgctttaaatggctgtttttaaattaatatttaccagttttgcaagggattacatccatggaactcctcagatgtcatgctggaagtcagtttttacactacgatttgaatataaaagaatataaaatcagagtttattggctaggacagttgtttttttatagcctggagcttagtgtatgagacttccacagattgtgaaggggcttgtatgtcacactgggaaattttaaaattatcctttaagaaatgcagcacccatgtactatctaagaatctgagtgatatgaccagatttggggttttaaagaatagttccagaagctgtatggaagggaaattcaactaagctaagcccagatattaaatgattcaagaccttaaaacatgacttgaagagttagaatagatagagaatgaattcaagggaaatataagagaaagttgagaaattattgattggatatagatattgactagcagaaaagtaaaaatttgataatggaacaatattttgtagctaatgtctgatttcaatgctagtggaatacataaggagagaaacaaactcgaagcagaatgtaattactatggttttgaagatattgttttgatgtggctgtaggacatcctgttgaagatgcttagcaggcagctagaagtatggctcttgaggtatgagagcatttgaacttggagatagaaaggtgagaggcatgataaaatatacaatatttgaagtcactggaacagatattacccaagaagatcacatagaagaggaagaagataacagctccaagggtgaaattctgtcacaatatactttcaatgatatgattggaagaagagaagccagaaaattctactggaagaagataacaaaactgaatagagtaagataacagcattgcagaacaattgcctgacagagtttcaagaaggaaagtatggtcagcctttctataccaaattcgaacattcagtgggtttttatatctccttctctaagatgattattcatgtagggtcctagagaacctccaatggaggtaaatataaataagaggaacattcttgacaggaagtatgtccatataatttaaagaaacactatctgacaaaaaaaatgcttatatataatgtaaagaaacactatctgacaaaaactgtgcatatatttgcatctgtttgccacctgcaattatgtgtttaaatgtttctcaggctcccagacgtttacgaagcgatatctgtcaaacatatgaaattgaacattccattctcattttaaaaatatcattttacgtagtaattttcatactaagacactgcatttccttcccatgaagagtacaactaacgctaatggttgaattacagtccaagacagtatgttgtaatgccatttataactggtgctctacaatcatacctcacaagataaacagttcttaaatgagttcagatgtttactacaatgcaacacgagttttaaatgactaagttattttattttggaagaataagaagtcttagttcccagtggagtgggaaattctgtcaacaataatgcttagagaagacaaacaagtagaatatttaaagataaatcaaaagaacactgttttattcctgtgttatgtttaggttatgtctcccaagggtcatctaggttgtcaacctatgtggatggtattaatcagatacctgaaaaattcttcccttatgtttcctaatttagctataaacttaatgttaaccaaaataaataaattttatttttattgaaggcttttactctattcatttagtgaatacagctacctgcctttgatgtaagatataaaaatggttatcttgccatcgttgaagaccttcaaatctacagtctgaagcaaagcagaaactgattcagatttaccagaacttataaaattgacaaaaagctacacagatatatcagttttatttttaactgacatgcatttatgacattgtacaagaaccactcaatgataaaaatatgctgcctatgatatccatatctgtgttagatatggtcttttatgactggtataattcaaagtaaaatagacaatattgtataagaaaaacactagtcttaggataatatattgttggagctggggaatccttagggaatatctagcttgccttcccactcttattcttcagaggatgaaaatgagattcagggacattaagtaatattccctggctcagaaaatatcttattgtctaaaactagattgccatccttatgttctgaactctttctagcctatccaatattctttccactgtactacactactctttatgttaaaaatcataataaactttgcttgaagagcagtaaaataaaactgttactttgactgattcctctagtgaatttgagattaaaatatgatgatattgaattgaaataaacttagaaaaatgacagcttcccagccctcttaagttagccatgattgcaatgaatataatcttgcagccaatttttttttgctgtatcccaagagataatctaggaaattggaatatttgaaagcaatctgttacactcacatctgtctacctacagccaattgaatacaatttttcttgctgatttactatattttactaagactgcacttagcaccagattatgtcagatattcagaaaaacttcctaacaaaattctaaaattattgatagtcatgccacacatagacacagcctaaaagctgttgtactagtctacgaggactgccataacagttatgagaattaccacatatgggtaacaaagttaccacagacggggtaacttaaatgataggagtttattttcttcctgtttcagaaagtgcaagacaagatcaaggtgccattaagtttggtttctggtgaggcctttcttcctggcttgctgatgtccaccgtcttgctgtgtgctcacatggcctcttctctgtgtgcatgcagagtgagagatatctggtgtctcttcctcagtcgtatcgaatttggacttcctcttcttataaagacaccagccctatcaaattaggaccccagctttatgattccatttaaccttaattactttcctaaaggccctatttgcaagtcacattgggggttggggcttcaaagtatgaatttgggttggggggatctattcagtttataacacctgttaagcatatacatttgatgttacttcatcacatcttttcacaaacttttaaagtggaatctacctagaggaagctggcatatgcatatgtgttatgaatacagtaaatcatgattgaatgacagaggtacattcaaactagccaccacccttacatttcttactattttgctgcacttatccagagcaaaatttaactaacataaaagaataaacatcttttttctctgaaaactgttgaaccaaatgtacaatgggtgacaatggcagtgaacaggttttgtgtttttttaaaaaataggagaatacacatttttctcaagtacacttagaacactctccagaattgaccatatgacagccataaaacaagtcaataatgttaaatggctaaaattatacaaagtatccttttcaatcacaattgaatgaaactagaaatcaaggatagaaggaaaatccaaaatatgtggaaatttcttaaacaaccaataggtcaaggaagaagttgcaagggaaaatataaaatatcttgaaacaaataaaaataaaacaatttaccaaaacttgtaggatgcattgaaagcaggaaaatttatagctataaacaattacattaaaaagaaaaataatctcaaatcaacaacctagctttacatcataaagaattagagaaagaacaaactaaacccaaagtgaacagaaggaaagaaataataaagactagagcagaagtaagtaaaatagagaatagaaaaacaatagagactatccatgagcttaagaattgtttctttaaaaagatcaacaaaattgacaagaatttcactaaatttatgaagaaaaaaaagactaatatttaattaatatcataaatgaaagatgagaaatatcaagaatgaaagagataggaaggatccaaatagcactataattgtaaagagattgaatcagtaataataataataattaaaaaaaaaaaaacaacccttgaccaggcgctgtggttcacacctgtaatcccagcactttgggaggccaaggtgggcagatcacgaggtcaggagttcaagaccagcctggccaccatggtgaaaccccgtctctactaaaaatacacacacacacacacacacacacacacacacacacacaaattagccgagcgtggtcgtgcgtgcctgtaatcccagctactccggaggctaaggcagtagaattgcttaaacctggaaggtggaggttgcagtgagccaagatcgtgccactgcactccagcctgggcaacagagcaagaatccattgggaggggaaggggaacaaaaaataaaaaactcttaacaaagaaaagctcaggaccagatgtgtttactggtgaattctacaaaacatttaaagaaaagttaacatcaatccccttcaaattcttccaaaaaattatagaaaaggaaatacttaccaactcattctgtaaggtcagtgtgatcctgataccaaagtcagaaaaagacactgcaaggaaagaaaactacagaccaatactgctgatgaatattgatgaaaagttctcaacaaacattagcaaaccaaattcagccacatatttaagggattatataccatgacccagtgagatttatttctggaatacaaggatgtttcagtgtattaaaatcaaacaatataatacactacattaacagaatgaaggaaaaaaattatcatctcaatgtacaaaaaacactttcaaaattcaacatccccttttatgataaaaaataagcaacaacctagaatagaaggaaattatctcaacataataaaaactacatataaaaaacccacagctaacataatatgaaagtctgtaagctttacctctaagatcaggaacaggaatagggtgtctgctatcattccttctatttaacattgtaatggaatggatttgaaagaaagacattaagttgtcttatatgcattatcgcctgattttgtaaatacaaaaccctaaagattctacaaaaacattcttagaactaaaaatgtgttaaatcattttctccatttgcatgaaggtctcatggcaatcataacaattatttaagtgcctcaagttgtgaaagttctacaaaattcttagaactaaaaatcagtgtaatacattacaagtaaagttggaggacataaaattaacataattagttatatttctatacattaaaaatgagcacaaaaatatttgagaaagcaataccatttaaaatatcctcaaacagattaaaatactgaggaataaatttaactgaggaggtgaacgacttgtagactataaactacaaaatattgctgaaagaaattagacaccaataaatggaaagatatactgtgtttatgaactgagtgacttagtgttattaagaagtcaataccccccaaagctgtctacatattcagtgcaacccctatcaatcccaataatactttttgcaaaactagaaaaatacatcctaagaatgatatggaatctcaagggaccttgaatagctaatacagtcttaaaaaagaacgaagtgggaggcctagcactttctgatttcataacttactacaaagctatagtgatcagaacagtgtggatgctggtatgaatacaggtatatagaccgatggaatagaatagaaatcccagtaataaactgtcatgtatatggttaaatgattttcgccaagagtaccaagacttttgaatagggaaaagacagtctatttaacaagtggtcttagaaatctggatatgcacatgcaaaataatgaagtgagacacttaccttatgccatatacaaaaattaattcaaaatgaatcaacgaccttaaccataaggggtaatatataaaaatgttagaagaaaacataggggaaaagcttcattacattagatttgataatgatatcttggatatggaatcaaaagcacaggtaacaaaaataatacattaaaattaaacaaacacttttgtgcatcaaaggacactgtcgacagagtgaaaaagcaacccacagaattagagaaagtatttgcaaaccatatatctcataaggagttgatatccagaatagctaaagtattcctacaacaacaacaaaactaaacactcagattaagaaatggacaaaggacttgaataagttctccaaagataatatataaattgctaataagcatattaagagatattcaatatcactaattattagaaaaatacaaattaaaaccacaacaagaaaccacttctcaccgattcgaaaggctattactaaaaaaagaaaaggaaataccaagtgttggtgaagatgtggagataatggaagccttgtgcattgttggttggaatgtaaaatagtgcagctgttgtgaaactgagataatgaatagttcttcaaataattaaacagaactgacatatgatccaacacatccacttctgggtataaatgctacagaattgaaagcagcatcttgaacagatatttgtgtacccatatttatagcaacattttcataacagcaaagagatggaagaaatatttgtgtctattgatggataaacagataagcaaagtgtggtatatacatatacaatagaatatcactcagctttaaaaaatgagggaaattctgcaatatgctacaacatgaatgaaccctgaaatcattatgctaagtgaattaaaccattcacaaaaggacgaatactggatgattccacgttgtccacctaaagaggtgcctagattagtcagattcatagaaatagaaagtaagatggtggttgccaggggctggagggaagggaagagtgaggaaattattatttaatggctttgggggttttgtttggaaagataaaaattctggagatggatggtgatgacagtttcacaacaatgtgcgtgtacttaatgctactgaagtgcacacttaaaatgggttaaaattgtaaattttatgttatattttttcacaatgaaagaaagaaatttacagcaaaacaaactcagacctgtaacttctaccatgtctaaaattaaatgggattttccctccactaaggaaacaaaggaaatcactttctaatggtgcatctctcactgccggaggcatttcccccaagccagtgatagcagggacaaaatacaactacctgtatagcagcaattttctatttaatactgatctagatttgctgtatgctgcttttcaaacatctcttccttgttggtgtagaatgacacttttacaattgtattattaattttttaaggaaaagaaaagtttggttcaatttccagacactctagtttctatttccttcagtttaaccatcattcttgttttcttcctcgggtttttttgctctgtttttcaccacctgcttcactctgttgctgtttttgttatgcctttgtttcctatgtactactctcttcaactttcctttgttacctgattctaaacaattttccccaccgtgtccggtattctctcatgttttgcttttctgttctggttgaaatgcagaccagtaaagagatcaggctgaaaatttatgtttaattaaatttgggaatagaacttttaattttgtcaacatcaccgcattctaaaatcttttactttcggaaacatgtgcccctacttagtcttctttgtgttaacatcatgttttttctaaatggtaatttacttatttatttattgtattttattttatttttgagatggagttttgctctgttgcccaggctcgactcattgcaacctcagcctcccaggttcaattgattctcctgccttatcctcctgagtagctgggattacaggtgccccccaccacactgggctaatttttatatttttagtagagatggggtttcaccatgttagccagtctggtctcgaactcctgacctcaagtgatctgcaagccttgacctcccaaagtgctgggattacaggcttgagccaccccactggcctctaaatggtaattttaaaatatttattccattcattctcaggtatgagtgaaaagcaaaaatgatgaggataagtgttatctcctcaagagcatatgaactctcttccagtaaaacacttctacaaaattttgagaaatagttaaaaatgtagatttcgttttcgtaaatgtagcgcattgtagattttatttgtaagtcctagttcacctgaaactctgagtaaaataacctgagcagtttgatatataataagaaattagatcaatgagttagtcaaataatgaatttctcagcctttgagttttccgagtaacccaaatgattttatgtacagtgactttgacctcaactaaatttccagtttatctaatttctattagatgagaaacggatggagaataactttaatatataaaacatttaagaacaatagaaatgtaaaatgaggatgataccaatcgttcgatgatttataaagtaggaaataatgcataaaactcacctcatacataaaagacactcagttatggtagactgttttctgctttcaagtcagttttatttttcaccttgaatccattttgagatacagtcagccttataaaactggaagtgttctgcactagttaattgtcagtgttagattctaagtggtaaatatttgcttttaatatttcttctcttttttatgataactttgtaatcttagttgatgtgccatcaccacaggtaattattatttgtatatttagttcttcaaataaaagagagaaaaaagcccaccaaaacccaagtagtcaaatatatcagattgatattgttcagttaaaatgaaaagccaccacatttggcaattgaaagttaattctcaaagaatgaaatataattaaatgtttgcattttttttttccacagtagctcacaggaattatcttccctcactactagtgcttacttcatgtactccagaaagtaagcaattacagtgtgtgtgctacaaatttgtccgtaatattcagttttataattttaacatgggacattctatgattttatattaaatggaaataaaaagatactgtcctttttcctctttgtttattacaatacagataaaatggaatatatgataaggaagcagtaggatattaagtttttttaatagaagaggatagtttctctgactttttagcaaagaaaagaaacattagttactatttttgagagaatagggtaagaaaaagatgatcttttgaaaattaagtatatgtattctgtagagtaaataagcattgttaggtacactgttggtttaaaattatttagcataaccaaatttggcatcattgcagtgccaaagaatgccctggccagacgtgtctatgcattgactttttccattggtggtaatgaaactgttccatgataaattaatttttccattttatttttctttcacaaaacatagttgattaccttttaaaaatgatacagtggaataattatagcctttagataacttgtagggcaaaataggaaatttgagagacatttaatatcactgtaaaataagttcaaggagggatttagtatgtagtatgaaaaaaatttattagcatatgtgttccttatttaattaaatagatttatttcggtgccacattctttcaaatttatcaaaatgtaataatacgatttttatattaacttacatgttaaagtaagagattggttcccgtgggaaaaaggttttgactaatgtactactcagattaataatatcactgacataaatactccattattttcataaatattactacacaagaacacatgcaaaaaggacaagtacctatctaaaatagttttccaattgtagaaatggcaagcatttactaaaaccttagaaatttgaatgtgtttttatttttaccagccaataatcatttttacagttttaaatttatattcaagtgaatgctgtttgaaaagtgtcattttccactgtttcaacttactattttattttagatcattttccctactaacacgagttctttttttaaactatgtaccctgaatgagaagaattaaccaggatacacggaaggcctaaaataactaactcctgttcaggaatagaggcttacccagtgtgttttggggtcatgtagacacttagtctagtacctgaaactattaataataatttagttgcttgatttccctgatgctcttatttcctataaaatagtctcttcattaatggctagattattatgtattaacaattgcccatgttttccttgtaacaggagctttttcattagtcctaatttgagaagagcaaagcagtctcagtgacaatagtaaaaagcagggataaagatgacatttcttcagtctgtaattccacaaaatgtgtacattttttttttctgtaagaaagaaggcagctaacttttattgagtccccactatgtgacagggacattgcaatgtactatacctgaaggtaggtatttttgactttgtctgcagatgataacacagagccttagagaaaataggtaacttggcaaaagtcacacagttagtcaatgactgatagagaagacaaacctacatctggccaaatacctatactctttccatcattacacacttccttcacattaaagaaaagatacaacttgtttcttgtggtccttacatttgaatatcttctatgtaattttttcttgaacaaattataactgtaaaattttcatgtaaattgtactgacacacgcccagtagtgtttgttgtgcaggtttattaagtacagtcatgtgtcatttaatgatggagatactttctgagcaacgcattgttaggtgatttccttgttatgagaacatcatagaatgtccttacacaaatctagaaggtatagcttactacacacctaagctgtattatatagcctaatgttctttggttacaaatctgtacagcacattaatgtatatatttgtaacctgtagacacatataatatgatggtaagtatttatatatctaagcctagaaaaagtacagtaaaaatacggtataaaaaagaagaaatggtacactcatatagggcagttaccatgaatgagcttgcaggcctggaagttgctctgggtgagtgagtgatgaatgaatgtgaaggcctaggacactactgtacactactgtagactttatcaacactgtacacttaggatacactaaattgaaggaagtctatttttctttcttcaatagtaaatgaaccttagcctattatacagggcccaaaaatattttatttgtttttattctcattctatagactttttctgtttttaacattttgattttttaaactcttctgttaaaaaataaaacaccaacacatatgttcagctaggcctacacctggtcaggatcatcagtatcacatcttgtctcactggaagatcttcagaggcaatagtatgcatgaagctgtcatctcttatgataacaatgccatcttctgaaacacctcctgaaggacatgcctgagactcttctacaactaatttcttttccaaagttggagtacactctaaaataatgataaaaattgtaatatagtaaatacataaactagtaacataattgttaattattattatcaagtcttatgtactgtacataattgtatatgctatgcttttatatgactggcagtgcaataggtttgtagacaccagcatcaccacaaacacgagtaatacattgcactacaacattatgatggctacgaagtcactaggcagtaagaatttttcagctccattataatcttatggaaccacagtcatatatgtaatctgtcgctgaccaaaacattgagcggcacagggctgcatatcaacatagagcactggattgttttttgcaagttttgtgggatatctaaaacatcgatatacaggatcaaggttaataacataaataggtcagtaagattgttttctagtctgtgaagatttaaaagtgcaatgtttgaagaccagatgaagttaatattactatgcaagcctctacaggtttggatttcaatatgtttaaatttgaacgcttaacaatatgttatgatttgggtttccatttcatttatttccctttcaagttctagcatgaattttgagaatcttcatcaatgtccctgtgaagtaaatgccacaagaaaagtgcaatcaatatgtgcacctcccagagagccctaaacaagttgaaacactaaacaactttcaaatctttaaacttttatagatgctcatagatgcactgtaatattagccacatactctatgtcttattaagatattctgtaacatgtgctatttactcctgccagatctatatagcataaagtgcactggaggattggcatctatccattaaattttaatcaacacagagacagtttggatatttaaaaccttcttttatttacagctggtttttaaaattattgttgtttcttttgtttgctagctagattgcttgcttgcttatttattgactggagccatgtgaataattttggaagtcccatctcacttctctggcctcagaaaagtgaccttaaaccacaacatccttgatagaaatgatagaaatgatcaaattatttaaattttttatgttttggagacagaatctcactccttcacccaagctggagtgcagtgatccgatcacagcttaccatagccttgatctcctgtgctcaaacgatcctcaacatcatcctcttgaatagctgagactacaggtgtatgccatgatgctgggctgatttctgtattttatgtagagatggggtcccaccatgttgcccaggctggtcctgaactcttgggctcaagggatctgccctccttggcctcccaaagtactgggattataggggtgagccaccacccctggcctgaattatttaatcttagagcattgttcttcacttattgcggctgtatgtttttaactgaaaccatatgaagagttgggaaattactcaattaatacaagtataatgaccaaaacaagaatatatttcatttttatatttttattcagatggacttggcaaatgaattcaacatgaatattacttacattaatagaaaaaattatcagtgctcttctgaagtcaaggcaagtattcaaccccatatgctttaaccatcacattttctgaacaatctttgtgctggcaattgtgctagatgtacaattgtgctagaagcaggtcatggtggcttgctttaggtgaactcacagtttagtgtaggagaaaggcaaataaattatacattataaaacaatatatttaatgttttccctagaatttgccaaatgctaggcaaataatattgtagaaataactgcctgggaaaactgtgaaagtataaaatcgcataagatgctgagaaatgtagtgatctctctaaacagaccagtgaatgctgcatttgatttattaaacagttcgtcaaaacttatttttcaaaaggagttccccaattagcatcttctttatatccaagatgatataaaatatgatgtattatttatctcttcttaaaataattggacacttttttcataagacattatctgtgattatttatccaataattagtttagaaatttaattaaacattaggagtttttagtgtcattttgaaagaccctattatgaaattatgaaaacagtaaggtcaggaaatgttttctgttattgaccttatgttatttgtttatttaatttagaactctttacaaataacttactggggtcaaaactgctctgacactggtatcagaaagacttttgagaaaagtgaatttactttgtatttcaagttcaaagggatttagatttggtagattttggaaacttctcgccctgcatctgctaaaaaccaagcaacttcctttctgaatttttaatctcataatgcccctgtagtcattaaagaaccaatgcatgatagacatttattcactgtgcctttctacattgaaaagctgaattaaggtctccagagccaaaatggaattaaaatgtttatgtcttaaagacagccaaacacgtactttcagaaaaaattgcagtcaagggggaaaaaaacagaaagtaatttgtaaaactgttcgtttttaaactttggagttagagagtggaaatatgatacagacaagagtgaagaaatgttaactaaaaagaatgtgttatagcttgtgaaactgtcccctcccaccccccatccctgctaggagtaacatttgcattcaatttgaatgaagacatactgatagaccaaaatagtttgatttgtctttagagagtccttcttcatcctctcttaatctataatatgtgtttccacattccttcttcaaatttcttcattattctaccagtttctttaaggagtcccaaaactgtaggctagacaaatatgaacctttctgtttgttaaaataatgcttctttgaataattatttttaatctctttctctttctttctctctttttgtaatgctgcttctcaatgcacattgtattttaaaatcagtacagagtcataaacttgacaacaattgttgataatactttccagtggtacgtaaaatatctcaactatttctcagttggaatgattgggtacaaatgtggggaataaatctatagaatattttgaaccaagatttaaaattcatagcaaatctaagcagttctaacagatttttttcgctcactaatatttaagtgtaaaaagcaatttagtgtaatagacaagctcacagatttggagttatacatacttgaggttagatcctggatatcacatttattaactgtttgaaattcagcaagtcacataacttctctaaaactcaatttaccaaactagaaatgagaagaataataattaccttctcagattactgttagcattcagtataatgttagacttaaaagacctcaacatacagtaatttttattaaatgttacttattgttattagtagtactgatagaagtagtaacaatagtagtagtaatagtaatgtaatatctaaaaatgtaagattatcatttacttatttttggtgtttcttagcttcttttatctttaattgtgtaatattctaatgccatattaatttgttcctaaaaaaaatttaagtcaaatcaaatttgcaccacaattaccgtggaaaaaatacctctttgaataagttcattctatcaaaatacactatctggatgaaagtgttttccttatatttttattgtctacctacatttcaaaattactctgtttttatcctctgatttgggatttgccacattcctgagacttccgtgttttgtagctaaacttgatttttgccgtgcttttctacagtgtcaaccagaaaagtctcgcctgtacaatccagcaatcaaaactcacttgcaaacacaaagacaaaaatagaaatagtcagtaggaagcagtttttccctcaaattttttctctctgtgattgcacagcaaagctcagacttttttttttaaatacagatactgggtagttgagatttgtgattaaaaaaaatacaggccacaattgcataaaccatttgtttctcttatgagatattttttactcttgcactggtgtgaggtcagtacttgacatcatctccatggatgtaggacagcaccattattatttcaaagcaccttagcctgggaatagatttgtttcatgtctgattacataaaatctcaataactgtttcactatctttctaatcataggaaaattggcttttctagaacaaaattaaaagaataccatccaaggtaaaggcaaacaattctgtaattgtcacttttgtatcaatcttactgatcaattagttagaggactgggaagctgttaacatccttaaaaaccataaaggaaatccatagtcatttagcgatttcaccggcattataacatgaaaaagtcttatttgtttaaactaactatgactgtctttatatagcaactttttctcacagaataaagtacgtattgttactttattcaaagaatgtaaattctctctaaaaatagtccaattttgcaagcattttgcaagcagcctcattgctatatgggcacaactgtaaagtaaaccaaaagatttcattcactatcaaaatgttttgtgaaaataattagatatcttagataaccacctggattttctttccttttgttcatgtttggtgaactttaagcagggatcctgattatctttatcttgagagtgggtagtggaattcatcttcctctatcaattggtcatttattatatatttgtgtccacagtatatgtcttgagactgtcttgcaaaattattaatttaatttttgatttttcaagataaacaaagatcaatacaggaatactttgaacttaaggttttagacattcagtaagagaacaaaagataaaattaaataatttggattgaattttaagacctggtcttctacttaatgggaatgagaccacggccgtagaattaaaagtcttatatgccttcattgcttctttttttgctttaatttttagtagagacagggtctcactatgttgtccaggctggtctcaaactcctaggcttaagtgatcctccgctttggtcccccagattgctgggattacaggtgtgagccactgcatccagcctgccttcattatcttctatgtgaaatgcagataagcacacctaactcagataggattatcaggagagtgaaatgagattttatatatataaagtgcttacatgtggcctggcatatcatgagtacttgatagagagagctgctattattatcatcaatgataaattaaaatttataaatgtaaaataatactgataagtagatcaagatcttttcagtttgtttgctagtggacacagaattttctttgacatatcaccattcatttttaacgctgctaatcttacacagtttcctttatcattttgctgagcatcatggtataattctaatcaatgttcatgtatgttcagtaagttaattaaagcttccatgcccaaccaaaatgctaccacagttaatgggtttggggttgattaccagaatcctatatgatatgatattcttctatatattgaaacaaagacaataacatctcattctaccttgtctcatacgctcacatttgtgtacagtacacaaatggagcatgtgtctgtggcaatcggctagtgagaaaaataaaatatattagcaatcattatagtagacaaaagttctagctcacatgcctctgagtttttcatctgttaatagaatcctgctgaaatgtatattacctgtctctgctcctgttctggaattttagtatagaaaggaagtgggcagatctaacaaatagacaatgatctcatgatctctctctctctctctctttctctctctctctctctgtcacacacacacacaaacacatactttttttcaactaaatcaataatatgaaggatatattatccataaatcactaggattactgttaccactagcaaataaatagtgtctaaatacagttctaaaaagttattatgattcattgcacataatgaattataacaatatttgaagatactggaatgaaaggacaaattttccttacaatcttgtatactcacattaattaaagaacccacacaatttacaaatttagaaaaggagaggaagatttatttttataaggggttacagcctgtaaggggtccatcctgcaggctgagaagcatgcctcccgcaaagaccagagacaggcactttaaagaagggggattggggtaggagctttatgctgaacagattggctaaacatacatattcaacaggttacaggaggagctatgaatatttatgaagatcctgacacatctattgaacaaacatgcatgtaacatatgacccatgttcactttggggcgaagaccttaacattttaatgtattacaattgggacctatacatgaaaggggcttttctggacatgaagacatagaagcttacagcctctgtaaagttgccagaatcagtctatggttagtgggcttcttatcaggagaaagtcctgaaatcagttgtcttgtacaatcaaagctatagttatggcttgtggaacaggaggtcggttagtcagtatctgtgagctgaactgtaattttttttttttttttttttttgagacggagtctcgctctgtcgcccaggctggagtgcagtggcgcaatctcggctcactgcgagctccgccaccctggttcacgccattctcctgcctcagcctcccgagtaactggaactacaggcgcccgccaccatgcccagctaatttttttttgtatttttagtagagacggggtttcaccatgttagccaggatggtctcaatctcctgacctcgtgatccacccgcctcggcctcccaaagtgctgagattacaggcgtgagccaccgcgcccggccgtgtaattgttttaatattgcttatctcatggccagtgcttgtttagctgctagagaaaaataaaaaccttgtggaaggttaaaacataatttattctttaagtttaagagtcttaacccttgcctgctaaggccttagatcctatgaataatttggtatcttattaccacagagtctcttctgtcatcttatgatctcaattttaacattaatgctggtcagttgcgtctacaccccaaaaggaaggaagtataatgaggagtgactgacttcccatctcatcatgcctgaggactgtttttaagttttttttctggggtacccttggccaagagaaagtccattcattcagtggtaatgcttaacattttatttttagtttatattaatttctcaaccattatgttttcttgtttcgatttttgactatattacatgcagctttcacataagtgcacgtagagcatacaaaatattttctatttttaaagcttttccagcagaaacgtatatactttgctggtatacagccttttaaattataattaatgtctgtctaactttctgctgatattctctaatggctaatttactccgtagtctattttaggaatttgatcttacatacttaacacatgcacacatacacatgtttacaagaaacaaagagtactaaatattcagtattaccttgaatataactaacttgttcttagataattactataacatttcccagaattatgtgcaatattctccaaatggacaggtgactgaatcaaatatgcatgagaaaaagcacaaataacaaccaaaacaaaattaactgatattgactcagtatttacaatgtactttccattccttattttatacaattcaaaataatcagagaaaaaagttatttttatcatcagtttacagatgatgaaattgaagctgaagggttgagtgcaatgcaaggaaaataggaagaagtgggcttaatcatggggactcgggtatagtctatggctttatgaagtcgttatatcttatttactgtaatttgatcatgtttctcgtcatctcagtacaaacatatatgacatattttataaacagataactctacaaatatttcttgacaaagatgagtagttacaagaagtgtttccaaggtaacaatactaattcaattgctatcataatactattattaataacgctcttatcaacactcataaagtctattgccaggggaatattgtcattctaaggacaaaagtatgacagagactgcggaaaatagcttgaaagcaaagaatgacagcaacactgaaatgatgaaggggatacttaatactgtttgattttaataaatgctttagctctttttaagtggtattatgtcctttagatctgtcaaacaggtcgtgtttcctctctcaggattcagattgtctagtcattggaaccacagggaaagaccaataacttgaaattggtagtacgtttacagctacttcctttagttgctgagtaatgacgctatcctttctaggttatctgcttgcttaagcaagaaactaaccaattaacaagcaagtgcattgtaataaacaaatactttatagagatttaatgggagaaagcctatttctttctgtttaatgccatcactatgcttatgtaaacagaaaatattaaagctgttgttttaaaatggaaatgagctctttcttatatagaatcaattaaaagtatgatatattataaaaactaatctgaaacactgtcagactgtgatctttttctctgctgttacactacttagacaggctgatattgattgaaactgttgcaagacaaggaagagaggtaactataggagttgtcatttacctaccactctaagatgaataaagaatcagtaaaccctcagatccatcttgaatgctggctttcagacctgcctcttcactggtgacttggtgagcccatgtataggagagtgttctgcatttatcttgcaatctaccccattttccttgactttcagatactggctttctttttttttaatttaatttaattttattattattatactttaagttttagggtacatgtgcacaatgtgcaggttagttacatatttatacatgtgccatgatggtgcgctgcacccacagatactggctttctactatgattacaactatgtgcctctagacaagggaagttattaatcactccccaagaccacctccctctgatacctttgcaatcatcagactcaccagctttttaacagtgtcgaatccatttcagttaaatatctggatttctctctgtttcaacaatgggaatgaaatgggattactttacacagtttcaattttttttccaggctttaataacatacttattaccaatccaggaaaattaattctgttaaaaatacaattcaataaatcagtgttccagagagcagttttaggtcatgatctaagcctatataatatattctgtatttctttattaaaatcatcttaagagcaatgattatgtggttctgctttaagctggtgagttaaggtgagattggcatagggagagactctcttggcttataaatggtggaggcattacaaaaatcctctcatatccttttttatgatgagtaggagtgtgctatttctagtacagttaggattttgacaagttatgctcaagtaattgatgtttgccctaccctgttggctagattgctcaggtcatgcttgaagccaccccaggaatcatggtcttctgtgtaaacctgacaacctgttgctggaaggcaataagttaatttgatggtgtccaaagtagttataaatcaatgtggcaatctctttcttccacgtcaatagagggaacaatctgacttcatagatcagatacatttaccttcatttatagctttagagtgtcacagcaatctgtagagttattgagataacttggtgacattcttctagttttcttcaaatgcctttgggtaacaagaagatagacaatcctaaataatgtttatataaaatttattgcagagttaagctcctaatatagaaaagatagcaatgtagtacatgataacactatttatcaccatcactttgagtgccatcattaagatactgcaattcttctcttaaaaaacttttattttcaggggtacatgtgcagttttgttatacaggtaaattatgtgtcatgagggtttgatgtacagattattttgtcactcaggtaataagcatggtacccgataagcagtttttttattttcatccttctcccaccagccacccttaaatgggcctcattgtctcttgtctcttctttgtgtctatatgtactcaatgtttagctttcacttgtaaatgagaacatgagatatttggttttctgttcctgtgttaattcgtttaggataatggtctctagtttcatccttgttgctgcaaaggacacgatctctttctttttatggttgcatggtagtccatgcattttcttatccagtctgccattgataggcacctaagttgactctatgtttttgctattgtgaatagtgttgcagtgaacatacaacatactgcaattacttggaacaaaaagataactcgttgagaaggatagaaactgaacaatcgacatatttggagatggtcttgtacactcctaaacttggcaacattctatgcccaagaattctagaagcaatgactcttacccttattcaccctatattctctgatctgaaatcatataaatgaaaacaggaaggaaatgatagaaacagacaaaaactcttgcttttttccagacattatatatacattttaaaaagaagtattataactttaagtgacaatcaaacataatattaagatagtccctctacgtgaaatcattctaatatcaagggaaacagcaatttaacaagtaaattttaggaaatgcagcgttccaatttaggtaccaaaacttattttaaatgacattttcagccaaatgagagaaaaagaaactcaccatttttttctcatattattctaatttcatccctgtgcagtatagaagccagattgtcactgtgccctgggaagctttgcaaatatggcacatgccacagtcagcatgaccctgacttatactttaataactccttgatttagcagacaaagcttttctctgcctccaatacaccccttaatctagcacttgtccccatgctgtcccatggttgctcaaagccatcttatgttagtttcatccattgttccataattttcctcagctctactttcctataacaactaacctgctcctgttatttctctctgtagtcaagtgtttctcagagaaattaatgccacagtgctaataattgttgttacctgtcattagcactataacctctatagcatgttatccctttcagatatcaatttgttaaaataatgaaagaaacaagtcctctggttatttctatgtaatgaatcactctaaaacttagtggtttaaaataacaacaattattgtattatgtctcacagtatctgtgggtcaagaattcagaagtagcttagcaggaagttctggcttgtggttgcagtcaaaacagcaggtggctgaaatggttggaaactggcaaggaagcattctgttcatgtagatttctggcctctccatgtggagtagtttgggcttccttgcagcatggtagactcggggtaatcagattgcttacagggacgctgaaagatccaaggatgaacatcctagagaagcaggtgaaagtgtgcagcatttttatgacctggcattgaaattcagagggtatcattctgctatactctgttagtttgggcagtcacgaaagtccactgagattcaaggggaacatggatattcaaagggaacacagattctatctaccttttgatggtggaatggcaaggttctaggagatatgtttctagtcatctttggaaaatgcaatctgctaaaatgagtaatgtgggcattttgtgccctttattatgttactctctagcatattattttcaattatttttaataaactatatatatatatatatatatagagagagagagagagagagagagagagagagagagagaaagagacagtggaaaataaaatgatagaacagttgatgaaatgccacttaggaatttttattttctgttcctatttctctccctaggaagactacctaaatgaatataaacttttaggtacttttgccatatttagtgaagatattgttacccatataaatatttgaagagttagaatctctttaaaaaagaaaaattcacagaaatcattagaaatgccaaaacttcatctcataatttgcagatgtaatacaataaataattataaaacattccaatatgaagtctctcatcagtattctcaggtatctgtgttaataatctgaaaaactagagcatgtatatctgatatattgtcagctaataattgcatgctttcaaaggccatatcttaaggaactcactatagcgtaaaaataaagagattaatattagacctaaaagtctaacatagtagggtcaaacaatggacttgaaagccctggaacattttgaatatttgaattacataaatcgttttaaaaacaactgtaataaaaaaccttgtgttaatgagttttaagattttgcagtgcttcatagccaagtcttgagatacaagattgaatgtgtatttcttaaaaatacaactttgtgttgtactttgaaataaatgatgctttaaaaaaaaaaagcttttgcagtgcttgattactgccaaaatctcttatttttcatgtgcacttgggcagtctagttgattgcatactgagctgtcctctaaagctttaagggaatttattttaaaaagactcataaaaaaggtttattcagactacctgcaagacccccatgtgctttttgctacttgagataataacatctattatgtgagaaataataattgtcactctgaaaagaaacaattgatttcactgttttactttgggtcctggcagctttttatcctgactttttcagaattcaattattgaagagatctctaactgtccatacagcatgcacctgggattagtacacctgctatttctattcaacatggatatatcagcaaaagctattttgctttttcttggggaagattttccccaacagaaagatgttttcttttgagcaactaaggtattgacaattaagatgcaaaaaaagattatgcctgtaaatatttctttctcagaaatacaacatatgatttctgagacataacttacatgatctgatcatggaatgtgttattaaaaaatgtcctgtttaaaaatttttcagaaagccacttaaagtaataattacttttaaagaagtacaagtaatgaaatcatttgaaatttctatttcttgtgaagattaagtgtcagggagtgaatttacccttcacctgaaacaacaaagaaaccaaacaaaatgtatgaaacaatggttctcaacatatcatacataaaggtacatgaataatgatacttaagaaatagaacataaatgaaacaatagttactcttgccttagcttattgcttgcatataatttctatcctttagcacagggagagggaacccaaatagagcatgattgggccctcgtagtaaattcatctcctggaattgtgagcccagggaggtcaaggtggctagggtccctggtcagtgcttatagggaaatttatggcataaaattacaatattagacaagaagatctcaaattaactatctaaggttccacagtgagaaaccaggagaagagcaaaagaaaaccaaattaagcagaagaaaaaaagtaatacaaattagagcatgaatcaatgaaatcaaaagccaaaaaacaatggagaaaattagtgaaaccaaaagctagtattttgagaaaattaataacattggtaaaactctaggcaaactgataagatttaaaaagagagaagaaaattaatagtatttggattaagagatgatatcactgcagatattaaaagtataaaaagggagtattaatatttatactgtatacgtttgacaactttgatgaaatatgcaaattacttggaagagaaaacactaccaaagtccaatcaggaagaaatagcttgagtagccctatatcacttaaagaaattgaatttattactaaaataaatcctctcaaaaagaatactccaagcttaggtggcttcactaggaaattctaccaaatatttaaggactaaataacaccaattctatacaaactccaaaaacaattatcaaaagagaaaactataccccaactcattccttgaaactggaattagactctgataccaaaaccagaaacaaatatttgaagagaagaaagcttgcacaccaatatcctttatgaatatggatgtaaaaattcttaatgaatatttggtgagtcaaatccaacagtatacgaaaaggatactatttcatgaacaagtggggtttattataggaatgaaagatttgtttaacattcaaaaatctatcagtgcaattcatgatattaacagactaaaaaagaaaaatcatataagtatctcaatagatgcagaagaataatatgacaaaatctaacatttacttgttgtagaaactgtcagcagactaggactagaagagaagcgttgcaacataataaagcatatctgaaaaacctatggccagcataatactacatgataagactgaatgcttttacttaaggatcaggaacaaggcaagaatgtcccttctcacaaccactatggagatcaattagagggtttgtcaaaaaactaaaaatagaactaccatatgatttagcaatctctctgctagatccacattcaaaagaaagaaatgagtacatcaaaaagatgtctgtactcccatgtttattgtgggacaattcagaatagctgagatttggaagcaacttaagtgtctatcaacagacaaagggatgaagaaaatgtggcacatatatacaatggagtactatttagccagaaaaaggaatgagatccagtttttgcatcaacatggatagacgtggaggttattatgttaagtgaaataagccaggcacagaaagacaaacttcacatgttctcacttatttgtgagagctaaaaatttaaaacaattgaactcatggagataaagagtagaattatgtctaccagaagctgggaagggtcgtggctggggggaagtaaggatggttaatgggtacacaaatatagataaataaaatgaatatcatctagcatgtgttagcacaacagtatggctacactcaacaataatttattgaacatttacaaataactaaaagagtataattggattgtttgtaacacaaagaaaggataaatgcttgaggtgatggataccccatttactctgatgtgattattatgcattatatgcctgtgtcaaaatatctcatgtaacccataaatatatacacctactatatacccgcaaattaaaaattaaaaaaaaaaacttagaatgaaaagacaaaccacaaagaaagagaaatatttgaaaatctcatatttgctaaagaatttttatccagaaaatataaagtactctcaaacctgtgtcagaagaaaattatcaacctaattaaaaatgttaaaagaactgtgaacagtcatttcaacaaagaagatatatggatgaaaaacaagcacattaaaacgtgcacattactaatcatcagggaaatgcaaaataaaataacatttagaatacttaaaattaaattgattctttgtatcaagtattggtgaagatgtggagcaactgaaactctcttacactgctggtggaaatgtaaaattgaacatgttggaaaacagttggtcagtttctaataaagttaaacctactcctactacatgacctagtcattccatccttattcatttacccaagagaaatgaaactaaaaagacttgtgcagacccattcatagcagttttattatagttgaagtctaggcacatccgaagtgtccatcaacagtaaaattaataaacaaattgtagcaagccaattaaatagatttctattcatcagtaaaaagtaacaaactattgatacaggcagcaacatggaggaatatgcatataattatcctgagtgaatgaagccagataccaaacaagcatgcatactgtatgaatcaacttatgtaaaactccagagcctgaaaactaagctattatgtcagaaagccaatcgatgctttcttgagaaatgaaaatgttcaagagtgagagtgaaggattacaaagaggcgcaaggaaactgttgagggtcaggatgtgttcactgtctagactgtagtagtggtttcatgagtgtatacatacttcaaaacatatgttgtgcattttaaatatgtgcagtttactgtatgttaattaaaacttaataaagcttttaaaaatacttttgtacaaataattatgataggctacatcttaaatgatgttttcatcaaccttacaatttagctttgtaggaatgtctgaatcccttgcaaaacagtagtcattaaatgcccgtttcctgtcttgatatcattcatgagctgattttttctttccacctcctcctcctcctctttcttcttcctcttcttcttcttcctcttcctcttcctcttcttcttcttcttcctcttcttcttccttccttccttttcgccctcctcttcctcctcctccttttcctcctcctcctcctcctcttccttcttctgcttttacttctttctttgtttttaaattgcctagaatgtcctgactcttgtggtaactgcctatgctagctatggtataccaaaagaaaatgcataaaactttttgcctgccatcaaaaaacttttggtttcgttgggaaaaaatatgaatataaaaaaggaaatagtatagtcaatacaagacagtacatatttaagcaccaaattttctgttacaaattatgatattgaagttatgaaaagcaaaaatcaatatataccataatagattggggaaattttacggagaaaattggattatcagatattttattcaaatggttctcttcctttttaaccaatttacaccttaaaacatttggtttaaaaattatgtcctctacaaagccttctctgattaatctcctatcccttatcaccaggtattaatatacattctctcaagtgtgttgaactcagtttttctcaatttatttgcactgttacatcattacaactataatttaaaataaattgtggtcaataaccctattttccatctttccttctccttgttgctcaatgtactgttccatgaataatggacgttcaaataaatagcattatctggcacacattaattataatacatgccataacgagggtttatattcacaacctgaagtctgtaattataaactgttaaagatgccctattaatacagttacagtgaaatcaccaccatttgcaaattatgtgctgatacttaagtgctaaagtctcttaaatttcttgaagaaaatggcatgatattcagtgtaatgagacttgtataaataagaaaatttaagaaagcaagtaaatacctttctaatgaccattgcattacttttgacaatagcttttatttatttgtatcccagggcagctacatttgtaacaatattcaggttagccttttgtcttactttcccacacttttacttgtatataggtgtgtgtgtgtgtgcgtgcatgcacacatgtgtgcattcacgtgcatgcctctgacatataaaggtgaagaccataagatgtgagttctcaaagtttttaatttgagctcctatgtgtttattaaagtaccactatcactactccctgttgatactcactttcagttaataaaaaattaaatcagtaacaattattggctttaatttacaaatatgttctcacaatttctaaagataaatgacaacttatccttaccatatgcttttacaaaatattgtgtttattaacaggcaacaaattgggtaatttgaccaatcaatcttgaaatgtagttactaaaacagcagcagcagcaacagcagcagcagcagcagcagcagcgcagggaactggttggaaatacacattctcaggccctacccagacctactgaatccagaacttcaggaataagcctcaaaaatggatgtttccatagactgctagcttatcctgatgcatattaaagtttagaataaagttgagaatttgggttagacccagtggaaacttaacaacttgggtttatgtctaggcattcagaggggttaccaaataggaaatattgttatattaaatcccaggttagaaactgtgagggtagaagcatttatgcaacatgtacatgggaggcaacagaaggaattagtttcatgcccttatttttgctaaaaactattagggtttaatgcctactcacaccatgaagtgacaataagaacttcaataagttatgtaaaacttttgtgacttaattttaatatcttcaaaatgagcatgatgatattgacacctgatgaataacgttgttgtgaagtttaaatggcttaatacgtataaagtatttgaattacaggagatttaaatcctaatgtcttgcatgagaagatattttgtttttttttttcttttttatggcttgtgtaatagagctgacaattgatgcctgtgtgagtcatagagtgatgaaattattcctacctgttcgagacagcattctgtactaaataactaatgttttatcaagcgttcaatttcccaaaaattgctttggaaataattttcgctattcagaaatttactcaaagtgaatttcctgatataagcccatgtgcagcaacataagtcaagatattgaaagaactcactttgagaactttcctgagggaaggtggtcatagagcaggttttattatctgagtagaggttgtagacagccaggacaagttaattgttagtttcaggtgacaatttgcctaatttggtttatatactttgttccattcagtctttgataccaatttagcatatataaatcatctatgatatttttggaaagtaaagttcaattaagcaacacacacttattaacatcttcaatgacagaaaaaccataaagtattttattctcatagaaaaccagcaaattattatcagtgttgaaagtttgagttgggatctactttaactttgtgctgttctagtttggctgccttggaaagtctccatttgcatttcaggctctgacaatagcattcgctttcagactgtggttgtctcttaaacaacatgggtttgaaatatatggatccagttatacgttgatttttttcaatgaatactgtaaattgttttgaaatttctgacaatttggaaaaacttacaaactgtgtagcccacagaaattgaaattattaagaaaaaggtatgtcatgaatacataaaataaatgtagacactagtctattttatcatttactaccataaattatacacaaatctttaataaaatattaacattgatcaaaatttacacgcagaaacacagaccatacacagcaccatttgcagttgagagtgatataatcaaacataaagatgtagtattaaattataactgcataagtttagtgtagtaaacactgtactactgtaataatttcatagtcacctcctatttctactacagtgagctgaactgttgcaagtatctcctttaaactccctgtgatgctaattatctccaagtgagcagttctctctctagtaaattgtgtattgtagtaaaaagtgatctttcaggtcttgtgtgtatttcatcatgtttagtgcaataccataaaccttcaataacaccatgggagccatacgaagtgccagtcgtcatgctggaagtactcccaaaaagcagagaaaagtcatgccattacaggaaaaacttgaattgcttgccatgtgccatagattaaggttggcagctgcattgcccgccatttcatacaactgattcatcttgtaaacagacaagataaacttatagtatcgacaaacacaatatagtactctaaatgaatcttctcttcgttatgattttcttaataaggttttcttttctctagcttactttattataagaatacagtaggtagtacatataacatacaaaatgtgttaatcgattgtttatgttatcggtaaggctttcagtcaacagtaggctattagtagttaccttttgggggagtcaaaagttatatgtggattttcaggtgtaagaagggctggttccccttacccttgttgttcaagggtcaactgtatattgcctatctctcagggtctagggtttatagtcaatcatttacaggtaagggaaaaaacacaatttactctattactgacattcccaaacccccttttccttttttagcatgaagacaaggaattattttcccaacattggatgcatggaaccaccttgaatctatgtaaaataaatttttttttcagagcccaaagcatagaaataactgccttcagttccaaatgaacaccaaagttcataattttagacctcgagtgactcttcatccaacatgagagattgcttttttatttcattcatgtgtaagtagcttcttaagtttaaatcatgcttgcatctataatcaggaatctgaaagtaatgtgctctaggctttcattcctgaaagctgtctgaaaataagtgaaaatcaaggcgtttgaaggaaatcgaaatctatttatctcgaatgggctttgcatgcacaggcatgttttccaatccattgttggactagtagcaaccaaatgataacaaaagggtgaaaatgaactcctctctaatctgcaagtatcagatcaataacacttcatctgttaatggagcaggtctgagttttccaaacagtgtgaaaatcacacttacaatgagtaacaaaaagcaactactagaaacattgtgcagaaaatttccttaaatgtattttgttggtaaagctaagactatactacaatgaggtcattaatttctagccagtatcatataaataaatacatgtatgggtgtagatagatagatattgggtgtgtgtgtgtttctaaaatatttacaatagtgatcacgatttgacagttaatacctaccttctctatttaatatctaagttttgcagtaattgatctacttttatgccgttggtggtcatagtagcaaagctataatcaattagaaattctcttttgagatgtattttaaatgtttgtagatgacacctaccacaagagaacagctatagcaattatcttagtgattttgtttgtgcttattatataaattacaaggaaggtatctaccaaaattatcaaaatagaaaaaaataaaaaaaggaagttgtcatataaatatgtcaaaattacataataactattataagaaaataatttgatttattcttatgttatatttgacatgcatggaagatcctttttcaaatttaatctggaggattcacacacaaaattattctgaaataagatgacttcaaggtcataaaattgaatcttgagatattttcaagatatttcaagattttcattgtaatgctgaatagttaacatttattaaagaaaaccagaggtagtccatgtttctgataacaaatatataaaaatgtttattgcatatatgtgaaaaatatattcaaagtctttcattaataattgatcattcacattatttcagccttgtaaatttcaaaacccaaatctgacaacatatgaaaactttttcattaaattcaagaatatatatatttataattttttgttagggcatttttgattaacctgtgaatccattgatttttgccacatatgctgtagtggaaactgtatgctgcgcagttacttgacctcaaattcactcaaagttttcaaagtttctaaatatttctcacacttatgagtcacgcaatgcatggacagcttttatctctttgtagctgcatctctttcagtaagaattttgagccaattaattcacagcaaagtgggcaacataaggttttttttttaagaaaatagtcatagtgtctgaggactcaaactcagccctaccaaacaattcatacaagttactttttgattcagttccttacagcgctgtcttctagttttatatctacactggaggggttgacaggctctaaatatttgatgtcccactccaagtgacatcagatttctccaaaaataaatgtagatgtgaagtatttctcagccttcacacagtgaatttatactacttaaactatgacatgtttaatacatagtagaaccatttgtgatctttatgtagctgaaaagttactggagatagctggaacactgaggctgcatatatggccagtggaatgcaattttcagtttgtcttgtaaggtaggaaatttgcatttgttaattggcaagctcccaccatgatccaagtccaagatcccagtgccttgtactgctaacatattgatgaattccacaagttctctggaagcatctagccctgcggcttgcttatagcagataagtaatagtgagttcttgctccctttggtaagttaatagacctctggtttctgccaatccattagtttttcagagaaagcactacattgtatccattagcatcacaggaaaaaaatgctgacattcataggtcattcattcaacactgaatgtcctggatgtactcattgttcttggtcttgggatacagagctgaataagacaagatcctagcttgagtaaagttcataatcaatgaagaaagaaagacataataatttaaatatgtaatgcaacatgaacaaactgtgtaatagagatatgtattgatatgagggcctacctgattacagagaagaaagtgagtaagtctgtttcagtaatttgagtagattcctagggattaattggagtaaccaggtcttgattccggaaagaccatcttcagggttttctaaagatgttaaatatgaatatgtgtataaaagatggggatttactgtgggcaaaatgaatactgtatctatatccaccacttacagagtgtttattatgtttaaagatccatactaagaaatgcagataaagtccaacagcttttaattagacatattcttaaactctacattatattgtcccctcttacatataaatttccatagctaataaatagaaatatttttgcctattcagtttgctgagaaggatagtgagagggttggggaggtgtgggtgttggggatggttaatgctttaaatatgttttacaatgaaaacccaatattcacaaaataagtcataattcaattttctaagacctgttctcatgtttaaatcaccttttcaaataacacaataaattaagctgacaacctttccacatagaagattcttattcaaataactgtcttaagtaaatgttatattaatttcttgtttcttaagtagacagttattaaattagcttctggtattttggagagtttaggctacactctgtattgattagcttaatccatgttgggatagcagagtgcacacttcgcagctgtgaactgtcacaatgttcctttttttaattgagtaatttgagcctggagactgagacaaggctatataaaaacatgtacaagcacataatccaattcatgagattgcatacaaataaagttcattcttttccaaatgttggaagcatttcaccacataatactgtttcctgccttgaattattgttggatttagaccccactacctatcactatctattagagcaaattatattcacttactgagacaatcacccctaattttatacaacatgacgttggtcttcaggtggcagaaatagaaacacacaagcctggaaaatgcttgtaaataaccaataggcaatcaaatcaaattgttcatttttattgctagcaattactctgcgtaagtggctgggtcatgctggttggtgtcctgaagctcaggtatcagagaaaatgttaaagtatataccttgcttcttctctatttctaactactggtgggctgctcaaagctatggatttgaatttatttacttttatgtgaaattcaacataaactgaataaaagatatgaagataatatggaagcaaaaaagagcctgagtagtcaaagccattctaagcaaaaagaacaaaactgaaggcatcaccttacctgacttcaaactatactacaaagctacagtaatgaaaacagcatgatacccatgcaaaaatagacataaagaccaatgtaacagactacagaacccagaaataaaaccacacacatacaaacatctgatttttgacaaagtggacaaaaacaagccatgaataaataactccatattcaataaatgctgctaggaaaactggctatccacatacagaagaatgaaattagacccccatctgtcactgtatacacaaattaaataaaaatagattaaatacttaaatgtaagacctcaaattataaaaatcttggaagaaaatctaggaaatacccttcttaacatttgtcttgggaaagaatttacgactaagtcctctaaagcaactgcaacctgtattagcccattctcgcattgctataaagaaataccaaaggctgggtaattcataaggaaaagagatttaattggcttatggttcctctggctatacaggaagcatgatactggcatctgctcaccttctggggagtcctcaggaaatttaccatcatggtggaaggcctagggagagcaggcacatcacatggccagagcaggagcaagagagaagtgccacacttttaaatagccagatctgacaagaagttgctcactattgtgaggacagaatcaaggggatggtgctaaatcatttatgagggatccaaccccatgatccagtcacctcccaccaggccccacctccaacactgggcattacaatacaacataagatttgggtgcagacacttatccaaactatatcattccactcttggccccctcaaatctcatgtccttctcacattgcaaaattcaatcattccttctctatagtccccccaaatcttatctcatttcagcattaattccgaagtccaaaatcccaattctcatctagagatgtgtttcttctgcctatgatcctagaaaatcaagcaagttatttacttccaaaatacaatggaaaaaccagcattgggtaaacattctcattccaaaaaagagaaatcggccaaagaatgaagctacagaccccataccatcaggagagtcattaaatcttaaaagctacaaaatagtctcctttgacttcatgtcccacatccaaggcacagtggtgggaaggatgggctcccaaggccttgggcagctctgtccctgtggctttctggtctttggccccaacagttggtctcctgggctgacactgaatgcctgcagcttttccaggtgcacagtatgagctctcagtggatgacagtgaccctcttctcacagctccactaggcaatgccccagtagggactctgtgggggctccaaccccgcatttctcctctgcactgttctactagagtttctctgttgagggctccatccctgcagcaagcttctgctggagcactcaggcttattcatacatcctctgaaatctaggcagaggatcccaagcctcaagtcttgactcagtgcacccacaggcttaacaccacatggaagccaccaaggctatgacttgcatcttctgaagcagtggtgtgagctgtatctgaggcccttagagctgagactgggaacaaagcaactgggatgtgaggagtagtgtcccaaggctatgcagggcagtgagaccctggtcctggcacacaaaaccattctttccccataggcctcagggcctgtgatgggagaggctacctcaaaggtcgctgaaatgcctccgaggccttttccacattgtcttggaatcaacccttggctttttagctatacaaatctctctggcaagtggttgctccaccacctgcttgaattcctctcccaaaaaagctttttctttttctgacacttggctaatttttcaacattttatgctccgcttccccattaagtataagttccaacttatttattcactcccacatctgaacatatgctgttaggagcaggcacagcacttcttggacacttgctgctagaattttcttctgccagttactctatatcatcattctcaagttcaaactcccacagaaccgtaggtcatgaatacagtgcagccaagttctttgctaagacataacaaaagtgacattgacttcatttcccaataaggtcctcatttccatctgcgaacacagcagcctgtacttcatggtccatatcactatcagcgttttgatcacaactatttaaccagtctctaagaacttccaaactttcctcatcttcctgtcttccttggagccctcccgactcttcaaaccttcacctgctattcagttccaatgtcacttccacattttcaggtagctttatagaaatacccactccttggtacaaaaataccaaatttttgtattagtccattctcacatttgtataaagaaataccagagactgggtaatttatcaagaaaggaggtttaatcggctcacacttctgcaggctacacagtaaccatgaggttggcatctattcagcttttgaggaaccctcaggaaatttacaatcatggtggaaggtgaagggggagcaggcaccttacatggccagggcaggagcaagtcaggggtgccacacttttaaacagccagatctcataagaagccactcactattgcaaggacaacaccaataggatggtactaaaccattcgtgagtcgtccaactccatgatctaattacctctcaccaggccccacctccaacattaggcattacagttcaacatgagatttgggtggggacacatatccaaactatatcacaaccaaaaccaaaattgacaagtgtgatcgaattaaactaaagagattctgcataacaaaagataactatcaacaggataaacagacaacctatagaatgggagaaaatattcacaaacacaaatccaacaagggactaatatccagaatctctaaggaacttaaacaactcaagaagcaaaaaacacataactccactaaaaataggcaaaggacatgaacagaaaattctcaaaagaagatatacatgtggtcaacaagcatctgataaaatactcaacgtcagtagtcatcagatagaagcaaatcataaccacaataaaatatcatctcacaagagtcagtatagcttttattaaaaagttaaaaaataatggttgcagggctgcagaggaaagggaatgcttatacacaactagggggaatgtaagttagttcagccaccgtggaaagcagtttcaaggattatcaaacaaacaaacaaacaacaaatgaaaaaaagaaaactaccattcaacctagcaaccccattactgagtatagacccaaaggaaaataaatcattttaccaaaaagacacatgcactcatatgttcattgcactgctgttcacaatggcaaagatgtggaatcaacctagatgcccataaacagtggattggttaaagaaaatgtggtacatatatcccatggaatactacgaatccgtaaaaaaggaacaaaatcatatcctgtgcagcaatgtgaatgcatttggaggccattttcctaagtgaacaaatacagaaacagaatccaaatactgcatgttctcacttataagtgggaggtaaacatttatggacataaagatgagaatgatagacactaaagtattcaaaaggagggagtgagggaggggtgcaagggttgaaagagtacctattgggtcctatgctcactagctgggtgatgtgttcattcatactccaaacctcagcatcacacaatataccttggtaggaaacctgcacatgtaccacctgaatttaaaataaaaatagaaaaaaataaactcaaaaaagagaaaagaatatatgaaggtagttaaattattccatttatcttttcttgtagatgatgaaatgatttctattttgtgctccccaattgctaatatgaaacattttccaagagaaatagctgaccaaacatgagaatatttctaatcaaattaagtgttttatataatcagaatcatgatgaagactgtttgctgaagttggcttgggactaaacaccattatttgaaactcaaatagctgtctcattttaaatgtgtaagggacagcattcaggcaaagtccattttcaaaatgggtttgcaccaaagctgtttggaaggccaatctttaaggtcagattcattttggaaattccatctgccttgtttagtgttaggtagaatagaacttataacaaatcaattgaagaatattggtataagcctatatagttctaccattttaaaaatcaaccaaaagcacttagaaattcagacttgctttcagaatagctttacggagtcggttttcaccttaccctgtgatatggtggataatattacagtaaagagtggggaaaaaaggaggtaataattgttaaacctgtagtggcattttaggttttatttcagaattacccatattggacattatcataagggaacacacataaactgttttatataaagctatatatctacgtgtatttctttatgtgaaatgactttgcctttcaagaaaaagagaatcacattaaatacaatttttaattttaccaaactagttttgaattatctagtggaaattttcagtctgtattcaaaaaatacattgtgcctttagcaatgacatttaaaaattatttctaatcaagaagcttatgaaaatgatactgctaaatttaatacccacctcaatagcattcaatgctatttttggacgttcaattatacattatatgtaaactgaagtgggccctctgttgagtctggacaatgtctatataactgagtgtttacaaacttagctagatgagaaaactttactttgtgtattctagccctaaattagattttaaatttcttgaaagctggttgtacaaacgttttttttgtcttgcccctgtcttctaagttctttgggtcctcaagttttggcacattattctatgtatagtaggaactcagtagatgaataatttgtgatttacagactatgaagctaatgaatgatgatgtttgaagatcttatccatctggacctttcctcatgctaggcacattattttggcccgttattctagatatagtagggactccataaatgaataatttgtgacttacagactatgaggctaatgaatgatgatgtttgaagattatatccacctggacctttcctcatgcctgtagaagcaaattaaagttattatttaattaataattaggcagcacaaagcaagaaaatgtcattaactattttataagctaattaacaatgtggctgttaacattattttatcaaggtcaggtagtaagtcaagacagatagagaagcataatctgtatcttctgtctcagtctgagttctcccttgtaataggctgcttttctcctccactttctggaatagatgagggggattttgtttaaacaacattatatgtagtgctaaccacttgtaaaaataaaatcttatcccttacattttccatagttgtactatagaattgcatcgtagaaatgttgttgatcataataacttttatagatttcataaatacatcaacaaggcagagaaaattaatgatgcttgataaagaaataagataaattcatttctcaagaacattttgattgtaagctactcctgtattgtcttttaacattaatgtctatgcaataaactcagtggtgaataagaaataaagaaaagggccaatgacagaattaatagcaccaagtaataattaataatgttgaatggaaagaaaataaaataatgaggataaatctgataagagtattcaggaatgtaacagagcactgtctactatcgcttctaaaagcaggaatagggctatttcctgctatacagtgttgctagctaatatgatgaataggtggaaatgcttgcccttcatctttcctttttaaaaatattctttctctgtttcttttccttttttacctaaatttttcagatatttccaaatgtttactagttcttttctacttgtcttgatttttgagctctttgaaggaaagagaacttataaatcttattaatcaaacaaaagagaatatgaagatacaatcatatagccttagtgaaaacagagctgaagagtatacgaagaacattccttttcaatttggtacgtgtttttttactgttgtgtctaggttacttgcttctcagaaacatgaaataattcagctatagacagggtacataaacatatcatctaactcccattgggttagatacagggaagctacttttatatagaagtaaataataattagcttgaaaataatacatttggagggattacaaagaacaaccacagagaaaatgacttagaatatgaagctttatactctttttcccactggccccaactctacactagaaatattctcaacacaatcagaatattagtaaatgtcttaaacattaaaaaatgagttttaaaaaattgtttaaacagattttattaaatccagaataatgttaatttttaatttgtatttgttttaataactgcaataaggtcagaagaaatctcaaaacaattgttttataaaataagttcattgtcttgatagttattttttttcctccccgcattataggaattcatgaagttacgtctgtcatcttcatttgttatttgaagttactctgcaagttaccttaataaactcattcattatttttcagaatatgaaaacacaggagacatggtattgaaagctaattagacacccctgagcacatatcagaaacgtatcaaagttagtacctgtattttttttctgataaaagtactaacttctaatgtgtgagtagctaacatagcaaaagaatcctaatatatgaaacctaaggagaaaatacatagaaatccaattttaaagtaaaatgttgttgttttgaatttccaatgataggttttagatcttctttttctttacttaagtgaagcagcaaatatagatgggatgcttgcatgtacattaacgactgccaatgctatattggcaatgaattcatcaactcatatgacagattcaagattaagttcttatgccttccttgacattttgaagtagaccatttttgttgtggaagaaagaggaaaaggaaaggtcatagaatttttatcagtcagtcttattgtcttttaaaatagcaatgtctgtttaatgtcagtgaacaattcagatggggatttgtgggtaatttgttgatggagagcatttttgctacattttacatctcaaggtgtataatcccttaaacttggcaataatagaatactctataacttactagatggatcctctgtgcaagatgagttatttctgcttccagtcatcctcttcccataatataaataaaacctgcacaagtccaaaaccttgaactttatcttaccatcttctcagaaaataatactttgtattaaaattttacaagtgacacgtggaattatacttttaagtgaaaacatatgtagtagactacaatcaacatttaataataaatgcccgtgcatctagactttttaccaaaattaagtattgcaaagaaatttattagattcttttacttgacgttcaataattcattctagtcaaacgggcctatcctagtccatcctcatggtggcagccatagatatttagttattatgtgaataaataatgctttaattcactgctgtgtcatggtctccaatatgtattttctacggtattgaaacctcaaagaagatgtcttgtagcatatttttccctagaaaatgtattacatggtatccactaagatctagttattttcagttggtttcctactaattttctgttaattggtggtaaaaaaaactaaggtttattaaatcacttgtgagtcattcacttgaattatatacgtatattatgtgacttttgtgctaaaataatcttttctatgtttttagatatgcttaaaattcttttataaccttaagtatgtattgagttgcagctacactttgatttataaaatatattttaaaattatttgcatatgtagacatatttgtgtatgtgtacaagctcagacataaaccatgttactactagttataaatgtcaaattaatcaataatcatataacttattcattgacaagtaactcaataagtaatttaagaaattatagaatactagatgtcattatatattcacatagtttgacttaatgaaatgtttgatgtgaaacatggcattaatagttcataaagaagactttttttctccttcagatgctcttatagtcttctaattcaacaaaaattttgacagaagacaaagaagacaatagtctggagaaaatgaagattacttgaaatcctaattcaaaatctaagaggcttctgggtagaaatgaattctctaagtatgcctgagtgttaaggaaagcagctgaccttcagagacactctaaaccatttatacgcaggttcatgtcatcagcatagttcatcacaacctatttccattcttgcagatgagggtcttggattcctaggtgtcatggcatcaagtctatatcctccattataacctcatagatagtttcttctgttataactacattggagcaaagtatatttaaaaacccctttattgttcttccttattatctatattgtagtatatacatagtagattccacagaaatagctgggtcttcaattgacttgcaaatcaatttttcttattttctccaagtagcataattttgcaatttaatgctatctttgaagacaaatatcatttttgtttatggaccatagagattacatgaaagaaaaggacattatacatcagagccagagagaaattcaaaaagaaaacaagggctgatttcagtcagtgtcctgtttttacagacactggagccacaagctttctaattagggtgatttattatagaacccactccattccaccaaactctggcatttttctgttcctttacacaacactgtcacctggattcctaaagctgaagcaaaacggttcctgaagtaattgaatcagctttgttattttcagctctgaggacatctgttggtgaagttctggactactagcaaccaatgatccagccccgggctgggtcagaaaatcaaaatgaaacaaaaacaaaatatacaaataagtattatatcttgtaagccaaaggctgtgttaaagtagtaaatgccagagtaggattctcatcctggtctatctgactccccaagcccaggatctcaaccaatatgctgtacagctttctcttttgtaaccatccaaaatccaagttcagggattgagaccattcatctatgagatgttttaattcagagaaatcaaacatcaaaattatcattattattattattattattatttttgagacggagtttcgctcttgttgcctaggctggagtgcaatggtgtgatctcggctcactgcaaactctgcctcctgcgttcaagcaattctcctgcctcagcctcccaagtagctgagattacaggcatgcactgccacgcccagtcaattttgtatttttagtagagacagggtttcactatattggtcaggttggtctcgaactcctgacctcaggtgcttcactcacctccgcctcccaaagtgctaggatttacaggcgtgagccaacacgcctggccacttatcaaaattataaggaacaaataaggtatgggacactgatcatagtcagcactactggcttcctgacagcagtcaaatttttctgcacttactttctaaatgtggaatgttctttctacaagtatctatgagcatctgacatgtatgggtattagtgcataattgtagctctgtgcacgtgactatagctggtagagctcatagaaactcaaaccttgtaactttttttctagatctcgttgaaatggacattactaatacatattatatttaagcatgtatttatatgctttaagccactgtgtgcttattaaatatccattatataatgtatctaattatgataagaaatagtgaaaatttattgtttggatatttacatttttaaaattgcaaaaaattaattcttgtttattttataggtaactgaaaataatgtttagctttttatgaaataatagccattttaaacaacagaataaaatttattttaattggacatgtagaaagtatacattctcacttgcagttcatttatttacctaacatgtatttatataagaatgatttctgtgattctaaccttgacctcttcagtcatttctcaatcaagctgccacaaccatcctttaaaactcagatcacatcactcttctgctcatgacccaccaattgcttcccatttctctcaaagaaagttaaaatactttaccatgttctacaagtcccgctaccatttgtcccctcccctttccgttcttctctgacctcctttcctcttatatatggtccttatcttatgatgaatcaatttatgattttttgactttatgatggtgcaaaagtaatacacattcagcataaattgtactttgagtatgcatacagtcattcagttttccactttcacttcagtattcaggaacttacatgagatattcaacactttactataaaataggctttgtattggctaattttgtccaatgtaggctaatgtaagtgttctgaggacggtaaggtaggctaggctaagccatgatgtttggcagcttaggtgtattaaatgcatttttgacttaagatagtttcaatttagatgctccttgacttaacaatgggtttatcaggacataaccccttcgtaagtctagaagcatctgtactctttcctggtctcccttggctctagcaatactggcctgcttgctatgccttcaacatatacactgaagttgtgattgctttttatttatgctatctatttcactgaagatttctcccctggtatcttgtttcatttttttgatttccttaaattggacctcacctctttctggtgcctccatgattagcttaataattgaccttctgaattctttttcaggtaaatcaaagatttcttcttggtttggatctattgctggtgagctagtgtaattcttggggcatgttaaggaaccttgtttcttcatatgactagaattgcttttctggttctttctcatttggtaggctatgtcagagggaagatctggggctcaaagttgctgttcagattcttttgcctcctggggttttcccttgatgtagtagtctccccttttcctagggatgtggcttcctgtgagccaaactgtagtgatattatttctcttctggatctagccacccagcaggactaggttgtcttcacagacagagtcctgtgatgtgtaccatcttcaggtctctcagctgtgaataccagcacagtgttttggttgtctcccaggtcctgtaggagcaatccactttcttcagggtgtctatggattctcttggctttcctagtatattcctgaagtagttcttggaacaaaagtccatgattcaagtctccacacgctgctctgtctgtctgactgggagctgcaatttagttctgccttctatctaccatttttctcagtatccacccagaacagcttatcaagatgggcataaaaattgcagacctgtgaccatgtattatcttgtcttgttatgctctcgtacttcaaaacacatttgtttcacccatgtaactcattattctcatttgtcatgaaatatttgtgcactgatagacaatgaaaattggcatcttcctctaggattttcatttcactgatggcaggttttgaactccatagatgattttcaattcaaagtggaagaaagaacttgtgagttaatttcaaacttctgagtaacttctgttcagtatgatgtttactttactgcagttgcaggtcaactgttcttcagtcctaaaatacaataatccctaatcagatatatctgtttcaagaactaaaattacttctaatttacaagactcgcttcttataaactattccatcaacttaattctactcctacaaagctcttttgtgtaggttcacaaataaatcattttacgcctctttgctttcagaataattcattcaggaatgactcagagtaggttcgactaatgcatgacatcttttaatttcatgtaaactaacaatattcaatttcatttggaaatattttatatcacctgaacctatggggtacatatagtaagttttctttccatttctttagctatctttaacattcacatcgaataattttctaagatctgtaactatgaaattctattttatcttactgctatcaattttatttatagtgtaaaaataattatattatctttacatttgaatgcactacactggccttgagtcaaattttttaacacggtattaaacattgcatgtttagttactgcaagcatcatattagtcactgttaaatgaggtaaaatctatttttccttagctcacttcataattctctactgtatatgattcatcccttcatctggaatctgctgtagttgagcttccattgtgttgggtatggaagaggtttgttcacactgacttactgatacagcagctatcgaataatggaaaagatgttatgatttcttaagatcatcagtccactcctagacattgcctgtaaagaatcatatagattttaaagaagacatgtgaagtgtttaaatggaaacctctgtagttttcaaacaatgggaaattggaaatattaactcaatctgactacatgaccttaccatcatttggagaataagctatttccagttgccctacaactgaaacgataattttcttcatcattatcatgactttctcctttatacaataaaaagttttaatattgaagatgcagtatcttatatttgtactccatctactgatcttggattctaaatggattggagcttttgccttgagtaaatgtattcctacaaaaaccatagaattttagagagaaaaatgatattagaaagacattatatacccaaccctctcgtttgattgatgagaaaactgatgccaacttagttatgaattacctggatttacatgaacaagaagtggaactggagctcaggtctcttgattcattttctagagcttttcctactccacaaactccttttattatgaattctgtattccaaatattactataaatgaagaattcaatgtaggattttttttttcatcactaaggcaagtgttagttaacaaatacagtcaaggagaaaatgaaatatttgaaattagctgaagttatactaaaggcacaaagaaaaattctcagacattattaggtactcagtaaaagagagaaattcagcatcatagagctgtaaacgccttgataaatgtgaggtcaatcaataaaataatgacagtgaactcgtgtggctcatagcatagcacagaagataaatctgaaagagaaacagcaaaatgttgtgaacaatagcagcatcgttgaaataaatagtccccatttatactagtctgtagttagagttctaatgaattaataatttttattgatttcagtttctaaaagaaatttctattcttgtcatctttatctgccttggaatctgataaaatctaagttgactacttctcattaaaagaaattgttgaagcagaatctctgttattaaaagtaatgcaaaaccaaaacaaaactcttttatacatctgaaggttacaaataaaacatacatttatcagttttattacaaagatatattattaaagcatgaatggttttaacatgaattgtttcttcatttattcacggtagtttatactgccattgtaaattttagagtttccctgcattttttttgcaaatatcataggagctattatagatatttcatgttctatatctgacttacagttacccagttttgatcatgaccaagcaataggatcctaagggtccatttgaaaggatttggaggaaatatagcttcatgttgcaatatagttttgcacatttgtgactgatcactgcaatcagagaaccgtgctatctcatgttaagactgtataaatatatactgtttcacatattttcatataatcattgcaaattctaaaaaaaaaaacactttaaatgatgttttaaatactcctgagagttgttacttgtacagcctcgtacttcagctgaacaagtcatgtatatatagaatgaatagatcaccagaagctccttctgtgtcaatgctcctggtaaatgtttctacttgtattccccagagggaatcctaggagataatttggagagcaaagcaaaagttataacatttgtttttctctatttctttgatgcactaagaattcatttactttctccacagactggtcttcctttgccagcaaagaaactgcaagttatattactttataaaaaggaaacattaaccacattaaaatgtttcatgtctctaaaaattgtggtatgtaattacctaaaactgagttctttgaagaaggaaagaaataataccaaatttagctctaatatgcctggctatatgtcatataaattctattaagttaactatatatccccagttttaaaactattaagtgattcactcttcgaaatatttcccctatatttacaacataatttagagtagaatcgccttgtaataataaaattaaaaacccatatactcacctcttggtaaacagcaaatgcagcaagaatacaatagtatgtatgaaagcagagaacacatttgcttgtaatgtgggtgggactgcctcttataagtaaggtaatcatatttgtttattttcttatcactttgttattgcttccataatcaccgtgtaagaaagtgtaacagcttaaatcctatatctttcaacctcattgggtaaatatagtcaaacttttaaagaatgtggcacagagtatcatactagggaattgctgtaatcgttggagtagggtctttggccatgtcagttcccatagttatttacttaaagtgaaatcatctttacacagcaattgctattttccagagatgggccacgttaaattgtccactctaggtgatttagggaccataatgaagattggcatcatgaaaggcaacaggaaatgcacccctttgaagagaatgtggctcctgtgcaacagtgaaaatgcaataagtactgaatgccaagagcaggtggctgaggatggagcaaagttcaaaaattcacgtctattctcaatagcgagtggaatggccttttttattttttctgaatgaatcacccaaggcctcactttttttaaaaaaaaaaaagcctgataacttatattgctcaaaagagaaaatgtaagaatgtaagtcattaatttaaattcctgatttctccttgcttcattataataaagcagatgaatgtggtcactacaattgatgatcaggaagaatttgaaaataatgcatgttgatgtcctaatattgtctttctcactaactcttatgattgagaatatatttctttatttcatttaactaatttggaaaaacgaaatctagtctttcttttaccttgtgctatggtcagaatgtttgttcctaccaaaattcatgttaaaatcctcacccctaaggtgatagtattaggaagtggggcctttgggaggtgattaggtcataggagtggagtcctcatgcataggattagtgcccatataaaggaagcctgagagagtcccctcacctcttccaccaagtcaggacacagcaaagagccttctatgaacagaaagcaggccattcctagacaatgaatctgtcagaactttgatattggacttcccagactcaagaactgtgagaaataaatctctgttgtttataagatatctagtttatggtattttgttataggaggctaagcaaattaagataccctgtattacttgtatcgatctcattaagtataaatctattttaatttattatgtatcttttcagtgttatgtcttttttttatacctaagagaattgaatatattgaaagttaattttttaggatatattttactttatgttttacctgcagataaaattttggtcaatgaatgtaggaataaagcaaaacacatgcaggatggaggaaggaagaaattttgggcatatttaggatgtagaatggacaataattggtgacgtctatggggccaaagccaaggacccacaagaaatgaaaaacagaaagtgcagaagactgagggaagggcaatatggactttggtttcggaaatgttgattttgaaatgtctataagcaaacagttgtagatctggaatggattccatagctaaaaaaattataggtctaaatctcagaagagacatctaactgcactgaaggtaaataatcattagatacagatggtcattgatgtcatggagtaaagattctagagactcttttttacacatttatccatttcatcaacaaataatcttgagtgcctatgatgtgccacacacataatggtgaaaagagaataaaactcctgttactgaaaacacaaagatgttgaatctgtgcattcatctaatgtagaatctacatttttggctattgtcagatccttttaggtcctaaattgatactttttagacttttttgaaaaatgttataatatttctggtaagttttttgattttttttttttttttgcttaggtagactttgtgctagcctagaaacttgattattacatatttctttgcccataataacccagtttttactgtgacttaaattactttatttctcctagtgctaaagttaccaatgacacaacctgggtagtcacagacaagaaaaactcctctacctatcatgctcacagatagagacaaaaatatgatcttggacaaacaataatattttattccacctctgttagtttcttttattttcttttagcatctagaatttgagatctgtaggttctcatatttatttattataaattcttctcataaggaacttgcttataggaagttgctatttcaggctatataatctcaataaggcaaggacatttatggtttcatcaattctcactaatctgcagtccttcagccttacaatctgattcttgtgaaaagctgtcatcagaaggcagtatctatagtgtacattttccctgtaaattaattgtgacacattgagtggcggttcctcatgcctggaggcgtggctattttttcatctaatttcatttatgtttttttttgtgccaaactgccttttgttagaaaaaatatatatattcaacttgattaatttgggggaggataaacatgcattattttgtgtatgagttatcttcatattttggagtgtgcagaagtgattggctatttttgatgaccactaatacagtaaaatttggtatctcattatttaaacttattgatcagaaggaaagaaaaagcactgtgagaactgactgtaatgaaaagtctataaggtactaccttagcttaaaacatctaaatagatttctcacaacaattaagggtaaatatgtcccttggtacatgcacacaatgaacagcttggattgttgtatttaatttcttacacagtatgataaaagcaaactagtggaatttaaactttagtttaaagcaaagttcatgtctctatgataaaattcagtgaatcaaaagccagttttttcagccgacctaatatctcatttattttatgacacaatagatttgattggctctgccatttgagatatacagggctagaaataaactaaagtatgtgtaattcagcagctgcaagcatgtgatatctaactatctcttcatcattgcattttaggttttgtacatggtaactagatcttactatagcaagcaaacaccactattacctaagagcatcatataagatagaatactataggtagtttattccactgtgggtagaagcatttgatgcttctgttaactttataaatgtcccttaaaacacaatattgacccatgaaaataatagtaattttagtcctcctcagtgccttgtaccaaatacttatttaatatgccttttcaaatgagttgtctgtaacagcaaacaaatctatgtgactaagcataaattaatctctccatcaagttttactgttagcatccttattttctcactctttaggcaactatttttaaaataaattatctgaatataaaagatctgaagtgtaagttttacaaagcttaagatacaacatttcaaaactattaattcctattgtttccttattttagaagtacttgtagggtattttatactttatactttgtataagtgctttatactttatacattgtatacagtgctttatactttatactttgtatacagtgctttatactttgtaaaagtgaaatacagctttatttcttgcttttctgatgttactgttcccttacatttaaaaatcattttagggtgatagcatcattcgcatttctacagcgtttgaaacacgaacattttaatgcgcaaaatattttgaatttatgatgtatattgcacaggagataaataaatagaacattattttctcgaaattggtcctatctaaatttgatatgcataactcaaatgatcaattataatatgtggggattctttaaaacattgcagggaaaatattggagatcagccaactcaaaacaatgttttagatctctagagtagaaatgcatttcttcccttcatttgtaagttttctagatatcatcaaaaagtgctcatttagcttttttgttaaagttgtcttttactacatcatacatatttaaaaagacattgcatacaagtaaatctacttagtgtctatatgctccaggcactattctgggcactgcaggtcttcattagctcactaaggggtcattcattttaaaaccaagaaaaaaaatcagtaaaaagtaaatattttgctgtttggctcccagatttccaaaactgctggaaaatatatttcttaaaatggcctgtgttgggccactacaaattcatacttctaactgtatcagggctcttggcacctctgggcagtattttttttaattaaatctcttattatttcttaacacattatccgaagaagctgatttatttatttattttattcatttgaaactcttagtcccatgctacgtcactcacaatttgccaggtattatctcaattactgtttatttaggagattaagataattaaaccagtttttttcaccttctcgtctatacttttcagaatatttctgaatctttcctttcactgtctttattttggttactgtctttgagaaagaagtatatctctcctttcaattccccctgtttgcatctttaagttatttctctatttggtcttcctatatctctccacatgatcaggtctttattattttaaaagacaaataattctaaacatcctaaaccctacttttgcttcagacatttgctgaaactcttcacttccttttccctccaaacaatttaaaagataattttataactgctgtcataacacatcagctctttaacttcttgcaactaagaattatcttttccaattttataaccttaaagaaaaccaatgatgaccaaactcaggtgacatttctcagtccatagctttttgaaaatccctgattcattagattttttttactatccccgttttacaaatgctctcttctctctgataacttgtaatatgccactgttagcttttaaaagatttgttgtgaaatacagataacataaaacttaccattgtagtagtttttaagtatacagttcaatggcattaagtacatcacattgttttgcagccatcaccatcatccatctccagagctgttttcatgttacaaaagtgaaactctttacccatgaaacagtgatgccccattcctcctggtacccaagccactggcaagcaccattttactttacgtttgtattaatttggctattcttgttaccgtgtataagtggacccatgtactatttgtctttttttgggttatttaacttagcataatattctcaaggtacacccacattgtagcatctgtcaaaaataccttctgttttaaagtgtataccacatttcatttatccacttatctgtcactggatatttgggtggcttttaccttttgtctactctgaaaatttctgctatgaacaagggagtacacttgaatcttagagaccctgcttctgtgtgttcatatctagacatagaatttctggatcatatggtaattctacattaaattatgtgagaaatcgctacactgttttctattgaggctgtaccattttatatttctaccaacagtttacaggatttcactttcttcacatcctcatcaacatttgttattttatgttttgatagtagccattctaatgggtgtgaagtgatatctcaatatagttttgtttttccctaattattagttatgctgagtatcttttcgtgtgcatactggtcatatgttcatcttccttggaaaatggctattcaagtcctttgcccattttttaaaggagttatttatttacttatttattatttttgatgttgagttgtatgagttctttagatgttttggatattaaccatataccagatgtagggtttgaaaatattttttccaccctgtaggttgcattttcattctgatgattgtgttttttgactcatgaaagttttaaattttgtgtagtcaaatgtatctattttttcttttatttctatatttttgtcgttatttctaagaactcattgccaaacccaatgtcatgaagttttttctctctgttttcttctaataattttatagttttaggtcctacatttatgttattgcattttgagtttttctgtatgtgttgtaaggaaagggtccaccttcattcatttgcatgtgagtatcaaggtttccaatatcattggttgaaaagactgttcttttctgattaaatggttttggcattcttgataaaaatcatttgagcctttgtttttaggttccctatcatgtgaacctttaattttaggttctctaatctatttttttttgtctatttatctgtctttattctagtaccataccattttgattattgtagatttgtagtaagtttacaagtaacttaaatgtgagactttttactttattcttcttttcaagattgttttcactattgcagttctcttgaaattccatatgttttttggatggatttttccatttctctaaaaaacaccttttagattttgatagatattacactaaatatgtagatctctttggaaagtgttgaaccatgcacaatattaagtattctaatccatgaacatagaatagctttctacttatttgtgtcttctttcatctgtttcagcaaaattttggagttttcagtgaatacctttcccctctttggttaggtttatacatacatatattcttgttttgatactattgtaaacagaaatgttttcctaattttattttcatattgttcattgttagtgtttagaaacctaactgatttttaggttctgattttgtatcctgcaactctgctgatcttacttattagttctaacaggttttttttttgaataatctttaggattttatacatctaatatcatgccatctaaaaacagagataaacttacttcttcttttccaatttagatgactttcactcttttttcttgcctcattgctctggctagtacttccagtagtatattgaatacaagtggtggaagcagttatccttatcttattcttgatctcagagggaaatcttacagacagtcaccattgaatatgatattagctgcaggcttttcatatatgatataatgttaaaatagtttccttgtatttgtacttggtttaatgtgtttttttttaaatcataaaagagcattgaaattcatcaaatgtttttcttcatccattgatatgatgaggtatgtttttcccttcattctgttaggtggtatagtacagtcattgatttttgtatgttaaactgtctttgcattttcttctcagaataattactactcagtctcggtgtgtaacctttttaatatattgttgaattctgttttaaagtattttgttgtggattttcattagagatattggtgtgtagttttcttatagtgtcttagtctagctttggaatcatggtaatgctttcctcatataatagtcatgtgctacttaacaatggcaatatgttctgagaaatgccttgttaggggattttgtcactgtgcaaacatcatagagtgtacttacatgaacttacactctatagcctattacatacttaggctatatggcatagcctattgttcctaggctacaaatctgtacagcatgttactgtactgaatactgtaggcaatggtaacacaaaggtaagtatttgtgtatctaaacatagaaaaggtagagtaaaaatagtacaaaaaatagaaaatgctacatttgtatagggcactaaacatgagtagagtttgcaggactggaagttgctctgggtgagtcaatgaataaatggtgagtgaatgtgaagtcctaggccattactttacactactgtgtactttataaacatgtaccaggctaacactaaatttatgaaagaatatttttatttcttcagtaataaatgaaccttagctttctatgactcttttacctcgtaaacttttatttttttctaacttttgactctgttgtaatagcacttagcttaagacaaaaacacattttatagctcaaatcgttttctctttgctgggcacagtggtgggcacctgtaattccagctacttgagaggctgagacggggattccttgactccaggctgtagtgcactaaaaagactgcaagattgcacctgtgaatagacactccactccagcctgggaaacataagaagaccctttcttaaaaaaaaaaaaaaaaaaaaaaaaaaaaaaaaaaaaatttctttctttatattcttatgttatgagctttttctatttttttctatattttaaactttttaaatctttctgttaataactaatgcacaaacattagcataggcttgcatagggtcaaaataatcaatatcactcttttcacctccacatcttgtccttgtcctactgggaggttttcagggacagtaacatgcacagagctgtcttctcctatgataacaatgtcttcttttgaaatacctcctgaaagatctgcttgaggctgttttgtagttaacttttcttttttcaataagtagaaggaatatactctaaaataacaattaaaggtatagtatagaaaatatataaaccaataacatcgttatttattatcattatcaagtattatgtactgtacataattgtatgtgttatacttttataccactggcagtgcagtaggtttttgttgttgttgttgttgtattgtttttttaaaaagtaaagacagggtcacaccatgttgccctggctggtctggaactcctggactcaagcaatcatcctttctcagccttccaaagtgctgggattacaggtgtgaaccaccacacctggccagtacgtttgtttataccaggattgccacaaacacatgagtaatgcattgtgctatgatgttacaatggctatatcattaggttttagctcttattattttgagatatgttcaatcaatacctagtttattaagagtttttagcatgaaaggatgttgaattttatcaaagacctttctgcatctattgagataatcatgtggtttttgtcattggttctgtttatgtgatggattacatttattgatttgcatatgttgaaccagccttgcatcccagggatgaagctgacttgatcatggtggataagctttttgatgtgttgctggatttggttttccagtattttattgaggattttcgcatggacgttcatcagggttactggcctgacactttctttttttgttgtgcctctgccaggttttggtatcaggataatgctggtctcataaaatgagttagggaggagtccctcttttactattgtttggaataatttcagaaggaatggtagtggttcctttttgtacctctgggagaattcggctatgaatccatctggtcctgggatttttgttttggttcataggctattaattactgcctcaatttcagagctcgttgttggtctattcagggattcaacttcttcctggtttagtcttgggagggtgtatgtggtccagtaatttatccatttcttctagattttctagtttatttgcatagacatgtttatagtattctctgatggtagtttgtatttctgtgggatcagtggtgctattctctttatcattttttattatgtctacctgattcttctctcttttcttccttactagtctagctagcagtctatctgtttttaaaaaaaaacttttcataaaaccggttcctggattcactgatttttttgaagggttttttatgtctctatctccttcagttctggtctgatcttagttatttcttgtcttctactagcttttgaatttgtttgctctggttctctagttcttttaattctgatgttcaggtgttgatttcagatctttccagctctctgttgtgggcatttagtgctataaatttcccttttaacactgctttagctgtgtcccggagattctggtatgttgtctctttgttctcattggtttcaaagaacttatttatttctgccttaattttgttatttacccaataatcattcaggagcaggttgttcaatttccatgtagtgatgtggttttgagtgagtttcttaatcctgatttctaatttgattgcactgtggtctgagagactgtttattatgatttccactcttttgcatttgctggggagttttttacttccaattgtgtggtcagttttagaataagtgctatgtaggtgctgagaagaatgtatattctgttgatttaggatggggagttctgtagatgtctattaggtctgcttggtccagagccgagttcaagtcctgaatactttgttaattttgtgtcttgttgatttgtctgatattgacagtggggtgttaaagtctcccactattattgtatcggagtctaagtctctttctaagtctctaagaacttgctttatgaatctggttctcctgtattgggtgcatttatatttagggtagttaactcttcttgttgcattgatccctttaccattatgtaatgcccttctttgtcttttcttgacctttgttggtttaaagtctgttttatcagagtctagaattgcaacccctgctttttttcttttttttttctttctttccatttgcttggtaaatcttcttccatctgtttattttgagcctctgggtatctttgcatgtgagatgggtctcttgaatacagcacaccaatgggtcttgactcttaatccaatttgccagtctgtgtcttttaattggggcatttaacccatttacatttaaggttaatgctgttatgtgtgaatttgatcctgtcattatgatcctggcaggttattttgcacaatagttgatgcagtttctccatagtgtcattggtctttctattttggtgtgtttttgcagtggctggtactggtttttcctttcaatatttagtgcttccttcaggagctcttgtaaggcaggcctggtggtgacaaaatgcctcagcatttgcctgtctgtaaaggatttcatttctctttcacttttgaagcttagtttggctggatatgaaattctgcattaaaaattcttttctttaagaatgttgaatattggcccccagcctcttctagcttgtaaggtttctgcagagatccactgttagtctgacggacttccctttgtaggtaacctacctttctctctggttgctcttaacattttttccttcatttcagccttggagaatctgatgattatgtgtcttggggttgcttttctcaagaattatcttactggtgttctctgtagttcctgaatttgaatgttggcctgtcttgctaggttggtgaagttctcctggataatatcctgaagtgtgtttcccaacttggttccattttccccatcactttcaggtaaaccaattaatcataggtttggtcttttcacatagtcctgtatttcttagaggctttgtttgttccttttcattcttttttctctaatcttgtcttcacactttatttcagtaagttgatctttaatctcagatatccgttcttccactttatcgcttggctattgatacttgtgtatggttcacaaagttctcgtgctgtgtttttcagctccataacgtcatttatgtttctctctaaactcgttactctagttagcagttcctgtaaccttttatcaaggctcttagcttccttgcattgggttaaaacacactcctttaactcagaggagtttgctgttacctaccttccgaaacctacttctgtcaatttgtcagtctcattctccatccagttttgtgcccttgctgaagaggagttgcgatcatttggaggagaagaagcattctggtatttggaattttcagcgtttctgtgctggtttttcctcaccttcatggatttatctacctttgatctttcaggctgatgaactttggatggggcttttgcgtgggggtcctttatgttgattttgatgttgttgctttccgtttgttagtttttcttctaacaagcaggcctgtctgctgcaggtctgctgtagtttgctggaggtccactccagaccctgttcgcctgggtatcaccagtggaggctgtagaacagcaaagattgttgcctgctccttcctctggaagcttcgtcccagagggcaccagcctgatgccagctggagatctcctgtatgagatgtctgtcaacccctattgggaggtctctcccagtcaggaggcactggggtcagggacctacttgaggaggccatctgtcccttaccagagctggtgtgctgtgctgggagaatccctttttttcaggatcagctgctctcttcagagccagcaggcaggaatgatgatatctgctgaagctgcacccacagcctccccttccctcaggtgctctgtcccagggaaatgggggttttgtctataagttcctgactggggctgttgcctttccttcagagatgccctgcccagtgatgaggaatctagagaagcagtctggccacagccgttttgctgcactgtggtgaatttgcccagtccacacctcccagcctccttagcactgtcaggggaaaattgccttataaagcctcagtaatggcggatgcccctcttcccaccaagctcgatcatctcaggtcaacttcagactgctgtgctggcagtgagaatttcaagccagtgatttttagcttgctgggcttcgtgggagtgggatctgctgagtgagaccacttagctccctggcttcagctccctttccaggggagtgaatggttctgtcttgctggggttccaggtgccactggggtaggaaaaagactcttgcagctaggtcggtgcctgcccaaacagccacccaatttttggcttgaaacccagggccctggtggtataggcacaggagggaatttcccaatctgcagattgcaaaaactatgggaaaagtgtagtaacatggccatgtagcacagtccctcatggcttcccttggctaggggaggaaggtcccccagcttcatgaacttcccaggtgaagcgatgccccaccctgcttctgctcaccctccgtgggttggacctactgcctaaccagttccaatgagatgaactgggtacctcagttggaaatgacaaaatcaccttccttctgtgttggtctcgctgggagctgtacacaggagctgtgcctattcggccaccttggcccctctcctgtttctagttcttgaaggtgtaaattttggttgtgaattttagatctttaatccaatcatttacaaaaaattgtttcttagcactggttttctttatctcataatttttttgcattttttgcatgttgtgttttaattttcattttctcaagatattttctaatgtgatttttctttctaatattttataatgtgatttttttgacccagtagttgcttaaaagtgttgtttaatttccacatatttcagaattatcaagttttttctgctttaatatatagtttcattccattgtgattgcaaaagatatttgtatgatttcattcttattaattactattagttttatggccatatatattatctatcctgcagatatttccatgtgtactttggaaaaatgtgtactcttttgatctcgcgtgatatgtcatgtatatgtttgttagatccaattggtctatagtgttgttgaagagccattatgttcttttttctttttttttttttttttttttgagacacagtctcgccttgttgcccaggctggaatgcagtggtgcgatcttggctcactgaaatctccacctcccgggttcaagcgattctcctgccccagcctcccaagtagctgggattacaggcgtgtgccactatgcccagctaatttttgtatttttagtagagactggtttcactatgttggtcaggctggtctcgaactcttgacctcgtgatccgcccgcctcagcctcccaaagtgctgggattacaggcgtgagccactgcacctagccaaagatctatattttcttactgatcatctttctggttctagccactattgacaatggaacattgaagtctactatttttgtagtactgtctcctttcaattctgttaatgttggcttcatatatttagaagctctgatatgtagtgcatgtatgctaataattatatatttttggtgaatagacatttatcaatacatattgtccttttttgtctcttgtaacattttttggtgtaaaatctattgcttactattagcatagctatgattgctttcttttggccactatttgcatggactatctgttttcaccttttatccttcaacctatttgtgttcttacttctaacatgagtctattgtagacagtacatatttagttcccggttattcattcactatgccagtgtaatgtcttataatgtcttataattaaggtgtttaatccatttaaattttaagcaattgctcatagtcaggacttactattaccaccatattatattttttaaaaactctctttcttctcatatgcaccacgaattgcgtctgaccttttagagtataggtgacttttctaatgagattcagaaaataatttccacttgtccatttggcatttctacctgtatgttcattactcttgaagtgatttaagtaggaaaagaggatgctaccttttaaatttgtttccattatttaactagaagagtttgttcattaaaacattatactcctcagacatgtcacttaactcaggtattatggtactctcttttgcaaatgtgagtcctcgaaaattcattagtgtacttttaattcaacagatatgtattgacttttacccattacattcttggtattgttcaaggtactgagtatatcacagtgaacaagacagaggaaagcttctgctctcatggagatagacaataagcataataaatcagtaagtgatatagtgtattagaagatgtttatgtgctgtgcataaactagagaagtgtaggtgggaatagcagtgccacttgggggtgggtgatttgatggcttttgggtaataagggtttaggtacttttgggtaataaggatttaggtacttttgggtatataaggaagacagatttggatcatagtgccaacagaggagctatgaatgaaattagcataattatattgtgatatacagatgatatttgaattttttttataatgtaagaaatatattatatgtctattttatttatttattgagtatgattcctagcaacagataactagctaaataaactgcctttctcttaagctcaatgctaattgaaaaagaaattaaagccagaatccatgtaggacagtgaggaattcatggctatcaatatcaggatctcctttcagagagcatcacaaaagtgtgctgatagacatgatgaaggaaaataaggaaaataaaagattcttaggggagggaatatgctattttttgtgataagcaactcctgttacttctctttgataggtacaggattataaactaaccctcaattttaccctgttttgaagaatatgttttaaagtgagcttaaataatacaatataaaaattgacttcttcaagtggcgagagcactcagagacgcgacgtggagctggcgggtaccgagcgggtgcctcagtctccttcccctcccctcgcctagccttgccgtcttctccccgcagatggaccggaactatgtgatcccggaagttctagggcctttgctgtgtgtgggataaacggtcatggcggaggctccagctcccgtgacaacagccacaacatcaggagcaggagacgcagcggcagcagccacagcggcctcccgcaccccgatccccacagtcactgccccatccccagtgtcttatttgtacaatgtattttaaatgaggtagcaatgcattataagtatttaataactagcttatcaattgttacattatatttgtctaaagtttgaaaaccactaattttaagcatgtatcattgatagatcatcaaaaactatattattaatagaacatttattttcagctaaattgaagagacgtagcagggtaataaggcccagcacttagatttgattatacaattaaaaatattttacaccataaatgagtattcattaactagattgaatcatctgactcaagttggtatgtcaatcaaatgaattttcaaatgttttaaaataatcatatattcatacgttgatactaggagataaaaatatgttttagagactgctaaaaggaaggcaaacttttgcccttactcttagggtttttctgctggatatgggaattaaactgacacgagacaggtcaatagaagaaatgtatacatatttattcaatacaagttttacatggcatgggagtcttcataaataaggaaatgaagaaccaaagtcgcagttggagttgaaaacttacatgctgtattggacaaaatgtagtaaattgtgaaaatgtagcaaggcaaaggggtttgggctacaggagttaattgggtagagttgtgactaagaagataaggttggtttaacaaagtttgtacaaatttccctcagtctcaattttctgtcctcgaagacaagttttcttgccttccagtacaaaaaggatatctttcgcatgggaatttcgtctcctgctgttaagaaacagaatgaaggtcagagtgaacttcttgcacctgctgtttttcaaatgcctttagctcaaaataattcttatgccaaagagcatattctggaatgatgtgttttaaaatccttcactgcattagatttcagagtaagaaaggagcagaatataactcttaaaaggatgcttctgaatcttaaaatctctgagaaattaggaagtaggcttttcttgaatgacgctgaggtattaaccacttcgatttttttaacagctcattaataatcaagtaattatatcagaaagataattagatttgatccttagaaatgtgcctacatattttagtgtaaaactaaagagtaatgctttactgaattaactaatttttaaacagaagacagtgttcaaacaagtgaactgtattcatttactttcattcatctaaatgaaattgtatcctatttttctaagacttcacggcactcatccttttctaataaccaattttgcaccgcaattcctgtggcaattaaaaaaacaataatttacttgcttgtagatgttgcactacaaaatgagacattttaaagaccaaggatgcatgttcctatgagattgttttgaagtttttatatataattatatttaatgaagtgactggttataatttccatggtttcatatagtctttatgttgtttttattgcattttcaaaacctcacttttatatttgtcatttttttcttcagaaatgaatcatggaactttatattttcctggccatttctctttttataatatgaattttaaaaatcaataatgcaaccctttaaaaaacatttaccaaattttaaatttctgaagattattttcaattgaattatgtgtaactcacattttatcttttccaccacagaatactgcttcaagttgcctcagtacaagtttgttatcttaacatttctcttttatccaaagacgatttatccattgtctcccagagagtgctctttgtctccagatatttgcacttagcatagtaatagtcaggaagacctttatcaatactttagaatatcaatgaaaagtcttttttttcctcctaacaaatgaatattagatgtggaagcttcacaatatgctacatttctggtatgataattgattatatttgtttgaagaatgattcttctgcaacgtgagctttttgttggttcagttgaaaataatggaaagatcctctggatctgagatgtgttcaagtgtaataagcaacatttaacaaatgttacactgttgccatttaacaaatgtctttggaattcaattgagccaggttttaaagtgataatccatatcaccatgtgtgaaatgtaattcagatcttgtttatccatatttaaattgtgtataaaatttatgaaaatgtccaaaggcttatcaaattgaatcattaattactatcttgaaattattggtgtcaaatcaatgatttttgttgatattatatgaatatacggataagcaaacttagatgtgatttcttcataatacattggcatggcaaaatttttaaaatgtgcagttaatgaaaatttatcctaaatatttgggattattaaatataaaattaaacatgcagattttaagggtttacctcacttactttttaatcattccattcatatatatatatatatatatatatatatatatacacatatatatatatatatatacacatatatatatatatatatatattttttttttttttttgagatggagtcttgctcagttgcccaggctggattgcagtggcacgatctcagctcactgcaagctctgcctcctgggttcatgccattctcctgcctcagcctcctgagtagctaggactacaggtacccaccaccaagcctggctaatttttttttgtagttttagtagagacggggtttcaccgtgttagccaggatggtcttgatctcctgacctcatgatccaccctcctcggcctcccaaagtgctgggattacaggtgtgagccaccgaacctggcccattcatttatatttttaagaattagtttatgtttatatgtattttcaattattacctgaaaaatatttgctagtagtatctagttaaagattattgcatatttaaagtgtttacctgtttacatgacttttaatatttttttttgttgtttctttgtttgtttttgagatggagtcttgctctgtcgcccaggctggagtgcagtggctcaatctcggctcactgcaatctccgcctcctgggttcaagcagttccctgccacagcctcccaagtagctgggattacaggcacccgccaccacacccggctaatttttgtatttttagtagagacagggtttcaccatcttggccaggctggtcttgaactcctgaccttttgatccaccctcctcagcctcccaaagtgctgggattataggcatgagccaccgtgcccggccttgttttgtttgttaaaggcaattttttaaataacctgagaaggaaattaagaaatattgatgtgcttagacttttgaaaagcactgtgcatatgtgaatgcatgtgcatgtgtgtgtgtattcttcctaccatcaagatatcttctttatgcccttctttcccctattaggtctgagctcatatttgtaaatgtatgtatcacaacatattttgctgttatttggatcagagaaaaatctgttttataaaatgtaccacaaactgacatgtcaaacttgttttaaaaaatcaattgcggggtgagcaactgtctttaatttgaatttatcccatcttttatgaccagtttccaacttagagtttaccctcttaacatcgagttacttgtgttattttctcaaagtgatgtgattattttgcttttgcttcattactgcaacaaaatttaaataccttcataaataagcaattttagaggagcatgaaaactaacaaaatgtaacaaacacactgaagagatttgatgatttgcattttcatgaagctattgaacaaaaaaaatatccagcagcactaatatacagcaaattcatctttcaacaatagggctaacttaattctttgtgccatatgtctattaggattttaagctgcttggttgtctgtgatcactaagtgaaggtgaagtctagattaataaaacatatttcaaaggctgatgtcaaaacagaagcaaatgttcagagtgtgctactctttctttaggtaaaataaacagcacctgattcttcctcttttcagtatcactttttgcaaaaataaataaataaataaatcctgtacttatttgtgacaataacttaatgttccattatgtttaatttaacattctttaaatttaaacattattagctaatggcagttttcaaagtaccaccagttctaactcctgacccttatgtcagttactaatgagacacttgtgatttacattaacatttggaaacatgatcaaaatattttttaaaaacagataattttccagtaaggaaatattctatataattgccaggtacagttttatagattctatgtgttaattacttactgaagaattgtcaaggtgtaagtggaaaagacagaaaggtatcattttgaaatttaataggaacttcagagagctagagacaacactagtcttttaaaattgtaaaatgtgacctactgtatcttgtaggatgtaatcttttcaatttgtatatcttaaataaaccattgaatgcacttcagaaatcagaacttttggaaggctcattgcatttaacattagttgaactcagtattggacctagagtcattatacctatttgggaatattttattatgaatgaaggtgccccaacactacagtttatagagctcttaagcacaaatctcttttagcaatatttttccttcaatgccatgagattcatagctctaattttaacagtcctatgatccaacttgtcttcactgtaaatagaagcaaaattttgtattatgaaggctgtaccaagcaataatcaattcttattaaatagaaaatatgtgattcctttattcacacaagcatataatcagaaaaaaatatttttactgattttattttaatccttatagtaccatgcaattgtcttagtttttcttcagaacagcatcactctagtatgatcaaattatccacagataatttcgtatctgtgaagctcccccatcccacgttttttcattatattataccatggccatctctgtgttaataatgtcatcactagatcatatgtatcatttatcaaaagtgagcaggaacacatcctgaatgcaaaatcattctagtaatagcaactaattaaagtgaattaaaagtgaactgattaaactgtatagttaatggatgtagtggcttgaaaatataaaattatatatatatatatccaaagacaattcatcaattttgccaagtaaaatgaatatattcttgtttcagaattagtctcttatttttaagataatcctatgacttttgaatgttatagaatttaattattcagcagataacaaattgtaatcatgatttctctgatcaatacaatgtatttttgatctacaaagagggtatatgagcaataaaaatcccagaaatgttgcccataatgatttcaaatgccttagaatgattaatattataaatttagaaagatatttttgtgtagatttatttttgatttttacgaaaaataatgatttttgagagtttttatttcatagtttcacggtaagttgtcttgtttaatggtcctctaatgagagtcagggtaagagatgtgattaaatataatattgtggcaaaaggagatgtctatagaataaaaattgtgaaataatcatattctaaaattgttctaattagggtagtctgacatcattaaaatttcattactctaatatgatcatattaaaatgccaaaaaaagagtctattataaacatatttagaaaacttaatcagcattcccagttttctctcatacacacatataaatatatatgtttctgaaattatcaaagaaccatgtcttaatctgctcaggctgctagaacaaaatgctattaactaggtggcttataaacaacataaatttatttctcagagttctggaggctaagaagtcctagatcaaattgttggcaaattcagtgtctggtgaaggctcacttcctggttcatagacaaggaggcatcttttcaccgtgtactcacagggaagaaagggtaagagatctttgaagtcacttatataagggcactaatctgatttataagggatctgccctcatgacctaagcacttaccaaaggccaacttccagatgccatcacattagtgattatgttttaacatatgaattttagggtgacacaaacattcactctatgttagaccatgtggcttaaataatctgaatcttacttcggacctactaaaacagaacagaatatttgaattttgaaacccaggaatttgtgatggcagtggcggctgtctggagtggccactgccatgacaccagctgcagtgggggaggcttgaccagggttgcatgctccatggagcctgtgggaaccaggaacaggtgggagcccctcctccttctgaattggaggggtgacagcctcgccttcccaggtgcagttgcaggggcccagctgggactgctgccccaggtatcctgtgctcttggggatccaggaagccctcctgccccagcaggcttgaaagagcctgcacctgctgcttggcctctcagctctccagctgcccactccaattttggagcaaagttgaggccaagcctgggcactgtggcaacctggtgggatgtgtgtgagcttttggcggtcctgacatgcccatggctgcctcagccccctccagactttgaccacccacaaacaagggagggaagcagagggggtgctgagggcagctgggcatgggcctgaaggtgtcctttggcatgaacagcctgggtgccatagatgtcatgattgatagtgggtgccatggatgacatgattgatagcgtcaggaggcatagaggcttctgctcagaaaagggcatgtccctggtgaagtcccaccttccggtcagagaaggcctgaagcctgggggcccgttggccagttcctcagaccagagtgagaatgcgtgctttttctggcctgcctatggctgtccatggaccaatcagcatggactttctcccgtctcaagcccataaaaactccaggactcagtgagaattggacaaacgacagatgatctaactgctgttaggagctacccactccgtgtcttctgagaggtgcgctttcactcaacaaagcatctcttcactttgctcacactccaattgtctgcatacctcattcttcctggacacaggactcaggacccaccaaatggcagggctgaaagagctgtaacacaaacagggctgaaacaccacccccccaccccaacttgccacgttgggggtgatgaggatagaagagagcataagagaagagctgtgccctttggggagcctggacctaggagctccctgagccagggctgtgacaccctttttggggctctgtgggtcctggcatctccaagattccaggtgccaccatgttccctggtgcccaattcacttgcagtacagttggttcagctgcagccttgcagggatccagtgcccacgctggcacctgcagctgcccacctcaccacagccagtgtacctggttatgcgcagtggccggaacttgtgcttgctcactcacacacccctctcctccctgcatttgacttgcctttggcaggcatgggttccgggctggtagtgagacctgagtgcagcctgccaagccgagtgggtggaataagcccagtgggcccgagcaaaactcgagcaaaggcaccatcggccacagaggattctgtctggtgaagcaataccccaaagatcttgtgacatatgcatgattaacaaattaactaggtgatttctacgtagctgatgttttgaaaaccacttgatagctactggttgctgtagctagctatcaattttatccaaattttcaatcccttatctaattcccaaatgttatgaaaggcaacaaaagtagtgttacaaaaggtccaaataatatattgggggtaaatatataagattgatttatgggttttagagttggagactatatctttctactagtttgtattcccatcctcaatttagaaataattaagaagtatatttttatacctttttaagaaaaatgaaaaggacagtgccatatcaatttactcctgggaccatagcataatgatctttttttttttaattctttaacttgtcagtcactttgaggttatttttaataccgtgtgtgtgtatgtgtgtatgtgcgtgtggagtatgtgggtgtggtagacagtatatagagatatttttgtttgtatggaaaataagtagaggggagtctgcttttagaagaaatacacctctgtagagagatccacaagtaaaagactacagcaacactacagatattagttgattacaattcctccccacaactccacccacaactatatttaccacaacgttgcttgctactatcttccacactggtgaatattattactggaagatgcaactattttaatttattatttgattatctatgatgattatagaacttcaatgttttttaaatgtaagaaaagttcaaaggaaacattggtctattcatctcatattaatttccaggaagtgacacatattacaaagcagcaattattttccatgtgctaatgaacaccaggtaaaaaagatgaaacaaacatgtttcatatacaccagaatgggtctaaacaaatatgttaccactatccataaactcaacacactaacgaaattactagcatactggccgatgtgtgcattctccaattttattaggaatacattctaataattattatttaaaaactgatatttattcaccatcataactttttgttgcattttttactaacattaaacaagaaatattttgatccaagcgtttatgccattaatgacaatgccaggtttttcctctttcattgtatgctacaaaattattccaacatctaatccaagtcagaaaccatctgttgcttgaatgacatttggcttgtttaaaatgtattaattaaacagacatgttgtgtaactatggcaaagggagaattattttgaaaatataaaggagtgacaccagagatgaagcagtgttcaaaccaaacttgtggcttattttatggaaacatattttcaaataacaactagaaaaacttaactattgactaatattcttaaaaataaaatgattatttggatcatatgtgatccatggttccatcatctcccaagtctatttcatcactgacaatggagtaagtagtttaggtttgatcttgttaattatgctagtagactacagggacaaaaatgaaaagggttaatagcatcataaaagttctgaaaaccataacaaattaggatgggaattatagcctggaataggaagacttatacatgagtcttaactatcttcaaacacaggagggcttgtcacgtagaagaacaatcacacatattttatgtagctaaaggcatatctaaagaaaattggtgggaacttctccttctgtcaatgttttcatttctagcagctaccaaccctcctaatacacactgtgagctggagaaacagatatccaagtttgttaaaattaaaaataaaagcagagtatggtagatatgattctgaaaacaaactttgtgataaatactttaggaatttacatgcctttattcccccacttacttcctgatatgaggttcttttaggatagctgaggctatcagataactattagatagtcaaggtgctttggtaattcataagtttaaatgtaagtcactaaatatggatgtggttagtaccaaaaacaatgtagatatttctactattctttttttgactgataattaggcttttcattgaaaccattgtctatttcagttttaatatttggttttagtattacttaatggcttttttgacacatgccagtttcaaagcgtattaagtttcaattctgtcatattttaaatgttagtcaaagaattgtagtttctcaaacattcacaatattgctatttcatttgcaaagttcacacaactgcagtaatagccaatttaacaatttataaacaataacattactgaaagaagaagcttcatcttgcgtatctacaaatagattatttccattctgattgagctgaaatgaattatgattcaaggaatgaaggaaagttgcctgcttataatgccatgtagtcttctaatcagcaaaaaatatgtctgactgtgtcacacacacacagacacacacacacacacacacacacacaaaacttatatcatgaaaaatgtaatggcagaatagtcagagctaggaggtcacctgattctcatacaatgtagcttcataaaaagcctccagcacaggctagtgatgtattatggtacttaaaaaaaaatagccatgaagggtaaaacccccagaaacatgagaaatgagactattcaaattttatgaaatggagcagtgaggccgggagcagtggctcacgcctgtaatctcagcactttgggaggctgaagcgagtggatcacaaggttaggagttcgagaccagcctggccaatatggtgaaaccccgtctctactaaaaatacaaaaattagccaggcgtggtggcaggcgcctgtagtcccaactactcaggaggctgaggcagaagaattgcttgaacccaggaggcagaggttgcagtaggctgagactgcaccactgcactccagcctgggcgacagagcaagactccatctcgaaaaaagaaaaaaaaaaaacaaaaaagaaagaaaagaaaagaaatgaagcagtgaaaacacaattaggccaacaggtcaactgatccatcctgcaaaatgacttgagttggtaaagtagaaagttttatgactacaaatttcagggccaagtagtaaagacctgctacaaaataaaaaggcctgacatgtcatctgtgagatttacactgggaattatgatcttcacatgggatgtgcatgctggccatataatgcacatgaaaatctttagtttctaaccaggctatttgcacattttactttatgatatactgagtaattataaatcatttggctaagagacagtacctatgggaaaaaaaatgcagaaatcctctgacattcagaatgaggttgtttactattataaaatgtgggaacttggaatcctaaagtattcttaatagtttgaaattcaaaatgttttttacgtaaatcaaaaacaaacttgcatatggtaatccttagaaagtaatgaccctacatatgattactctttctaatcagagttactggtgatgacagtgaatctaaaggaagattgggttagagtgtattaggtttgaactcatggcatgtgcaaggttgtataagtaattctaatgagccttctctaacatgatactcaagtattctataattagaatcacagggtcacctatctgcatgcagcctctttggtgccagattaacctgtccgaaatgccacttacatcatgttatgaaatgtaaaaatatttacctgataattactatgaaatgatgccttcatgaggtttaatggacacaagaatgctggggatttgatatttagtctgtaaatgatttatgtgaatgacaccaatataatttctgggtattgttgtgtcctggaattttgattcatttgagctaaaaatgaggtgtgtagattttagggagaggtatcctgtgctgtttctctctgctactggcagaaaataagtagcttttcagggcaaatatttattcatgaaaacgccaggatttatttccatcccataaagtcactattccagtcaatagatttgttttaatttctgtgtcacaacttctctgcagggctacagacagaaatttgtcatgaacaaattatgacatgaatattaatgtagtagcccttttatactgcacaataattatctttaaccagcttttccatattgaaaaattagccttccagatcagaggtcttcaaacaatggcctttagagccaaatgatgaagaagttcaagcaaaacattatatttaataatacataaaagtacctaaattttaaattttaatgtccataagtacagttttattggaacacaggcaggcccattcagtttcatattgtctatggctgtttttacacttcaacattagggttaagtagttgagaaagagactgtatcatatggcccacaaagcctaaaatatttactatctcattctttacagaaaaagtttgctgaaccttcagtttaatggttataagaggggtcctagaggatgattagtttatcatccttaaaactgtagataaatgttgtggttttttttttttaattatacttaagttttgggatacatgtgcagaacgtgcaggttttttacataagtatacacatgccatggtggtttgcagcatccatcaacccatcacctacattaggtatttctcctaatgctatctctcccctagccccacaccctccaacaggccccagtgtgtgatgtttccctccctgtgtccatatgttcttattgttcaactcccacttaagagtgacaacatgcagtgtttggttttctgttcctgtgttagtttgctgagaatgatggtttccagcttcatccatgtccctgcaaaggaaatgaactcatcctcttttatggctgcatagtattccatggagtgtatgtgctacattttcttaatccagtctatcattgttggacatttgggttggttccaagtctttgctattgtgaacagtgccgcaataaacatacatgtgcatgagtctttatagtagaatgatttataatcctttgggtatatacccagtaatgggatggctgggtcaaatggtatttctggttctagacccttgaggaatcgccacactgtcttccacaatggttgaactaatttacactcccaccaacagtgtaaaagtgttcctatttctccacatcctctccagcatctgttgtttcctgacattttaatgatcgccattctaattggtgtgagatgatacctcattgtggttttgatttgcatttctctaatgaccattgatgatgagcttcttttcatgtttgctggctgcataaatgtcttcttttgagaaatgtctcttcatatcctttgcccactttttaatggggttgtttgtttttttcttgtaaatttgtttaagttctttgtagattctgggtattagtcctttgtcagatggatagattgcaaatattttctcccattctgtaggttgcctgctcactctgatgatagtttctttaaatgttgtaaattttttatatattatgaatttctacatagatccaacaagctattgacaatgttttagttagtttatttacaagaatgcaaatgtaaccacccagtgggttcaccttgcccgctgcctagagagagccaatttatcaagacagggggatttcagtagagaaggagtaattcacgcagagttggctgtgtaggagtccagagttttattattactcaaataagtctccctgagcatttggggagagagtttttaaggacaacttggtgggtgaggggaagccagtgagccaggagtgctgattggtcagtggtgaaatcgtagagattcaaagctgtcttcttgggctgagttagttcctgggtgggggccacaagatcagatgagccagtttatcgatctgggtggtgccagctggtccatcaagtgcaggatctgcaaaatatctcaagcactgatcttaggagcagtttagggagggtcagaatcttgtagcctccagctgcatgactcctaaaccataattactaatcttgtggctaatgttaatcttacaaaggcaatctagtccccaggcaagaaagaggtcagctttgggaaagggctgttagtgtatttgttttaaactataaactaagtttctcccaaagttagttcagcctattcccaggaatggacaaggacagcttggaggttaagaagcaagacagagttggctaggttagatacctttcactgtctcagtcataattttgcaaaggcggtttcacaaaggcttatttagtactctgagactttagagttgaagcagctaaactttttataaacttttatgaaactctgcttttgaagaatacagtattgatgattatttcagtagctccctactaaatatctttagtactaataaatgatagatgactgacaggctaggtaatccatgtattttaatgccctgtaattcaggttaacattcggattatgtctgtgtagaggtgatcagaagacgacctgaagcttttattttcctcttttcactgtgggttctagatacaaagacaaacagaaaaagggatattgactaggcaaaagcatacaaaaaggtatttcagttacattatttccctgataaatgctttaaatcttagaaaatacagtgtggtttaatcagataatacagtcaatctcactcttcacagcttccacacaacctaacactcatcccccaaaaaactaaaaccaaggctgggtgaggtggctcatgcctgtaatcctagcacttttggaagcctaggtgggtggatttcttgagctcaagggtcgagaccagcctgggcaacatggtgaaaccccatctctaccaaaaatacaaaaaattagcttggtgtggtggtgcgcacctatggttctagttacttgggagggtcgcttgagcctgggaggtagaggttgcagtgagccaagattgtgccattgcattccaacctagatgacagaatgagaccctgtctaaaacaaaacaaaacaaaacaaacaacaacaaaaacccctgccttctgaactcctcaatattacttagttccagcaagcttttcttttattcagtttattttctgctcatactaattctgctaagagttaccttaaccaacaccacccactactccctctgagaggcccaaaggaatcctgtctggctgttacactcacatgtagaaaatcagcagactatttctcattagaagaagtaattttatgttcagaaacatattccataatatatattacatattacatgcattagtcattttctcctattttattgagactttaatataaaaaataatggctaaaaactaaagaagattcaagtgagctacttaaatattttatgcatctattatattttcatatatcttccaataagtttgaagtatgatattcaaatcttttcatagctccatctgaagaaatggctgactgttagacctgaatttgtgaaaatatatgcattctgttatgaaaatgcctaggatgtaaattcttctcatctttgatatatgcaaatctcttaaataaattatacctaatttgaagctttcatgctgccagtagtttagtgctttggttgatctattgttacatagcaaaccatcagtaatctttggggacataaaaatcaatagtccttcttaatttttaggtcaggaatttaggtagtgtacagcagatatagctatttctactccacaatgactgctgccttaagtagggggtgctcaaatgtctgaagatagttaggatgactccaataaggccactagctggaatgttcataatggattcttcatgtacatatccggcacctgaacttgagtggctggaacagctgggcctctctcggcattgtagtctctttttatacagtctttccacgaagctagcttgagcttccccacagtatggcatgctcccagtactcaaactactttcaatgcagctgtaattttccatggtgagttttccaagggtgcaaagcagaagctacagggtttgattacagagtctgtgcagattcaatgtggtctcaggctacttgaaagtctgaatatcaagaggtgatgtccattggggagcctatttttggagactactacatatagcatagcaatgctgcaaacaaaaatgctgctacaagatctggtgaagatgttacaaacttcttctttcggaaaccaaatgcttcatctttatctttttatttgtatatatatttttatattctgctaggaataccatttatgatgataactataatttgttttcataattaccattaactgttatccatattatgtaattacttttttcttagaaagtaaaatcaatttaaataaattccaattcaaaattttgtctctaagattcttctaaaggatgatgtacttttagttttctaagcctacatgattgaataaatttgtgttattattcacagtttcagctcactagcaacttacagatacagcaaaaaagtatggttatatttatccacatttattactcaaaaaataagttattgccaaataatacctaaataaatacatgttaaaattatggttggaatttccagtttgctcaaatgtgctataaagctgactgtctcttgctttagaacaagttgactttcattctgcatctggctgtgccttgttttgaaatataatggaagcaacactgccttcaggtgaagaaggtttgaacacagaattgtgttattcacaaaagcctgaaattgttcacaactcaagataatgttaatgtgtcttcaccagatagccgaaataatgcattttctaaattgcagcattaagcaatgattcagatcatatctgaaaccctgtaattttcattctccctttcagtcccagcggcgtgtcacatttcacctgccagaaggctctcaggaaagcagcagtgatggtggactgggagaccatgatgcaggcagccttaccagcacatcccatggcctgccccttggctatcctcaggaggagtactttgatcgtgctacacccagcaatcgcactgaaggggatggcaactccgatcctgaatctagtaagtgatacctctctggttcctcaatataaacgggcttactgtgtttgcaactcaagctatcatagccataataacatgggctaatttattatgttattgtgaatagtgacacatttttgaaaggtaaacatacagaattagatggatggcaagtataaggcagtttataatattttaaatgtatgatcataactacgctgaatgaaatttattatagtgactttgttaaggcatagatagaattttccatttatgtacacctgtaatttatttgtatataaacagccaatttattttattttattcatttatttgtgaaggtataaattttttcttatatataaaaatatttcctagattttatttttatttttattagagataaaaaccattgacagttattttctttctgaggaaataagagatcctgactccaatgtaggagagggcatctgaggttttcagcaatatactgaaatcacacacctgtgccatgttactgtttagaaaggtattcacatttggtcttcagacagaaggcacaaaatctgtgttttgcaaattccaaagatgttgaactctttaaaaggatcatagagttgatattaaataaaatttcattaaatgtattatcttgaacgtgtagcgaacaaccttgctgatttataatttcaggaaatacaaaatttgataagatatatatttctcggaagagtcttgaaattgcaagaagctacaatttgctccatttatgttatgtacataaaagtatgtagatacaaaaaagcatacaatatatgtgagaaaaaagtcatagccataaaccaatatgaaaaaaaatgggccaaatacctggcaaaaacataaataaggtaatataaactagacattttgaaaggttattttgagcattatggattgcagggatgtataattcaaataaagcttctaggctttagaacaaaatagcttccctatcattgtattttaatcctctatttttgaaacttcaaaaaatagggaaatggattggctaaacattatgatataatctaaggctaaacatatggaaccaatgacaacataacatcaactttttctctctacagatgtagatgctatatattataggtatttttaatgtaaaaatattagagacttttgagtcagcaagttcagacagtcctaaaaatctactatctccattttcaattttatacttggaataaatgatcaacatttgttctgaagataaaaaattcccctataccttgtgtcactaaactatctttaatttactttgtttagcacagcaaaatgactcctggtagaaatacatagttgtgattatatttacttgtgtaatgaactaagagttaatctctaataagaatatgatcataagtaacaaatacacattaagcaagggtgccactgatcttctttcctccataaatcattgttttagttgtaggtctatcatgccctgttaaataagaatatagaaatgggataagtatcatttttataaactagaaagagttgattcatttgtacatgatgtgttactaagcctctttcatagaggattgcatagcaacaattaaagagtaaactcagagtaagcatccacagtgcacatctcaccctgaaataaaattccaactgaatgagactcaaatggaatactgttgataatagtaggagaattggtatgtgtcagaaatagtaaaacatttaacattaaatatagctttattaatcccaattatatttagaaataagtagttgttttaaaaagtattcaaatgcatagttcttaacagaagctggtcttgtttatagttaaggatataagtgctagcatcaatgtattagctgacatacttaggggctttttttaaaaaagggtgctttctgttaggagctaaacatttctctcttctaattatatttacactattatcttgaacattaaatatcttgttcatatttactctacaggatgaaggactcacaaaatttgcattaaaaactttagttgctcaatcgattttattttaaaatctagatgtctgtgggcaatgataatagtaaaacaaattgtatattttgctgcttattattttaataaacttatgcaaagggtagatataattaaaaatgaatgcccattttctacaagtctaacaatattgttaagcgaatgtttaaatgttatttttttactatgaataatactaacaaactgctctcctactaaatgtgaaacctccccctaaatcatgttccaagaaaatttttgttaggagttttgttttgggacagtcagagaccttactaaaagtgcaagaagcacaataatttacttgaaatgaagctccattgtcttaatgtgtcacggtagtgaaatgtttaacatagtacgtgtgtgtgtgtgtgtgtgtgagtgtgtgtgtgttgttttaattaaaaagaaaaaacatagctggtttagaattggccatagcaaagtaatctctttaggctaatactgatgataaggtattttgattcttcaaaaagcaaagctatagctctgaaatagcacccgataatgggttttatgatatggagcagatgccaataaactgtgcattgtttgtcaatagcaccactgataggaatgtaaagtgttagaggaaataaatgctgtccttaagcaatggaattaatttatgcagttcccatttcacattttgaaatgtattacatcttcaatctgctttctttcttgctagtgaattgccaaaatagcacatagttctgcaaatcctttgtaaattcacaaaacaggaataaacatgacatttatgaataagggtattctgtaaaatttgctagagggatttattaatactgctttaaaaatatagttccctggttgataaaaatctgctgcttaggtgaagaaatcacacaattcattctcttaagtcttttgccaagactattaacttttctttttaaaataaagaaaacaaactcaagccaattattactttttgaggagacaaagtcaataaaatatcctgtctcattccatctgaagactttgtaatttttaaattttataattgcaatctctttactgtggccattggactaagggtcacttaatgccattctatacagttctgtcttccttggatgacagcttatattctagacctttcctcctaccatagcctcatcagattatttacaatgaaccctgctctttgaagctagttaatttgttaaaaagcaaaaacaaaatagaaacccaattcaaaaacagcactattgattgctgctgggttactgtggatactggaacagataatgtctgcattttcaaaggattttcttgagacacattcatggagacacatgtggccctggtaaagaacaagttgtgagtctacttttgaggattttacatatccaggtatagtgttaactcagagatttgaggatagtgagatcctcttgggactactgtaaacacattaaactatgtatggccctatgctcctatctacttatttttaagtagtctcaggtaaaatatgatttttgaggatatgatttaaaaatgctttccaatttgttttctaaattttttttctgtttttataattcagactgagtgctgagacatacagaaatattagcaaatgtctacacattaaacttctgagattttttaatactctatgtttatgaagccagggtttttatgttttgtcctcaaatagagaatgcattgctgctatttcactacaggtaagttggatctaaaagggtaactactaatatttttacatttctactgatctgctggcatattataattttccagcttcattggaagaaataaaatagccataattctttggaagataaatggtgaaatagagtattgctaaagaggctcaaatcagtcttcagctttctagtcataaatcagtacaattgcagagaaaaatccccctaaaatgaagaggagaatgatttagtttatatcagtattttaattttcttcaactgaacaagttatgtcatctgtattttttaaaacctcttcattgtatgtgatcatttcacgcatgaagtcactctatctgaaaatgttatagctggtctagtgtccagcattgaatcttaaagtaacaaaatacttgagtgaaatttcttcatcttcccccaaaaaagttaatgcttttcctctttttgtataacatagtcatttctgtgatacaaaagaagaaaatatagagtttcaagaacatttagggctaaaaaattatatgtttaaaataaagatcaatatatgtttttattaaaatgatgtctgctagagtttatctcatgttagcaaatctgtttgacattcatttttatttcagtagatcaggtttgcttagcactcaaatacactactaattaattcacaacaaggaagtaattaatctttccctggcaaggcactttgattgatcttctaccagtaatccaataaattggtataaaaagtgggagaccaatttgattgactagaatgaatttctactcagagaaatgccagattttctcctgatctgctaagagtattgacatgaataacactagggtaattactagtaagtgtttgaacatctcattatttgaatatctaattctaaacatagactactggtaaaattaaaaaatcaaaaccaaaaactgtgaaacgttaaaagaataagctagtaatgggtcattaaaactcagcctttcataattaaaaacattaggagtcagttgtctaaaagcaaaataaagccatggaaatatttttccctggaaaatattgatatactagtaccttggggaaagcagtgatctaattatttatctaaaaaattcaaggagaaaatatgattcaattatagaaaaaaggagtagtattggttagtatatttaagagaagagtaacacttctgatgtggcagaaaatcatctgagtccacagttcagctaatattacccgtataactgttaattaagtgtttttgtttgctgctatatgcccaggaaaatttgactccataggctttctaatatttctttaaaatgcatttttgacgaaagtcacatatcaattcatgtattacaataaaaagaaaagtgaatgcatcattttgttaatatttttacatgaaacaaatgggaaatatattccacttaacaaaaagaaattatgctccctttaaaggttaattacatagcaaggccaattctgactctgtaggctatgtatttgtaagattatttcttaaaactgtgctcagtagcctatataatagtgtcagtccatggtagaaaggggggagtaaaataatttaaatcagctcagcaagcttaatgtcatgtgttttgaaaaatgaatcaatcagtatttctaaggagtgatgttatcattatcaatgatatcagttatggtctatttcaagaaagaggttgaactccatggccccgggttctggaaatataggacatatgcctgctctatttcattgccttgccaagagaaaacaatatatagctttatgctgctactgaaaatttaaaaatttccttaatatttattaatatttttaaggtaacaataatatcaaagtcacttttattctttttcaaatgaaatatcattgtaataattgatactgtcaatgattattaccagtttattttagtccgtgatgtgttatgtaaatagtgttagaaaagtatctatatataaataggttataaagaatggttccacccaagagttcagccatctgccattgttttagagagaataaggtatacttggtagtgacagtagtttttataataaatgtgcttaggcaggtataaacagtgatctggtagcagatgctctgtgatgtatattaattttaccatttaaactgacatgcttttcaaaagtaaatctttctctattgaagcttctgaaagtttataaatacattataataagaaaaatgggtaaaacacgtcttacgataccatcctatcatattcaacttccctatataagagatgcaatctcaatgtagaccaattgaaaaatgactgctaatttggagtatataggctttgggaaggcaacaaaagctttatgctagagataatctttaaacaattatagaggtcatgaattaaaatgagaagtatatctttaaagttggagacttgaagacatttacaggattttatttgggtgacagtctctaagatgagtgtatctttaatatcttaaatataatatggattagatagaggttgatcactcaaaagcaggccactataagtaaagcaatctcttatcttgtcttttctgtttgaaagtgacaagcactaggagactggcacaagctgccagttgaaagccaatgccataggtctggaatgtcaataagcttgaataatcacctaaagtggcagagaataggtggccttctcttcacaataaaccttctcttgcttctaaattttattaagcttcctacaccaaataataaaggtcatttaacatttgtgtttctataatttatgagccatgaggcgattcattttatgacaacattctttcttctgctttttaaaaaatcttacttctcactttcctttgcctataagacagactatttgccatttgttattttttgtagttctttgaaagtcagtataatcagtcattcaagatgtagcatttgggtgacttggaatatttagtagtgttagccacacatcaacttcttattttaaaatgatttataaattttaatgaatgaggagtattatagcaacatatttttaatccccatgacacttttaaaattggacaataacttgcaactctcatgattgctttcatcaacagaacattcaacaactggtgaatatatcaaggaattcattaaaaaatgaataactatagaccatctgtcttaccatgatttctatgattttttaatttacattttattgaatattgaagatgcccaatagagaatagaatagagataacagtgttcgcttagccaattttttctctctcttaatcaataatcttagaaattgttttcccagttccactaggtacatggtctttatctggcattaatcaatcttatattggaaatgtttgtatgttatctaaacaaactttttctgaatagtgtatatgaaataagccattaaaagtttagttttttcttagaaaattcttctcttgcaatttgtatagacctgaaaggctggtaattttaaatattattttggggtatctaattatacgataaaaatatttgaacattgaatacaaatttttattgcggtaattctttgtgtaatcactattcatgaaaccttttcagcacagaccattgtagataatttgttttaggcaatcatcttacgtattacagaactctagtccgtttactacaattaactagctctgtgaacttggataggtcttttaacttcactgtctctttttcttaatttatataatgaagggattatacgaatctctagtgccccttctagggtcataattttgtaactattaaaatcccagaatttacatgtgcaggtgttgccttttacattgtctttaaattctagagctctcagggaccttgggtgctatttagtccagctccctcattatgcaaatgagataactgagatttggcccttttaagcaacaacttaatgttctaaattaagatttgaagtgtatcgtttatcgtgttctaaaataagagtcactaatgttggtaagcagctacttttgaaatttaaatgaaacaactcatgagagaaaagtagtataaaatttagcattatcatcactcaaggggactgttacaatatatccaaatggagaacttttttatatgtgatgaggccctttatttttttaaaaaggttcctgttttaaaaatgccctgaaagagcatttggagcaatacagactgccgatttctaaaattactgtttgtgctaaccagtgaaagtactgcagaaaaaactgtaaacatgctgaatgataatgatctctatgtcaggaaaactagccacttttcactatgcttatctaatgtagttaaattgtgtgtacgtgtgtgtatgattacttccagaacaacttggaattaaaaaatgaattttagaaggtaaatttcctttgaatatgatgaaaagtgcataaacagaatctccaggaggagaaacgcagaatatgtgaatatatcttttatgcattctgctgtaaactcagctcttcctctatatgaaattcctgtgtaactctatgctacttctactttccagaagaatgaagtctcagttaacaaggaattgatattcatagactcaatcgactgagttaatagtgtgccatatagtcaaaatgttttgggtaaaccctattataatagtcctttttggataatgattagaacttgagatgaaagcaggataacttttatagttatataaatgtcctataaaagttatcctgcttttggccgggcacggtggctcatgcctgtaatcccatcactttgggaggccgagatgggtggatcacctgagatcagtagttcaagcccagcctggccaacatggtgaaaccccatttctacaaaaacacaaaaattagctgggcatgatggtgggtgcctgtaatcccagctacttgggaggctgaagtgggagaatcgcttgaacctgagagggggagattgcagtgagccgagatggcaccattgcactccagcctgggtgggtgacagagggactctgtctcaaaaaaaaaaaaaaaaaaaaagttatcctgctttcctgcttttatctctagttctagttctaatggattgagcagagtacaactccttttcatctctagttgtttatcctagagatgaaaaggagttgtactctgctcaatccattaagttatatgaagtttgtcttacatataaagtctgttagcttttatttatactaatagatgacatcatagaaattgatgctctggattaagaaagtcatgcaaaaataaaaatattttgagaagaatacttgatcatcttgaaaatagcattagttttataggacaatattattgaagcatgtaaaaaaaacagtgagttttaattaacttttagaagattctactcctactccttggcttatcaatagtgcattgcaaggttcacttggctcactataatttttattttaatgatgttgttttccagggctgagtttagactgtgatttccttagatttatgcatgtaacttaatctaaaactgaacctgacaattttttctaactgattgttccatttaactgtattctgtctctttggaaagtgtgtgtcctcatattgcagaaatgcctcttaaatttgatttgaagaaggagtcaattttttttttggggggtgggggaacggaatctcactgtcacccaggctggagtgcagtggcgcgatctcagctcactgcaacctgagaggagtcaactttacagaggtacatacatgtcttctacattcttttaaagaatgtagctaattaatctgatttttaaagactaagttaaatattaacaaggaattcagggatctttgcctcattcagactgtagttacaaggacagagtactcattagagatatttttgatatatgaatgcaccaaaggcattctcagttgttggataaatcatgtatttgattcagctgtttgtgtttgttttcttcgttcagataatcttctataaaagctacttttactagcttaaatccattgcaaactttgcagtaataatgttttctaatttctcttcccccagttgattatgaattatactggacagaagaacaggatacattgaaaaatttcacacaaatatgtttttattcaagtagaaaactggagttttaggatttgacccaaattaaatccaaatattgaaatttcaattcaaagtgccatagtattgaactattaagtcttcccttctgaaataactagccattacatttttgcaaaacagcttaacttatgaaatataatatctgaaatccaaatatcatggcgaaagatcttaaacaaagtgagcccaattcaatacccatgtaactttggcaaatatcccctcagggtttcaaaggatatgaactgtggctaagtaaaaaaacctttcatctagaaagatcccataatgcccaacagtctgaagtgaatctgtctatgtgttagtactcaatacagggtaaaaacatactgctttcagggcagagaattggaatttcactgcacaagggaaatttatcatatgcttgaaactgaactttcagagctgctttagcaatactattttttgcagaaagaaaaaaaaaagttgaccttcagagaccttgttttcaaaagaccatgaatttctttgtctactcccaaaaagattttttttgaaatcagagaattttaatacccgtaagagatgcagatatgtttaattctcttatattctgtttctttcttagtctcttatctacaaaacacattttagtggttattaaagtatataagactaaataactcgttatgaagagaagcattctattggagtgggaccagattgcctagaagagaatatcaagtctgctccttcctagtagtatgacatttgacaagacatttaggcttcctgtgcctcagctttgtgcatccttaaaatgagaataataaaagcagttgctttgtagcattgttgtattaaatgaaagtgcatgtatttgtctgcatatatacatatatttacagcatttaaaaatattttagccgggcgtggtggctcacgcctataatcccagcactttgggaggctgaggcgggcggatcccgaggtcaggagattgagatcatcctggctaacacaggtgaaaccccgtctctactaaaaatataaaaaattagccgggcctagtggcaggcacctgtggtcccagctgctcgggaggctgaggcaggagaatggcgtgaacccgagaggcggagcttgcagtgagctgagatagcgccactgcactccagcctgggtgacagagccagactccatgtcaaaaaaaaaaaaaaaattataagataatcatattctcacacagcacttttcagtttcaaatgcatacagaccacctagaaattttgttaaaatgcaaactcagcagttgggtatagggaccagagagttttcatttctaacaagtccccagggtatgtgaatactgttggtgtgggggctacactttgggtagcaaagttctaacaaatgtgcttagcagctgacccaggtaaagatgaaggagagcagagcagcaattggccatgataaactgaggcattaaaataactcatgacaatctgtcctaaagcctcagacacattgtattatattttaagatacataaaattttaccatactggagtttgtattatagagactttgagataattctcatagtaaagtgcagaaaagcattatagaaagtttcgaaggtcagtacatatttgcttgattcttcaataaagagactttctcttctttctgtatatctgtccacacacacaaatgtgtacatgcgcacaaaaatccacacatcttatttttatttatttatttatttatttattttgaaacggagtctcgttctgttgcccaggctggagtgcagtggcgtgatctcggctcactgcaagctccacctcctgggttcccgccattctcctgcctcagcctctcgagtagctgggactacaggcactggccaccacgcccggctaatttttttttgtatttttagtagagatagtgtttcaccttgttagccaggatggtttcgatctcctgacctcgtgatccgcccgcctcggcctcccaaagtgctgggattacaggcgtgagccaccgtgcccggcctttttctgataatttttatttgaaaaacaatgcactccatttatacgtcacccatgtcatctaggtgaatataaatgccatttttattttaggtgttcaactataggcaagctcttcatttctaggaaactgatcagaagaataacagggcagatagggcattcgcaaagcagagtaccagctgcgctgtcaactaatcaagtcagcaaacatctctgcaggtgaagtcattgtgattcctattaactcaagcagattaagaattcttctggatcattgctagtgttgatgtgtcaacttttgcaaacaattatcagactgggaaaggtgaacaaaggaagccaagaaagtcacaggaagtagacaaaaaagatgcagataagttttccattgaatgtggggtgctggactgttttatttgaccacttttgcctatatccagaagaatttgtttgttgtgtatgcaattgagtcatagaaaagaaacgtcctgttgttaaagttctcatagttttgggaaacatatttgcttagctattcaatgtggatatattctatgataggaactttaattaggtaactgctgattatgtgtaagttttatttcttttttttatctcattgcttacttatatatcctagtttaattccaaagagtgaaaaaatattgactgattatttgttcttgcatcttttttaattatcaccattcattttcattgcaatctccttctcccagtatgttttatgaggctttgtgccttgagtgtaatgggcataaaatgaagggaagtctatgtttttagtatgcatgatgttttctgaatatagatgcttaaggaaattgtaggcaggtgtgttttcatctctcacactatgtggctttttctattccatggtaggaatcaaagatagccaagttaagaacattgtggctcattggaattagaacttcatgcagtttaaaactgattattttatttgtttcaaattattttagcattctcaaattaaccatccaaagtttccccagagatgaatagtttcacatcttacaatagcaccagcaataataaatatatagtcaacattttccttttttcatatttaaatgtacagactactttttgagatgttagaaaaagtagattgataatgtgtcattgcaaacttataatcaggcttattgtcacataggcataagcacaaataaacattcctcctcaaggtgtggaggaatattgaatatattgaagatgaagcaaactaactctcaacaggaaggaataatagtatacttggcatctttataactccaaatcatcacggaagtaaaacatttttaatattacatttttttcttgtgtagacatggcagcacaattttgttttacttcatcacaagagtgtttcattgcaaattttaagaatatttttataattttctttacaatggctgtattacatgagaccaagccatttcattgtaatattttaaggtgatttattgctagtaaccacaaggcaatatgccatcttttattaaaaaaattccacaggaagcataatgactatgttttttaatcaatgcaatttgttttaaaggattttatcttgaagttagtaacgaaacttctgtacatctggaatgctgaatgtcctatcagacttcagcctgtgctgatatataacaagtataaatatatctaatgaagatagttttaggcaaatatgagggttctggaagcaataatttgaagttttgaaaaattactatggatcaaatgataacgcttcatttgtattctgcttttttgtccttggatctacgtttttactttaagcaaatgtaaaaatggctgtaaagagatataatcatttttgtgaaaaagtaaatggccttaagctggttacatgaattaatccttcatgtcctttactcctttctgcttttgaaggaaagattaattccgttatcaaattaacacgtgcacaaatatttggtactgtatattcagtggaatgaatatgattagaaaaaaggggacctgatatacagtctaggttctgtcaataactctgtaacctaggtgacacaaacaaatggaaaaacattccaagctcatggataggaagaatcaatatcattaaaatgaccgtgttacccaaagcaatttacagattcaattctattcctatcaaactaccgattacattcttcacagaacgagaaaaaggctattttaaaattcatatggaaccaaaagaaagcctgaatagccaaggcaaatcttaaaaagaacaaagcaggaggcatcacactgctctaattcaaactatagtacaaggatccagtaaccaaaacaacatggtactggtataaaaacaggcacatagaccagtgggaccgaatagagagcccagaagtaaggccacacacatacaatcatctggtccttgacaaagctgagaaaaagaagcaatggggaaagaactccctagtcaataaatggtgctgggataactggctatatgcagaagattgaagctggactgcttccttacaccgtatacaaaaatcaacacaaggtgggttaaagatttaaatgtaaaaccccaaactataaaaccctggaatacagcctaagcatccattctcgacataggaactggcaaagatttcaagaccacaaaagcaagtgcaacaaaagcaaacattgacaaatgggaatctaatttaatgaaagagcttctgcacagcaaaataactatcaacagagtaaacagacaacttaaacagcatctataaggaacaactgctaaattacacaattgcttcttaggcaaatacaagacaagtaattaacattgtattttcaactatgcatttgaaattttatacatgtttataatttcatatatttgccaaaagtgtgtgcgtgtgtgtatatatatgtatatataccaaagattctaattgaagatgaatagtgcatttaaattctggaaattttactaccttgcctcttgagatactgataatggagaacttccagaacaaaagaatacaacgaataaatgataaaccaaaaatcactaataaaatacaagaagctcatcttaaattagtcttaattattaattttcacctagatcttcacctttaaagttttcaaaactcctagttattttgtttcaaaacatcatgagttgtttcatgtgtcattactgtgtgttctgagtatctgtttatacgtgtgtactgggatatgtgtccgggcatttacgtttttttgtttgtttgtttgtttgtttgtttgttttgtagagtgtgaatctgcaagtcattttatgcatatctcctgggggtttaaaaataaatctcttctttctgctaaatcaagttgtaaatatctcgtttagtctgctactacagtaactcatgaaaagagaaagattgcttttcaacattttacctctgtcctcattttatgtcagtgactgctgattatatgtactattagtgaaacagaaatcagcatggagcacttaagttgcttttcaaataaagttcttctttcagcatttagtttcccagaaggcttttaatcaaggttatgggaaagtccataaactttctgctgaatatttaacaagctggaagtcactgcaaatgtgttttttcaaggacaagggaaatgagattgcaatcaggaaaatagaagaccttataataagcaaagctttgtcttctggataaaatctaacaagaaaatcaaagtgactcacattttcaagtttccttgtaagatttaaaaattttcctagtttggatcatcattttcaaaatggtaaataggactgagtaattcatttgagtccaattactatcttatctttaagaagatggttggaatgagttctgcaaaatggtgatagcggcagaatataagaagatgtcactgaagttccactgtttaatattaaaagcataattcttttggataaaagaaattttataaaatttacaaatgtcatgtgattactatatattttgtaaatgacctagcccaccctcatcaaagcaaaaacctcacaaaactatgtttccactctcacaggaatcaaaagttatgaaaagagataggaacagattcaaaaatacttacatattgtattttcttttaacatgaaagaaaattggaagtttctttcaacattgtctgtctactgagaatggtgacaaggagtaaaaatagaaatgcatactttggactttcaaagaaatgtaaggatatttggcagctttagtgtggtaagggcaagttatgatcatgtgtatcatgcctactgtgtaataaaagaatgaatacattttcattctatcctcatttatattaaaataatctatgtagggaagttaagtctttccctcgatcacatagaaatgtagagtaaaaatttcactcttatcgcctctgattgctaaatcagaaaaatttatacaagacatttatccttactgtaccttcaagttttgatatatagtaagaatatcctactgtttgttatttatcttaaagttttatgtatggatatagaaacattattcttttctgaaaagaaaattttgacttttaaggaaaaattatatagtaggagttcaaatagattgcaacttacctccttcctgcttacataattttggaactgttctagcagagtttaagaagaactgtgaggggtaggcaataggttggtctttgagcttaatcactgaattccacttctccaacctgtgcatgagtgaaataagcaggtattggagaaaggacttggctacatattatggaagccaactctggtctctgccacttggtgcaagtgaacatataactgaagaattttaagagacaataatggtttgttgtgtctgagcaattttcaatgcatgcaaatcatattctatatttattttgttattgcccctaacacctcctacaaagtaatatatattgtaagaatggtggggggttgtgacttgaggaagtacatattcatgcgccatcaggtttcctcctctgtgtaatgtacacaataatactgcctacctctttggattattttgagggccaaatgacataagcaatacaatacccttaacaccacatttcacacaccttaaacaatttactgttaataatggatacttttctaatcatattcaagccatgaactccctccccataataataaacattcattcaaggattcacatagcatttcacaaagtctttgatcactttggagattcagttgtctgacctaaacaagaaaggccataggtattagcctattacgttagaggaaacttcattgaccattttgtcttctcaggccaatccactcatgttaataagtgatttctctggttgtttttagaagagaattgtttaacaaagttgaatgagttcatgagtcatatagacaaagctttagttgtattttttttaaaagtagctcttcttttgtttccattgcaaagaagattatattggcattcagaataaagaagaaaataaaatgaaccataatctcagtaccaagataacatcagttatattaaaaataaaagtattaacatgtgtatacatggtaaaacatttaaacaccactgtaagatatgaaagtaaaagttagtgtctccctcagcacctctcttcactgctcacaaacacctcttacaacagataatttctgttaaaagctttttctgggccgggcgcggtggttcacgcctgtaatcccagcactttgggagggcgaggtgggtggatcacgaggtcaggagatcgagaccatcctggctaacacagtgaaaccccatctctactaaaaatacaaaaaattagctgggcgtggtggcgggcgcctgtagtcccagctacgcgggaggctgaggcaggagaatggcgtgaacccaggaggcggagcttgcagtgagctgagatcgtgccactgcactccagcctgggcaacagagtgagactctgtctcaaaaaaaaaaaaaaaaaagctttttgtgtttacttccacccaaaatttgtataccaacatttatttatatgcatatagatgattttaaaattattaaccaagtgagtattactatacacaagtgttgatgtcttgttttgtttttcacttaaagtatgtcttgcagaattttctacattaaaaagaatagatatatctcattattttagcggtggcatggtattctaatgactttgatggaccatgactgatttaacctgttcataactatttaggtaatgtctagattttagctaaaacagacaatgctgcaatgaatatcattgagcagaaattgtaatgctctattactagtctatctgtcatggaaacaatggaattgttggatgaaaaggaatgtgcaagttttattattaaaattttcaatcattaagaaaaaagactgataatacataattgtttctatcctctaatattttcaaagattaccattctgccatgattgtgtcatatcaccctttattattaaaaattgaactcttggctgggcacagtggctcacgcctgtaatcccagcactttgggaggctgaggcaggtggatcacctgaggtcaggagttcaagaccatcttggccaacatggtgaaaccggtctacaaaaaaaaaaaaagaaaaaaaatcagcaggacgtggcagtgggcacctgtaatcccagctacttgggcagctgaggcaagagaattgcttgaactccggaggcagaggttgcagtaagacgagatcgcgccactgcactccagcctgggcaacagagtgaaattccatctcataaaaaaaaaaaaaaaaaaggaaaaattgaactctcagagttgtgaatactcctctgttcccaatctgcttcctctctctccagagtaactcacaattctgaatttggtgtttattacccccaattattattttttgtatttttattacatatactatacattataaatggtgtagtcatgtacagacctttctgctgttgactccttttgcatgttcttatttattggcatatgtaagtttagtccctccacttccactgttttgtagtgttttgtatgaacatttcacagaaattagttacctattgatattttcaagttatgttgtttacaatacttgaccataacaaaaactgctacaaagaacaaccttgtacatactttctgttgctcatgtttaaagttactcttgggtatttacctgttattaaaattgttgagttgcatgttcaacctatctgaagtctctaagtagtacaagagagttgttgctcaacatcccatagccatttgacaccatattttaattgttcaaatgtgaaaattgtaaaatggaacttcattttgtcttttatgtacattttctagtttactgatatgattgaatatctattcaaaaatgtattacttattatgtgtttttcttctcttgattaaactattcataaatgtagctgatttttaaatttgattatttttacttaattattcttatattctttacatagtcttgataaaaataatcagatatgtgtatggcatgtgtcatctttcagtcttctattcatcttctctctatgtacattaaaacacatgtatttctagatattgttaagctgcctgacaaaaagggtaaactagtttataatcccactaagtgtgtatgaggttactcttcccctacacttttgcagatactggatactattaaagtgttttttttgtttgtttgtttctgttttttgttttttgagacggagtcttgttctgttgcccaggctggagtgcagtggcataatctcggctcactgaaacctctgcctccgggttcaagcaattctcctgcctcagcctcctgagtacctgggattacaggcacatgccaccatgccaggctaatttttgtatttttagtagagacggggttttaccatgttggccaagctggtctcgaactcctgaccttgtgatccatccacctcggcctcacaaagtgctgggattacaggtgtgagccaccttgccagccttaaagtgttttaatattaagaaatgaatagatgaaaaaaattgtctcattgatgcctagatataattttccatatttataagtgagacagggcatcttagcatgttttaacatgtgtttatcagaatagtaatttcagctacagaaaattccctttatcattattatttgaaatataagacttttgcaaataactgcagttttttcgtaaaagcagtttgtcaatttcatagagttagatgcatctgaaattaatttgccttgtcaagctcatgtagaagggggaagaaacaccacaaatgtcagtgtttgccaaagttactggaatgcgtgtaataaagtgaaatgcttcatttattactattgtttaatgaaatagtatttgttttttatttttattttctttattttattttttgagacggagtctcactctgttgctcaggctggagtgcagtggcgcaatcgatctcggctcactgcaagctctgcctctcgggttgacgccgttctcctgcctcagcctcctcagcagctgggactacaggtgcctgccaccataccgggataattttttgtatttttagtaaagacagggtttcaccgtgttagccaggacggtctcgatctcctgaccttgtgatccgcccgcctcggcctcccaaagtgctgggattacaggcgtgagccactgcgcccagccaagaaatagtattttttacttttattcaaatctatatagaatttatctatataaatgcctgcttaacattaacatatttttaaaaatgtaattggctaattatatttagaatgatacaatttaagctgggaagtaccaatattagattaatgtgtgctgtattatatactttctgagaactagaggaggtggtggacaagccattgattgctaatttgaaataagttttaaagtattttggtggaatttattttgctagcatgacttctcttgattgaggctttacttattttaatcatgcaggacccatttgtgagaagctctttacaaaaccaaatggatttttagaattaacctaaattatatgtcatccaataacattcttgatgttgtcatagttcagcagaggacaatcttgtatcgtatctctgtcacatagacataatcataccacacaatatttaagctagaacgtggtttggcattctgtttaaacactcatcaaaatggtaaacattcccctctcttaattgctttgttaggcttcaagaaagagaaaaattataaagcactattttcttcttgctacaaccattcattctacagataaattctatattggtgaatgggctatctggattatgtgtattattggaagcataacagatatgtcatgtagatgacaatagcagaaaatgtgatttagctgaaatgatagagctatgaaatgtttttcttccctaggtctggactacacacaatttcaaaccttgtggtttataaaattgcaaaagatgcattatattgaatcatgcttttgacttattgggtagaaaagtaacaatggctaaactcaagtgaagatttggttcttaactgtatttgattcacatttctcttggttatttgctttactctacctcattttgcttgtgcttattctgtttcaattagtggactcttaacatttgtatttactaaaaaatcaatgccaagaaattgcttcttttaagacttatgctttgaagtgtgaaatatttagctttccaaagaactttataagcctatttttttagcattttaaaataagcatagatttatacataggactggtggcaaaaaatgtaaactagaaatatgaatatagtaataatagctttaattacttttacagaatttagaagaatgtgtctctgtgggaataaagatttctccctctcttgcccccctctcccatagtagcatcagtataatttatttttaaagaaatatctcttatacatttcagtttttccccttatcattgtcattgagtaaattgataggaagaaacataattaaggaaggaaaatcttatttcggaattataagcaattttctcttctcctcctattgctttctggtaggcatctgttcaggtatttagctggagatagagtgaatcacctttcttagtgcgtacaggaaggggctttgcttgtagtcacactgtcaatactgataattacctgcatagcaacaaaagatatattcttgtgatattttcaaagtgaaatcggtacttcagtggtactcttcatgcagaattgcccctgtggtaccaagttattggattttaatgctgcacctgtgtgaaagggagaaccagaaaggatataaagaaaagatacctttaaggaaaggtagtagtttccatcaagaaacaaaggaaaatataggatatttttaaaatctagtttgtgattatcattagtttttgctgaattggcttaaaggatttataaggctgtaaatccagaaactcaagcgtaatatttattattataaaatatagcaggaaatgttaggaatttagaagctcatattttgaatcaacaatgccaaaatattataggggaaaatggaaaaataagagaatttgtataagtagtaaagactgctttcttgaggcagaaggcaaaagtgccaactgatgtttgatgccatcaaaggatactggtcttctattaaagaaaacaatttgtatcttgagggtaagaaagaagaacctgcaaactctgtaagaagcaaaatatattcatgtggtatcagtcactaagaaaaaggcttaatttaatgaaagctatgtacatcctgttattactggggaagtaaataaagtcaacagattacatttaaaataatctcttgttttcactattcctgttgttttgtatcaccagtttttaaagctaatataagatatgaagaagaaattttttaaaatccaaatatattgcaagagattactatcagagaaagtttgagtaggtcaatgctataaatacacattaacgttatatttccccttaggttgaataaattggctatcctatgttattgtacttttaaaattttactttaagccctgggatacctatgttgaacatgcaggtttgttacataggtatacatgtgccatggtggtttgctgcacctatccatccatcatctaggatttaagccccgcatgcattaggtatttgtcctaatgctctccctcttttttcccaccaaccccccaacaggcccctgtgtgagatgttcccctccctgtgtccatgtgttctcattgttcaactcccacttatgagtgagaacatgcagtatttggttttctgttcctgtttgctgaggatgatggttaccagcttcatccatgtccctgcaaaagaaaggacatgaactcattctttttttatggctgcataatattctgtggtgtataagtgccatattttctttatccagtctatcactgatgggcatttgggttggtttcaagtctttgcttttgtaaatagtgttgcactttttttaaagggcaggtaagagttaacaggaaatggagattggacatgctgtttcagagaagtataatcagataaactgaaggtaaacaaggtatgctattggtgtaaaattttgagagagaagaagaaagagagaagaagaagaaaaagaagaagaagaagagggaagaggagtgggaggaggaggagtgggaggaggaggagtgggaggaggagggggtaggaggaggaagaagaagaagaagaagaagaagaagaagcaacagcagcagcagcacaagcaacagcagcagcagcggaggaggaggaggaggaggaggaggaggaagaaaaaggagagagagagatttccccgttgccaaaataaggattttgctttaccttcaactgcttaagctaaaggtctttctttacatgggataatagttcactgtaacacatctgcctgcagtagttctcttccttttttggctgtcagaaggtgagactttgctctcactctattggcacctgtaacagtgataccagaaatggcaactttaaagtatgacgtagttgcccaattgtacgtctcagaacctactgaggtgctacactgtcacagggggctttaattgttgacaatttaatttctaaagataaaaatttgatgatcaaaataaagaaaatagtatatatatatatagataaagaggtagataaatatggtataatttatcttttttttataaaccagcatacccacactcttggagtttatcttttattaccataataggagttcacacaatcttgcatctatagtaccttcatttaaagatttgtttgttggaactgcaaaaagaattattttctattaattaattattacctattatcaatttttcatatgtttcaaaaaacagtctctctctctctctgtgtgtgtgtgtgtgtgtgtgtgtaaatttatttttaggtagagaaaaaagtaagcatattcattctaagataagcagctagaagcttcgtatgtacatgatcatatgtatatgttaggtggttctctgatgaagataggtctatttctcctaagaaattgctttgtcttttgtttttgacagcatgtataatttatctaattatgttgctttatttgtcttgttttctgtgaagcacagagccaaaattgtggcccaaataaagcaagaagatttgcagtgcaagctgcttctttcaaagggtctgtgaattcttttggtgttctggtatgttcctgtggtggttcttggagcaaacgtttatgatgtgagtctccacatgctgttctgtccttccaagtgggagcagcacatgagtccaccattttgctggattattttttctattcattctttatttattatttgcatttcattttggaaaccttctattgacgagttttgtcaatagacatcaagtctttgattctttcctcagctatctccaagttattgataaggccatcaaaggcattcttcatttctgttaaaaagaatttggcaatctttagatctacatatatatatattattttctcaagagctgagcaaattctaatggtatctctctttgaaaggaatcaaatattattattatttgatgcacatatatttctcaaaaggtcttattaccatagattggtgctgttaggcttaggtatccatggctcctcaactcatagtctctcaatactatgataatgtcaactgaagaatgatgaggttcataaatttggaaagaaaatctttatttccataagggattgcagcctgcagagtggctgttgtgacaggctgggaaggctaacctccaatcagaagccagaaacaaatacttaaagggtcggaagaataagacatggatttgtgctgaatgaagtggccaaatatacatattcagtaagctataggaggaggcatgaatatttatgaaagaagaaatatgtgtatgtacaactgagctttatgcctctccatgggatccatgttcaaaaaatggcagtgttggcatatgagggtggagtttttggccctctgacattaaaagatgaagtagaggacacaaaaaccctcactgtgcatcctccgtagactgtccagaaccatcccatagctggcagtctattattaggaagaagtgctggtctgttgttttgttaaaacctcaaaaagagggagcaatatcaggtacttggttaaaactagcagtgcagcaagtctcttgaaaggtttggtttctgtttaatccttagagaagaaagcctattggtggttagtgagggagtgaaggattataataaggaatgacgccttcccattgagtcatggccagaaactcaggttccaaggtttctttggggatcccttggccaataggagaggtcattcaattgaattatgggcttttttatttttatttctcagtagaatggatcaggcagtaatcattgtggaaaatgtagaaactatgtcaaactaaatgtttaagtactactactattaagtaataatatcaaggtcttaaatcatgtgcttaccgtgttcaaagcactaacattttattctcaaaacaaacatatgggataaacttaacatctcaaatttaagggttagtaaactgaagcttaaagaggttaaggaggttgttcaatttacaccattaggacatgatggaaccagtggtacatgtgccaccaatatctgtctttaactcttatgtgatcctgacacaaatatgtttgtttacagattcaccacattgacacatacactttcattgtgaatggaacaagaggaaatagaattaagacatcacagactgtttcatagaatcactatttaaaaaaaaaattctgtagcgttacagctttccaagacaatcagtcattcttaaccaagagtcacatggctgcaccagtaacacttcatatcttgagtcctagaatgcaattcttatccaaaggatgacataagaaatcagaatggaatttctattctcagtcacatccattggcctatgaattgaaaatttcattttcagaaggtaattatattctcttctcaggatttatctttgaggacagtgtatacttcttaatttattttagtacagactctcatttctaatcagtaatgctaatttggagagaaaagaaggttttctttgcaagcatggggattttgatagaaacgtcatacttttttaaactttcctagacaatttcagcttttgtttttttctctgaagcagatggtattgagtgaaaagttctataatgcattcatcattacccattcactgctcattgagatgagagagtgatgtacttcatcagaggaaagtactctactgtctaacttacactaccactttcaggagaaacagttaacttcctagaagaggtggttaaccatatatgggtgaacatatgtgtgcctataattttctccttttaaaataactttcagacaattgtggacctttatttcatgacattaatgtacttttacatcattgactaacaaagaatgtaatttacaatttttatgtgaatgagaactctagtccatcaatgcaattacaatgcatcaattatccttcctgaatgttaagtacatctcgcaaaaaatagtatttttacttttactctgtataaatgaaaaattttgaaacagtccaaaatatgtcagtattcatttgcattaaaataagaggatacagtgtaggcaactagaaaatatttccgataaaaatattctagtgactttaaagctgaattgcagggattttaagaaaagaaaaataataatttgttgtgtttataactacaacaagagatatgtttaacctatttagttacttcactaaatagcaatcatgcaaataagaattcgaggacacaatttagactgaatatatgttttaactaccaggtgaactggcacaagttgtgaataccacaaataaaatattggcattctataattcttttaaattaatagaaaaatacattttatctttgaagatttatattatttggaaataaaatatttatagttatttttcactttgtataattggaaaaattgccttaatatgtgcttattatatgagagtgaacactttttatttctcactgtgctgtactgaaagtcaaagatttgctattgtgtgtatatatgtgtgtgtgtttgtgtgtctgtattttcttaggtcaaattattaatatttagtgtgcaaaaattcctggatatagaaagcagcagaatgattatcagatcctggaaagggtagtggcgtgattgaggaagtgggaatggttaatgagtacacaaaaatagaaagaatgagtaagacctactaattgatagaacaatagggtgactatagtcaataataactgtacattttgaaaaaaactaaaagagtgtaattggattatttgtatcacaaaggataaatgcttgagaggatggataccccattctccatgatgtaattatttcacattgcatgcctgtatcaaaacatctcatgtaccccataaatatattacacctcctacatactcacaaaatttaaaaatgaaaattgaaataaaaattctacatatccaattcaaaagagaaacaatggaaggcacatgtttataaaaaaaaaatctcggattgagaatggaaattagaaagtgattcccaaataactagagaagtggagttaaaatattcctaacacaaagaaatgataaatgtttgaggtgacttttaccccattaccctaatttgatcatttcccgttctatgcttttatcaaagtataacatgtacctgataaatgtgtgcaattattatatgcacataaaaataaagaataaaaaaggattacccctttttaaaaaagttaaatgtataatatttctctttgagtacattaaaacaagtgcttttatttattctgataattgaatatgtgttaaatatgaataaaagttgtacgttatttattgtgttttcaggatccaagccactttggtggcattttttttttagtttaacattatctcataattataactttcatataccggacaattacttcattgcatgtaaatatacctcattgattttaacaatgacagaggtgggtggatgactgtcagagttgtttttcttaagctattgtggtcctcccctgaatgatgctgtaacatgcattatgctttgaataaatgccatctgtaaacaaatgagtgatttgttaaaagaaaggtagcaataaatgaaaattccggcagaagttaatgaatattgttagttgaactgtacaatgcaagtaaatattagtttttacattttatatgagtagacatttgcaaagtgtcaatcactttcttttcatgtatatttttttcacatacagtgctaatgacctagcaagcctatagctgctaaatcagtactatttttttttatttctgttttttataaacgcagtcagtattagaacaaaagctacatactctgtcttggtcacagttgacatggaagccaaatatgtctgtaattgaattatgaatcttctataataaccttcaaacaaatctttttattacttacaatagtgaaatagaaagtttttctaattttatttcataaaagacacttagagactactcaataaggatttgaagagtgtctttcaatgttcagggagtcctaatacacatgtaatttttgttaaactatatttctgctccttgctcactctaaaggtaaaaatgactggtggaaaagattgtgaaactgttataggctatgaatattgcagaggcttagctagttgcctaatgtgtttaattagtattgaacaactgcaaaatcactttggtttatagccatggtcacacacttttgttttcttcttttcttccattttttttttttttttttgcccctttcctctcttatgcaaaagcctgctctgatttcacaaactagaaggttaaggctcgcatagccgactcctagcagattggtttaatacataagaagtattcagtttgctcatttttagtgtaggcctttaacctaagtagataaagcattttatattttcaatatgacgttaaataacatttgactaatctttcactgatatatattggtgtatacctaaactactaatcaccatcagatttccatcatgcttccattgccccaagctaggtctcttctctatctactagttattctatttttttagttattcaaatttaacatccttactattactagtagtttctactagtttagcaatgtggaataattactattcagttttgttgcttactgagacataactgtcaaataaagcaaatttttttattatctgtaacagcaggtaatcataaaatataaacggccaggtaatcacaaaagtatgcatgcatttcaaatgtatcatgcagtcttcttcctggaggcaacagcagatattcttgactttttttcctagatagcattttagtgagagttttgctatgatttactttgccaggaggaaaaatgttattacaaataaatgtcatatatactaaatgctttgtattgccccttttcattatctcccaccttggacctttcaaagaactagattttgatttcatattgttttcattatttttctgttttaaattttattgatttatgtttttgttttagatagacatggtcttgctcagtcactcaggctggagtgtagtggtacgatcatagtttactgtgacctcaaactcctgggctcaagtggtctttttcctcagcctctcgtgtagctaggactaaacacacacaccactatgcctggttaatgacttatttttcttcttcttctttttgcttgctttgattgtatttgctgttcttcaagtttcttaaggtgaaaatttagaacatggaatggagaactgtcttcttttctagtttgtagtatttaatgtaatgttccctctaaccagtgctttcgttgcatcttacaaattgtgatatgctttattttgttttcattcaactgtgatttccttttggcctatgtactgtgtagaaatgtttgttttctctctccagttgtattgggttttttttttcatgtatttcaaagctctgttttaaggtgtatatatatgtaggattgttaattcttcttggtaaattgatccttttataattataaaatttcactccatatccgtgtttatattccttgttctgatgtctacttctgatattaatatagtcatttcaacttttttgctcttggtttgcatggtatatctttttccatcttttagcttttttgtatgtctgttttctgtttttttgttctttttttttttttttttttgtctttttttttcttagagacaaggtcttgttacgttgccccagctggctcaaactccagggttcaagagattctcctacctcagcttcccaaatagctgggactgcaggtgtgcactgctgcacctggctagctatcttaacttttatcctacctaggtctttctagctaaagcagcttttttgttcacggatatagttgggctttgtttttttttgtttcattttgtttttttaatccaacctgaaaatcttaaaatacatgtgctataactatttattttcatgtatttattgatgttattggatttaattctaccattttaataggtgtttcctatttgtcccttcccttttctgtttctctctcccctccctccaccctttttttttttttttttttttaagatgattctcgctttgtcgcccaggctggagtgcagtggcaccatctcagctcactgcaacctctgcctcccaggttcaagcaattctcctgcctcagcctcctgagtagctgggactacaggcgcgcgccaccatacccagctaattttttgtatttttagtagagacggggtttcaccgtgttagccaggatggtctcgaactcctgacctcgtgatccgcctgcctcggcctcccaaaatgctgggattacaggcgtgagccaccacgcccagcctctctctcccccttttcttttgaattccttggatttgtttttcatattccactttaatatatctgttgacctctgactatgtctcctgtattatttcttagtgcttgcgctaggcctgataatatacatacctaacctttcacagtttactcagagttatattttactaccacagtaaaaatgtggaagttttaccatggagtttatcttttcccacaaacctttttgttatagttgtcatatgggttacaactatgtactgattgcaatgatcatacataatttaaagaatttaagaaaagaaaatttagttttatattacccattttttattattcatctttctcttactttattcctgaaattttttcctacaggccttcaaattaactttttattagttacaacaatgaaattgaatatttaattttttctcttaagaacgagatttaataaattcaacttcatgtaattttccttcagcctgagatcttttggcagtgagttctgtgagtttcccttcatctacgaatgcctttctttatccttcatcccaaggagggtttttaatggatatttaatggatataaagttttacattaggagttagttgctttctttcatcattttaagataccatctcactattttctggccttcatggcttttaatgagagaacattggtaattcaaattattgttccattaattataatgaattatttttctctagctacttaacattttctttctctattgttagaagcttgattgtggtgtatctgggcattgatttctttcagtttatcatggttgggggttgctgagctaatgaatatgtaattttgtttctcatcaaatctggaagtttttggtcctaatttcttcacatttttttttatggagcaatcactttttcttcttcctgagacgtcaaagacatttattttaaaacttttgagattttcccactgtttcctgaagctcttctccgtcttttttcaatctttcttctctctctgttcttcagattggataattgttattggtctgtcttcaagttcattgactcttgcctctgtcatctccgttctgctctcaatcacatgatcatattatgtgaatagtttatttatctgtgttttgttttttaacttttaagttcaggggcacatgttatacaggtatattgcatgccatggggccttggtatacagattattttgtcacccaagtaaaagcatagtatccaataggtagtttttctttgtgtccatatgtactcagtttagctcccacttatagtgagaacatgtggtatttggttttctgtttctgtgttagtttgcttaagataatggcctccagctttatttacatttctgcaaagaacatgatctcattctctttttattgctacatagtattccattgtgtataggcactacgtatttttatctggtgttccattgatgggcatttacgttggttccatgtctttgctattgtgaataatgctgcaatgaacatacacttgcatatgtctttatggcagaacgatttacattcctttaggtatatacccaaggatgagactgctgggtcaaacggtaattctactttaagttatttgagaagtccccacactgctttccacatggctgaactaatttatattccaactaacaatatgtaactcttccctcttctccacaacattgtgagtatctcattgcggttttgatttgcatttatctaatgatcagtgatgctgagcatttttcatactgtgcttgtaggtcacacgtatgtcttattttgaaaagtatttgttcatgtactttgcccactttttaatggagttgtttgttttttgcttgttaatttgtttaaattccttatagattctggatattagacctttggaattgtttattttagatattgaattttcagttctaaaatttttatttgattatcttatagtttctacttctgtgaaagaaatagaatgtctacttattagacagtgattttaagcagctcttatataccggctcagtgaaataaatgaacccatagaatttcttttttctttttttttttttttacattttatttccagaggtttttggggaacaggtagttgtcagttacatggataagtttttcagtgatgatttctgagattttggtacacacatcaccccagcagtgtacactgtaccaaatttgtagtcttttatccctcactcccctcccaccctttctcctgagtccccagggtccattgtatcattcttatgccttttcatcctcatagcttagctcccagttatgagtgagaaaatatgatatttggttttctattcctgagttacttaacttagaataatgatctccaattccatcctggttgctgcaaatgtgattatatcattcctttttatggctgaatagtattccatggtataaaacacaatttatttattcactggttgattgatgggcatttgagttggttatatatttttgaaatcgcaaattgtgttgctatgaacatgcatgtgcaagtatttttttcgtctaatgacttattttcctctgggtagatattcggtagtgggattgctggatcaagtgatatttctacttttagttttttaaggaaactgcacaatgttttccatagtggttgtactagtttacactcccaccaaccatgtaaaagtgttcccttttcaccacatccacgccaacgtctattttttttattttttattttatttatttctttatttctttattttttgagacggagtctcactctattgcccaggctggagtgcagtggcgcgatatcggctcactgcaaactctgcctcccaggttcacgccattctcctgcctcagcctcccaagtagctgggactacaggcacccgccacaaggccctgctaattatttttgtatttctagtagagacgggatttcaccatgttagccaggatggtcttgatctcctgacctcgtgatctgcccgcctcagcctcccaaagtgctgggattacaggcttgagccaccgcgcccagcctgatttttttattatggcaattcttgcaggagtaaggtggtattgcactgtagttttgatttgcatttccttgataattagtgatgttgaggcttttttcatgtttgttggccatttgtttatcttcttttgagaattgtccattcatgtacttagcccactttttgataggattgtttttgttttgttttgttttttctgttaattcctttgagttccttgtagattctggacattagtcctttgtcaggtgtatagattgcaaagattttcttccactctgagggttgtctgtttactctgctgattgtttcctttgctgtgcagaagctcttcagtttaattaaatctcacctatttatctttgtttttgttgcatttgcttttgggttctaggtcatgaagtgtttgcctaagccaatgtctagaagggtttttccaatgttatcttgcagaatttttatagtttcaggtcttagatttaagtccttgttgcatcttaagttgatttttataaaaagtgagagatgaggatccagtttcattcttctacatgtggcttgccaattatcccagtaccatttgttgaatagggtataatttcgccactttatgtttttgtttgctttgtcaaagatcagttggctgtaagtatttgggtttatttctgggttgtctattctgttccatttgtctatgtgcctatttttatacctgtaccatgctgttttggtgattatggccttatagtataaagtcaggtaatatgatgcctccagatttgtactttttgcttagacttgctttggctatgcgggctcttttttgttttcatgtatgaactgggggatttttttttctagttctgtgaagaatgagggtggaatctgatgggagttgtattgaatttgtagattgcttttggcagcatggtacctttcacaatattgattctatccattcataagtgtagaatttgcttgtgttgtctgtgatttctctcagcaggaacacagaatttctattggcaaatgtttttttttttttttttcccttgagaatctctcatattttcctgagtgtttttatgttaaatgttatatagtatagcctctgggttctattttaatcatctggataatgctgatttttttctttatttgtttaaccagcagttgttctagtatctgttaaatttttaaaggctttcctatgatgtctagattaatccagtacatgcatgattcaggggataatctgaagttaaggttttaggttatatcatagttcaggtttcaaaaccccttactctcctgctttgggtctctctctggctcgtgcagttcgtaggggaacctgggatttgtgtgggttcacatagaattatggagtccctttagttaacatttctgtttctaggactgctgctacattctctgactcttttctggttcctctatgcattttcaactgaagttctagctgtcagctctatacctctgttgagctttgcaaagggagcttacattatggacaaatctgtgagacaaagggaaaaatgtatgaggaaactcctccctgaatgtgttgcttctctatgttttgactctttttctaaacctgccttccttttgtttacctttcagagtcctcgggtagttgccttttgtatattttccagagattttagttataacaagtggtatatatgggctatactgggcttactacattttggacagaactgcaaccctccaaacatgaggtgcagctcagctgatgcttatgtttatgagcacagaggaggtttctctgggcttgagacccaaacctttgagaagcagatgctggctaactggtagtggtatctgtgagggaagtgtaatctggctggttctagaagtgttggaaaaactgcaaactgatttcagcagtggctcctgggacaaactgtcattatcagcataaaaaaagagtctgagatcactcttataggaagattttgagcaaagaagtggcatgatctaatgtatgttttaagatggacaacttgattgctattgggaaaacaataaatgggactggagcaaaaagaaggagactacttagaaagcttttgaaataatgtaggtgaattacagtttatacaaggatcatagcagtagatgtggcagatatttgtcagattatagatgtgttttgaagatacagccaacaaagttccctaatatattgtatgtgtgatatgtgtgtatccttctttaataataatgaaggaatcaaaggtgactccattttttttcacctaagaaaatagaagtttgcatttttcaaattagagacggtgaagacttgggaagaagaaagtttggagtttagaagaaaaggttgcaggggaagattgggtttgttgtgcctttttctcatgtaaatagaagcgttatgtagacatttagatatacagggctgtattttaggagagatgtgttggcttggaataaagagtatacaaatggggttttaaaccataagaagggatgagatcacttagggtacgagtatagatggagaagatgaaaagtctgggtactgatcctaagatatttcaacttttagaaatagaggaggtaagaagaaatcagctaagtagactgagaagaggttagtatgatgtaagtgaaaaactaaaccaatggcagatcagaagtcacatgagaagctatttcaagaaaggagaagcatgatcaacaatgtcaaatgtagagtctagaaaatgagatctgtgaagtaaaattagatctgacaaataactatttgattttagcaccacagagggttatttgtgaccttgataagagaattttcagtgtaatattggaagtgaaagtctggatctagtaggttcaagatggaaaggggagcagagaaattgtatgagttcaaggaaatatttttcggcgaacaaacatagatttcatttggattaaaaatgttattaatatgctggttctttcagccactgtatttttttgttactattaagctattagacaatcaatagatacctattaacctcaaagtataatagaattgaccaaaatgttctgctcttaataaatagagcgtaaatagtatttatagagctaaggacatttcagtagttctagacttcaggcattgctgcaagcaatttgaaacattactgtcctgtctttaaaaaacaatgcaaggtagagaaagagagcaaccagagttgactaagaaatgcattttcttcaatgtcatgaatattgtaataacaatttgtcctgcattatttttggactacatttttaggactgatatgtgtgtttcaaattaaggaaaaatttgcatcaaactatgttttcatttagatgacaaaaacaaagataatgaataatataaaggcacaattttaacaatataataactaatatcaatgcttattgttgcataaaataatactattttaggaaattattaaaataaaacatttatattcatgaatttgaaaatatgatgaaatggcaaaaacagggtattgcatatttttaacaagccctttaaaaataatatggtatctcataatctaagctgaaaatactagaggaaatagtataattttattcaaaagcgaccttggagttgattttatccaatgttcttcctttataaacatagcaatttagatgcaaagtatataatgacctgcccaaggtagcctaactaatttggacaatgtttggtattctgtggtgttcagtactattgccactttactattgagaattatgttagagaagcaattgaaacatatgcagaaaacgttgcattatcttctttcctctatcctccccttcactccctgcctttctcctttccttctttcccttcttttctccttcctccagtttcagctttataaaaaaattttcctcttcttaaagaaaggaaaacttaagtgttagtgaagtgggagaaagttgaaaaaggagaattattttagtagcttcccctataattatttaccttcatgcctatgcacatgcacacacatacctaaaaccatttggaagacataatcctaaaagcattaagtttccaaattttttctagtttaaaaaataacctctaatattgtatcctgggacagaaagcaataacagtaaccatgctttactaaataaatcaagatttatttaatgaacttcagattaatcatgttccgaggtttcacttttctgtgggctattgaccaatatagcaaaaatttagtgtcatatgagtgcagacaggcacagttttaaattctatttttcatagttactagttttttaaagtttgcaaatgatttaacacctctgatccttagtttgctaatctaaaatataagggtgataataatgcttattttgtaaagtaattgatagctgtacatggtacacctggtatagtataacttctcataaccgttaattattttattgccattattgctattagtaccagtaataacactcttccaatggaaaatatttttctgaaaactcataaatataataatattcattgtttcagaaattagctaaaagtaggacctatgaagtattatggtgcttgttaacataacatgtagttagtgaaatcaccaataaatgaagacatgacatataatctaaattatattatatttgcatagtctaaattatattatattatgtatggcatatgtccatactccatcctaagaaatccaattcttttaataattgtaatagaattgattgagcttgctattagagtgtttaactgtactcttgaaatgggttttactaaaagagatatggaaaaatttatttatgagcttcaaatgagcatctaatctactaatgtcattgtaatttctcatacaagtgtacaaatgatagcgcagcatctctttcaggtgttatattcagaatcataataaaactcttgcagaatatatgtgtgcatcaaaatgaaatgacaatgaattttcttttgaaattgatagcacgtattagcataaattgaactgtgcaactgtgtccataacaggctgagtgatgtagcagttgattgctttgtacacattcttgtgttttgccttccgttttccttgctgtgtgttattctctcttccgtcccaccaaggtaagagtaaatttttcccttcctggctttattgcttgaagataatagagtaaggcaggagcatgtgcaaggcaaaagtacctcttgtcatcattgcccttttccggtgtccctctttatttccttctgtgtctttgatattccaggcaaaactcttttataacacttcatgccatggccccttccagctacagataggacaggtggttgaatggctagcactccatgagctttattcatgtatatttataaaagtgcaatttctttttctttctttctttctttctttctttctttctttctttctttctttctttctttctttctttctttctttctatattatagcaaactcttgtacatttacttacttattttctttcagtgatcatgctagtatggttgtactatctgaaaatctagccttttagcttcctagatgatatacttaatatgactaaataaatccagcctgtaccacaactgtcaaaacacctggaaatttataatttcaccatctcttcagaggaagagagcttttgtgacaaatatggtagggtgaatacggagcagataaacccacatactctgactttcaataaagcaagagggggtaacacttcatagagaccagataccactctatcaaggttactgaatggactatgtcctgtaccagatgtgatgccttaatgtgaccaaatccattctagatgcctcaaagctggtttttttggacctgcatttttttgtgaaaaataaaatgctaacttatagggaaaatgataactaattttcttggcagtggtcaataactggagctagcataaatagccattggatttatttaggagaagttaactcagaatataagtggctttccccttctacctgtatcataaagcctaccttgaccaatgagaaatccaacagtatttgaaaataaactcctgagaacatagaacgcaaactaagataagcaaattacagttgttatgctctcaattggcctataaaaataaacagtttgagaaatctgtgtctcctacagaaccacactgaccagatagcacagatgagacagctagcaccctgatcattaatgtcacaggtaattttgttgttggttactagtatctgccatacatacccttcaggaattaaatgggccatatttgaaagccaaggtcaaggagtgaaattttaaaataataatccacccccagctaacgaaaagctaggacaggtagtgttttcattgcttttgtattcaggcccttctcgtagtatgctgtgccttatgaggggaagagagacccttgattttcaaggagggtgagtgggtgggagtgctcctatgagggatgtatatcatgacaaataatgggctcttaaaaattacacctccttactaccctgattctctgaagcccatagcggtgccatgcataaccttgttgagaattgctgcctagtgagcctcactgacaggtaatagtaacgcattcaggtttgttgataaggagaaaaggtttagaagtaattgataacttttcttccaatacaagttttcttaaaacttctagtatgttgttaaacaacagaaaaataagcgctctgagtcttgggagattctgtctgtgtacaagcatgaactatgctccatatgagaacatgagccttgtcatctgctttaaatgtcacttgagaacagttatcaatgactactttcccagagttaaaattaataaacttgagcttattgtattgcaagcttctttaggatttcacccactgtgaaaatatcctttaaataacattttaccaaacttcaggccttcttgtaaaattttgtgacagttcatcttaatatgcatactatttctgttctgattccatttttgaacttttgtactctatttttatctgtaggatggagataatgctagataaaattcagaacaaaagtatttaatttgaaaaataactgttaagaattaatactatgcaatttcccatggcaattgattacgtgtttgttcagaagtttggcacagttgcttgattaaaatattaattttccaatttcaattgagcagtttatgaattttactttatagtgtttactttctctgataatgtcaatgtttttcactaattatgtccaagggtgagctaccttggccaatagaacaacttggtttcaggtaatttgttcttttcagtggttgtaaatgtattggctatgtggttgaactttgaccatttctctgacaataatttgcaacctccatgagatcagtcataaatccatagtcaattatgtgttagaaaatatattaaaaagcctcagaggaacaaaattatgtcatttctgttgtggaagattggtttaaaataggtcttacaaatattatgaaaatacaacttactgtaatcatactgcagtttgtcatatgtggttcattgttatgaggcagtaaggtgatggcagagggagcactatatatagcaaataaataaaaataaatcaggtttacaaccctgtttgcaaccatctgtaatgcatggtagcatatgttttatagttttattgagagaatacatcttttaattctcaaaactttgagtttgaaagctcatctctgatagaaactaatggttgaattacaagctaaagtgaatttcattttacttattcttctaatcagtttacaaagtgcagctttacatgcaggaggcattcttccttttctttttttaaaggatgaaatgtaaaagaaagcttacctcaactttactatacaatattgtctcttggaaatgaaaagtgcaggatttctaacagtttccttcaagttgtaattgaaaacagtaaattgtctccatattttctttaatacctgtaagtctccatacgtgtgaagaaaatgaattgatattttgtgtggtagtagtaatacatttatgaaatttatttgtagacaggaactttccattgaagatatctgactcttttcatagttgtattttgaaaaggggtatttttttccctagatgataatgctgtgtttgaattaacactattatacaaaggaagtgtgaaggacttacaaaattgcactggagtttaagacttaaaatagaactcaatttttgtttttgacaagtttactcacacgtataaggaggtaaggggaaaaatgtagttacaagtaatcaaagcatttgaaaatgtgcagaaactaaagctattattttggagtgggtggggagggagaaatgggagtatttctattattctatatcatgtctaagatacctattaatttaaacctcagtaatcttaatcagattatcttcacatgagatgagaataaattctctacctgaaattctccaccttacaatataggatcaaggcaagaatttcggaagctacatattgctaaaaaactgaattatctctctgtgtatcatccatatagaaattaatgagcttatatctagaagctcatcttttttttactcctctgacaacttagacaaggttaaaatcttaaacaaattttaaattccctttaaagaaacactataaaggaaatactacttctaacttggcaattaaattttcattaacctagtaatttttacatattttagtataaaggacaaaatgatctgacaatacatttacttaacatttgattgcctcagaaacgcaccacccaagaaatatgaataaaaggattcctcaaacagtaataatgaattgaccattttatcgtagttaatgatccttttgcatttttattaccagtattgtccttgttattttcttttttcttcctttgtagccttcatttcatggtcttttaaaattgcattgtcatttaaaactttttaaatgattccaaataatatggcaccattctcttaaagtttctaatgattagtaatttctacaaccatctgtatatttatactggtagctttcaacagaaataccatttagattagattaaaagatttcataaattaggttatgcacatctaattttactttataaaatatatttaaagatagctttgcattttaaagttttattctccagcgtatgatattacaagatatgagtgacatcaaaaccacctcttcaaaattgaaaaatttcatcctgtggattaataaatgttatgtggctcaaaatgccttctttatttggctgcatttcccatggtaggtagttcagagtttcatatcaagtaggagttgagtaaatacttgtagtgtatgtatggaaaatagttgctaaataaattctaccagaaaataactgtgatttccatgggcactctgttaaaaagggggagggagggtagatatttatttgttcatatatatgatagctaaataaagttaaaatatatttttgacaaaaataaccactcagtatattgatagcatcattacaattgtttttttactactggctatgaagttttataattagagctctgaatcattaacaaaatccacaggaaaacctagtgaacaaactttcataggttttcaaaatttatattttttatttttatgttttaaatcaattaaaacttatttgtgagctcaatcatcttcaatacaattttagttgagatatagaaagtcatgttgtattactccaaagcatactgtaaatccattaatataaatctggacttggctaatgtagtttagtttaacaaggaatagacaataaatgaactaccttagtttctgcaatagaaagtggtggaggggggattcatagtggtgttttttgttgtttgttttgctttttgtgtctttgtttttaaagagctattattgtaattgctactagggactataagtcaacaataaacttattcaaaaaaagttttataaataatttgctgttttaaagcttcagtatcttgttcctgcatcgagcctgacccagcaaataaatatagtgaggaaatgaatagttagcatataaataattcctattatttgcagtgatagtaatattaaacagtgttcaaccttctttcctggttgctccaacattttggaaacatattcttgtggcctacactcacagtgtggatcactcaccctttaggattattaacagaaagtcttatgaacatatgaaggagatgaaaggcagctggaagaggtcccatatgctctattcctttctcttagattttatgctctgagaacatctgtgtgaagagtaaagttgacatggtgttgccaaaatgtcagtgttatgggacttgtaattgattacaaaaatgacccttagtgtagaatagtgtaaaaaacatgaggttggaatcagtcctgaaagtgaatcctgattttcttataaaacggatataacagagggtagatgtgcaggacaaatgatataatgtatgtaaagctccttgaatagtgcttgaagtcttttacttgaacagtaatgataactattgttcttgtcttcatttttgttgatatatcaagacttacagtatggaagcaaattgacacgtgcctgtcctttcataatcaaaaagcattagtgatgtgacttgtgaagcagtgtgaaaaggttctgaacacacagtagccttcctataagcagaataccaaaagcaaactcactttgcctagagtaagctacttacttgggatccaagggggattattacaattcaaggtcaggtccattatattattttttcatcttctaagatcaaaaagcataagcacaagatccttatagatgtattttaacctaaattttatctatctatctatctatctatctatctatctatgtatctatcttcctatttaacagattttctatttgtacattcatgccatagtgtgcaaagacttttgccatttacccatatgctgtttaacacttggtttaacaaaaagaagcttaatgaaaagaacacaaatgaactatctttcataactatcaaacatatttttcactaatcttagtaagattctataattacatgatactacttttttcattgacatagcttaagagaagaaaagacaaaatgtaagtatcagtctctggcagactatgttaaatatgtttactcataatgaattaaatttatagggtaaagaagaagagtgaatttttaaaaacgtatattcacttaatgaatacctgaagtaatgatgtacagccacactcaaaatttaaattttcttttctttttaagagacaaggacttgactggtcacctaggtcggagtgcagtaacatgatcatagctcacagtaccctccaactcctgggcttaagaggtccttctgccacagcctctcaagtagctaatttttttttatcattattattctttgtagagacagatgtattagtccgttttcatgcccctgaaaaagacatacctgagactggggaatttataaagaaagagaagtttaatggactcacagttccacatggctggggagacctcacaatcatggcagaaaacatccagaaaagaagtctatcgactcaatctacactgaagttaaaggaacacccacacacacaaatgaggaagaaccaacacaagaaccctggtaactcaaatggccagtgtcatatgtccatgaatgactgcatcagttctctaagaagggttcttaaccaagcttagctggctgaagtgacagacatagaattgagaatatggataagaacaaagatcacggagattcaggagaatggcaaaaccaaatccaggaaaactaagaatcataataaaatgatacaggagttgaaagccgaaatagtggaataacagcagaatagaccaacatgaggaaataatctcaaatcttgaagactggctctccaaaataagacaattagacaaaattaagaaaaaaaagaataaaaaggaatggacaaaatctctgagaaatatgggcatatgtaaagaggccaaatctactaatcattgacatccctgaaaggtatggggagaaagcaaacaactttgaaaacatatttcaggctatcattcataaaaatttccccaatattgctagagaggccaacagtcaaattcaggaaatacagagaacccctaaaaaatcagacacaagaagatcatccccaagaaacataatcatcaaaatttctgaggtcaaaataaaagaaagaatggcagctagagagaaggggcagatcatctacaaagagaatcctttctggctaacaccagacttctcagctgaaatcctgcaagccagaagagattgggggcctatattcaacattcgtaaacaaacaaacaaacaaattcaaccaacattttcatatgcagccaaactaagcttcctaagggaaggagaaataaggtccttttaagataagcaaatgttgagggagttcattaccaccagacttgtcttataagagatcttgaaggagcactaaatatagaaaggaaagactgctaccagcctatataaaaacacactcaaatacacagaccagtgacactataaaacaatcacacaaacaagccagcataataaccagctaataacacaattacaggaccaaacgcacacatatcaataccaacattgaatgtaaattggctaaatatcccacttaaaaggcactgagtgacaagctcctgcatagcaaaagaaactgtcaacagagtaaacagacaacccacagagtaaattattttttgcaaactatgcattcaacaaagggctaatatccagcatctataaggaacttaaacgaatttataagaaaaaaacaaacaaccccatgaaaaagtgggcaaagggcatgaacagacacttttctaaaaaagacatacatgtggccagcaggcatatgaaaaaaatctcaatatcattaatcattagagaaatgcaaatcaaaaccgcaatgagataccatgtcacaccagtcaaaatggcttttattaaaaagtcaaaaaataacagatgctggtgaggttatggaaaaaaagggaacatttatacactgttaatgaaagtataaattagttcaaccattatggaaagcagtatgaaattcctcaaagatttaaagacagaactactatttaactcagcaatcccattactgggtgtatacccagaggaataaaaatcattctaacatagaggaacacgcacacaaatgttcactgcagcactattcacaatagtaaagacatggaatcaagctaaatgcccatcaatggcagattggataaagaaaacctggcacacatgaaatattatgcagtcatacaaataatgagatcatgtcctttgtgggcacatggataaagctggaggccattatccttagcaaactaatgcaggtacagaaaaccaaatacaacatattctcacttataaatgggaactaactgatgagaactcatgaacaaagaaagaaacaacagacaaagggggcctccttgagggtggagttttggaggaaggagaggagcagaaataataactattgagtactaggtttagtacctgggcaacaaaataatctgtacagcaaacttccatgacacgaatttacctatataacaaacctgcacatgtattccaacctaaaataaaaggttgaaaaaaaaaaaaaagaatgtaatttgattgtttgtaacacaaaggatagataaatgattgaggggatggatacccgtttctccacgatgtgattattatatgttgcatgcctgtatcaaaacatctcatgtatcccataaatatatacacctactctgtacgcacaaaaatttgaaaatgaaaacatgaagtggcaaggatagtagatgtgcatatgtgtgtatggtttgtattaaggctgaagtttaacatgcagaacaggaattagtttaaccactcaaaataggaagtcaggattctgtttatagttctaactaaagataaccaaataatgattttagtaaaattttatgtcttttctagagatgttggtaaaattttatagtctgagcttcagtggatctctactaagataaacaagatatttaaaatgtaattttgaaaagccagatactgataatgaaggataaattaccttacttaaatacataattgaccttataacagaaaaacaaatatgactataatttttaaattgtccatatgtccccttccttctctctttaaacttagcatctgctcattaattaatttcactcacttctattaagtgtatcatgtgctctggcactgtactattattgcttttgagtcttaagtaagcagaagaaaagctttcttacatggaatggcccactgttttacatggaaacagaagtcctgcaacaggtgcagaacttttcctagctgctgtctagtatatatttctcccttaaggtattcttgtaagggaaaaagataattgataattagtctgaatgaacccaagggtggaaaaggaccctgctttaagccctaatatgactaaaccttgcagagaaaataatgaaaaagatttaaaaaatacagctataggtaacaagacagatgacagcatgatttaattgtattgaaaacaataagggacctactgctaagtaatgcacctactgctaagtaacgcatcgaaaattgggtgctgccaaaaatggccagttgtgtgctttgaacttaatctgataggtagtaagacatacgtaagcgaacacaatattttagagtctatagaaatttgatgttgtaagtaaattgagagtcatatattccatcttcaactcagtcaagcacccttgcctacacattgtcctttccttaattctactctaatgacaaaagtaccagacaacatgtatcctgaatgatgtcttttattgttttaaaaattgcatgtatattgcataaacacgtattttagtaaacataagacacacaatatgattttaaaaactccctcggtgctgttgctttcactcaaagcagttattattaagggaattgattattttgttgaatttaatttaaaatgttaattatgtatcatttattggggttgacaaagttcaggatattctactccaaaatatgataccttgtcatactgaatattttcagctgaagtaatttgagaaaacagcagaagcaggaaggtcagtctcaactcctccccacctctccttgttacttgaagcatgccataaaacctaggaaggattttctgactgttccctgaagcaggtcataagacactcaatagaaaggtacccttcttatacccagaagaaaagaatatttttatatctgaagatgaagggtcacagagaaggagttgaaccagcaggtcttgctaagtttccttcagtcaccattggatctaccccactttgtccatttatttctccataattattcactcttcatcaaacataagcataaaaatacacaagtttacctgtttttatgggtcttcatttccttattacagtccccatgtcatatgaaagttgtactgaacagatttgtatgctttttccttgttagtcttttgctatagtgcctaagacatgagattaatatgggtgagaaaaagatatttctcctcctctccacagtaaacttgatatacttggacttacttggacgtatatgtcatgacaccagaagtagacatgaatagaatttttaatacttttgtattagaaaaatgcacaggagacatctggaatttcaacaaatatcagactatgcataaatatgtaacccagaattcatttgggtttcctaggtgttattgtcaattaatggcatttatgtaattaaactgagtttatgaactgtcataagaaagaagtagtaaagaagtgtctttagggtcatacctctgaaggtaagaacaccaagtgggctacaataataacaattaagcttatatattatcctagcaattactttggattgtgtttatctctgttatactgaaatggaagccaaagcttaaaaggaaaacaaaatgtgacctgaatttggaggaatatggacagaccttagatggaatcagagccataggatcttcctccatgtaatgaatgaccaaaccatgcagctattctggatggctgtggatcaagtcagcttgcatatagtactaaaaccattataattttgaaaaatatatctaggaaagtatgaaaaagtgattgagtttataaatcaaaacttgctaaaagatttttctatgtataaagacataaactatttaaataatcactgcttgacttattttaaacatttttatgaacttcttgagagttcaggtttaggtacacaaacagatatcaacttcaaaatttcagctctttctctcccctcctcctccattcttttcctctcccttccttccttcctactatcctttcttctgcttgcatctacttatgcattggagacagtctaagcaaaatgattcccaacaaaacattacacttaaacaatctttggaagactaaagattttttaaaaacaataaaccacaagatgttatgaattatcggaaattacataggagaatggagtacaaacagttacatttcagagccgtttttacttgataattatacttaatgacaatgttttgatagctagttttttaaaaaaacaattttattctcttttattatggagtgtgaacatgcttttcctcttggtattctccagtgtcagccttgtttttagtgctgaataatgtcaaagattaaattttctttttagaaaccatttttttccaataatttattctaatttacaagatcttgaatggtttttttagaagttttattttagattcagggagtacatgtgcagtatgttacctgggtatattgcatgatgtttggggtacaaatgacccaggtcctgaacatggtactgaatagtttttcaacttttgcatccctccctccctccccactctggtagtcctcagtgtctgttgttgccatatgtatgttcatgagtgcccaatgtttagctctcacttacaagtaagaacatgtggtgatattctttggctgtgtctccacacaaatctcatctcgaatacccatgcattgtgggaggacctggtgggaggtaattgaatcatgggggcaggaccttcccatgctgtgctcctgatagtgggtaagtctcatgagatctgatggttttaaaaagaggagttcccctgcacaagctctctctgcctgctgccatccacgtaagatgtgacttgcccctccttgccttctgccatgattgtgaggcctctccagccatgtggagctgttaagtccagtaagcttctttcttctgtaaattgcccagtctcaggtatgtctttatcagcagtgtgaaaacagactaatacagtaaattggtaccagtagagtggggtgctgctgaaaagatacccaaaaatgtggaagcaactttggaactggttgacaggcagaggttggaacagtttggagggctcagaagaagacaggaaaatgtgggaaagtttggaactccctagagacttgttgaatggctttgactaaaatgctgatagtaatatgcacaatgaagtccaggctgaggtggtcttagatagagataagaaacttgttgggaactggagaaaagttgactcgttatcttttagcaaagagatggatggcacttttcccctgctctagggatttgtggtactttgaactttagagagatgacttagggtatctggtggaagaaatttctaagcagcaaagcattcaggatgtgacttgggtgctgttaaagacattcagttttataaggaaagcagagcataagagttctgaaaatttgcagtctgacaatttgatagaaaagaaattcccattttctgaggagaaattcagccagctgcagaaatttgcataattaactaggagccaaatgttaatcaccaagacaatggggaaaatatctccagggcacaccaggaggctttatggcagcccctcctatcacatagcctcctcctggaggcctatgagggaaaaatggtttcatgggccaggcccagggttcccatgctgagtgttgcctagggacttggtgccctgtgtcccagctgcttcagtcatggctgaaaggggccaaggtagaggttgggccatggcttcagagggtgcaatccccaagccttggtagctttcacttgttgttgagtctgtgggtacacagaagtcagtaagtgaggtttggaaacctctgccttagacttcagaagatgtatggaaatgcctggatgtccaggcagaagtttgctgcaggagcagcaccctcatgaagaacctctgctaaagcagtgtggtagggaaatgtggggtcggcacccacacacagagtccctactagggcatcatctagtggaactgtgagaagagggttacagtccttcagaccttagaatggtagatccactgacagctttcactgtgtgcctggaaaagccacaaacactcaacaccagcccacgaaagcagttgggagggatgctgtaccctgccaagtcacaggggcagagctttccaagactatgggaactacctcttgcatcagtgtgacctggatgtgagacatggagtcaaaggatatcattttggagtcttaagatttgactgccctgctggattatggacttgcatggggcctgtagcctctttgttttggccaatgtctcccatttggaatggctgtatttactgaatgcctgttcccccattgtatctaggaagtaactaacttgcttttgattttacacactcataggcagaagggacttgcgttttcatggatgagaatttggactgtggacttttgagttaaaactttgagggactgttgggaaggcttgattgttttttaaatatgaggacatgagatttgagaggggccaggggtggaatgatatggtttggctgtgtccacacccaaatctcatcttgagtttccatgtgttgtgagggaactgggtggaaggtaattgaatcatgggggcaggcttttcccatgctgctctcatgatagtgaataagtaccacaagatctgatggttctataagggggagtttcctagcacaagctattcctttgcctgctgccatccatgtaagatgtgatgtgcaccatgattgtgaggcttccccagccatatggaaccataagtccattaaatttctttcttttgtaagttgcccagttttgagtatgtctttatcagcagtgtgaaaatggactaatacatgtgttatttgggtttatgtacttgtattattttacttagggtaatgggctccagttgcattcatttcatagcaaaggacataatttcctttcttttatggctgtgtagtattctacagtgtatacataacacacttcctttatccagttcatcactgatgggcacctaggttgattccatgtcttgttattgtgaatattgctgcaacgaacatgctgttggcatgtgtctttttggtagaaaaatttatatttctttgagtatatacccagtaatgggattgctgtgtcaaatgataattccattttacattctttgagaaatctccaagcttcttcacacagtggctgaattactttacattcccaccaccagtgtataagcattcccttttctccatagcctcaccagcatctgttgttttttgtctttttcataatagttgctctgactgttgtgagatagagatagtatcttattgtggttttgatttgcatttttctgattagtgatatggagcattttttgcaacccactggtatgagatggtatctcattttggttttgattttcattttctgatgattagtgatatggagcatttgttcatgtttgttggctacctgtatgtcttcttatgagaagtgtatgttcatgtccattgtctatttttaatggggttgttattaggtttttgcttgttgatttgtttaactttcttatagattcttgatattagtcctctgatagattcttgatattagtcctctgtcagatgcatagtttgcaaatattttctcctatgctggagtttgtgtttttcctctgctgatagtttcttttgttgtgcagaagatctttagtttaatcagttcccacttgtgaatttttgtttttgatgtaatcacttttgagaatgcagccataaattatatcccaaggccaatttccagaatggtgttttctaggttttcttctaggattcttatagttagaggttttacatttaaaccttcaacttatcttgagttaatttttgtatgtggtaaaaggtatggatctaccattattcttctgcatgtggctagccagctatcccagcatcatttataacatagggagtcctttccctattgcttaattttgttgactttgttgaagataagatggtttcatgtaggtatgcagctttatttctgggttctctatcctgtttcattagtctacatgactgttcttgtactagtatcatgctattttttttattgtagcctcatagtgtaatttaaagtcagataatgtgatgcctccagtatttttcttttagcttaacatagcttttgctattcaggctcttttttgtaccatatgaattttagaatagtttttttttctagttctgtaaaaaatgatgttggtattttgatagaaatagtgttgaatctgtaaattgctttgggcagtatggccatattaatgtattaagtcttccaatccatgagcatgaaacgtttttccatgtgtttttgtcatctctgatttctttgagcagtgttttgtagttctctttgcagagatatttcaccttggttagatgtgttcctaggtattttatgtttttggtggttattgtagatgagatgacattcttgatttgaccctcagcttgaatgtttttttgggaaggagtgtaaaaatttactgatttttgcacattgattttgtatcctgaaactttaccatagttctttatcagttccaggaactttttgacagagtctttagggttttctaaatatagaattttgtcaaccacaaacagtggtagtttgactcttttctttttttcctatttggttgtcttttgtttctttccctttcctgattgctctggctagctcttccaatactatgttgtataacagtggtgatagtaggcattcatgtcctgttgcagttctcaaagggagtgcttccagcttttgtccatttaatatgatgttggctgcatgtttgtcatagatggctcttattgttttaaggtgtgttcctttgatgcctagtctgttggattttttttttaatgatgaagggatgttgaatttaatcaaaagctttttctgcatctattgagaaaaatagtttatgacaatatggtttttgtttttaattgtgtttatgtagtaaatcacatttattgatttgtgtatgttgaatcaaccttgcaatctcatgaataatgcctattcaatcatgacaagttaactttttgatgtgctgtcagattccatttgttagtattttgttgaggattttcatgtctgtgtttatcaagaatattggcctacagtttccttttcttattgtgtctttgtcaggttttgttttcagggtgatgctggtattttagaaagagctgcagaggagctctttctccttgattttttggaatagtttcagtagaattggtaccagctcttctttgtacttctggtagaattgaactgtgaatccgtttggtccagggcttttttttttttttttctttttttctttttttttttttttttgattggtaggttttttactattgattcaattttggaacttgatgttcctctctttaggatttcaacttcttcccgattcaatcttggaagattgtatgtttccaggaatttgtcagtttcttctagatcatctagtcatctagttcatgtgcatagagttgttcttaataatcccagaggatcatgtatatttctgtgaggagatcttatattttaaaatactacaacttgcttgaaaaaaaaatgatataaatacaagttagttccaacatggattttaagagttcacatcaagaatgcatcataaattatgaggggttaaaaaactaaaagaatattttttcagaacagaccaagaaaacaattaagttgggaaaacttaatgcataagaaaagtttaaaggaatcaggagaagtctaaaaccgattttaaaactgtttttaatattgtaagtacttaatgaaactaggatatttaagatcaagtgtactttattttcactagatataggagagaatgttgaattgaattaaattataattaaaaattatgctagctctgaggaattgcttctttctagtaagatacactgctgaaaaaatatatatgggatattatagaatatcccttgaatgtgattaagagtagaattttcagcagtgtcacaaataactaaaattcagatttgtaatgaaaaagcaaactggattagaaaattatgcttttgttcctactctttgattccataataattctgaaagaacatgttagcaaatgccttcaacttaggtgaactccttaatttaacctcatattattggttttgtgtcatgtctcaatatgtcaccaaagccagcccagattttaaattcttattattacttaataacacctacatttttatcttagaaattctccttcaaggcatcacaaagcagaatttaaaaaaaagaaagaatactttctgagtatcaaccaatattttaaatgattctgtatcatgtgcagcctctttcctatatagtgtgcaaataatgtacttctttttggattaaatggactcaggagtgtactatctagaatattgtacaaaattgccttgaatatgttatatgcaatgatatggtttcactgtgtcccaacccaaatctcatcttgaatttaatgcccataattcccaaatgttgtgggaggaggaacctggtgggaggtgactgaattatggggcaggcctttcctgtgctgttcttgtgatactgaatgagtctcacaagatctgatggctttaaaaacggaagtttccctgcacaagccctctctttgcctgctgccatccctatacgatgtgacttgctcctccttgccttctaccataattgtgaggcctccccagccatgtggaactgtaagtccattaaatcctttcccgtataaattacccagtctcaggtatgtctttatgagcagcatgaaaatggattgatacagtaaattggttccaggagtagggtgctgctgaaaagatacctgaaaatgtggaggtgactttcgaactgggtaacaagcaggggttggaacagttggagggctcagaagaagataggaaaatgtgggaaagtttggaactccctagagacttgttgaatggctttgcccaaaatgctgacagcaatatgcacaataaagtccaggctgaggtggtgtcagatggaaatgaggaactggagcaaaagtgacccttgttatgtttcaacaaagagactggtagcattttgccccttctctaaagatttgtggaattttgaacttgagagagatgatttaaggtatctagcaggagaaatttctaagtggcaaagcattcaagaggtgacttgggtgctgttaaaggcattcagttttgtaaggaaaacagatataaaagttcagaaattttgcagcctgacaatttgatagaaaagaatttactattttttgaggagaaatgaaagccaattgtagaaatttgcataactaattagaagctgtatgttaatcaccaagacagtggggagaatgtcaccagggcatgtgagaggtcttcatggaagcccctcccatcacaagcccagaggtctaggatttaaaaatggctttgtgggccaggctcaggtccctgtgctgtgtgcagtctagggaattggtaactgcatcccagccactccagccacaagtaaatggggccaaggtacagctcgagtcatggcttcaaagggtgcaagctccaagccttggcagcttccatgtgatgttgggcctgtgggtgcatggaagtcaagaaatgaggtttgggaacctctgcctaggtttcaggggatttgtggaaacacctggatgtctagcagaagtttgctgcaggggcagggccctcatggagaacctctgctagggcagtgtgcaagggaaatgtgaggtcgaagcctgcacacagaatccctactggggcaccacctagtggagctgtgaaaagagggccactgtccctcagaccccagaatggtagatccactgacagcttgcactgcatgcctggaaaatctacagacactaaacaacagcctatgaaagcagctgggagggagggtgtaccctgccaagccacagaggcggagctgcccaagatcatgggaacccacttcttgcatcagcatgacccggaagtgagacatggagtcaaaggagatcattttggggctttaagatttcactgccctgctgagttttggacctccatggggcctgtagtctctttgttttgccaatctctgccatttgaaatggttgtatttacccaatgactgtactcccattgtatctaggaagtaactaatttgcctttgattttacaggctgataggcaaatggggcttgccttgtctcagatgagatgttggactgtggacttttgagttaatgctgaaatgagttaagactttgggagactgttgggaaggtatgactgtttttgaaatgttaagacatgagatttgggatgcaccaggggtggaatgatatggtttggctgtgtctccacccaaatctcatctttaattgtaactcccacaattcccatatgttgtggggggaacccagtgggaagtgactgaattatgggggtgggtctttcctgcactgttctcttggtactgaatgagtctcacaagatctgatggttttaaaaatgggattgtccctgaacaagctctttctttgcctgctgccatccatgtaagatgtgacttgctcgtccttgctttatgccatgagtgtgagccccctccaccccctgccatgtagaactgtatgttcattaaacccttttcctgtataaattacccagtctcaggtatgtcgttattagcagtgtgaaaatggactaacacacgaaatttcctctatcttttaaaatgataactaaagagactgagcatatacgccaccaagaatatgtgtgtgtggtggagaaagggtacttaattagcttaactctttacaattcaagaattttggggagtccaagttttggctaagtagtatatgtggttttgatagttttcagtaacttcttatagccgaaattttattgtttgctagctggcaaaagcattatgtttaaaaatatacagcaacagattttcatattttttcatatctttttagaatgactcacataagtagatctgttcttttgcagattactttagcgttcctcagataggcatcacttaaatgtgcggtagcagataggacttttctaaagtcctcttataatgtaatatttcattacttcgatttaccaagcttaacaagtgtttgacacccttcagctactaaattgattcagaaaagatagaacagcataggcatgctctgatttttttgctctttcttgatggattacaattattaacctacaggtggagtctagatctttatttttagagaaaaatctcaacaaatagtcaactgaatagaatcagggcaacatagctatttgagaagtacacaactttcaaattaacttcttgtatagcagcttcaatcttctgtattagaaattgtaataaactattggccgggtgcggtggctcacgcctgtaatcccagcactttgggaggctgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagctgagattgcgccactgcagtccgcagtccggcctgggcgacagagcgagactccgtctcaaaaaaaaaaaaaaaaaaaaaaaaagaaattgtaataaactattaaactgaatattttttatttgtcaccacactattcccagatggttgatcattctcatgaacagtggaagaccaagaaacatcaagcaacagaaactgaatttctgatcaacctattaattcaaaatttagtccctgatatgagtgtaaaaattcttttaaagttaaagtgaacatttataataatatacaaaaataccccattttaaagatgtggaaattgaggctggagaaggatagattatttgcacaaatttcacaaaaaataatgatagagcatgggttaaaacacacagtatcgtgattatatttgaatcatacatgagagctcaaattacatcacactttgcccattctgccagaaaatattctggaggtcattatcatgcagtagttaagcccacaaaaagctctagagtcagcaactctttgttagaatctcagctctgtcacttacctttctatctcaacttcagtttccccattgatttaacaggaatgaaaatagtatttatgtcagagagttgttgaaaagataaaatgcatacaaaaagagaccccctggcacatggtaggtgtaacagatactaatgtatcgtagtgtttctcttaaaattttggaacagtataattgtataatttaaaaaatcaatattgcatatattgaataaataataactttattatagagttcatgaaatggtaaagataaagtcaattacattgtatccatctcagataattgggaaaattttcctcacacaaatatacactcaagaaatacacaccaagaatacaacctcagatatcagatattagagctaaattttgttcacaatgctaggctaagaaatctttggttagaaggttatggaacatcaagattttattggtaagcacataaccccatttaattccagtagacgctcttttaacagtcacagtcagaatcagaggtaagatggttcatcaaagcaatcagatgaacaggtaaatcattaagaaatgcatacatatctcatatatgttacatatatatgataaataaatacttgaaacaaagaagtgtacatttatctttcataatttgatgtagaatctttgccttgcctttggatgtatgttcactgattttagcacaatgcaccatatttattacatacactctaccaatattacataatatgtagtgtccggtttttgttcccataaaatggagtgtgtttttaaatgctcttgaaaagtgttctgagtatggaatgcttctagagttttatgatactttttctgaatcttctgtagttctcttgctcagacagtactctatgacaagtcattgcagcattttgccctttgtaatctttctgaaaagttcaatttcatcttctttgaagcaattatttttatattaacatttcattgggttatatgagattttaattaaattaaatggttgcaatagcaaatgcagctcatgtaaatgtattttaaaacaatatctgacttttcttaagcataaactcgctttggctcagaagtcagtgggtatactgtaaagtggcatcctagctgaggtgaggacataaagcttgttgacttcatcaagtcaatgttttattcactgtgggaataatgagctttatttaatcaaatgagttggttaagtagaggcctgtcaaaaaagtttccaatttattaatattgatgcatttgctatatcagagtaggacatccaattgtggaagatttcacaacttaccattgtatttacaaatctaaacttaatttttgatcattctaatatctcaagaagtttgtttgcagtttgcccataccttcacagtaacccgactgctacacgacagcaactctagcctttaatcaaaagtatgaatttttgaatgaaacaagtacatttgcataattttttaaatagttaaaatcagtgtacctcaaactttcatgtgcagatccatcatataacatataaatcttatgtatgttttaccaaaattaaaaaggcaaaaaagaaatattaatgctatgtcctactaatatcattattttccctgggagtgtagcctggaaataatatttttgtaaaattatccatttgatctatgtgtatgcaaattttaaaaaccactgatttaaatggaaaaccttaaaatgtgtttcaatcattcaccacttgagttccagtgagaacaaaagtaaagttttatctttgagtctaccgattatttccgttacagggtaagaaaatgtgtttgctaagtaggcatattctcaagacttcgttaggctgaatgtaacataaaaaagacttcatgataagaaaagcaatgaaacctgattaatacagattgacttagcgaggagccacaaacttctggcattctaatttgtttgtagttgactacttaacagtattcgatgatcggagaatactttagtagacagacagaaatgaaaattttcctttaattacatcaaattctccctagactaaattctgtgttttgtttaacaatcaaaatgtaggaaacaggagggtgactggtaatgattcaaatgggtattaaagtttcatctactatacatcatcatatatttattaatctgaggttattcatggaactgatatgaaaactgaaggactgtgaagttatattttagttcacataaatgtgtgaattctattgtatattaatattatctgtatttggatatggatagacaaattatgtagatagagagagagatgtacccatattatatccagactaaatgccttctgagaatatttattcatgtagaaattcatttatcaaaaccaaatatttatcaaaagaaagaatatattcatccgaaccatacgattttgattcaaatattaacagctttataaactcaagcaagtaactactaatttctgagctcactaacatctacagcaaaaactttctataagaatgaaaataattttgaactctctgtaagaaagatgagcccatcctgatagcataagtattaaaatgatatttgagcactgtactgcaaagctgctaaaaacagaaaaattacatatatagtagtttgtataatatagatgtgtgtgtgtgtgtgtgtgtatatatatatatatatataatatatatatatatatgtttttttttttttgagatggagtcttgctctgtcaccaggctggagtgcagtgccgtgatctctgctcactgcaacctccacctcctgggttcaagcaattcgcctgtctcagcctcccaagtagctgggactacaggcgtgccccaccacacccagctaatttttttgtattttagtagagacggggtttcaccatgttggccaggatggtctcaatctcctgacctcatgatctgcctgcctcggcctcccaaagtgctgggactacaggcgtgagccaccacccccagcaagtttatatattatataatattaaatatgatctaatatagcacttggagtatttgggtctttcttcttttacttctgtattattgtttttgttattttattctgcccctctttgtcttccttcttttacccgcatattttagtttttgttattttctcctacccctcttttacaagttaccttgcattcttagtgaatgacttatgtggaattataattatgttgcctttttatggatatgtcaatatttataacagtgtttgaagtagacaaatacttctccacttctcctaaatctgtcttataaatgtaaccggtaatgacacaatctatgcagtattaaatattaatttgggattatatattaatgatagagaacaaatgaattcctttattgctaagtcaatgcaaactagtgaagtggcttattttggtgaattacactatgataaacatttttttggaccaccatatcacatatcacacaggacaaccatatagaaactcatagcaaatattgtagtcgtgagtatctgttctaaatttcatccgaattaatattattttatgaaactataggaagatgaattcctgtatactgactttacaaactacattaagtctgtggaagttgcataccaagtaagcaatgtaatggtagagatgtgaaaattctgtcagttgtctttctaatcagtagtcaaattttgacacaagaaatgctatcaaattcaaaaggcatattcatggaatcctctccaactatttagttaacagaatgagattatgtttttttttttctttttatggtacgacatacagtgctgtgttttacttttctctattgtctaataaattatttttaaataattttttctgctgagacagtgtatgatctacatgtcttctgaaaaccaaagaaggtatttctttgatttgaaatagcgtttaaaatacctacattcttaaaagtcagagcttgtaaagtgattgcaggcatttgcgaatcaggtgaaatttgtgtggtcttttgactcttgctatattaataatattttcaatgaaaactgtacctacttgctttgtgtgcatataaattgaatatattgtaaaatttaaaataacagtaatagttccggtgggctgatgttccataatctgtatctgtacttgtataaagataattagtttgaatcaatcacttatagaaaaatgtcacctcacctgcccattttaaaaagtggctcacagaagtgaaattagttacacagcatactaattacagaatgaaaagactgctcaaaaatgctaaatacaggcctgtaaattagcatatcttcatacagatataaattaaacatataataaaattatatgtattataattatatataattatatgtgtagtgtatatatacatatttatatataatcagtatatatagatattatatatctatatgtaaaatatatatgtatctaaatatgtatctatctaaatacatatatatacacaaacatataaaataagtgctaagtcgggtctgggacaatgtcatttattcagcacagtgttcttggtacatagcaagacctgaaacatactaaataatcaataatatgtttggttcaacaagtgtcagaaatgctttattttggtgatgttttagatttggaaattttacacaaacaggcatagttagcaaaaatattttttctttttttaagtttaaaagatatgaacagtacagtacagtgttccagaaattcttattggtgaagaattcatggcttggaaaactaagttgatgatgcagaagaatgttcattatgaaagaaatgggttataaagaagtctgagaaaaagactatttaggaaatttgtcttaaaagggtgagaaatggattagatatgggcatgaacgaaatacaattttttctttcattcttaggtttggctttgttccttttcactgagctggaatgagtatcacagggtaattgtgacatattgacccttaaactttcaacatgttttcattaattcaacaaatattatttaaggtggcatcatacccgacacaattttagcttatcctttatgtaaaccttatgtaaactaaatatacattaatcttgcacaaaaattttgagaaaatattttgaggaaatgtgttaatgcattatttgcttctgcatgtacctttttccctagaatatgactgggttttgattatatattgccagaaaatagtttcacctatgtaaaggatttgttcttagtgacttttgttgtcaggaagttttgcatttgtgttaacacttgtgtgttttgtggcatcatgtttttattagtatcagtgctacattctgtgatacctttatgactcctaaatctttgatttagattatataattcattgctaatcatgtcttcttctcaatgtatctcatttaaattattttagctaaagggccaagtgatagctgggaacattatgtgcccattcctgatggtgcccatttttcaaaaggaagggattttgagaaaggtcctcagaattcagtaatactggtatatagtgtaatgttgaaagaatgtaatgatgcactaactttggcttatttatttatttttagagacagggtctcactctgtctcccaggctgaagtgcagtggtgtgatcatggctcactttagcctggagctccttgcctcaagccatactcctgccttagccatccaaagccttggaattataggcatgagccaccacacatgacctccttttcaagttattccattaattatttataggaaataacaacagtttaatgaaaatttaaaaaaagaattaggaagtttatccatatctaattcaaaatcacatgacaaattcttatttaacttagtcaacctatggggataatttgtattcttaaaaaaatctcttctagtaggaaaaaatataatttcaaaatcttacttaaaccaaatgtatttgttattcaagatatgagtacatttctctctgtcttgacacttgaaattctcgtataagatttcaaattataggggaaaaatcagaagaattgattgttgtattttaggaaactcacattgtgttttgggaattttggcaaattataaaaaataccctttaatttccacaagcgaaagtacatgctgacttgaagttaattctactttttaaaagtaaaatcattttggaaagtttttcagtgagttatgtccatgcaaaataagtgaacactggtaattctttgtacaacagagtacaaaaattgaaagagaataggaaaatattgctacttagggatccgggatatatatttttcatcatgggacatgatatttcatctgagcacaatgtgcatttgaggaatggataggactggcttatagtttaaataaatatcttagctagtcatggttatattctcttagactaaatttcagtcaaattcttagcaatattaatatgtgtatttgaactaatttctgtgtcaattctccaaactgtgtagcagaaacatcattttatgtttaaagaaacaaagtaaagggagagattaataggaactcagacaaatgcagaatcaaattatagtgtattaaagatgtatatctccttccttgttatataagaactaaaacttaggcaacattttatctcttagtggtatactctccttttacaaataccaaaatataatatttatattttgagtatccaaagagccattaccttaaatctgtatcttctagtcatgaagtgcagatgatttttaaggcagacagcatttggtttattcaaaaaatcttttaatatgtcttttgcagtgagttaatctgtcagactgataaaataagttcctcatactccccctcctcttcctgtgcatataagcttttatttaattctgtttgaaatagcttgcttctatttttgcttcctcttcatgtttgtggcactgctttttatgctttgttctttgctgacataaaatatttatcaacatatcatctaagaagattggttctccacagtagatatccaatatgtttcaccacatggaaaatgtcttttcttgtttattcctaaaatctgtagccaaattcccatatgtctggtttatccattgatacttgaaaatgtaaaactaagtaattctgtggataacaattatgcatgaacattgccattaaacagtaaattttaaaataatttatatttaaactaaaataataatcatatatctttcaatatcaagcaaacggatttgattttattccattcctttgttataatggaaaataaattttctaatacatttatttttcattttttctttgatatgatttccctaatagttaaaacaatagcattattcagagactgtatttttagatgtggcctatgatttcaaggatccctcctttccccatgtgttacaatacaaaatataaataaccagttggttccaagactaaaaatttctgccaaagcttgtgttcatacagttacaaagtcccaataaaatatatattagagagaaaaaatataaatatagaaaataaatcaaagtctccaattctttgaaaatgccagcatggtactactgttaagctgtcagtaattcactgtgattacaagaaatcacaacttcagtccatgctaatatcacatgtgagattatgaaaacatatttataaagagaattatcaagtcagcttgcacttccaaaactatactttcgtttcaattatttcatctccttaaatattttatatgtaaatattaagatctatataataaaataatcaatttatttggagttttataagttgtccatccagatgcatctctctaaactgatgtattaggaggaaaaatactgtcaatgaataaacatcactatctttctcattttgtagcaaattttaaagtgaaagtaatagaacattactttgggggaacaatgcaatatttatgatagtgaacattattgaaataagttcaaatttttctttatggattttaaaaaacatgctttcatatacaaaaacatgtaaacatctgcctaaaataaagttgaaatagatatttttgaaatggtaattatatgacctatttcttattccagttttctgttacatatgctacatgtaatagaaaatgtaaataatatagtattaatataagtatagacatgcatataatatatgatcaatataagtacttctcaaatgaaatctctgtttccaaactatgtcctaagttgtgtgcagagcttaatatgtttagcaaggcatacgaacatacagaaagagaaaatatgctatagaacttacaaaactgacattcactaataaaataagactttcaagtgcttatttttatttgttatttttaactttattatgggtatataatagttgtatatttttatgaggtatgtgtaatgttttgatacagacatataatgtataatgatcaagtcagggtaattagagaacacatcatctcaagcctttatcatttttttgttttaggaacattccaattccactcttttagttatttaaaaataaacaacaaaatactgttaactagagtcaccctattgtgccaccaaatactagatcttatgcatgctatctaactctatgtttgtacacattaactatcttcactttatccttctgtctcctctatgctttccagcctttggcaatcatcatttcactctcaacctccactgagttcaaatttttttttagctgccatatatgattgaaaacatgtaacatttgtctttctgtgtctgacttatttcacttaacataatatccttcagctccatacatgttgttgcaaatgacagaatttcattttctttatggctgaatgataacccattctgaatatgcagcacattttctttatccattcatccattggacacttagattgctttcatttcttggctattgtgaatagtgctgcaaaataaacacgggagtgcagatatctctttgatatactgattttctttcatttggatttaaacccaacagtggaattgctggatcatatggtgggtctaattttagttttttgaggatcctctatactgttctccatagtggttgtactaatttacattttcatcaaaagcgtatgagcgttcccttttatccctacccttgccagaatttgtgattgcctctcttttggataaaagccattttaactggggcgagatgatttctcattgtagttttgattggcatctctcgaaaaactgggtatagaatgaacatatatcaacacaataaaagtcacatttgttaagcccacagctagtatcataccaaacaaggaaagtctgtaactctttcctctaagatcaagaacaataaaagcatgtgcacttttaccacttttattcaacatagttctctacttagataagagaaggaaataaagggcattcaaattgaaaaagaagaagtcaaattattcttgtttgtagacaacgtaatcttatatttaaaaaaaccttaaagtcctcaccaaaaaactattggaactgataaacaaattggaattagtaaagttgcaggatacaaatccaacatacatagaaaaacattagtagcatttctatatgccaacagcaaataagttgcaaaagaaaccaaaaaagaaacaccatttacaatagctaaaaataaaacaaagtatccaggagtaaataaccaaaaacttgaaagatttctacaatgggccaccatcgtcggcaaagcctgagtcctgtcctatctctctcctccccggacagcatgagcttcaccactcggtctaccttctccaccaactaccagtcactgggctctgtccaggcgcccagctacggcgcccggccggtcagcagcgcggccagcgtctatgcaggcgccgggggctctggttcccggatctccgtgtccgctccaccagcttccggggcggcatggggcctgggggcctggccgcggggatggctgggggtctggcaggaatgggaggcatccagaacaagaagaccatgcaaagcctgaacgactgcctggcctcttacctggacagagagaggagcctggagactgagaaccgtaggctggagagcaaaatccgggagcacttggagaagaagggaccccaggtcaaagactggagccattacttcaagaccatcgaggacctgagggctcagatcttcgcaaatactgtggacaatgcctgcatcgttctacatattgacaatgcccgtcttgctgctgatgactttagagtcaagtatgagacacagctggcgatgcgccagtctgtggagaacgacatccatgggctccgcaaggtcattgatgacaccaatgtcacttgactgcagctagagacagagattgaagctctcagggaggagctgctcttcatgaagaaccacgaagaggaagtaaaaggcctacaagcccagattgccagctttaggttgaccgtggaggtagatgcccccaaatctcaggaccttgccaagatcatggcagacatccgggcccaatatgacaagctggctgggaagaaccgagaggagctagacaaatactggcctcagcagattgaggagaacaccacagtggtcaccacacagtccgccgaggttggagctgctgagatgacgctcacagagctgagacgtacagtccagtccttggagatcgacctggactccatgagaaatctgaaggccagcttggagaacaacccgagggaggtggaggcccgctactcccttcagatggtgcagctcatcgggatcctgctgcacctggagtcagagctggcacagacccgggcagagagacagcgccaggcccaggagtaatgaggccgtgctgaacatcaaggtcaagctggaggctgagatcaccacctaccgccgcctgctggaagatggcgaggacttcattcttggtgatgccttggacagcagcaactccatgcaaaccatccaaaagaccaccacccgccggagagtggatggcaaagtggtgtctgagaccaacgacaccaaagttctgaggcattaagccagcagaagcagggtaccctttggggagcaggaggccaataaaaagtacagagttaaaaaaaaaagatttaaacaatgaaaactataaaacattgatgaaagaaattgaggcagatacaaaaaaattgaaagacatttcatattcatagattggaaaaatctatattgttacaaagtccatactacccaaagccatctacaattcctatcaaaacaccaatgacattcttcagagaaatagaaaaaataatcctaaaatttatatggaaccacaaaagacccagaataaccaaagctatgctaagcaaaaataactacactgggggaatcatagtacctgacttcaaattatactacagagccatagtaaccaaaacagcatggtactggcataaaaatagacacatataccaggggaacagaatagagaacccacaaacaaattcacatacctacagtgaactcatttttgacaaaggtgccaggaatataaactgaggaaaagagagtctcttcattaaatggttctgggaaaactggatatccatatgtagaagaattaaacttgacccgtatctcttgctatatacaaaaatcaaatccaagtggattaaacacttaaatctaagaccttaaactatgaaactactacaagaaaacactggagaaactatccaggacattggtcttggcaaagacttattgaccaatgccccagaggcacaagcaatcaaaccaaaaaatggacaaatgggatcacagcaagttaaaaagtttctgcacagcaaaggaaacaatcaacaaagtgatgagacaacccacagaagggggggaaatatttgtaaactactcatctggcaaggaattaataaccagaatatatgaggagctcaaacaactcaataggaaaaaaagtgattaataaatagacaagagattgtaatagacatttctcaaaataatatatacaaatggcctaccttcaagtgtttaagtaaaagttgtttcctgatatcatgtccatttacttatgcaatatagagactttatttacctactgttttctttatagtacagcagatttttaaattagtttgtaatggagcaaacaggttggtgaaaatgtaaagaaaaagttttgaaattttttattctaaaaaacttcaattatattctctctctagatatgattgagttttatccctgttttatttctatgcgcacaactcaaaaaggtttgttgacaaaacagtcaaagcttcgaaattgggtaaattgcttagaagaaacttattttcaatttcacaaggaagaaattttaaaacttaagtcttttagcaatgtacagattgtacattattatcttggaggcatgtattttgtctgcattaaaatcatgcaaaggaacacgctttacaaatcaatttcactgtggacctaaagaccagatacaccaccaagtcccatttaaaaatggccttaatttagaattcaccctctcaagaacagattgagtattaaaacatatgaaatgtttgagagctaaaattgtttcaaatattttggatagcttaaaggcatattttagaaatactgatttcttagtattttctttgccaaactgaagaaaataatggatccagccctcaaaattttgctttgggaatttctcatcatcattaaaatttgtatattatcataactgcttcatgtacctcccaaagcagtgtaaccagtgccttagtaggaactttcaatggaccatgaaacaatttttattcccacatttatttttgagaaaagttgagtcctccataattcatatttcttgagttctttctgggagtcagcaaaatctttaaaaagattctttaaaaaaagaatttgttatcttaaatatccaaactaactgagaaggattttaaattgacatttgtgttgttaggatagtttgacaatgtaattagtgaagtcagatggcctgcagaaaaccaaatgaaaatataatgtgatcatatataaatttttctgtaagatgtccagttctgtatatctcagaattattcttttaattgtagctaccaaaaggagttattatgattggctagattcgctttatatagccatgaacaatttaaaatattaaggctagattttgaggtggaaatttttgccttatatttttagcaaaaaggaacaattatattctatttctcttaaggactaagttaatttgctaattagtatttttcaataggcattatcattttgttggatctgccaaagcaagattttatttcttaaaatatgattttctcttattctgcccttgtcagttgatgtgtacatgagggggtaaattgcatttagtattcatctaaattggaattttccaaatgtataatctaaaagcactgatctgttgatactccctgcaataaaagttttccttgagcaaatagttttggatatatgtattgttttcatatcttggaaatgatctgtaaatggtggcatttaatagtatgtgagttccttggtaatgaaaacatgaattctaattctacttatgtctctaacttgttgtgttagtctcagatctaagtcattttatttctcttgatgtcattcttcatgtgtatattgaggatgctgaatcggatgactgtctaagggctctggttcttgacttctctaatcgttttattctagataaaatttaagttgtaactctatgctctttgaagcgcataaacactgtcaacataaaaaaatgagacttgaaggtggtatccattacagcctttgcaaagatttcccttgaataaaagggcagaaaatagagccaatagcttgtggactaggaagattttgtgaagaataggaaaaatgagttaatttcagaaatggaaaaaaaagtacaactctaggctatgaaagaaaataagccatctggtattatggcactgcatgagttcagtcaaccaaaattctgttaatgtagaaaatggtaattgcatattttgtgaaaatgtttcgattcctaaggttttagttacctctataataaaggcaacattatgacttttgctgttgtcaattttcaaattaatatttctttgatccagtagtaacctaatttttattgaaactcaaggcacagaggaatatggatagaaactttaatataaagggatacataattaattttatatttgcaatacttatttcactgcaaataagatgctcattatgttaatcacattgcagcttctctgtttgtagcttatatggtttggctgtgtccccacccaaatctgatcttgaattatagtccccataatccccacatgtcacaggagggacctggtaggaggtaattgaatcatggggacagttacccccatactgttcttatgataacgagtgcgttctcaagagatctgatggttttataaggggcttttccccctttgcttgacacttctccttcctcctgccatgtgaagaagtgtgtgtttgcttttccttccaccatgatggtaagtttcatggggcctttccagctctgtggaacagtgagtcaactaaacctctttcctttataaattacccagtcttgggcagttctttatagcagcatgagaacaaactaatacagtagccttaaccttacacacaatttgaatagaaaatttgattcgagcttcattatttttgtagttcagactctatgcaatctacacaagtacaacactgctacagtatattagttttgcactcaataggagattcactggggtgatttgaattatacatcaagaagaattgaatctttttggcatattttgtagaattttttaaaattagcattattcaaagaggtattggtttattaatttgacaccacagtcttccgtacactgatttcattttttttcatgctgattctgccatatcctgtgaccttcagtataaactactgtgtggctttgcataagaaaatgagaaacttgttctcaaaagttagcctgtatcacggttgcatatgctagtccatgctataggtggcataggcctgtagtcctagctgagatgggataactgctagagcccaggaatttggggttgtactgagctatgatctttccactgcactcctgcctgggctacagagtgagaacatgtctcttaaagaaacaaaaaaagcccataagaataggataaacatcagttttcagatgaattgaatcttgactgatcagattttatttgtattaggaactataataaacattgtaattcactgaattaaggaggagatatatgcatatgcatagtgatacttacatgcaatattatatttcaattgactctagtagtaaagatatctgattatttctaaacaaatgtctttgaaaatgttttcacttcttatttattccaagaaataacacttttatttcaaaatggcttcattaatgcagctttattacatgactttaaaatttatgcataataaaactgcaactgttacttctttattgaagtaaatggcaattatagattgatgcatggtacttgatcaacaaaggttacgccaacactgtgaattttatggtgagttctattgacctataagctcttcaaccatcatctagttatttggaattctcatttacttttagccagatatttctagctcatatttagtacttaaaatttgttttaggaatataaaggagatattaaaatatgtgtgtatgtgataatgtagcatgttttggtattgttctcatgataaattttagtaatatttatgaaactcaaagaggagattttttttctttaaaatgtatgttttcttaattttgtggtaaaagaagcctagttatttctattgttttagtttactaattaaaatatttgctagtcattaattcagaaaataatgttaaaaaactcaattatactcaaagtaagaatttatgcaaacataattttttattattattgaatttgtgtaagtaaaaataatgacacctaaactatcgtttttaaatttattaacaaataaatttaatcacagaatatttaatagcctaaaaacaatcttcttgttaaaaacacacttaacttgtgagatatgttcatcttccatattagacaacttatgttttaagttacacattagtcatattatatacctagtcattcataatataaaatttggttggattatttattttaaaaattagtttcagtcataatgattcacatagtctatagtatttcagatgacaaggactatgctgatctgtttaccacaaatatcttgggcagtgttgatgctttaaaaatgtcaatgataaacctttaaaccttaattaaaaattactctgagatttagagatacatttcaagatgggcctttagcttacacaaaaaagtcctaataattataatgaatgcatttcttagtggttgttagtatataagatatatatagatatatatatatactcccttacagtgggaaaatggttccttttctgtaccatttctcatgtgatgaattcgagaaattcttcacattcagtcttaaaagttttaagccgaatatgcttattgttctgaattttaaggaaaattaatcaatatttgactttggtggtttataaaccaattttcacttttcaatttgggaactaaaagtcttgaataagttgttaaaatgtgtttgttttcttttttattgttgtcacgtcccatgttttgcttcttttatttgtacttccatactattagaaataagtccagacccattacattacttatttttttgacctttttagttaccaaattagaaaggatttttatcactaagctctagacaacactgaaattgcagtctttaaaaatgaaaagcacgtacgttattacttttctgtttaaagcagtctttctctttttagagttttgtatatttgaaaactctacacttaaatattacgagttgattatgaattctaattaatacaaaattagagtgattctgtgtgtgtgtgtttgtgtgtttcttatcattgaaatagaatcctcatttaaagtgtggggaattgcaaaattctatgtagaagatcaatcctccccaaagtgttttatgaaagcactatttaaaaaaaattttatacttcagcttgtattaccattaaattacattgcatacagatgaaacatcttgcaatgagaaataaatgtgctgtttgtcagtgacacttaaaaatgttgtacaatgctcttttattgatccttattagtgcatagaaacattactttcacctctatttttctattctgctttattccatctaagaatttcatgtcttcagttttataatattctaattttattcaaaatagatttttaacaaattcaaaatgtttatctttaagcttttatccataatggatattattaaataattcctaaaatgcagatgtgatcaggaaattatttattaatattggctttaaaattttgtgatgaataaacttgagagtcatctgtccagatcaatacatatttgggtgtttataaacatacaattattttgtttaaaaatagactttgctacttgttccaggtcaagcatgatttcacagtgttttgaagaaagtcaataatgcaaggcttgaatttatctagaaaataatgacaataatctctaatcccttatgtcctaattgtgagaaataatataaaattttaggtgaagacaatggtattatagaaaaagtttcttaagccatgataagaataattctactgggccattctcatgctagtgcctgctgattttgggtttttcctattactattttatatgtcagaagtttggggacagagcaacctgttaagtcaaaaacaatgtctttccttgctctacacttatagtaggaggttgcgtgaaagaaactggtatgtcagtagaggactgtgcttagccatcacaggcgacgaagctagaaaatctactgagttactgcaaaatgttacgtttaataacacatctcctttgtggaaagcaccaatcattacttcccaggaagccaacatattgcataggcttggtccaattctataaaaatgtattacaaaatacaaatgtgaaggagcagcagtcctactatgtctcaattatcacattctttgtaaagtgaagtagaaaatatattgcaataccttacaaattatatttatttaggtatgctaatataatgttgtagaaataagagaaaatatttattgtgtttaactttattaaaatttctttttagctttcatacctggactaaagaaaggtacagtagaaatcaacacaaaccatcaccatgttgcatgtttcattttaaaatgaagtgctgatttgtgtttaagaactgtttacctttttgctactcataaaacatcaactgtttgcttcaaacacatttttgatacatttaaaatatctgaaatctaggaagggcattcagtcagttggatatcttatatatctgaatgctttttctaaattgtgtgtcatcaatctttagataataaaataaatgtgactctatagttatttatttggcttaaagtagttactttcaaattacctatgaatttattattcatttctctcctctgatagtataagcattttcagtattttgtttgagcagccattaaagatataattatatttttctgtattctattccaatttgatctataaattgtatatgttttctaaattactaacaaagtttacattgtttatgaatttgtaaataatatgtaatatgcattttctttgccaaattataacacatggattacatgggaacctatgataagttaaggttgacagacaaaatatttctaaaaacatggagtttaagcaatcagttgaaaaatatatatattttttgtgctgataaaattttaaaatgctgcaggatatattgaatgttccaaatatatctgcactcattgtgcatatgcacacatttctttgttgtccactttatatttggtgatgtttctgtcctattgttccactgttctttataacaataatttatttcactcatacacttttatcttaaactgtaatgtataatacattgatgttttgatgaaatagaaagagcacttaaagaaaaaattttcctgaaatccgtcataaacctgaattgttatgtaaggaagaaacttacctttaatctttaattttgacatattagcaatattaacaacatactttatcaatttttggtattttaaatgtaaaatgttgcttttgactttttacactgtgttggggtacttcttctgttcttctataatcagttctaatgtccatgatacatttctgcctatcatctgaataatgaaatgtgatctcatttgtccatctttgctttggttgcctgtgcctgttggataatgctcaaagagttttcgcacactcagatttcctgaggagtttccccaaagtgttcttctagtaatttcataatttgaaatcttagagttaagtctttaatatgcattgatttgatttttttgtgtatggcaagaggtagcggtctagtttcattcttctgcatatggatatccagttttcagttttccaggaagtattgattgaagaaactgtcctttccctaatgtatactcttggaacatttgttgaaaatgagtttactgtagatgaatttatttctgggttttctattctgttccgttggtctatatgtctgtttttatgccagtacaatactattttggttagtatagctctgtagtataatttgacatcaggtaatgtgatttctccaatgtagtttttttttgcttaggatagctttggctattctgcgtgttttgtggttccatataagttttagaatttttttttcaattaatgtgaagaatgtcgtgattattttacaggggtttgcattgaatctgtagattactttgggagtatgaatatcttaacaatatttatttttccacatacatgtaatatcttttcattttttgtgtcttcaatttctttcatcaaagttttacagtgttcattgtagagaatttcacttccttgattaatttatcatattttattttatttgtagctattgtaaatgggataaatttcttgattccttaatgttggcacataaacatgttactggtttttgtatgttgattttggatatgaaatcaatattcatcagtgatattggcctgttttctttttctgatatgttgttggattttggatacgaaatcaacatacaaaattactaaatttgtttatcagttctaatcattttcttgtggactctttaggtttttctaaatataatatcatatcattaacaaacaagaacaattttacttcttccatttcaacttggatgccctttatttctttctcttgtctgattgctctagctaggacttccagtactatgttgaatgacactggtgacagtggtcctccttatcatgttccagatcttagagaaaacacttttcgttttttcccctttcagtatgatactagctgtaggtctgttgtatacgccctttattatattgaggtatgttcatcctatactcaattcttagagaatttttttaaatgaaggaatgttgaatttatcaagtaatttttcagcatcaattgaaataatcatatgatttttgtcttttagtctgttgatatgatgaatcacatagattgatttgcatacattgagccatctttgcatctctaggttaaatcccacttggtcatgatgaatgatgttttcaatgtgttgttgaattcagtttgctaatattttgttgaagatttttgcatcaatattcatcagtgatattggcctgtttgctttttctgatatgttgttggttttggtatcagggtaatattagcctcatagaataagttttgtagtgttccctccttctctattttctagaatagtttgaatagaattggtattagttctttcttaaatattcgttagaagtcagcagtgaaaccctctggtcctcagctatttttctgctggaagatatattttttctttttttttttaacttttaagttcaggggtacaagtgtaggtttgttacataggtaaacttgtgtcatggggatttgttgcacagtttgtttcatcaaccaggttttaagcctagcacccattagttgtttttcctgatcctctctctcctcccaccctccatcctccaagagaccccagtgtgtgtggttctcctctatgtgcccatgtgttctcataatttatctctcattaataagtgagaaaatgtggtatttggttttctggccctgtgttattttggtaaaaataatggccttaggctcaattcatgttcctgcaaaagacataatcttgttcttttttatggctgcatagtattccatggtgtatatgtaccacatattctttacccagtctgtaattgattgacatttaggttgatatcatatctttgctattgtaagtagtgctgcagtgaacatatgcatgcatgtgtctttataatagaatgattaatattcctttggatatattcccagtaatgggattgctgggtcaaatgttatttctgtctttaggtctttgagtaattgccacactgtcttccacagtggctgaaataatttacgctctcaccaccggtggataagttttcctgtttctctacaacctcaccaggatttcttactatttgacttttttgtagccattctgactggtgtgagatagtatctcattgtggatttgatttgcatttctctaacaatcaatgttgttgagctcttttcatatgattgttgaccacatgtatgtctccttttgaaaagtgtctgctcatgtattttgccactttttaatggagttgttttttttctttgtaatttttttaagttcattatagatgctggatattagacctttgtcagatacagagtttccaaaaattttctgtcattccatagattgtttactctgttgatagtttatttttgctatgaagcagccgtttcatttacttagatctcatttgtcaatttttgcttctgttgcaattgcttttggaattttttttatgaaacttttgccagcgcctgtatccggaatgatactgcctaggttatcttccaggaattttatagttttgggttttatgtttaggtctttaatccatcttgagtttatttttgtatatagtgtaaggaaggggtccagtttcaatcttctgcatatgtcagttatgtcaacaccatttattgaatagaaaatcctttcttcagagcttctttttttttttttttttttggtcaggtttgtcaaaaatcagagagttgtaggtgtgtggtcttatttctgggttctctattctattccatttgcctatgtgtctgttcctgtaccagtgccatgccattctggttactataatcctgtagtatagtatagtttgaagtcaggtagtatgatacctctggctttgttcattttgtttaggattaccttggctattagggctatttttggtaccatataaatttttaaataattttttaaaattttatttctgtgaagaatgtcattgataatttaataggaatagcattgaatgtatacattgttttaggcaggatgaccattttaatgatattgattatttctatccaggagcataaaatgtttttccatttgtttgtgtcatctctgatttctctgagccgtggcttgtagttctccttgtagagatttttcacctccctggttagctgtattcaaaggtattttattctttttgtggcaaatgtgaataggcatctgtttgtggctctcagcttaactgttgttgatgtataggaataccagcactttttgcacattgattttgtgtcctgagactttggtgaagttgtttaacagcttcagaagcttcggggctgaaaaaatgttttttttgtttgtttttttttttagatatagggtcatgtcatctgcaaacagagatagtctgacttcctctctgctggaagatatttattatggctttgagctcattatttgttatggatatgttcaggttttggatttcttaatggtttaaacttgataggctatatgtgtctaggatttgtcaatttcttctggctttttccatttattggcatatagttgctaataatggccattaatcatcttttgaattcctgtggtatcagttgtaatgtctccttttacaactctggttttattcaggtcttctctcttttctcttagtctggctaaaggcttgtcaattttgtttaacttttaacaaaacaacctttttatttcattgatcttttgtattgatttatttgttttgatttcattgatttatcttctattattattctttttcttctattaatattggattttgtttgctcttgcttttcctgttgtttaagatgcgtcgttaggttgtttacttgaagtttttctcattttttagtgtaggcacttacagctataaacttccctctaagtactgctattgctatatcccatagggctcagtatgttgtgtgtccattataatttgtttcaagaattttttcaaatttctttttaatttctgcattaacatactgatcattcagcagcatattgtttaatttctatgtgagtgtatggtttccaaaattcctcttgtaattaatttctagttttagtccattgtggtgagagaaggtgcttgataatttttgacttttttgaatgttttaagaattgttttttgagctaatatatgacctttccttgagaatgatctctttgctgaggagaaaaatgtgtattctgcagcagatgggtgaaattttctgtaactattaggtttttttgttctatagtgaagattaagttcaattttttttgctgttgctgttgttgttgattttctgtctgaaaggtccagtgctgaaagtgtggtgtttaagtctccacctattactgtattggggcctatctctatctgtggctcaataatatttgctatatatatctgagtgctgtagtattgagcacatatatatttacaattgttatatccttttcctgaattgacccatttatcattatatagtgactttctttgtctcatagtttttatattgaaatataatttgtctgatataagtctagctactaccactcttttttagtttttattggcatggaatatcttttaccatctgtttatttgcaatgtatgagtgcctttaaatgtgaagtatatttcttgtaggcaatagattatatagtttttttaatccattaatccactctatgccttttgattggagaatttagttgtttttacattaaatgttattattaacaaataagggcttattcttgccatattgttatttgttttctgttcattttgtggccttctcttccttctttccttccttttttcttcttttagttaagatgattttctctggtgatacaatttagttttttttttaaattttttgtcagtcagttatctgttttttgatttaaggttaccatgaaacttgcaaatactatcttataacccattattttaagctaataataatttaacactgtataaacaaacaaacataaaaatgtagagaaaactcataaacactctacattttattaccctactttttaatcttttgttgttcttatttatatattgttatactgtctaggtcttgaaaagttgtagttattattttttattggttcctgttttaatatttctacttatgataagaatagtttacacaccaaagttacagtgttataatattctgtatttattgtgtatttactattaccagtcagttttgtacctttgtatgaattcttgttgctcattaacattctattctttttaattgaggcactctctttagtatttcctgaaggacaggtctggtgttgttaaaatccttcagcttttgttttttgggggaagtctttatttctccttcatgtttagaggatatttgcaccagatatactattatagagtgaaagtattttttctccagcacttctttaaatatgtcatgccactctctcatgccctgtaaggtttccactgaaatgtgctgccagatgtattggtgctccattgtatgttatttgtttgttttctcttgctgctctttctaaaataatcctttctttatttttgacctttgggagtttgattattaaatgctttgagatagtctcttttgggttaaatctccttgatgttctttgggcttcttatacttggatattgataatatttcactaggtattggaagttctcttttattatttctttgataaaacttcctactcatatctctttctctacctcctctttaaggccagttactcttagatttgctcttttgaggctgttatctagattctgtagttgtatgtcattacttttattcttttttctttacttctgtgtattttcaaatagcttatcttcaagcttactaattctttcttctacttgatcaattctgttattaaaagactgatattgtttggctgtgtccccacccaaatctcattttgaattgtagctcccataattcccatgggttgtgggacggacccagagggaggtaactgaatcatggggatgggcttttcccatgctgttctcatgatactgaatgagtctcatgagatctgatggttttataaaggagagttcccctacacaagctctctctttcctgctgccatgtgagatgtaactttgctcttccttgccttccaccatgattttgaggcctccccaaccacatggaactgtggttaaacttctgttaccttgtaagttacctagtctcgtatgtgtctttatcagcagtgtgagaatggactaatacaaagactcttatgcattcttcagtatgttaattgcatttttcagcaccagaatttttacttgattcattctaattatttcaatctccttgttaaatttatctaacagacttctaaatttcttctctgtgttatcattgaatttctttgagttccctcaaaacagctatttttaattctctgtctgaaagttcacatatctctatttctccaggattggtccctggtgccttatttagtttatttggtaaggtcatgttttcctggatagtcttgatatttatggattttcatctgtgtctgggcattgaggaataaggtatttattgttatctttgcagtagggacttgtttgtactcatctttcccaggaaggctttccagatatttcaaagaactttgatgttgtgatctaaaatatatctgtattagagaacgcaagaagcccgaagcccaggacaactttttaagtttaagaactaagtaactgtggttcttgcagacttgtagaggtactgccttggtggttttggacaacatccagaagaattctgtagattatcaggcaaaaactcttgttctcttttcttactttcttccaaaaaaaaaaaaaaaatggagtctctctctcgctctctgttctgagctgcctggagttattggtggaatgacacaagcacctctgtgaccaccactactaggattgtgctgggtcagacccgatgccagtacaatactgggcctcactcaaggcctgatacaacctcaacttgactactgcctatgttttcccaaggccctggggctctacagtaagctgctggtaaggcctttcaggcctgtgttcttcccttcaagatggcgaatttccccaggccccaggtatgtccagatgtgccatccaggagccagagactagcattaaataccttagatgtctaagtggtattctattgtacagcaactgagctggcactcaaaccacaagatgcaatccttcccactcttctttcctttttccaaaggtagaggagtttcaccctgtggccactgccaacatgaggccatggagaatactgccaagctattgctgatgtttcgtttaggtccaaagtctcttcagtcagcttgtgatgattgatacctggcctgggactcacccttcagaacaatgggctcctctctcacccagggcaggtccagaaatgctgtccaacatccatgtcctagatatggggacctcaagggtccacttcgtgctctactccactgtggtgagctaggacttaaggtccaagacaaagttcccttttccctcctcatttctcaatcagagggagtcttgccccctacacacacagcaggaaatgtgctgattgtagcctgagtccaacaagtctcagaatttcaccccaaggcactagaagtattgcttgggtattattgctggtcattaatcttctgtgatcattatttgtatttctgtggggtcagtggtaatatcttctttgtcatttctaattgtgtttatttggaacttttccctttttttctgtatgagtgtacctagaaatctgatatggtttggctctgtgttcccctcaaaatctcatctcaaattataatccccatgtttccagggaggaacatgtaatctccatgtgtcaagggaaggaggtgattggatcataggagcagtttcccccatggtggccttgtgataatgaatgagttctcacgagatcttatggttttataagtgtttgacagtttctccttcacatgttctttctcctgccaccttgtgaagaaggtacttccttcccctttgccttctgctatgattataagtttcctgaggcctacccagccatgtggaactgcgagtcaattaaacttctttcttttaaaaattacccactctcaagtatttctttatagcaacgtaaaaatggactattacacaatctatttcactaattaaaaaaaaaaacctcctagattcattcatcttttgaatgttttttcctgtctcattttccttcagttcagctctgattttggttatttcttgtcttctgctagctttgggcttggtttgatcttgcttctctagttttctttagttgtgatgttaggtggttcaactgagatttttttaacttttagatgtgggtatttagtgctataaatttccactttaacactgccttagttgtgtcccagagattctgctatattgtatctgtgttcttatgagtttcaaataacttcttgatttctgcctcaatttcattatttacccaaaagtcattcacaacctgagcaaattatacaatttccatttaattgtatggttttgagcaattttcttagtcttgcttcctaatttgatagtgcaatgatctgagggagtgattcttattatttcagttcttttgcatttgctgaggagtgttttgtgtccgattatgtggtcaattttagagtatgtgctgagtggcattgagaataatgtacattctgtggtatttgggtagagatttctgtaaatgtctattaagtatatttggtccagtgcggagtttagttcctaaatatcttcatgaattatctgtctaatactgtcaaagggtgttgaaatctcccactattattttgtgggagtctaagtcactttgatgatctctaagaacttgttttatgaatctgagtgctaatgtgttgggtgcatatatatttaggacagtaagttcttcttgttgaattgaaccctttaccattatgtgatgcccatctttgcttttttctatatttgttggttgaaaatatgttttttctgaaattaggattgaaatccctgcttttttgttttccatttgtttgtatatttttttctattcctttattttgagctcatgggtgtcactgcatgtgagatgtgtctctcaaagacagcataacaatgggtcttggttctttatgcaacttaacagtctgtgccttttaattgagagcatttagcttgtttacgttcaaggttagtactgatatgtatggatttgattctatcatcatcatgttagctggttattctgcagacttgtctgtgtggttcttcatagcgtcactggcctgtgtaattcagtatgtttttgtagtggctggtaactgcctttcctttccatatttagtgcttctatcagaagctcttgtaaagcaggttggttggtaatgaattccctcagcatttgcttgtttgaagataatgtcatttctccttcatttaggaagcttagtttggccagatatgaaactctgggttgaaatttctttaagaatgttgaatatagaccctcaatcttttctggcttgtgaggtttctgctgagaggtctgctgtttgtatgatggggttctctttttaggtgacctgactcttctctagttgcctttaattttttttttttattttgaccttggagaatctgatgattgtgtttggaatgatcttcttgtaaagtatcttactgaggttctctgaatttcctgaatttgattcttggcttgtataactaggttggggaagtgaccatggatgatatcctgaaatatgttttcaaagttgcttccattctcctcgtctttttcagggacaacaatgcttcatagatttgttctctttccataattccatttttttggaggttttatgtattccttttaattcttttttccctattcttgtctgactgtattattttagaaagccgacctgcagactctgagattcattccacagcttggtcaattctgctattaatacttgtgattgcattatgaaatttttgtagtgtgtttttcagctctgagagctcagttatattattttctataaagacctattttgtttgttagttgttgcatcattttattatgattcttaccttctttgaattgggtttcaatgtactcctgcatctcaatgatcttagtttctattcatattctgaattcaatttctgtcatgtcagctttttcagcccagtgaagaaccgttgctagagagttggtgtggtcatttggaggaaagaagacactgtggcttttagagttgtcagagttcttgcactgttctttcttgtctttgtgggctgatgttcctttagtcttcgaagttgctgttttgtgaggttttttgttttttttttttaatcctattagatgcccttgagggtttagttgtggtacaagcttagttcagtcaactggcttcatttctggaagaatttggggggccaagtctctgctcccaacttctatactacgtgctgtaactctgggagactggtattgggccctgtctttgttctctggctcctcaaagttaggaacccaatgtgctcggaaggctgaaatgctcccagactactgatcactacactttgatggctggtgccagccaaaacatttggtaggtcagtggcagtgggatctgtccttgtttgcatgtgccagcagcagtgacagtggcagcactgtgtggtacctgcatgttggctgtggcagggcacctagtgggtattggggtactggtctccctacacacattcacagcagcgacagaggcagcatggctctctaggatggggatcccctctggtgactgtgcatgtggtcatactggtggtggttttagcgcaagggctggacgctgtcaggtgcaggtctttgtgcaccctctatgtgcattcatgcaggcagaggtccccactcagggaatgtgagggtctgctgttctctgttcctggtttcactctggaaatagcattggcacaggggcaggggcctggcaaaggtggggctgctgggctctgtgcccaccaaggctctgactgcaatgacagtacagtggggagagaggaggtggagtgaactcatgctggcagcagtggaagggcagggttcacacacacacacaccccacacacacacaccccacacacacacaccgaggggacacggaatgcaaaagccacctcacacacactcaccagcaaggcaatatggggaagggccgtgggcctgagggtagatgcagttgagggagggagggtgtgagctagtgcatggccatgggctttgctctgctggagctctctgccagtgtggtgcagtccaccagtgcaggagctatgatgtgggtccccagggcaccagaggttgcaccgcaaagaggcagagtcaggctgggcctctgggacaggccagcagaccaaggggtgcgcaggttggaccatccccttctgatgggcctgcagagttcaggcctgacagttcctctagggataaattctcctattagagcaagtcaagcctcgggggtgagagtccctgaccatggtctgctacagacgctcccacaccaaaccctctgcactcctcactggatgaaaggctgcccttactacttctctaagcagctctctctgccaacgcaagtgtctgtggtagtcaagtggtttcctactgctgggattccagaggtccatggtgagtgctaattgctccttgccagttcaacttacctgttcccttagagttactgggggccaggaacgagtcctgctgcacagtagccccttgcagtattcccagcttcctccctcttcagcccatttttgtcttccctttgtccactctcagtgcctttcctctgaagatctgttaggagtgcagcagctgtcaggatccctcagtggcagccgttccacctggctgcttctagttggccatcttgctcagctccaatcatttaacctcttaaagtctgtttactcatttgtaaaatataaatatcaatagcaagtatcacaaataatttagcactgccccttagacatcgtagatgttaaatattatgctaatacaataatagcattcttatttttccattattttttttctagattgaacttttattggctacccacttagcttttaggcaaaatcaatttcattttgtttttatttcaaatattaataaaagaggcactgcttgttttcattaacctgtgaaataattttctatgaattagaaaatacagctgtgtgcataattctgttcttttatcattattagtattttcagccacttttaagaaacagaggagataatttttttatgagtttatcaagttatcttgtaattgttaaatacaccttgaagtctccattcccataactaaatctggtttgtcttttacctttaattaagctaacctctctgtttagtaaagtctaactgtgaagatgataagccaggtaccaatgtttaacttgcatttttttagcatattttaaaacttcagtgaagtcttgatgtaaatgaatagatgtatgtatataaatctatggttatagtatctgttactcacacatgtctcattaaaattattgggaacattcttcctttactttgtttttctcttagtcttcaaagttttatgtgtagactccttataaatagtttaaatcagattgttagtaataaagaggaaaatcactttaagaatctgacagcaatgtttgcattttaacatccatgggaacagtatattgtgtctaacttaagtatctgacaccaaacattaaacataatatttcctttctaatcttatcctttgatacattttagtgtatgaggtatttcaaggaaagatgtgaaacatgtaaattaattgtcttttttatccctcaaagataaccaaggtatttattaaattccctgaagccgtatgacaagacatacatctaaactcaaactaaattatctggctcttgtaagctttatgtttgacatcatgataatccatattttgttcttttacaaaagtgatgcaacgaatttataaattaacacagagacattggttacaataatttcataaagacaaagagaagcctcacaattgtgacaccgggcttgtttgacattccttgtacctaaacaatttattaccttttacactatagtcagaggtagtgaactattactggaaaaatggtattttctccatgcattggaatttgaattattcctcaaaggcagttcttgcagtgggtaatgttcctcgtgttgtcacttggccaacagactgtaccttggcatgggaaaatttgtcagctttttcacatgtgacacagatgttgcttttaatgatgcatttaaataattttgcatagaaagggaagataagattacataaaaagaaaaatagttattcaagacttatgaaggctcaagaaactggagagccaataatacactctgaataaggtctatgatctttcacttatgaagaatttacacccaattttcataaattacatatcgatgtgttataaattatgtactttattttatttataaaattatgtccaacattttgctaaagttcattatacaaattccgaaacaaacaatagtttattttagatttggtagtttaatgatgccattcatttaacgtaaatatgtttcattgtgaaagaacatgggaagaaaaatgactttgtcatacatatatcttgtcacatttgatccagcaatcccactactggatatctacccagaggaaaaaatgtcattatatgaaaaggatacttgcacaggcatgtttatagcagcacaattcacaattgtgaaaatgtggaaccagcccaaatgcccagcaaacaatgagtgaataaagaaaatctgtgtgtgtgtgtaagtgtatatatatgtatatatatgtgtatatatatgtatatatgtatatatacgtatgtatatatgtgtgtatatatatacgtatatatatgtgtgtatatatatacgtatatatatacatatatatgtgtgtgtatatatatatacgtatatatatatgctagatcgaatggtacatctacttttagttctttaagacatctccatactgtttctcaaaggggttgtactaatttagattcccttcagcagtgtaaaagtgttcccttttcaccacatccatgccaacatctattaatttattattttttcattatggccatgtttgccagaataaggtggtatcatatatatatatgtacataccatggaacactactcaggcataaaaaggaacaaaataatggcatttgcagcagcctggatggaattggagaccattattctaagtgaagtaactcagcaattgaaaatcaaacctcatatgttctcactcataagtggcagctaagctatgaggacgcaaagacataagaatgatacaatggactttggggacttgggggaaagggtaggagaggggtgagaaataaaagactacatattgagtacagcatacactgcttgggtgataggtgcaccaaaatctcagaaatcaccactaaagaacttattcatgtaaaaaattttttttaatgtgattgctgtataaaatgaggaggaaacataaaaaaggatgagtataaattaagactttagatgaatattcttaaattgtattaaaactgatttctatcaaagaccaatataaatttttgaaattgtttctttaaaaattaattatacatattcattttcatacatttattaatacatatttgtttgtatttacatataaaatgaggtctgagatttttcagacaataagatttcatagttatttcaataattactattgtagcaaaaattataaatataggcaatcatatttggagcaatctttcattgtttatatggctcaaatttttaagtatatttaaattcaagtttttaagtatatttaaaaagatgtctaacataaatatataatactgtatttaccccagaaacattagtaattaatgataagaataatgacgtaggaaaatatcaggaaggcttcatctattttgtaaaaatgttcacatgtttttacacatcataagaagcacatttacaatgaagaataatttggcctttataataatgtaacaagatgacataattgctcatcacaattagaagctatctttaaggtctgaaaggacaagcaatctatctgagtcgatgtattattttgagtaatcaatgaaatttcagttacttgtgataataaagataatattatttttctttaagatatagccttgcataataatagaaagattgatgaaatggccagttatgttaaacttagaagaaacatttcttctagaaaagaacatcttgtagttctcgaaactcatttttttctgtcaacacagcaaaaattgaaaatatgtaaaaagtgttactaaatgtagagctgaaaatgtagagctgaaagcctcttcagcctgcctattgaattagcaaatacaaaactgagtactttgattgatatcaccctgccaaagattcagccaagagaatttgggtagctttattaaagctgggttggacggtgagtctgagcattaattttttatgtagtagaacacagggtcaaagcttgccttctgggactgcctttccttgtactataatagattatcagattgaaaaatactatcagaatacagaacagagtatagagattaagtgctagctatttatacatcaagaaacatgaattattttgatggctgttgttattatgtaacataacagtaactcccccaaatacccaaacaataagaaaatgtaaattatctattttaactgttaactggacggtggaggtgagtgagattcactgattgaatggtacaaaaggcattatatttaacatagaaagttgtacattttttacaatcttatttatgaacacttgcattatggttgaaaatgaaggctttcatgaaaataagcctatataaatatataaaataatatgcaggacacatgtgacccttatttattccccattagttttttatagtttgaacgtctaatagtttcgattttttcatctgaaaatgtgcaatagtaatgtgttagaacaaacatttgtgaaacacttatatcacaaatgctcaatatatattggtttctcattgcaataaatgactgcaaagtcattaaaagtaaaaatcattgacataaatgcaaagatgtgaaaaagtaaattgactctcacaagtcacaatttaaaatatctatacacttctatttttaaatttctttttagaataaaatgtactaactctatccattatgctccaactacaattgcatcataattaataattgatgtattttctcgctgtatccattccatatatttccaggagagctattttgcttgccaaatattgatataagcaaataaacttaccaaatatttctgattttttattatcactcacccaatcaaggtacaatttgagaacaacatttttagcatatattaagcagaggtaagatcatcatcttgtcaaagaaggattttagtatatctttttagagataatgtattgcacttttccaagtgtcatataatactttgttaaattttaaattgaagtattacattgtgaagccacagaactccatgattatagataaagtgcttttcttagcaaagcttaactgacatgacaaatatatagttttttattatctctgagaaatatgcttttttttttttttttttttttttttgagacagagtttcactctgtcgtccaggctacaatgcaatggcatgatctcggctcactgcatcctccgcctcctggattcaagcaattctcctgccttggcctccagagtagatgggattacaggcatgcaccaccacgcctggctaatttttgtatttttagtaggatgggggtttcaccatgttggccaggctgaactctgagaaatatgctttctacttttttgtttaatttgaacttgaaaacaaaacacacacaacttcccaattggattagactattaacatttcagaaaggatgtaagaaaggactagagagatatacttaatgtttttagttttttaaactttacaaacttaatactgtcattctgttgttcagttaacatccctgaatcctaaatttcttcagattctaaaacaaaaagttccagatgattttatattacactatttacttaatggtacttaaatcctcattaaaaaaaacagtacggttgttaaataattcttccattagaaattctgagcctttactctgtgtcaggccttgtggtaggagctgggcttcagaaataagtatactgcaatctgattccgggaaatatttaggttcataaatagataattttaacataatatagtaagggaagatggaggtatagaaagggttttcacctctggagaaataagaggggtatttagaataggtctcttaactaagaggcctaacatttttgtctgtgaatccataatattggcaaactaataatgtgtacacaccactgacaacaatactttatcctttgatgaataccctacaatggtgtgattgaattggcttccaattaatttcaaattctatatatcacgaaaaggtagatatataccagaaggcatctcactctgttgcccagcagtgcagtggcacaatcatggctcactgtagcctagaactgctgggctcaagtgatcctcctgcctcagccttcccagtagctgtgactataggcatatgccaccactcctggacttggataatgttttattagaatcatatagcataatgatatcttttgttaacctctcaacatcagtatcatctttgtgaagtgagagcgcatcatcagattataagaaatgacaggaggactgtatacttgggaaagttttgttcagtgtcttgagaattaacaaatatttatttttctagaataacttgaatgtaagctcactagaatgtaagctctatgatggcagcagtcttgtctgagttgttcacttgtgtttctgtagttccttcaacaatatctagcacatagaaggtttttaataaatattcattcagtgaatttctacttaatgtagcaatcatttgtctattcccttagtaaagtctaattgatctaggtatcttacaaatatatacaagacctggacatgataactaaggtagaatttttttagctaattagctactggaaaactcaaattagtaattatatatatttttattatatacctgtatgtgttattatatatttatacctctatctattagactcaggcaagcttgagaaagttgttgtttgtattctaaattctgtattcaaaatagtttcaatctggcctgcagaaaaagttgaattagtctcaatataaatacaacaaaacccttattgccaaggagaggcatataccatgcaaattctgatctgagggaatttcaattgtttcaaaagccatgatatttgggttcctctggattctagcattacataaacaggaagagaggtgaaaataagcagtagtgatataaagaagtttcaggatggcaatttgaaatcacgtattccagctcaactttctagaaagtgacacctgcagctttgtgggggtgtcttcatgcacaagctaaattgtacctgttccaaatggccagatgcacctatactctgaatgtgggtatacacccacatttaccaagcattttaaaatatgctctttaaagcatagttttgtatccattctgatgacttctagcctgtaaacacaggacccgtgttaatttaacttttagtatcacaatagaatgacattttttaaagtatagttatgatggtatcatacaaccagaaatctagatgtgaatgaggtatttcactcacttttgacctcttctgctttactcctatgtccaaaaaaagaaaacaaggcatggaggtatatttctggcattataggtgggtgaaaggcacccactatgagctctgagccgaaatgtttgccacaggcttaaataactaattaggcttggggaagagaatggctacttagagacatacacctataaactcgggcatatttacgctagcatattcatttaccacagaatttatttatcccttatctcttctctcatgatatttctgtatttttcttcttgggcagagccaagttttgtgagtttatttggtcattttctgcatgtatccctactcctgctttttttttccccttcagatccacatgcagctcaacagaggacataataatatatctcttctttctcactctcttctgttcttaccatcaaaaatattcctaaaccatctacctctccacctttttaatcagttttacctatttcatttttgaaaataagaggaattatgccacacaatttgtatatatatataaatttttatatatacacatatatataaaaatttatacttacacatatatatatatatatccattaaattgctaatattatcacatcagccactttactaaacaacatgatcttacttggacccaacaaataattaattctggtatgttatttttaacatctataattatataataataataacactaagaacaaaaacaacaataacgacataatagtttttgcaaataaaattgatattcaaggcagaaagatatacaactttgtaagcatagtaaagcaatataacccttcttcttgtaaaaaagcagaaaaaagttttcctgatacataaacataatagtttataactgatgctagtagatgaaagaatagtcaatacattcttagtacttccaatgctaagaacttgcccaaaagagataggagagatccttgtcctgaaagagtaatgagaacatcagagtcaagttagtagagaggtaaggacatgaattatttttggagtagatcaactaattatatgatttgtaacaataaaacttaaaatataatttgtatttcctaaatttctacaggtttttccctccacatatctttacgtcacatattctgcgctatttttcttccttgcatttattgtgatgaagctgtcaagtttatgtcagaaataggcatttacaatgaacaaaacctacactgtgaatctggatgcaggatgaagttatgcgcatctaggaaataacatgctacatcctgtatcgatgatcctgaaagatcttcgcatttacaatgaacctgtcatcagtagaacttaagccagatgtcagaaagagagtccagagaccgtggttctctatgtaatacacagaatggaaatggcatgaacagtgacactgaacttttgtgccctgtctcactatcatgcgtgcccaggagaccttgttctaagagaaaaagaaagaaagaaagaaagagagaaagagagaaagaaagaaaaagaaagaaagaaagaaagaaagaaagaaagaaagaaagaaagaaagaaagaaagaaagaaagaaagaaaagaaagaaagaaagaaaagaaagagaaagaaagagagagagagaaagcaagcaagcaagcaagcgggcatttggtccttaggacatttagtgaaatgacaaatggaagaacaattaatgacaactgtgagttttggtgcagatcgtagggaatcctaagctgagaatttgacagccaaatgactataattaactacgaaaaggtcaactagaaaaaacaaggcacatacttaagcagactcttgttaagcttgtcttgtggtctgttttgtgatctattttcatatgaactgaaacaggtctaactttcaaaaggaagaaaggtaaaatatgagtgaccatattttgtctattcatattcattttaaaaatatggcttaactgttattcccagaatcgtagttcaaatttcattaaagtagtttaaaagggaaagaggaggagaaagacagcaaggagaaagagaatgcatactacatataaatcgcactttgaaaattccaaggtccctcgtaaaattatgaagaagtgaaattgagcaagtatagtgcattcctcccggtattgcatttccagaagtatgttgtatagtcctaacagctttatacaagagatttggcttgttgatatcttgtattcagtctctatttttagttgtgtatttatgtatttatttttattgtctatatttaaggtgttcaacgtgatgtttttgtacacctctgcgtagtaaaaagatcactacagtcagacaaaaacattaacctacccatcacataccatagctaccattttttaaatagtaagagcgcttaaaatctactctcttagtaaactttttgtatactatacaataatattaactatagacctcatgctgtacatcattataactctagacctattcatcctacatagctgcaactttttactctgtgaccaatttctccccatttttttcctctccttacgcctgataaccactgttctactgtttatttctatgtatttaactaagttttagatattaaatatcattgagatcatgcagtatttttctttctatgtttggcttatttcacttaggataatgtcctctagactcatctctgttattacaaatggtagtttatccttttttaaagctgaataatattatgggatatcaagaagtcccaaattatttatagcacaaaaatatggtttatgttggcaatagctggcaggaagctccctggttttgaatttaatataggcaaatatgcactaatcggaaaactgtagtctttaatggtgacaagtcatactctttcaaagtttacattttatcatcaaacttacattattttagctgcttataagaactactgtgagctatgattaatttgctttcaatttttacattttctgtatttattattttttgtgctaattggctctgagcctctgggtacaatttgaagaattagaaactacatttctacaataaagtaatgagccacttaaactttgatgtaacccacattatattaggagacaatatttttatatcagtggctgtgacaaacaagtggctgtaattcaattagtttgaatttgcattttccagcataacaacctttattatgatattatcttcacatctgagtagctagatatgaagtattcaaataaatttctatgcacatttttatgtcacataatcattttattttgttctctctcacaatttttcatagtaaaacatgtttgctttggagaaagctgtattttttgtgcattactgagctgaagtaaaactatcattatgtcattgattagaaattgaggtagcaaaattctcccccagctgggtgcacaattgtgggaaagtgtgtttcagatccatctctgtgtacaaaaaggaatggaatgtactttgtcgagatcattagtgctgactacacatatgtgaaaattcagaagagataggtgcttgatgacaaatagaacttatgaaacaagcattagtgggactaatttttatagataattggaacaaaatttcctaaactttttctttctgttccttatgataatctcttctttcattttccaacaagcctgctgtgcatttcttaaatttatctaccacataactgagtgacagtttaaaactgagataaagcttgagaatatgcaaacatctttataaaacatacttgagagcccgttattatttttttattttttattttttattttttatttttttttattatactctaagttttagggtacatgtgcacattgtgcaggttagttacatatgtatacatgtgccatgctggtgcgctgcacccactaatgtgtcatctagcattaggtatatctcccaatgctatccctccccactcccccgaccccaccacagtccccagagtgtgatattccccttcctgtgtccatgtgatctcattgttcaattcccagctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgagttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgatttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgtttttgacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagccttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccacatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctattgttggtgtataagaatgcttgtgatttttgtacattgattttgtatcctgagactttgctgaagttgcttatcagcttaaggagattttgggctgagacgatggggttttctagacaaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttagtgaggatttttgcatcaatgttcatcaaggatattggtctgaaattctcttttttggttgtgtctctgcccagctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcaatttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtcattgttctcgttggtttcaaagaacatctttatttctgccttcatttcgttatgtacccagtagtcattcaggagcaggttgttcagtttccatgtagttgagtggctttgagtgagattcttaatcctgagttctagtttgattgcactgtggtctgagagatagtttgttataatttctgttcttttacatttgctgaggagagctttacttcccactctgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgctagtctgtgtcttttaattgcagaatttagtccatttatatttaaagttaatattgttatgtgtgaatttgatcctgtcattatgatgttagctggtgattttgctcattagttgatgcagtttcttcctattctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgaaccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagatttgttctgttgctggtgaggaactgcgttcctttggaggaggagaggtgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcagcctccttgagctgtggtgggctccacccagttcgagcttcccggctgctttgtttacctaagcaagcctgggcaatggcgggcgcccctcccccagcctcattgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcctcctagcgagagcccgttatttaatgttgaatattgtatgatttttctaaatgtgagcaaataatataattataatgttttcttttttcaaactctgaattatgtaaaacaaacatatattttgtaagtatctatttaaaacacagctatatggatgcacattgcatatactaaaaggtcataaatacagatcacactgtatgagactacagtaaagttcagtgagataatttacttttactgcaatggtaatttttttttttaaattgtaaagtttcattttagtaagaacttcaaagcaagatgaataagccctagagatctgctgtacattgtgtctatagtcaacaataccatattggacacataaaatttaagaaggtagatctcatgttgagttctctgactacaataaagtacaattttcttaaaagttgttatcagtaagttatagcattggaattctaatgtaatgaacagggcagttcatacatcttttttttttttggtctccttagaagtcaataaggtagtaatgtgttcatttctaggtcaaaacccatttttaggaataaagttatgagaagctttcattcaagacttagactctgaagaacgcagaaacgagagaacttcagtagtaaaacttacataatgtttgcccccttaacttttttttttttttttgagatggagtctcactctgtcacccaggctggagtgcaatggcatgatctcggctcactgcaacttcctcctctcaggttcaagcaattctcctgtctcagcctcctgagtagctgggattacaggtgcacaccaccatgccaggctaattttttgtattttagtagtgacggggtttcaccgtgttgcccaggctggtctcgaactcctgagctcaggcaatccaaccacctcggcctcccaaagtgctaggattacaggtgtgaaccaccacacccggctgctcccttaatttttatatccctctcttgccaacaggttttttttttaaggttattttctttcccttcacaaggctatgtgatgtaatgcaaaggaaaatgagaagcatctgctgaagagttaaacacccataccaaaagaaccatttcgctattttgcatattatctattctaaaggtagttaagagatcctcaccctgaactcaaaggcaattcaaaaatttccttaaacaaaatcagagtgcaattattggacatgaaatagtaaagaggtataagttgtttagaacattttattttaaaataacatgaaagtcatgcatatatggtcagtcctaagtccttttcatgttatttgtgattcaagagatatattttgtcctggcctctcaataggatgtcagtgcacttttgtcttctctgcatgaactgccaagcagtttaacagatcagaacatctagcccctgttaggagtattaaatatcactgtcagtttattctatgaaaaatgaagtgtatgtcagcggggctgtcatgctatatgtacaaacagttgaccttccactttgtttcaggaatgaggctgatatttgattttctttttttttaatcagccttgtttttgccagtggattttttaggccggcaccactgtaatccattatttctcactaacaatactgaatttacataaaacattcaagaaaatgcattgatctacagctatgtcctctttttgaaataaggcaataaggcatcaggggctgaatagttgtgaaagctctttgacctgaagtatcagtaaatgcataagatttatgaatagttcaccagtatttgtcagcacaacagaacataaacatttgtattgctgggtgctcattttacagttgtttatagagactacagggtgccattctactgtcgacgactctgcgctagatacaaaagtatcactacattgggattgtattttcctatagccaagtaaattcatgtgataagatgtaaactgaggctcaaagatattaggaaacttggttgtagtcatacagttttacatggaagaattgatatttaaaccctgatttgccatacccaagagttctttcctctgtatggcataccagatttttaatagtgaggttccttgaatatttacataaaatatttatatactgatacaatcctttatttactattctctttcatcaactcaagcgaattgcttagcataataaaacctccataaatctgcataccatctctttccatactgatttctccagttgcccctcaatcccaatgctttaaacaatccagataatcttaggttcacttaatgattcatgcggcttcatgtgcctgcttatatgctattctgtttgaatgtccactttgaaaacacttctcatctttcaacacacagtcgcagtcaatttttttttgtaatgctttccatttctcctccttgaggtagaattgagcactctctcctctgtgacatcactataccctatatggactgctgtcataccagctaagataaatttattatgtattttaacgagtttattgagaaataactgacaaattacaaattgtccatatgtaaagtatgcaattcggcatatcagtaaacattcgaaattatcaccactgtattattccattttcatgctgctgataaagatatacccgagactgggaataaaaagaggtttaattagactttcagtttcacatggctgaggaggcctcagaatcatggtggaaggcaaaaggcacttcttacatggcagcagcaagaaaaaatgaggaagatgcaaacgcggaaacccttgataaagccatcagatctcgtgagacttactcactaccacaagagcggcatgggggaaactgcccacatgattcaaattatcttccaccgagtccctcccacaacacatggaaattatgggaatacaattcaaaatgagatttgtgtggggagacagaaccaaatcatatcaaccacgatcaaaatactgaacatatttattattcctagaatttttttcattttcccagtacctactgcattgactaccattttagattttatcagttaattggtaaatatgtattgactgaaataactttctttggcaatataattctgtagtatatataaagtaggggttcattgtctatgatatagatgagattggttttaatgcttgaaaacatgcaatttatatgagaatctttaaaaattaggaagtataagagacaaaatatcaatttctttctcctacatttaagaacaggtagtctcttcaaaatcccagaagttgagccttagctgaggtttagtgttttctaaacaggcttaaaatggaagttgtttaattatataataattatgcaaggaaaaatgtggtgatgaagattaaacaactcttttatataggccatctaggaattaatcattggaggaaaagtaactcttaggttttagagcatcaattagtaaactacaggtgtatcattcctagcagctagtaaataggtgaaggtggttgcacaagccttttttcagagatgtatattctttgactttgggactactattaaatatgcccacacagaaagcattccatgaggacgacaatggattatggaatatggcaaaaccaaaattatgttaatgtagaaaccaaagtaattccacctttctggggacaagcccagatatgtaaacatactgcttatctagctacatttatctttcactatgagtccctaaaatgttataccgcaggtatgttaagtaactaacttctaagaatgcactataaactcttcttacatgcctttgcagtaccctcacctagaatgcttttccacccattcccatatccctttgcctagttagttctcagtcattagctctaattttgaagttgactcctctaagaagacatatttggccaaattacttgagactcttacctttgtgttccatagcactctgagatatttgtgttaaagaaaagcagatttgggcaatagttaaagtggtaaagcagattttattcaggaactattgtagatggagaaaagaggcttcagtatggcacttgagctcagtttcaaatacagcaagggcaagtggagatttatagccaaggaggaagttgttgggtgaagcttggtggatggaaaaattactaagtgtaggggaaattctgcctaaattgacctaacagtattcttgtggaatctttcaggtcaggtgatatggaaggtaagagattctgactaaaactgggctaagcagttcttaagacaaggctgaagaacaaggcctaatcaagaaaggtcttaaaggagcctgaccaaagtttggtcaatgagagactctttgtttctatcataacattcatcacactgtactgaaataactttgtaagaattttttttttacatataccccactagactggaagcttcaggagggtagattattctttattcaatattgtattcctcacaaatagcaacatgcttggcacatgcaatcaatgtttgttgaattgaaattaacttttaaagtacagagtataagataaatgtaagtgactatttttaaaatatatagctttagtggttgatattcattaggaattagataccagcattctacaatcaaatgataaatcctttgaagtataaacttctgattgatgtgtttatatatatttagtaattatgaaaatggaaactagttattttctgatctatcactgaaacttttcttaatagtatggctttgtttcaaataaccattacaatagagaatgatcttgtttacattagaaacaaggctaatataggactaaacagctgtcttaaattatttgtaatcaaaattttgtctgatatgctgtcgtaaatgttgctatgcccttatttgtttcatgcagatattgatcatttaagaataatatctgcatgatgacaaaatgcctgcttaatttgttaagtgagagaaaagtcaaactttttgatgaacagtttattaactttttgcaattatttatttattgttttgttatttggtaaagacacactctctgttggcttaaactgtaaactatagcaaggatttgcatacactttaatgggaattctataatttgaccgttatttcagatatccacaattaatcataccctgtgacttttccttttctctcttttaaagtgattttatgaatgtatgctccttaaaagaggtagttttgcttgtctttagttgagtaacattagtccagcaacaaaattagcaaaagtataatggtaacttgcaaagtttctataacaacgatgctatcctattgggaccacatggtatcacatatgttatgccagattactcactcttaacagacacctgtggttcattaacaaaatgtgctggagtatccctaattatacaaacaattgatagtttaaaataattttgctacatttttataataggggcttcttttccttaaatattctgctgcccagtttcttaaaactaaaaaaaaatcatgacaaaagaatgaaactttaagtcaggttattatattggccatatagttaattttactatatattagtaactaacatatagctttaagttgacttaacctacctttaaatcaatacaataatgtagcaattatgaggctgttgcaaactataaatgtattgcatacttctacaatatgtagcacttaaaactcataaaatgtttaaaagcaaagatcacactcatacataaaatacaactccacaataagaaataaaaaatataacatgaagtagtgattgtaaaatacccaatgaaagataaatcccttaacttgaatagcagcctatttgttgtttcattcatattgtcatcaacagtatattataatattataatattataatatctattataacaaaacttgaaatatcttgagtatattcttagataacttgagcggctgcagatcagcataatatttccagctgattatttaaaagcgtcctaaaaagaaatccgcagacagttttatttgtttaccaccttgaaaattcttcctaaatctattaaatatcaactaatattcattgtagttcttttcatattaaagtcaaaatcatttcaataaactgaacaactttttgaaaatcagaatatagaagttctgtgatgtttgtctcagtaactatgaccatttacctataggaaaaatttactcatcaatatgatatctaagttaatttagatttatgtttctttatgtaaataaatataaaatgattgaatatctgattctatattaatataatttttcacttgtagtaatttttgcctagataaaggtggtggattaaaaaaataggaagactaaaatagatggaagtgcctctcctcatctggagtttgaaaaaaaaaaaaacaaaaaaacagtggatagttactaccatcacctttaataaaggactttagaaataccttcctgactgggtacggtggctcatgcctgtaatcttagcatggtgggaggccgaggcagtcagattgcttgagcccaggagttcaaaaccaggctgggcatcatagtaaaaccctgtctctacaaaaaaaaaaaaaaaaaaaaaggtatcctagtgtggtggtatgtgactatagtcccaactactcacaaggctaaggtgggacgaccacttgagcctgggaggtcgaggctgcagtgagccatgattatgccagtgcactccagcctgggtgacttaaagagatgatgtctcataaaaaaagaaagaatgaatgaaagaaagaaagaagaaagaaagaaagaaagagagagacctttacctccaaaaggaaggcaagaagtaattacaatttttctctggcatttctaatgctagttctggtcactgtactgtaaatatgtattttttttttcaattccaaatccagctcttcactatatttgctgtgtaacacacatttctagtgcagatattgtattttataggggcttatacaacttttcttaaaattgatactaagctaagacattctttgacacacagaataaaatcagacttccattgcaatcaagatgtaaaatgttttaaagttattgcattctacttttttcatatgactgttaaaacaatttatcttttaaaagatcatatttcagggatctgaattctattgtagatatctctacttaacagagtttaatttggtgaaaatatgacacgaaactataaaaatcaactgatttctcctaccttttttaccctttccacaacatcaatttctacacttaatctagaaaggtataaaatataatggaggagtaaatatatttccagttggttttcttttaggaaacacagcaaaaccctttgtttaacatcagggatgatctaaaaggaaatcctgtaagtgtgagaggcaatgtcagacacttgtaataacatataagtctgagagatggagggaagatttaagcagaaaactgaagagtatgcaagattaagacatccactcaaaagcacacagctatttgctcctgaatgactcttgggtaaataatgaaattaagtcagaaatcaataagtttttttaaagtaatgagaacaaagagacaacataccagaatctctgggatgcagctaaagcagtgttaagagggaaatttatagcactaaatctcaacatcaaaaatctagaaagatctcaagttaacaacctatcatctcaactgaaataactagagaatcaagagcaagcaatccccaaagctaacagaagacaataattaaccaagatcagagcataactgaaggagacagagatgtgaaaaacgcttttaaaaaaatcaacaaatccaggagctatttttttgaaaaaaataataaagtagatagactactatctagactcataaagaagaatagaaagaataatcaaatgaacacaatcagaaatgataagggggatatcaccactgatcccacagaaataaaaacaactaccagaaaatattgtaaatccctctatacacataaactagaaaatctagaagaaatggataaatttgtggacacatacactctcccaagactgaaaggaagaaattgaatcattgaccagaccaataacatgttctaaaattgaggcagtaataaataacctacctactaaaaaataaatcacaggaccatacagattcacagtggaattctaccagaagtacaaagaagagctggtttcattcctactaaaattattctgaaaaactgaagaggagggactcctccctaactaattctctgaggctagcattatcctgataccaaaacctggcagagatacaacaaaagaaagaatactttagaccaatatccttgatgaacatcaatgcagaaatcctcagtaaaatattggcaaacgaaagccagcagcacatcaaaaagcttatccaccatgatcatgctggcttcatccctgggattcaaggctggctcaacatacacgagtcaataaatgtaattcatcacataaacagacaaaaaccacacgatcatttcaataaatgcagaaaaggccttcgataaaattcaacatccttttatgtttaaaactctagatacattaggaattgaaggaacagacctcaaaataataagaaccatatatgacaaacccacagccaatatcatactgaatgagcaaaagctggacacattccccttgaaaactggcacaaggcaaggatgccctgtcaccacttctattcaacatattattggaagttctggccagggcaatcaggcaagagaaagagataaagagtattcaaatagggagtgaggaagtcaaattatctttgtttgcagatgacatcatcctatatctagaaaaccccatagtctcagcccaaaagcttcttaagctgataagcaacttcagcaaagtctcaagatataaaatcaatgtgcaaaaatcgctagcatccttatacaccaacaaaaggcaagcagagagcaaaatcatgaatgaactatcattcataattgctacaaaaagaataaaatacttagaaatacagctaacaaaggaagtgagggaacacttcaaggacaactacaaaccaccgctcaaggaaatcagagaagacacaaacaaatggaaaaacattccaggctcatggataggaagaatcaatattgtaaaaatggccataccgttcaaagtaatttatagattcaatgctattcccattaaactaccattgacattcttcacggaattaaaaaaaaaactattttaaaattcatatcgaactaaaaatgagcccaaatagccaagttaatccatagcaaaaagaacaaagcaggaggcatcacactacctaacttcaaacagtgctacaaggctgcattaaccaaaacatcatggtacaagaacagacacatagaccaatggaacagaatagagaactcagaaatgagactgcacacatacaagcatcagatctttgacaaacctgacaaaaacaagcaatggaaaaaggattccctatttaattaataatgctgggagaactggctaaccatatgcacaaaattataactggactccttccttacaacatatataaaagttaagatggattagagacttaaatgtaaatcccacaactataaaaagcctagaagaagatctaggcaataccattcagggcatagcagaggcaaaaatgtcatgataaatcatcaaaagcaattgcaacaaaagcaataattgacaaatgagatctaattaaagagcttctgcacagcaaaaacaaacaaacaaacaaacaaacaaacaaaaactatcatccgagtgaacagatagcctacagaaagggagaaaatttcttaatgtagccacctgacaaaagtctaatatctagaatctacaaggaacttaaatttacaagaaaaaaaacaaacaccttcataaaaaaattggccaaaggacatgaacagacacttctcaaaagaagacatacatgtggccaataaacatatgaaaaaaagttcaacattactgatcattagagatcctcaaatcaaaaccacaatgatataccatctcataccagtcagaatggctattactaaaatgtcaaaaaacaacagatgctggtgaggttgtggagaaaaaggaacgcgtttacactgcctgtgagagtataaactagttcaaccactgtggaagtcaatgtgacaattcccaaagacctagaggcagaaataccatttgactcagcaatctcatgactggatatatacctaaagaaatataaatcattctattataaagttacatgcatgcatatgttcattgaagcactatttacaatagcaaagtcatagaatcaacctaaacgcccatcaatgataaactagataaagaaaatgtggtacatatacctcattgcataccatgcagccataaaaaggaacaggatcttgtgctttgcagagacatagatggagttggaagccattatcctcagcaaactaacgcaggagtagaaaaccaaacacagcatgttctcacttataagtgggagctgaacaatgagaacacgtggacacatggtgggtaacaacacacactgggcacctgtagggttggggaagagcatcaggaagaacagctaatggatgccgggcttaatacctgggtgatgggataatctgcgcagtaaaccacgatggcacatgtttatttatgtaacaatcctgcacatgtacccctaaacttaaaataaaagtcaaattaaaaataagaaaattgaagagtatgaccatgaggtgggatgagggagagttctgggcacccaggttcagaacagcttttccacagtttcagagctaaaccttcatggtgtctctgaatgtcttcatttgaatcaaatgctccaaatcagcaaacacccaagatcaaaaaaaaaaaaaaaaaagacttcttaaaaatgcattccagagcacaatatctgtcttcatattatgaatgtttttaaaaacttttattttgagttcagggatgtatgtacagatttgttatatagataaattttgtgttgcaggagtatggtgtacagattatttcatgactcacatagtaagcatagtacctgatagtttttcgatcctcactcttctctcactctcctcccttaagtaggtcctggtgtctattgttcccttctttgtgtccatgcatccttaatatttagctcttacttgtaagtgagaacatgtggtatttggtttcctgttcctgcattagttcacttaggataatgacctctagctccattcatactgctgcaaaggtcacaatctcacttgttgttatggctacatagtattggatcatgtatatgtaccacattttccttatccagtcaaccatatatgtaccacattttctttatccagtcaaccatggatgaacatttaggttgattccatgtcttggttattgtaaatagtgctgtgatgaaaatatgtttgcatatgtttttctggtaggaggatttatattcctttgtgtatatacccagtaatgggattgctgggtcaaatggcagttttcctttaagttctttgggaaatcaccaaactgcttttcacagtggctgaatgaatttacactgccatgagcagtgtatatgcattctcttttctctgcagcctttcaagcatctgttattttatggtttttaataatagcctttttcactaattgtggttttgatttgcagttctctaatgattagtaatgttgagcaatttttcatatgcttgttggccaagtgtatgacttattttgaaaagtatctgttcatgtcctttggccacttttgaatggggaatgctttcagcttttgctcaattagtatgttgtttttttgtttgttaatttgtttaagttccttatacattctggatattaggcctttgttggatgtatcatttgaataaattttctcccattctgcatgttgtctgtttattctgctgatagttgttttttttcttttttcttttttctttttttttgtttttgtttttttgctgtgcagatgcactttagtttaattaagtcacacttgtcttttttttttttttttttggcaattgctttcggtgtcttcatcattaaatttttgccaaggcctacgtcctgagtggcatttcttaggttatcttccagagcttttgtagttttaggttttacatttaagcatttaacgcaacttgggttaatttttgtgtatggtataaggaaggggtcctgtttcaatcttctggatatggctattcaattatctcaacaccttctattgaatagggagtctttcctcattgcttgtttttgtcaactttgttgaagatcagatggctataagtgtgtggctttatttctgggctctttattcttttccattagtctctgtgtctgtttttgtatcagtactatgctgttttgattattatatccttgtagtgtagtttgaagttggataatgtgatgcctccagctttattatttttgcctaggattgctttagtcatttagactcttttttgattccacataagttttagagcagttttttgttttctaattctgtgaaatatgtcattagttgtttgattggaatagcattgaatgtgtaaattgctttgggcactatggaatgctttctatgtgctgtgtcatctctgatttcattcagcagtgtttcttaattcttgttttggcgatctttcacctctgattacctgtattcctagatatttcattctttttgtggttattgtgaatgttattgcattcttgatgtggctctcagcttagatcttgctggtatatagaaatgctacttatttttgtacactgattttgtgtcctgaaactttgctgaagatatttaccagatatgggaacttttgggcagagactatggggctttctaggtatggaatcatatgatctgtgaacataaatagtttgaattaatgtttggataaacatacattcttttttaacattatcttttaaaaacattatcctctttttttatttggatacattttcttttcttttttttttttttttttttttttgcctaattgctctggctaggacttccagtactgtgttaaacgggagcagttagagtgaagttagagtgagcatccttgtctggttctggttttcaagaggaacacttttagcttttgctcaattagtatgatgttggctgtgggtttgtcatagatggctcttattatttttatgtaagttccttcaatgcctagtttgttgaggattttttaatatgaagggatgtttaattatatcaagagccttttctgcatctattcagatgatcatgtcatttttgatgttctgtttatatgatgaatcatattttttatttccatatgttgaaacaactttgcaccacaggaataaagcctacttgattgtggtaaattagtttttgatgtgctaatggattcagtttgctagttttttttttttttttttttttgaggatttttgtatctaggttcatcaattatacttgcctgaaatttatttttttggttgtgtttctgtcaggctttggttcagaataatgctagtatcattctataattttttggaatcatttcagaaggaatgatacaagctcttctctatacgtatgttataattcatctgtgaatccacctggtcctgggatttttctgtttgttaggcttttcattactgattcaactttagaactccttattgggcttttcatgttgcaatttattcctggttcaatcttcagaggttttatgttgccaggaatgtatcaatttcgtctagattttctattttctgtgcattcaggtgttcataatagtctctgagggttttttgtatgtctctgtgttggtattaaagccccctttttcatttctgactgtgcttatttgtatcttccctctttttttctttgagtctagctagtaatccttcacacttatttgttctttcaaaaaacaaacttctgaattcattgatcttttgtatgttttcatgtgtctcaaattcattcagttcatctctgattttttagttatcttttgtcctctgctagctttggggttggtttgctcttgtttttctagttctctaggcgtgatattatgttgctaatttgagctgtttctaacttcttggtgtgggtgtttagggctataaaagttccttttaacattgctttaatagctgtgtcccagagattctggtatattttatctttgttctcatcagtttcaaagtgcttcatcttccggtttatccttgctactgtcctctgttgggctagattggtgagagctgactctattttgattttttttaaataagatgcaatatttggaaactgacattatattcatttataatcaaaatatgcaggacaaagttcagctaaatcatctggttttacgtttggatactaaatatgtgattgatactgaaagaaaaacttatgtgggaactattgtttgatgctggccttgaaatgaacaggaacaggaagcactgctttgagctagcatgctcctaagagaatgggaattcaaaggaaactaataggaaaataaaatccaaaaaagaaacaagaatattaatattgaaccacaggaacattttttttttaacagagtcctcactctgtcatccaggctggagtgcagtggcagagtcttggctcactgcaacctccacctcttgggttcaagagattctcctgcctcagcctccccagtagctgggattacaggtgcccgccaccatacatgactaatttttttgtatttttagtagagacggggtttcaccatgttgaccaggctggtctcaagctcctggcctcaagtgatctgccgacctcagcctcccaaaatgctgggattacaggcgtgagccaccgcacccagtcagattaattaaattttatcatttatatgcatgaatagaaaaaagcatagtatatatagtgttcagtactttctgcagttaagatagtaactctactttgtttttttttggttttttttttttttgagacagaattttgctcttgtagcccagactggaaggcagtggcatgatctaggctcactgcaacctctgcctcctgggttcaagtgattctttgcctcagtctcccaagtggctgagattacaggcacatgcctccacacccagatagcttttgtatttttagtagagacggggtttcaccatgttggccaggatggtctcgtgatccaccctcctcggcctcccaaagtgctgaattacaggcgtgagccactgtgcctggccaaaccacaggaccttctttaatactaacacatttcagccctttcaaagtttataatgctttattgatattttaaaaatgatataaagctaagacttaaataaacccattattataaatcaatataaaaataaatagaatatggtaaaattaaaaatagcacttgggacagaaatacacccacaattttaaggtaatatgcctgaaaataattttgtatataaaaaattttgaaacaatatatttctaaattgcctgaagcacatgcaattttcttatttaatattaagatcataaaaattaattttaaaagctttatttcctgcctcaatggattattcatcatttgaaaagtgaagagttttgcccacatgagacgttgaccatttattcatattggctatgaaaacaaaaggtctggtattagccactgctctgcaattatgattgttaagcaaaaattaatgtttatattgggaaaaatactttacagccacctatttttattcactctcatagcaatttcccagggaaacaagacatctcaaaattaaagcagcaacaaggaaattgtttatgaaggtgaagatgaggaaagcaaaagtgacagcagttacagaaagcagcagttgctcttgaagttaagctgctctgtcacataccatcaattggaccattatccagtgcaggaagtctgtaataaattgtaagatttgcttctcagctcaaatgatgggatggaaattttcactgtagatgatgttgaagtggaggtacagctgaatgggtataccagattggcccatgttttaaatcctacaatgattgacactctggcactagacatataatttcttcaaataaattgtaactcaagaatctggttatcctgattatttaaggataaaaacatcacataaaaagttttaatagtgacaagaaatatttacttttctgagacatgttcttataattctgcaaaatgatttctgtttcagattctcatcttctttgagataagtattatttaaaagcaatctgagtttcttactgataacaccttccctgttatttattataagagctaatattgtctcagtaatattttgcctacttgtttgttctgcattttaagaagggcaacatgacatatgtggggaaacgtgaggataagagttaggtgatctggtttgttgtctagattctgatttacaggtgatgcttcatagcagttactttgcatcctttcctctgggcaaataattgttcagctagccaaaaatcaggttcataaaagcttctctgtgcaacttataaaattatcggtataaaggaacaacttattcttgagatagcttgttaattttccttagtcatatgctcactggagccttaatatcttttcctttttctgagactaatattgaaatatgcccacatttataataaacaattagagtgagaatctagcttgaaaattatagaatatttaataatgtaacaatatgttgtccatcttgacattttaatttggaaggttataatggtcaggcttgtgtgaaaacaaacctgtagtatacaatttcagggtgagtgaaataaaatgtttattttattcagaacaaacctgtatcttgttgtagttgaaatttataacttactgaggacaacattgaaatgtaactaacagggatcattaccaggctatgacatcttgtctatagaggtatcctaagctgacactgtatttcattcatttggtaataactaatgaaggctgttttcccctcttcttgaatagcaacttgtggataagagaagcactttagctgtgtcaacatgattaaaaaagttaaataaaagagagacaatcttgcaaatgccagtccctgtatcttttaaagtaactatcagtataaattcaggaaggggtttttgtctgaattgtcctggtataataattgctacaaatctctacttcttaacctatgaagctgtaacctaagggcatttagtgcattactgtcaattttcaaggcactaaattatcccgaagagaccttgaaaagaggactatgctgctgcagcaacctcacttattatccagtagggattcaggttttggggtggatttgatttagtattcctaacaatgcctccttgtgttaacagactgtatcttggatagttctagaaggtgcatgttctcttaatagaactctcctgcttttgtattcaattagattattaaaaaattcagtttgtcttatcctaattcatctccagatttttaagtacgacttccccaaacacatcagattcactctgctttttaaattactgtgcataaaaggtattattaaattatggaaattcatcctcagactttcaattatctcaagtttatctctaagaaataaacatttagcaataccttttaaagttgccgaatgttcagactgcagacagaagcactgagtgtggttggtggtgctatagcacctatagtttccccagatgtaatttaggaatagaaaaggatggcctgtagaaattccttttctgaccagtatcttcacaggtggccaatacacattcatatgcaatctcactggagagattagtacacctgtgatatctattagtatctgtgatatctattagtatctgcgatacaggtctgagatgcatttctgcggcagctgtgtaattttagaattctcagtaaattgtattgactccaggaagagacagttgcatggacggtgtcattaaaacatgtcactggaagttacttccatcagaagggacaacagagacgcttaaccctcacaatcacattcttaggtagtaggggggcaaataggcaatgttaatgtgactgaaaaagagcagttttggagagtcagtctgagtttgattattgtattatttagttgttagcctaatttgtttcaactgtgaaactatataatacaaccaatctcaatgaaataattttttttaaacactaagtgccatgcctgtcacagagtgttttttcaattattgattgtagctattgtttttattgctgttagcattatgattccataaagtgagatacagagaagttaactgcactagatgagaccaaaatccagtcttaattcagtatgtttctatgttgatgcattctagtgagagagatcagtggcaagacactgtttgtgaccagactttcttatattttttaggaaacaattcagtatagcagaaaaaaggcctgaaattccacaatacattatttgcttcctgatggtgtacatactattatcaaaagctatcaaggaacttccgcatttctggaagatgagggggtgcctaagggtataacagctctagcttcttgatggcaaacttagcagaaattcaatatggcctttatccgtggcatcacattgtaatgtcttgtctgtgcttctgcttaaaaatattccttgaaatatggattcttataaaatgatgctgtgggggacctcttcctcaagtataatatgtcctgttacttgctgttaaggcaatgtattacaaatcagaatttttggaagccttatcattaaagaagctgatttcacataccatatactatatgaagaccatactgtcataatagtctctttctctaaggcaccagcatattaatgcacacacctgtacttttatcagtacctctcagaaagcaaaatcattttgtttatgtgattcattgaattaaatcagtgcttcctcttatgaaaagacagacacttcatggaaagtgtaacagcttttgatgactacattttcaagatcagtagattgtagctcacatattaatactgggaactatttggggacgtaatataatgataataaattcatcagaatcctcttcatcatgttaaaatatttttagagagccaactaaaatgttttgaggagactgggtttatgaaatatgaaattgagatgagtttctcctaagaagtaaattatttagctaggaggaaattactagaaggatactgaaatgatgatatgcaaaagaaagaaaaatgtctaattaaaatcatagtatctttgcatctatacaccacaaaactgagccagcgtgtcacagtgagtgtacagagggcttgagcacaatgggaagagtaattttttaagtgaatttattaaatcaaagtcttttagatcattttgaaataaagcttgaaattttaatacaaagtagaaggcaacatcatgtagtggttaagaccatcgttcttgactaaatttttactctcatctctgcaattattagctatatggtcatgggcaagttacttaattatgcctcagttttctaatctctcaggtggagataatattagtacctacctcatggaaatgctttgaagagtaaatgagagatgatgtatccaatgtttttagaagagttcctggcatagattaggtcttcaataagggtcagctatatttaatatgaggattaattgagagagaatgattgtaaaacatttagggtggtgcttattcagtacaagttagttcttttatagttataaaatacacaaatagtatattcgtatgcttactattgttaaaatccaaacaaaagtggtaactcaatggtgaatgaatttttaatatacatgtgtacacatacccattgcaatttgaataacttaaaagtttcacctgttctttctaaaacaaaacccacaaaactatgcaaattgttattttactggtgatgacaagaagaagcatttccaactaagaaagtaacaacctttatattgtgagggtgctaaaaatattactagcaaaaataatgaagaaactttggaagtaaaaggggatatgaggcttatggaattgataagaataatgcatagtgagtaattccttaatgtttggtattacacaaaatgagaatattagaattctggccaccacataaggtaaaatttcatgaggttttctattggctataaaacatctcaatgtataaatattatttctattgaaaatcttaacaactcaggcttgaaatgagggttaagcttctgaagattcacttatgtcaacatttttttcatttaaacttttcaatttgaaaagtactttttttcccttttgtattgttattttcataaagttcttcacattgacttcttcatctttcaatacgtagttttttacagattctttgaagtataaattatataccaggaaattcacctattataagtgtacaattcaatgatttttaacaaatttacagacttctacaaccatcacaatgacccaattttagaacacttttcctcaccccaagaaagactgtggccaccccaattctgagcaaccactagtctgctttctgttcatatagttatattctgaacatttaatataaatggaattgtacagtatgttatctggcttcacttagcatagtgtttttaaggctaatccatattgtagtatgtatcggtactccattacttgttatggtggactaatatcccattgtatggacatgacatattttgtttatccgctcatcagtttgacttgtttctactttttggctactatgagcaattcttctataaacattcatgtatgagtctctgtgcacagacacttttatgttttcatttctcttggatatatacctaggagtgaaatacccagttcatatggtaactctatgctttaagacctgccaaactgttttccaaagcagctgtgccattttatgttctcaccagcattttgtgaataaggaggcggaataagatcagataaagtttagttttctcaaatcggttttggttataattattttagggcatctggcttaacagtttgaagtgatcaaaattaatacctttaaatcgcccactgggtggctcacgccagtaatcccagcactttgggaggccgaggcgggtggatcacctgaggccaggagttcgagaccagcctggccaacatggtgaatccccatctttactaaaaatacaaaaaaatagctgggtgtggtggcgtgcgcctgtaatcccagctactcgggcggctgaggcaggagaatagcttaaacccaggaggtggaggttgcagtgagccaagatctccccaatgcactccagcctgggtgacagagcatgactacatctcaaaaataataaataaatattaaaaattaatcacctggccgggcgtggtggctcacgcctgtaatcccagtaccttgggaggccgaggagggcagatcacaaggtcaggagatcgagaccatcctggctaacacagtgaaaccccgtctctactaaaaatacagaaaattagccgggcgtcgtggcgggcgcctgtagtcccagctactcgggaggctgaggcaggagaatggcgtgaacccgggaggcagagcttgcagtgagctgagatcgcgccactgcactccagcctgggcgacagagcgagattccacctcaaaaaaaaaaaaaaaagaaaagaaaagaatcacccttatccttcaaaaccgactctaactcttgtcatatgtattgatttatcttataagaaaaggtaagtcttcaaatagtacgataatacgtgtttcagggagatacatattgagcatatttttcgtttatttactagtcaattctcatttcttattatttcataaagaatatttttgcaaataccctaagttaataagtctagaattcaaagtccaaatgttcttatgtgaatttaaagaaagggtagccttgaccctgatttcgaatgtggtgaagcggccccagccgccccccacagtctgcccgttgctcatagatctcaaggaagttgctgggggaccggtaggcgtcattcaggttctgcggcttggtgatcagccactgggtgtcagccatggactccgccatttcgctgtagccgccgccgccgcgggctgccatgacacgttatggactaaaacacaaacgataaaagggttacctatttaccgctaacgcattaccagtcgtccaactgctgaagataagaaaaatgtatctgtgtgtgtgtgtgtgtgtgtgtgtgtgtgtgtggcattttagcattaagtttataatgtacccttacttttagttaataaaatatgtttccatcaaaaaagggtcgtctaattaaaatttcttcatctgaaaaagctacccaccatattgaaagcaatgacaatttttttctgtacaatagcaataataataataattgctctaagtaatattacaaatttagtgttattacaaagtacttggatacatgtttgatattttctattggaaaatgtctttcatttgcaaatatacctagggaagcagtaggtcaaatgaaaaagaaattgttctcttgaaatgttatactgctcatgattcagtaaatgggtatagttcatatcctgttcaaataaagaggaaagactcatagacctttttctgcttataagcttctattttaccaggtgaagtcttgataattccatcaaacttggaacctaattagaaaagtgactgatttatatcttctcagctgtgtgaacataattctgcctattgaattgaggggttgttaatccctggcaatcatgtttgtgccaacttgactggtgatcttagactatttccagtcataggaggttgaaaagcatgtggattttagaaaagaaacagggaaaagatgatgattctaaataaaaacagaacaggactaaacaaaagtcttgatatgatgaagttcagaaaataaaagattctgtgaaatgtactggtgaatgcttggggaaatgaagaaataaaatgaagctttttcagcttgattaacgtctgactttttgttaacagaagtggaatatgagaataggttttatcttctaatggaaaaaagtattttgaaaaatgctttctagttcacatagtttaacaacaacaaaaattttaatatacaatgctgagactagtaaaaaatcaaatcccaagggggaaaaagattactgaatcatataattaaactatactttacatataggtttactataaataatttagaatttcaaatatgatcagtgtattttccaaagtatgcatttgcattatatttatagaggtaatcaatctgtcttataaagactcagattttacaattttcttaatttcctcctgtgttagaaaataaaacacacaatgtcaaacgacgagaacaacctcaaccacaaacacaaccatctatatatgaaggttcatttcagagaacagtatctttctaacatttggcatctgccatcttcaggaccatttcagagaaaagggactgacctggcaagagaaatgtaagataaggtgatctatgataggcacgactgggtgtttttctgacaatgacttgctaaataaaagaatgactttttgtgaaagatgtgagaatgtaagcctggattgatttatgtgaggtattgtccaggctgaatgtgaactaaataatgtctcacagtacccaatattttattaattgtttcccatcaagggcaaattggagaatagataacaataatctgaatgattcgaaccttccctattctaccctatcccataacttttatcctcccttcttttgttgcaattgtctgtgcatttaaaaaacccaaaatataaaaaacagagcttgagtgtgtgtgtgcatgcataccaaatttcaaatgtgagttggaattgcatcagagatctctctgaaagccaattcaggctcttgagaaaattgtcaacaattagtagtgacatagctacatcacattaccattcttttggtaaagctggcaatggtataaactttccatagccttcgtggtaattcaaacatggattgctttatgcccagtgaaataaactttgagataagaaaattaatcatgtgaactagttttcaagggaaatacagtgtaccagaacactggtcttaaatatataacattagatagccaactgtataaaaaggactgctcattttaaatgggatttgtgtctttattaaattttatctcatgggatttttatttctgcctaaatatatatagcattaattatacgaaaattaataaaatcaaatttattttctaaagtattcacttaattcagacatttatgtgaagtaggcttccccttccatcttctcttcccagcttcacttcctatcatgaaaagttacatccataaactttgggtgaaatacctcttgagcaatgctacctgattcaataaagttttttctctatttgtaaaaaatgttactgttttcatatatcaagtccatcaaactatactctgtaattgttgacttctgtgatttttaacaaatattgtcatagtgcaatgatagcattttcattcacaggggctcagctctgtcttcttttggtaaaaattgcttgctctaagatgatagattaatctcaaaattgatggattgatttctctttttttattggttggtttaagcaaaccagtatgtaaaaactatcacataattttaaatagttttttaagttgaatctctttcctatctgccttaaacctctttgtgttaattaattctgtggttttaactgaacttttatcttgaaaaatatcagtaaactcatccaaattgagaagtaaatgtgatatgttttccctttgtgaaatgtctttccatgtttttcaaaatcttcctgtaagtttcatttactttatccttacctatcatgtggatattgttattagagcttccttagcaataataatcacaaaactatgtgtgtgtgcatgtgcacatatatgaagtatatatatacatactctgtaaactcaatccagtgaatgttaaggagtctgctatggatctacttaactgagtcaatttatcttcttgaacatcacaatcttcgtaacgattaaaaggagccaatgttttatactttccacttggtccagtgacctatttgacttgcttatgtaagtcctctttcctcaaccttacaaaaggtagaataatcagggccttcaggattatatcctagcttggcctgtttaagaccttctgcgagcatgctagcaaaagaaaagttccctagatacaaattaaatcttgcagggaactttcactatggcttaccaataaatttttttttttttttttttttttttttttttttttttttttttttttttttttgagacagagtctcgctctgtcgcccaggctggagtgcagtggtgtgatctcggctctctgtaagctccacctcccaggttcacgccattctcctgcctcagcctcccgagtagctgggactacaggtgcccgacaccacacccagctaatttttttgtatttttagtagagacggggattcaccgtgttagccaggatggtcttgatctcctgacctcgtgatccaccttcatcaacctcccaaagggctggaaaaaaattttttaagttctgattctgctgcttactatactgtttggccttggacattttgaaccacatttcttcatttgcaaaatgaggaccataatgcttcataaaacttcatttgttgtgataatacattacacatgcctagtgcttaatacaatgtattggcagatgaagaaatccatatagagaagatgagtaactcactcaagctcacacagtaggcagcagtggaattgggtgttatctcattcataattgaagccaaacttgtatttatccttctattatagtagcaaatagacttctttattatctctatcaaaacatgatacaaaattgatctcttcctctctcctaatgccatcttatatgtgctttatctttttatttttactttatgattaaattaatatcattctggcaacgtacttaagtataattaattatgactccttctttgctcaagataaaaatatatcattagtgactatgaactcatctatcaaaaagggtattaacctatctgttctaattagttcaatttattatagggattagaaaacaaatatcatagtgacgtcatattctttgtttttttgacttatgacaggtaaatcaaaagtgtaccctttattattagttaatttttaataatctcagtacagtcaaatagtatacttcatttcttcagtatgtcatatttacaaggatatactttgtctttattcctctcattcattttgccttcatatgctctttttaagtacattttaatagtaaaagcccccaaaaacatgtaaatcttttgagcttttgagggtttctgaccaaagataacaatagtatcaatagctgtatctttggagatttgaatttttactataatggttgaaaaataatactgacaaacattaagcactttctttgtcctgtgggatagggtggagggaaaaactgattggcttctaattacataagagaggagataggataattagacaccacttgtaaaaataattccaagtacaggaaaaatgctgataaatacaaatcttgtggggataaaggagagaaatagaaaggaatcaacatgaacacttaacggtatttatagaataagcatacctcgacgatattgtgggctcagttccagaccattgcaataaagtgaaatactgataaatacaaatctctcagatttttttttggtttcccaatgcatataaaaattgtgtttacattaagctatagtctattaaatgtgcaagagcattatgtcttttaaaatgtatataccttagtttaaaaatattgctaaaaaatgctgaagatcatctgcaccttcaggggatagtaatcttgttgctggtggaaggtcttacctcaatattgatggttactgactgatcagagtggtggttgctaaaggttggagtggctgtggcattttttttttttttttttttttttgtagaaacaggatttcgccatgttgaccaggctggtattgaattcctggacttgagtaattcttctgtcttggcctcccaaagtgctggaagtacaggcatgagccaccacacctggcctggcaatttcttaaaataagacaacagtgatgtctgctgcatcaattgactcttcctttcacaaaagatttctctgtagcctgccatgctgtttgatagtattttacccattgtagaacttcattaaaaaattggagtcagtcctctcactgctgccactttatcaactaagcttacataatattgtaaatcctttatttatatttcaacaatgtcctcaggatcttcaccagtagtagtttctatgtcaagaaaccattttctttgctcatccttaagaagcaactcctcatctgttaaaattttatcatgagattggagcagttcagtcacatcttcaggctccacttttaattctagttctcttgctatttccaccacatctgcagtgatttccttcactgaagtcttaaacctctcaaagtcgtccatgaaggttggaataaacttcttccaaactcctgttaatgttagtattttgacccccctcccatgaatcatgaatgttcttaatggcatctagaatggtgaaccttatccaaataattttcaatttattttacacagatgtatcagaggaatcacaattcaatgcagctatacccatggaaaatatgtttattaaataatgagatttgaatatcaaaattattctttgattcatggactatagaatgaatgttgtgttagcaagaatgaaaacaactttaatctgctcgtatgtctccattagagctcttgactgaccaggtacattggcaatgagcagtaatatgttgaaaggaatctttttttctcagccgcagatctaaacagttgggttaaaatattcagtaaaccatgctacgaaaatatgtgctgtcattcaggctttgatgttccatttatagagttcaggctcagttcatctagcgtaattcttaagtgccctaggttttgcagaatggtcaatgagcactggtttcaaattaaagttgtcaaatgcattagctactaacaagagaatcagcctgtcctctgaagctttgaagctaggcattgacttcttttctctatgaaagtcctacatggtatcttctttcactctatggctgcttcatctacattgaaaatctgctgtttagtgtagccacctccatgaattactttagctagatctggataacttcctgcagtttcttcatcagcacttgctgcttcactttgcacttttttgttatgaagatagctattttccttcaacctcatgaaccaacccctgctagcttcagcgttttcttctgcagcttccttacctctcagccttcatagaattaatcttttctctggattaggctttagcttaaaggaatgttgggactggtttgaacttctgttcagaccagcaaaactttctcaatattagcagtaaagctgttttgcttttttgtaattaatgtgttaactggaatataacttttacttttcttcaagaccttgtcctttgcagccacaacttggcaaactatttggtgcaagaggtctagcttttggcttatcttggcttttgacatgtctttctcactaagcttaatcatttctacctttgatataaagttagatatgcatgactctttttcacttgaacacgtaagatgccattttacggttattaattggcctgatttcagtattgttgtgtgtcaggaaataggccagaagaaaaagagagagatgggaaaatggctggtcagtggagtaatcataacacacacatttattgattgttcgccctcttatctgggcctggtttgtggtatcccaaagcaattataatagtgacatccaaggccactaatcaccataacagatataataataatgaaaacgtttggaatattgtgagagttaccaaaatgtgacacagagacccaaagtaagcacacgctgttagaaaaacggcatggatagacttgttggacacaaggttgccacagatcttcaatatgtaaaaaacacatctgtaaagaacaacaaagtgaagtgcagtaaaatgtggtatgcttgtaaatgttatattattgtgtttacaacatgctgcgctgagcaatttacagatgttatatctaattttcaaaatagtccttctgaagaagaggaattccaaactcactgtggagcttaagaaaaagtgggtaacatattgtggtgagagagttaattaactttcctaagatcaaaaattttaaagtgccaaaacaaaaaatcaaggccaagtcagtctgaccctaagaataatgcttctcccagaactttacatcacttggatgaaatgtatccaagagttattctcagcagttaagatttggccactaagaaagtaaggctttctgacaaatctgccatagatgggccattcagagagtgagctaaatataaaggaaagaaaataagaggcaaggcctcctgcactattttaatgatatgcacatcttttaaaatgtgtcttattttaatgtcttttcccccagaataacatcaaagcgacaggcaatccattctgtagttgctatccaatgtcatatctatttttctcagtgatgcactgctttttgaccaaaataatgatatttattagtttggatgagtcacctttttttgcatagtactcagcccactggcttctttgaatccctttctagatatacagggaatagttactattagtctagctctaaaattttatattattaaattgctccacaaatgttgcatccagtcatttcctcttcatttttctctcttaaggtgttagagagctgtgagctacattttctttctataaaaagcaagagtaacgttagacatcgctcagatctcagaagaaaacatgttgaatgatgattgaaatttgacattaactagtgctattgcagtcttaactgaaggtcacaggatatgtgaccaccaaaattccctcctagactcagtggtggatgccagagattttctccactgttttccttatctgctttcgtcactctgtcccataaagttcacagggcttctctaagggaagggtcaggcactgtagtgaacacttatcttttcttttaaagacttccagagatagaggttttgcagcagtgaatcagtatgcctttctggtagttcgcattgtcatgaaattctttcttttattttcacttttcttactccccaatccaaagcttcttctctttttgtttttcttctttttattatccttcacctcacaatccatcatacatttgtttttatgtaatttttagcatttttttcaaatgaaataggccattttagattcttttttatgaatcaatttttcaattaaggtgagttctttctgagattagaatttttttctgtatgcagtactagggaggttacaagccatatgagtaaacgcttagcacagaagacaagagattggtgttcgagaacatttcaaaagtggcttcaaatgcaaaactacacagagcaaaatttctgttttcatttattacatattatatggagttaaatgttaaatactattatacctcagtaccgtgattctgcctttatcttcattgattttaaacaaaagatctcttttccatcttctcgctttaagttgctctagagttgcgaatcggggtttataatctgaagcaaatacatcaagacataaatcaggttaacaggggaaaatccagatgtccaaattctactctacgtcttttatccaaaatttgaattatttgcctgttcatttttcagaagcgacttctgcaaatacacattatagtaaaacgaatgagacaagaatatttatttttctggcttatattctgatttctgacatgttatcttccaatatgggtatctactgcccatattgatatctactgcccatagcaactgcccagttgtcagtaaccccatccctatttttgtacccattaaaaaaaagatttgtgtttagtttcattggagcagtagttttcagcatgaatttgaccttttttttttttctaagaccaattactaattaaatttatcatctggtattctgttctttgtcccttcaatagactgttgtttcaatctcttgccattctgtgacttgacattcccttgagatgtgataactaactaaagttaacttaatagcagcatagaaaattcagagagtatcatctgtacaagtgtatgtgtatagtaatacctaaaatttagtacagggcatgtgcttgtgtctctaatcaggaccttgtgtttttgctatgaggaactctatgatttctaataattaatcctcaacctaccacagaattaactctgacagttgggaacacctaaatgttttccctactcagttaatataaaacagtgccagaaaggaatccttaaatggaaacttggaagaatattcataaactattacatgtcttcaatcaacccacaaaatgaacttaaacctcatttttattaaatgaacttaacctttgtatctatgcagtattacaattaacattagcataactctcttattaattttgaattctttttgtcaactgctagattttccttcctgaattatgtctttgtttgcaacttgtttttctactttatagacataagaacaatgtaaagaagataaaaataattcaatgtttttgcaaaagtgatactgcatgaaattaccaaagtaagactttaaaaaaagtagagttgtctgggtgcagtggcttacgcctgtaatcccagcactttgggaggctgaggtgggtggatcacctgaggtcaggagttcgagaccagcctgaccaacatggtgaaaccccatcgctactaaaaatacaaaaattagccaggagtggtggtgcatgcctgtaatcccagctacatgggtggctgaggcaggagaattgcttgaacccaggaggcagaggttgcagtgggccaatattgcaccaatgcattccagcctgggctacaagagcaaaactctttctcaaaaaaaaaaaaaaaaaaaaaagtagaattactatcttatcagttcttggccaaccatgtacacaactgaatattgaaaagttaatacattctttatcaaccttgccttacaaatattataacaatatcctttcttgaagctagttttttgaagctttaattgataaccatttaaaagaaaaatatttcaataataatgcaaatttcgtgagggcatggaattcattcattgggtcattttcttattttttgctccaattttttaaattttagaagattaaacacggagtgctacagggtgacctaagaatgaattgggatacaatactaacaaatagaattcagtacttgggctccagattccctgttgctccctgtagccaaatctttttcagggatcagaatataataggtcagtatctgaactttgaagagtatctgcccttaaaataaaattcattcttaattcatcacgggagatgtatgtcctcgtaggctgactttagcattttttttcttttttcttctacaacctgcaacataacatttggtatatggttccagttctatgatcattagcagcctttggagtactgtaggtgtggcaaaaatgaagtgaagaaaagaagaattttcaaattccttcatgaagctaagactttaggagaattgagatttttttaataagctctactctaattgcttgcttaatagttcatgtttacaatggggagccattgttcgcacactacccatctgacaagtgattcataaccagaatatataaggagctcaaataactcaataggaaaatattaataataccatcagaaatgggcaaaatatatccatagacatttctgaaaagaagacacccaaatctcatacaagcatctgaaaaagtgctcagcatcattgaacatcagataaatgcaaatccaaactgcaatgagatatcctctcaccccagttaaaatggcttttatccaaaaggcaggcaataccatatgctagtgcagatgtggagagaagggaaccctagtaccgtgttggtggaaatgtaaattagtacaaccactatagagaacagtttggagttccctcaaaaaaacaaaaattgagctaccatatgatccagcaatcccattgcttgatatataccaaaaagaaaggaaaacagtatattgaagagacatttgcactcctatgtttgttgcagcactgtttacaatagctaagatttgtaagcaacccaactttccatcaacagatgaatggagaaagaaaatgtggtacatacacacagtggtatactatttagccatagcaaagaatgagctcttgccatttgcgacaacacctatggaactgaagatcattatgttaagtgaaataaaccaggtgcagaaagacaaacattgcatgttcccacttttttgtgggatctaaaaataaaatcaattgaactcaggaaggtagaaagttgaaggatggttaccagagtctgggaagggtagccggggtttgggatgaggtggagatggttagtgggcccaaaaatacagaaagaacaaataaaacctacaatttgatgacacaatagcgtcactataatcaataataacttaattgtacatttttaaataacttaaaaagtgtaattggattgttttaaattcaaaggataaatgcttgaggggagaaatatctcattccccatgatgagattatttcactttgcatgcctgtatcaaaacatctcaggtaccccatgaatatatacacctggtatgtacccacaaaaattaaataaaaaattagaaattaaaaaaaaaagtattatgatttcaattcccatgaagaatatttgaaattagtgaacacattttttcttgctaaattacacatggtattattaacatatctttagaaaggttataacttattttaaagcactagacactgtctcaaatgagccagtcttatttactataataagctagaaaattagccctaaaattaatttactttaaaacatttatcagaccctaaagctaaaagaaaatactttttaaaagagcaacacataaaatatattctcctatttaaaaatcctgcccatgagaagggatctaacataattgagtatttcttgggaagaacatttactcatgtattcaagatccaactgaattgttcagcccaaatatctgaattttactttgctgacagaactaagtttcttcatttcaagcagtaatatccagcatattggatattatagatttataatgaataaatgaaagagtacatgagtgaattaagtggacccttatctgacatatttcaagatagctcttttagcataaggggcattctacatttcggggtgaattattagaactacttctaaatgtactcttattcccagacacgaatcataaacagaatgagattgataactgggggattaatagtgaaaacggtctctttatttgattaaaagaatttgcgtcatttttctagaacaggagtatacataatgtacctagcaaaattaaagagaagatttagtttaagaaaataaaaattatatgcacacacacatatacagacatacgcacatgtgcatatcctacatgtatttaatgagtcctaagttgttttatttttatttatttatttttttgagacggagtttcgttcttgttgcctaggctgaagtgcaatggcgcaattttggcttaccgcaacctccgcctcctggattcaagtgattctcctgcctcagcctcccgagtagctgggattataggcatgcaccaccacaaccggctaattttgtattttttagtagagagggggtttctgcatgttggtcaggctggtctcgaactcccgacctcaggtgatccacctgccttggcctcccaaaagtgctgggattacaggcatgagccaccactcgcagccttgagtcctaagttgtgatgggaatccttagagaaattccagttcaacccatttccatataatcctgccagtgttattatatttctctatattttaataagaattcaaattattatgtcaaaatctctaagaaaagaagacgtaatgttttaatgaagttttaagtatgaaaaaaagaacattcagttgtcttttaaaaatactacctacaaatgcatactgtaactctggtgacaaaatgagaatatcagcattaagacccagaaaataaggtgcatgttaagccctattatttgtaacattattaattggtgaaagataagtgcaggattgataaaggtcacagagggatatgctgcatgagataattagatccacatactttaaacaaacccagccttacgttagatttagatcgctgtctgaactaaagggtagaatgctttaatgcaccactttatcctgagcattatatttcacactgtggaaagttgccatttttatgggtttataggatgaaaaaattttctggagaaaaaaacacagtaggattgatgtttaccgaaataggcagtgattagcgagccatctgtgttgatgtaacaggcacatcaccattgtttgtttctggatgagttattaatgctagatgcatcagtcatggtttccatcattaatttagatttattccatggctgaaaaggttattctaacagtggaacatgcctgtgatacctttcagagaaatgctaatcacagtccactgaatctgtatgtattatttagtgccattaccaatcctaaagctttctagatttttacttctctattatttgtgttcatagatcttggtaatgctatatagcattcacactatgataataaagagcaactataggagttatagccagtctagggtcttgctcagagtagcattgagatgggagagaatgtgcagaggattaaggaatttaaaattatgaataattagacataaatagcacagaacaggtcacacatctgttggctaagtgtcagtgattgaggaaaaagaaaaaaataattaccttactcgaagatcgataagcagagaccagcatttcctaaagtatgttctattgaagactaatacaaggagatacttttaaaagtaaaaataaataaataaaggtgcagtggtctattgtgtttgggaataagaacataaaactggaattatctatgacttgagtcaataatgacatccattattgatgataacagttcttttctaggtttggtagaaataataatcgaaagttaccttatgtgaggatttaccagaaataaacagtcaaaggacttctctataaaatatcatttcttagcgagcattgacctcttttttgtgacatatgggtttgtaaattaaaaagtatgtaatagacctaaggatataaaaacaagtgattcaaaatactctgatgaaaagaaaagaaacctttgaaccaaagaagtggctttcaatttagatggttctcaaagactgaaaacattttttaaagattagcaatttttgtttattgttctttaaaccccaaagtcgaggtgcagattaacccttctaattaggcttcatctatgggggagtacaaattgtttcaaagattcaaaatcatttgaatatttactattttgcaaacagctggattcccttgctcttttacctgtaaagtgtatgaatgcaaaacttctaggaaatggtggggaagagcatacacccccaccaaaacaggccttgcattgttgttattttaccgtttataaaaaccttcctacgatgatagatttaatctatagctgtgaggcaggagaaatcccagagatggttgtttgcaatactaagagtaagtttagcattttcctaattctatgtcatgcatgccccttttaaagatactatggcctctagtacataagttacagtaattcttcacaatagttcggtgcttgaagaatgagatggcagacattttaaaagatgtagaaggaatgcttcagccacaaatattccaaagatataatattttatccctgggtgatgaatatttgaatcgattgtttttagcttaagttttttttcatgtcttctaaaactgattaccatagaaacaattgtattagtcatgaaattatcagatttagttatcaggttgtttacaaaacttcaagcattgtaaattatcttttccatatggaaagtaacatagatggagatcgtttcagtgcatcttaaactatattggtggccaatatagaatgcaattttttttataattctcaagttaatataataccgtaggtttttcttaatcctcatgttaatgcattattttcaaaaattacaatttttatattgcgagaaacacttcaatgaagctcccacatgtgagaaaaacactagaaatagaaaggcttccttaaaccacataaaaaatcaacttagtaggaatgaatcattaatttaaaagtgcatgtgtgtgcacacacagagagttttatcaactcctatgagatttcttgtaagaatttaagactaaatgtgatgtctcaaattaaaattaactctgtaagtaaaactctgcagtgtaccaagaacaaagggtaaggaatacataggtaccatcaaaattaccagagactcctttcagtagaatgtcagtgttccaatttttcttaactttagatgtcaaagttattagctccataggtgaatataatttcctgtaatgtaaataattgactaaagtttactgttttttgaacatctgaactctgtgtgaagaccgtcagtgaatttatgtgtttaattcataaagatatttttacatattattagcttaagccatcttatttgctattaacaatgagtatcatgctatgaaaatttcctcaaccagattttataaaaaattgacatatgaagttttttaatgaatatattaaataagcagctaaatactgatactaatactgaaaaaaaaattgacaatatttgacataccagagaacttgaaatgaaaaatattaatattaagtgactgacccatttatataatcttccttagttctgagcttttctggatttagtgagagccttatattgtcacagaaataaagtcaattatatttcagagaaaaaatcatgaaagatcatgacctaacagtatgcccaagggattggaaataaaaatatctttgagtttattaatctcactagtgtggataatataatgtgtactttccattggtgttgtaagaataaatagaatttttgtcttgttactataatgtattggtgatgataacacagagccacctcaatactacagggacaaagtggacactggagaaaataaggtctagtaagtggaatttcatgaaagaaagatataccaatagaaatacattttaatttaggacctctggtaccttgaaaggatctggtctgcctttttctacttcaagttgccattgtttagctgatgtataaagtttggcttctgataaatgtagttcttattctcccagagttacccagagaaggagaggacatcaataggaaactcttttaagacagagattattgccttagcctaaatttctattagatttattttctccttaagaaattagagacataatgatatctttattattcaaatacaaggagtgattctaagattccttcatttcttaaagaaaattttctttattaaatacaatatactagtggacaccatacaatcattatcatccactaagtctatactgcatttaagcatatatgagaatagacagtaaagacaagatatgtttagttgttctgagaagaataaattaggaaagagtagaaatggaagaagagatacaggttaggttcatgtaaaaaaacaacatgaaaagtgaaaagatgcttacctttggaggcagtgagatttaataatatattaaaagggatgtaggataagttggggagtaatatatttaacaagaagaaagttctcctccttcatttaaaaaaaaaaaaaggagaaggcaaagcaagatggtggaatagaaaactccaccaattctccccctgtattagttccttttcacatgctgataaagacatacataagactgggcaatttacataagaaagaggtctaattgggttcacaattccacatggctgcagagacctcacagtcatggcaaaaggctaggaggagctagtcatgtcttacatggatggaagcaggcaaacagagagcttgtgcagggcaactcttgtttttaaagctatcaggtctcatgagacccattctctatcatgggaatagcacaggaaagacccacctccataattcaatcatctcccactgggtccctcccacaacacatgggaattatgagagctacaagatgagatttgggtgaggatacacagccaaaccatattacccccacacaataacaggctttatagaacaccatatcattttcaaaacagaatataaattaaatgtctttgggaggaaaaagtaaaaaaggtaaattgtagtaaaacatagccataatacttgtgatgttatcacataattttatgtgtacaataaaaatgtccctaataaatattttgaatactctataacaggtcctgctctgggaagttgaggtctaccagaggacaaactagaaaaaaaaaaatgtcctacttaacataaaagaatatgctatcaagaaagctgaggatgttacagatggtctctctgtgaaagtaatatttaagtttattcctgaaggtttattaacactgggtgtgtagatgtgggaaggatttctaggtggagaaaacagcttgtacaaaagccctgaaatgaacatgcttagcatgttggaagaaccgacagaagacctgtgaatccagagcaaggatttcaaaggggacaggcacttaaattttagtggtgaaagaaagacaataaatatataagataagcaaattttattatttgctaatttgctctctcaaattttatagcatgttaaaagatgttgagtgctgtatagaaacatagtgcagagtaatatttgctgttctgcagcctccgctggtgatacccaggcaaacagggtctggagtggacctccagcagacaccaacagacctgcagctgagggtcctgactgttagaaggaaaactaacaaacagaaaggaatagcatcaacaccaacaaaaaggacatccacaccaaaaccccatctgtaggtcaccatcatcaaagaccaaaggtagataaaaccacaaagatggggagaaaccagagcagaaaagctgaaaattctgaaaaccagagctcctcttctcctccaaaggatcgcagctcctcaccagcaatggaacaaagctggacagagaatgactttgacgagttgacagaagtaggcttcagaagatcagtaataacaaacttctctgagctaaaggaggatgtttgaacccatcgcaaataagttaaaaaccttgaaaaaatattagacgaatagctaactagaataaacagtgtagagaagaccttaaatgacccgatggagctgaaaaccatggcacgagaactacgtgatgcatgcacaagcttcagtagccaattcgatcaagtggaagaaagggtatcagtgattgaagatcaaataaatgaaatgaagcgagaagagaagtttagagaaaaaaagcgtaaaaataaacgagcaaagcctccaaggcatatgggcctatgtgaaaagaccaaatctacgtttgattggtatacctgaaagtgacggggagaatggaaccaagttggaaaacactcttcaggatattatcgaggagaacttccccaacctagcaaggcaggccaacattcaaattcaggaaatacagagaacaccacaaagatactcctcgagaagagcaaccccaagatacataattgtcagattcaccaaggttgaaatgaaggaaaaaatgttaaggcagccagagagaaaggtcaggttacccacaaagggaagcccgtcagactaacagcagatctctcagcagaaactctacaagccagaagagagtgggggccaatattcaacattcttaaaaaaagaattttcaacccagaattttatatccagccaaactaagcttcataaatgaaggagaaataaaatcctttacagacaagcaaatgttgagagattttgtcaccaccaggcctgccttacaagagctcctgaaggaagcactaaacatggaaaggaacaaccagtaccagccactacaaacacatgccaaatcaaaaccacagtgagataccatctcacaccagtcataacggcaactactaaaaagtcaaaatacaacagatgatggtaaggtttcagagaaaagcaacactaatacactgttggttgcaatgtaaattagctcaaccactgtggaaagtagtgtggtgattcctcaaagagctaaaagcagaactatcattcaacctagcaattccagtactgggtatatacccaaaggaatatagataattctactgtaaagactcatgcacatgtatattcatggcagcattattcacaatacaacgacatgcaatcaacctacatacccatcaacggtgcactggataaagaaaacgtggtatatatacatcatggaatactacacagccataaaaaagaatgaggtcatgtcctttggaggaacacagatgaagccggaggccattatccttagcaaactaacatgggaacagaaaaccaaataccgcatgttctcacttatcagtgtaagctaaataatgagaatacatagacatatagaggggaaaaacagacaccggggcatatgggaaggtaaagggtgagaggagggagatgattaggaaaaataactaatgggtactaggcttaatacctgggtgatgaaacaatctgtaaaacaaacccctatgacacaaacaaccctgcaaatgtactcttgaactaaaaagttatttaatatgtaaattaaattagatcatatcattgagtattaggcaattagaaattgaggcaaagataggaatacgatccaatactgccatatagtaccagtaagaatacacatttgagaacactactctaatttaaatgtaatgatcacaaaataatcacaaaaatattcacaaaaataatcttcttaagtctttcctatcctaaaattgacaaaagattttaagaagcttaattaccttatcaaaaattttgcataagcttggtgaataaaatacatttcagagttcatcctttcaacttgatatttggtcattaaaaagtattttgttttacggggtttgatacgccgtctccctcataagtttgtgttcctcatagatgtgatctctctacatatttctatattactcagaggttggtttcttcctttttattctattcttttttctatttttttctctgttttgtctgaacgtcttatttttgaaatccagtctttaagctctgaaattctttcttcagtttggtctattcttctgttagtacttacgattgcattatcaaattctcatagtatgttttccaactctatcagattgtttatgtacatttttatacaggcgattttatctgccagttcctgtattattttattgtgatccttagctttcttggattgggcttcaatgtgctcctgcatctcaatgattttcatctctacccatattttaaattctatttctgcaatttcagccatctcatccttgttcagaacttttgctggagagatatatactgatattttctttctttttagtatatactcagtagtgggattggtataccatttggtagctgcatttttaagtttttgtggaagtttcagaatcttctccatattgtttataataattttcatcttaaccaccaacagtgtacgaggtttccctgttctccacaacctctctagcatttgttattgcctgtctcttggataaaaggcttttttttttttttttttttttttgagacagggtcttgttctgtcacccaggctggagtgcagtggtgcaatcatggctcactgcagccttgacctcttgggatcaagcgatctccctgtctcagcctctgcagtatctggaactacaggtgtatgccacaatgctaggataaattttgtattttttgtagagacagggctgtgcatgttgcccaggctgggataaaagtcattttaactggggtaagataataactcattgtaattttgatttgcctttctcttattatcagttatgttgaacatattttcacatgcctgtttgccatttgcatgtcttcttcagagaaatatctactccaatctattgcctgttttgaattgcattattgaattttttcttatgaagttattttatcttcttatatattcttgttatgaatcccttgacagatagattgtttgcaaatattttctcccattttgtgagttgtcttttaactttgtttattattttattcatcctgcagaagctttttaacttcacgtgatcccgtttgtccatttttttttttttgcttcatttccttgtacttctagagtattacttaagaaattttggcccagaccaatgtgctgaagattttcccccccaaaagtgaaagaactctacaatgaaagctataaaatctaataaaggacattgaagagaaaaataaaaataaaaagatatttcatgtttatggattagaataatcaatattgttaaaatgtccatactacctaaattaatctattgattcaatgcaatctctatcaaaataccaatgatatttttcacagaaagggaaaaacaatcctaaaatttatatggaaccctgtaatatttagattagccaaagctgtcctgagcaaaaagggacaaaactggaggaatcaccttacctgacttgaaattataccacagagatatatgaacccaaatagcataacactggccaaaaaaaaaccagacatatagaacaatggaccagaatagagaatcagaaacaaatccacatacctacagtgaacttatttttgacaaagttgccaagaacatgcactggaaaaaagacaatctgatttatttttccgataattaactattggcatatagaaaggctactgatttttgtatattgattttgtattctgtaaatttactaaatttgtccatcagttttaatagtttttggtagtgtctttaggattttccaaatataaaatcatatcatctgcaaacaaaggtaatttgaattctgttttaccgatttggatgtcctttttatttatttatttattttcagcaaatcaaataatatttgctttatatatatatgaatgctccagtgttaggtacatacatatttataattgttatgtcttttattaaatttacttctttatcattgtatagtgaccttctttgtctcttcttatagtgtttatcttgaaatctatgttgttgaatataagtaaatatattcttgccattttctggttgccgttggcataaaacagcttttagccatccctttattttcaatctgtgtgtatctatatcggagaagtttgtttttttaaggcaagagatcattgggtcttgtgttttttctttattctgacatgttatgtcctttcattggagagttcatctatttatttccttgttattattgacaactagagactcactcctgtcattttcttatttgttttctggttggtttgtagtctcctctctcattcttttctttttttatccttttagtgaaagtgattttctctggtgatatgatttaatttgtaactttttatttttgtgtatttgttgtatggttcttgatttgaggttatcatgagacttgtaaatactatcttataacccattattttaaactgatgacaacatagcaaagattgcataaacaaagaagcacaaaaagaaaactaataaacactctatactttaactttatactccccctttttaactttttattgtttctttttatgtcttattgtactgtctatgttttgaaaagtgttgcagttataatttttgattggttcatcatttgacctttctacttaagagtagtttacataccatgattacagtgttataatattctgtgcttttccatgtccctactatttccagtgagtcttctaccttcagatgatttcttcttatgtattaatgtattttgtttcagaataaagaacaccctttagcatttcgtgtaagacaggtctcgtgtttatggaatccctcagcttttatatgttatttgtttctttccttttgctgcttttaggatcctttctttatccttgacctttgggagtttggttattgaatgccttgaggttgtcttctttgggttaaatctgcatggtgttttgtaacctctttgtacttgaatgttgatttatttctctagatttggaaagttttctgatattacctctttgaatacactttctacccccatctctttctgtacttttctttaaggaaaataacacttagatttacccttttgaggatatttcctagatcttatagttgtacttcattctttattctctttaattttgtttcctttgtattttccactagcctgtcttcaactaaatcttttcttctccttgattatttctgctattaagattctctgatgcattcttaagtgtgccaattgcattaatcagctctagaatttctgctttattcttttaaattatttcaatctctttgttaaatttacctgacagaattctgaattccttctctgtgttatcttaaatttctttgagcctcctcaacacagctattttgaattatctgtctgaaaggtcacatgtccctgtttctccaggattggtccctgatgacttatttagttcatttggtaaggccatgttttccttgattatcttgattgcttatggacattcatcagtgtctgggcattaaagatatatatttattgtagtctttgcaatttgagcttgttttacatctgtcctttttgagaaggttttccatgtattctaagggaattgggtactgtgcccaataatgctgtggtttttgtggactcatagaggtactgccttggtagtcttagataaggtccaaaagaattacctggattaccaggaagagtctcatgttgtcttcccttaccttcgcccaaacagtgcctctctctgtgtgctgagccacctggaactgtgggcattgtgatgcaactaccatggggtcaccactactgggtctgtgctgggtcagacctgaagccagcacaacactgagtctcaccaaagtcctaccgtaaccactacctggataccacctatgttgactccaaggttctagggctctataatcagcaggtggtgaaaccagccaggtttctcttctttcattcagggcagtgatatctctcaggccccagacttgtgcagagatcctgtctgagagccagcaattgtagtacaaaaccttacaaatttaactaatatttcattctactttgtgtaagctggcactcacaccacaatacgaagtccttcctgcttttccctcctctttccacaggcagaggaacccctccctgtggccactaccaccaccagcccataaggcgttctgccacaccactacttatgttcacttaaagaccaagggctcttctaagagattgtagtgaatgttgccagaactatgacacgcctttcaaggtagtgagctcctctctggcctaaagcaggtccagaattgctgtccaaaagtctagaccaggacttgacaccaagagcctgcttgttgctctactccactgtgaccaaactggtatctagtgtgcaaaacaaagtcttcattattattccccctgcttttttcaaacagaaagagtctttcactgtagccagcaccgctgggaatatggcaggtcacacctgaagtcagtacatctcagagcccaaggcccatggagtactccctgactatcactccttactattcagagcccaagggctctttagtcagcagtttataaatcctatcagaagtggttttttcccttcaaggccatgggtctgcctctagcccaggttgattctagatatgtcatctgtgagccagaatggggacctcactactctgccggtgccctctacttctgtggctgagctggcatccaagatgcataagaaaggccccttttttctttccttttcttaatctgaagaaaggagtcacttttattgttgcgagctgcactgacttggcttggaaaaggagtggcacaagcactctcttagctgccctagctggtgtcttcctaggtcacgtgccacttgagtccactggctctaagcccagcctagcgcttggagttgtccaggaattgtattccttgtgtcctacactgcctttcaggtttacctgggaccccagagcactttggcctacagcagtaaggcttgctaaaaaaactcaagttctgaccactgtaatgggcgattcccttcttgtaaggactggtccaaatgctccctctgtgcagggtactggttgatcccagcatgactttgctctccactgtgacaggcagcaccgagtacaatgtaaagtccctaggtcactgtgctctccctcccccaagtgcacaaactctctgtgtcacaggaccactgccagtggatggggaggggtggtgtcagctatttcagactgtttctcctatcctttttaatgcctctttcagtgatatgaatttaaaccatgtactgtgattactcacttgatttttggtccagtgatgatgtttctctgtgtgcagatacttgttaaaatttggtgttccagcgcaggggacaaatagtgtaggcttttattccaccttcttataccaccctctttagatttttttcttaagcttttatttattttaaacaagaagttctttaaaaaaataactcaattaaaaaaaaaaactattcaacaactaccccctttcactataaaaaggagttcgagaccagcttggtcaacatggtgaaaccccgtttcaatacaaaaattagcctggcgtggtggtgggtgcctgtaattccagctacttgggaggctgaggccggagaattgcttgaacccaggcggtggaggttgcagtgagccaagatcgtgccactgcactccagcctgggtgacagagtgagactccttctcaaaaataaaaataaaaaggctatatataatactacacttaaaattatgttgataggtgtatgttttccagttcaaacaattctctgtattacttttttctcagggagatgtcagtttatttcaaatgtactttatataattatattttatagcatattctcacactacatatttaagatgaaatttgtaaatgtgattaaatttcacttaaaaattattgaattgaataaactgaaattcaacacctattccactgaattttactctacctgatgagtattttggcattgcagagaaaatctctttttttgaaaggaactcattaaatatcacttttgcatcaatattaggaccttttaatatgtagttgcacattaggagatgatgaagagttgcctgcagttctgcacacaaatactaatcttcatcccaatgatttccaaacttttgactttacaattatctgtattaccatactttatgttatattgttggaacactgggaccactagcaccttttaaaatgtccataaattagaataaaattataataaaaccacatttttatattttttcccaagagtttataatagaagactaagttttgtgggattcacaatatattatcaatgtatgtttcttgaaaatcatttagaatgagaaaataatttgaagtcaactaatatatatgtctccttttacatgaaagataaaacattattttctgtgaatgtaggtaaaataacttcaacaaatggaaatttttacctttaaaaaagattgtcatttattttctggtaactgttgtactctgaaaaatctaaagcctctctagtggcagaaatctacaaaattcaatacaggtttaatataaagaatacatgatctttaaaaaagtgcaataaagaaaatattgttttagtctcttgagagccatctttctagatttttcaaagtatagacaaaattgaagtgtttcaaccaattctgttattaacaatcctgaacaggattattaatcataagacatcaaaattctttagccttcaattttatcctttacaaaatatacttcttaaatccagattataacaccactcacttccacttttccatttagaataaaaggaactagtgagattatatgatttctacaagtatttaaaaaatattccaaattacaaatcagtgtaaaatctcctgaatatcaggacactgcatttcttaatcatacaataataatattgtcctttaaaattttggcttttaataactttttaaactttatttttaaacattataacttcctctagacatgtacttctccaatcgtgattgaaagcaaatattacataaaattgacttgcaaaatatcacagtaacatagttcttaatacagcactatattttattcatatcaacatcttttgacacaatttttctaaaagaagacgttaagaacttgttaagaatacacatgaaaagagattttgtttttaatcctacctttcctataaaccctagtaatcagaaagtagaaagaaatatctagctaactcattttttaaaaacactctaaatagactagaagctatgatatgaattcatgaaattggtatcagggtcattatttataaataaagttttggccgggcatggtggctcacccctgtaactagctgggcatgatggcgggcacctgtaatcccagctgagggaggctgaggcagaagaatggcttgaatccgggaggtggaggttgcagtgagccgagatcgtgccactgcactccagcctgggtgacagagcgagactctgccgaaaaaaaaaaaagttttatcataatacatagtctagaataacagaaggaaatactatactcaaacaatctaaaggaagtcatcaaaagccaatcttatttttcaaacatgttaaagataaataagaatatagacacgctaatataacaatttaaaaaataaccacaaaactctgtaagtaggatggatgatagacaatggaaggaagaaaagaagggaggtaattttaaaaaccatatacttcagacattttaattcccttgttagataaaactagtatgctcgggggttaatgtgtggcagttgtcagacacctttcacaccatggactaatttatagataattggaataaaaccctgagtttcaagcaggtatcacttatttttattgaatttcccttcttgagcatgattcacacatacttcacatttgcccatatactggctaagtaggacagcaaaatgccttaacgaaatgtaccattttaagaagctagctttttttcttagatgcataagttatgcttggagaaaatataattatattttcctgcataataaataggttttatgaaaaacacagcctttggagaatacaagagaaattattcactatgtttaacaaaagatgtagcagaacattttgcccttgattttcttattcaaatagtgggactagaaaaacttttgaagacgtgttagatgtagttagccattgaggtacactgaaaagtcagcacgagtgcatgagttggattttgttatgattattttgcttttgttttattattttttttcttactccctttggtcttgtcttatgtgaactccctttggtcttgtcttaggtgccattgaagacaccgtaaattcaaccccattatatggtttcattttaactcagaaggttagatatgttcagcacaaataaaatcagatattctcaggctcaccctaattaaaggtcctaatctaatcaaagctttcatgaagaaatgtcttttatggaggaaatttactggtgtgtattaataatggaagcacttttttaaagcaaggaaaactggtatgaatacaatttttatattaaatttagatgtcatgtttttattgatggtacagacgactacaattgatatatccagattcaagcccctacaaaacacagtcagaatatactggtacctgtctcttcatactgccttcacccagattctatgattcctttaagtgaacagaaagtctattcagtagggtagaattttaacagcataactggagagctcctgctgtccaaatgcatgcttccatgtggaggcctggaataaaaaggccattatagcttttggtacactctgtgggagagagtagagagagaagttgtaatgattagcaagtaagttttgtgattggcataaaaactagggaggcataaaagaatttacttttgtgcatattgttccatttttaccagagtgacttataatttagaggcttatttattccaaagaccagtaagaacttactacataagagacatgtagtctatcaaataaggagagtggttaaagtctcgtttttagtatcattgacttcgaaggttaaattccttttttttctttttttttttttttgaggcggagtctcgctctgtcacccaggctggagtgcaatggagccgtctgggctcagtgtaagctccgcttcccgggttcatgtgattctcgtgcctcaggctcctgagcagctgggattacagttgcccgccatcatgccgggctaatttttgtatttctgtagagacagggtttcaccatgttggtcagactggtcttgaactcctgacctcaggtgatcctcccccttcagcctatcaaagtactggggttacaggtttgagccaccacacccagcctcaagggttaaattcttgaattgataattaattccctgatatgcttacaattctgtttttatgagtacacatttaaataaagcttttgcatcagtctgatcgaaaaattagtagaattagtttaaaggtgtgattacatccaacatttcaagttaaaaatataaaattgtgatcacacttaatccctttggtttacaaatagcattttctctgatatcattttctgctaaattgtatgatatggtgtaggggaagtattatcactagccttcaggcactgtcagtgtgtgtctacgccttttattttaaaaatgtgaacccaatgataaacttcgaatatttgatttaatgtactatgtggtgagctgatttttacacaacagagaacctttgtctactcttagaaatagagcaaagaaaaatatttgaattttatatttgaaataatcttaaggatcatagaatccaagttctttattgtgtaatgggaaaactaagttttaaagcagatgtgacttacccacaatcacacatttattcagttgtggaacaaagaatataatctgaaagaaaaattattggacaaataatatccatctatcagattctagccagaatggggttaacatcagaaaactctatactatcagagaagactgcattgatttaaagtacaaataatgttatcttccatcaacatacatgaaagacgagtcttagaaaattcttatctctctgtatatataacacttttttcaataaaaatgtaaatcatattacttgtgttttatcaattctcattttgagaatggatagcaaaaaaattgaaaataatagttctcatatgttaatgcaaggaaaaaaaataaggtcatgccaaattccccattttcttctacaaattacagatgttatttcagtctaaattaagttgctatgtagtaataatccatttaggtggagaaaaatatccaagtttacattcatattaggaactatgtaaaacatgtaggtgtctgatgaaattttgtgtttccttgcagtatttcaaaccatacaattatttcatcactgccctccatttacgcaagtatattccctttaacttaaaaaatagtatatctgaaagtgagctttagatactgtccttcatattgggtctatgtctgcaggggcaaagagaccacatatcatctagtcagcactcaattattatatttcaaatgcttgttgcctgaaatacccatcttttgttctcctcactgtgtctttgcaacgcgccttagcacagtatcttattgacctccttggagcactaagatcattcactgcatgggaagaaatgattttcctcctcagcatggacatatttactgcacctttagggaagcccagcaaaaaagaagcagcttccagatagttttgttagaaaatactattacagaaattctgcataaattccgttttaggaattgttaactctttctgtgaatttaagtagtattaaggtgatttggcaagaactgtgaaaattaatgattgatttctctattggctcataactgtcaagattcttggataaactatttagaacacgacataaaagataagagattagtagtaaaaggaaacggttataaaataaaacatgttgaaataatagcagatattttttaaatgttgcttacttaaggtaatatttgttatggaaagatgctatcgaaatgcagattctacttctcacctggagtttctaagggaagattaaattgtaatcttagaaaaaaaatgtgaatgaatgtctctctcttccttcctccctttctccctgtctccctctctctctccatccctcgctctcccttcttcttcttttcttacctccttaacattttgaatgtttctagtaacttttcttataccattatgaggatttatatttagtgtttatttttcctgtcgaggcctttagaaggtaaacatttaccttgagaaaaaaatgatagttgtacatttttttctaatgggctttttcttttcttttttttttatttttttattttttgagattgagtcttgctctgttgcccaggctggagtgcagtggctggatctcagctcactgcaaacttggcttcccaggtttaggcgattcttctgcttcagcttcctcagcttctgggactactggtgggcgccatcatggctatatatatatatatatataagaattttaacatctattaaaatgtcattttggcaatacagaaattacattaacatgtttattctatttttgtaaagtgtcaatagcttcaatatatgtaaaaggtgattaaaaccaaaagcctttttaaaaaggagatgatctggtttcttccttcctcacaatccaagtttaaattgtgcattgtcatctataaaatactcttaaaggaaagaactcattcctttcctgcaattctattttttttaattctttccttttctaagttttgtttgtttgtttgttttgagacatcctttcagttgtccaggctggagtgcagtgacacaatcatggctcactgctcgcttgacctccccaggcttacgtgatcctcgcacctcagcctcctgagtagctgggacttccggcaggcaccaccactcctggctaatttttgtagtttttgtagagacagggtttcactatgttgctcaggctgatctcagactcctgggctcaagcaatccactagcttcagcttcccaaagtgctgggattgcaggcatgagccatcgcacacagcccctaaaattctcttatctagccttctggcatcttatcatcagcgtgtggaatgatagttgctgatgttgtcaaacctatgataacatgatgaagttcccaaagttaatttcggttaacactagcaccttctgaaatgtgagccaatttcaatactgcaatgccaagctttcctttcagccattttgcccttatctcccacaatgctatagaaagtagtgatcttaaaagatgacagagccaacaccaaatgacataaattctacttaaaatgtttgctcataggatcaaagaagaaaaaggtacacttgtttttcagtgacatgttcgatccatcattagagaatattgcaagcattactagagttattaaaattattcattttaaattattaaaattatgtcagctgaaacagtcaaaacataaattaaaggctcagaaggtctttaaaaatatctaatcagttttgttaatgtgtgaaaaaaacagtgcaattgtcatttattgaaatcaggcttaaagtgtaccattcaacagtttaaagcctacaccaggtacatctgatcattgtaggactagatgctatataaaaaatgattcactatatattctcacaaggcacattatgcaactccaaaatactctctttcagtactttatgagggacacaaatgtgtaattgtcaaatatgacaataatgtctaattaagaaagtacatatacatatataatatgtatatgtatgcacatacatttgactttgcttttctaacttaaaatttaacttaatgccttacattgccttattttgtagcactcatttataatttcgtcttgaacatgaaatggactttcacttcatttcatttgctgcttacttagaaagtatcatgatttcagttcaatgtgaaaatgctacctgtattgttcaacctgaaattaagtgtctctgttcagtgcttacatttactttcaacacagtttctttatgtgtgtaaatgagttctgaaacaatagaaaaaatgagaagttgcatgaaaatgatgaacattttcaaattcgtgatctaaattcagattcaccgagttcctctgtaaaatacttgttaagaaaacatgtatttctcaccatgagtagtgccttttttcctgtggtttatctatttagaacaaaactttaatgatttatttaatctctccctaagatccttttcacgatggcgaaagagagcaaaaaacatctatggttcagaataaataaaacaaagtcatctcactgaaatatacataaaaagaaactcaagtatattattaaaaagcagcatatgtatttttatttaatatattttaatagacataataattgaacatatttatggggtacatagtgatgttttgatacatacaatgcatagtgatcaaatcagggtaattagcatatcagtcacttaaagcatttatgatttcttgtagtgggaatattcgaaatcctctcgtctagctttttgaaaacatatcataaattattgtaaactagagtaatcctacagtgctatagaatgctagaacttaatcttcctatctagttgtaattttgtatcctttaatgaatgtctccctctctcctcttctccctaccctttgtagcttctagtaaccgcaattctactctctacttacgtgggatcaaatttttagtttccaaatataagtggaaacatgcggtattaatcctttgtgcctggtttatttcacttagtataatatgcttcaggctcacccatatctgtgtattcatttaaaaagcatattaaatgtgctatgaaataaagggtttgcatttttcctattgtaatatcataaatatcttccttggatatctaggtactctctcacttatatagttaaaaaataaacccatgattattttagtataaatttctggaatagttttctttctgaattttttaaattttaatttatttttgtatatagtaagtatatatatttatgtgataccttggatattttgaatcaggcatgcaatatgtaataatcaaatcatggagaatggggtacccatctcctcaagtatttatcctttatgttacaaaccatccaattatattcatttagttatttttaaatgtataattaaattattatcgactatagtcatcctgttgtgctatcaaatacttggtcttattaattctttctaactatttttgcactcattaaccatccccatctaaatcccaccacacactacccttccccaccctgggtaatcatccttttactttctatttccatgagttcagttgttttgatttttagatcccacaaataagttagaacatatgatgtttatctttctgttcctggcttatttcacttaacataatgatctccagttccattcatattgttgcatatgactggatctcattcttttttatggctaaatagtactccattgtatatatgtaccacatttctttctctgttcatctgttgatggaaacttaggttgcttacaaatcttagctactgtgaacagtgctgcacaaacataggagtgcaaatgtctctttgatatactgatttcctttctttttggtatatgccaagcaggggaattgctggatcatatggtagctcaatttttgtttttttgaaaaaactccaaactgttctctagagtggttgtactaatttatatttccaccatcagtgtactagggttccctttactctacatctgtgctagcatttgttattgcctgtgttttggataaaagccaatttaactgggttgagaggatatctcattgtagttttgatttgtatttctttttcatatacttgtttgacatctgtatttcttcttttgagaaaggtctatttaaatcttttgcccattttttttttgctcagattattaatttcctatagacttgtttgaactccttatatattctgtttattaatttttgtcagatgggtaggttgcaaatattttctccccttctgtgggttgtctcttcactttgttgatagcttcctctgctgtgcagaagctttttaacttaatgtgatctcgtttgtttatttttgctttggttgtctgtgcttgtactcatgaaatttttgcccagaccaatgtcctagagagtttctccaatgttttcttgtagtaggttcatagtttgaagtcttagatttaaatatttaatccattttgattttatttttgtataggatgagaggagggtctagttttattctccatacaaatatccaattttcccagcctcatttattgaataaactttcttttcccaagtgtatgttcttggcatttttgtcaaaaatgaattcattataagtgtgtggatttaattctgggttctctattctgttccattggtctatgtgtctgttttaatgccaccaggctgtgttggttactatagcagtgtagtataatttgaagtcaggtaaggtgattcctctagtttttttttttttccctcaggatagctttgataatttgggaatttttgtgattccatataagattcagggtgatttttctagttcaatgagtaatgccaccagtattttgataaagattgcattgagtctgtagattgctttgagtattatggatgttttaacaatattaattttaccatttcatgaacatggaatatctttcaattttttggtgtcctcctcaatttttttcatcagtgttttatagctttcattacagagatctctcacttttggttaattcctaggtatttacttttatttgttactattgtaaatgcgataactttttaaaatttctcttacagattgttccttgttggcatataaaaatactactgcatgttaattttttatcctgcaactttactgaccttgttcatgagttctaacagtttcgttcgtgcagtcttaggtttttccaaatataagatcatatcagctataaacaaggataatttgatttctttcactccagttttgatgccctttgtatcttctcctgtatgattgttctagctagttcttgctactatgttgaattacagcagtgaaagtgggcatcctttcaagtttcaggtgttagagaataggatttccatttttccccattcagtatgatacttgctgaggttctgtcatacatggcttttattgcattgatgtatgttccttctatacccatttctttgagggtttttaatcataaaggaatgctaaattttttcatatactttcagcatcagttgaaaacatcatatggattttatcctaccttctgtttatatgatttatcacattgattgatttgtgtgtgttgaaccactcttgcatcccaggggtaaatctcacttggttataatgaataatctttctattgtgtttttgaatttggtttgctagtattttcttggaaatttttgcatcaatactcatcacggatattgtcctgcaattttcgtgtgtgtgtgtgtgtgtgtttcttgatgtgcctttgtctgcttttggtatcaggataatattggcctcatagaatgaatttgaaagtattccatctacctctatttttaagaattgtttgagtagcatccttattagcttttctttacatgtttggtagaattcagcgttgaagtcgtcgggtctcgggcttttttaactgggattttttttttttattaagactttggtctcattacttgttatttgtctgttcaggtttcagagtacttcctaattcaattttattgggttgtgcatgtcttggaatttgtctatttcttctagattttccaatttataggcatatagttgctcatagtagccactaatgaccctttgaatttcttgcagcatcagttgtagcgtcttctttagcatttctagttttacatatttgaatcttctccttttttattagtcagtctagctaaaagtttgtcaatttgtttaactttcccaaaaaccaacttttttcactcatcttttgtattgttttcattttaattttatttatttctattctaatcttttttttcttatactaattttggtttggaatgcttttgatttcctagttctttaagatgcatcattagattgtttatttgaagtttttctcctcttttttgatgtaggcaaatatagctataaactttcttcttaacactgcttttgctgtatcccataggttttggtgttatatttccattatcattcaataggtggagttttctattccaccatcttgctccccctcctttcttaatttctggagttctagataaactttcaaaaccacccactgtgttactcagaatagagaatatgaatgtgttgcagaagtgacaaaaattcaggagtgaaagcttggtaaattcagtatctcattctccattatgggaaaatattctttatttacacagagtcagttttactcaaattggaagaacactagatcttcactgttaatcaaccaagaaaaaattttttaatcatagaacagtcggttttagaggtagaatatgccttgattcttctcaacatttttcaccaacgtatctctatctgcaaagaagagttaactggccactctgatgacctgtaagttcctcaaaacatactatttattgtaagtattgtgttttagttgtggaaaacaaagatattctacattctactcttcaatgtcttgtatacagcaagaagaggaaatgccacctttctatgccatattttatgcatgccactttctttaaatcagttaaaagacttgcattatttacagctaaacactaaaatttagcctgatattccaggccctaaagaattttttaaaaattactattattatttttaaaaattttatgggtacagggtaggggtatttatttatggggaaaatggcataacctagttaaagccttaaaccccttagaatcagagggactttattaattacatagttcaaacatatatatctaactataaccccttcgataatcctccatttttataaactattcttcagcctatagcacttagcaactcttaatttttaaattgatatattattaatttttgaattgaatatcacctctttgctctgaattttttattaactctttaatggctacaaaaaataattgaaataagtttgttcttatcatctgttttctgttttctataacttacacctatttttgtcattttctatatggcatattcttctcctaatgtgaactgtgaactaagaaggatcctgcaaaggagcctcactttcttcttggcatgcctttatataagctagctcttcccactgtcaacttcccacttcccaccaaactttccatactgtctaaggttattctttgtttccttagccctccaaagcctctcagttctcattttagcactttctagtgtaattaacttgtttacaaacgcgtattctctattataatatcagagcctgagtagcagggtttcgcgatgtgtatttttgtttctgcaatgcttaacccaacacctggtgcaacataggaacctcataacttttaaaatgcatgctgaataatagtatcagaaagaatcttagagatcatccagttctacatcttcactattaaagaaaataaaattaaggcccacacagcagaagtggtttgctaagtttataaggtttaaactttgtttgaaatggaagggaatttttaattcaagtgcatagtctaaaacacagaagaaatatttgatttgaccttcagtacttcttttaaatatgtacctaggatctatcatgatgatattttaacattcacataaaaaattaggtttatgatagggaggttatttttcaacttctcaagggacctgaaattttgacagaaaaatgtctaatattttctggaatataataatactgtaatcctgatataaccaaaggaaatacaaatcatacagattagagacttcaatggaatattttaaagtttattgtaggcagtgcttgcagtttggagacgtctgaggtctgagatcttaaactaacacattcatgacttcagataactggtgctatggctattgtatttccaaagccatagtttcccttatgaaacagctgcttggtatttgcatagcacttgcattaccatcccttctattcaattttagaaaggttctgtccttctctgattaaaagaattattgatcaaaagtcttatttcataagctattatgacagaggctcctggaaggtccttttggctaaacacatgtattagctcattctcacactgctatgaagaaatacccaaaactgggtaatttgtaaaggtaagaggtatgattgactcacaatttcacattgctgtggaggcctcaggaaacttacaattatggcagaagccaaagcaagcaccatctttgcagggtgacagaaaggagtgagtgctgagcaaaatgtaaaaagccacttataaaactatcagatcttgtgagaactcactatcatgagaacagcatgggggtaaccaccaacatgagccaattacctcccactgggtccctcccatgacatgtagggatcatgagaaaaataattcaagataagatttgggtggagacacagccaaaccacacaattccacccctgtccccacccaaatcttatatactcacacttcaaaacacaataatacctttccaacagtcccccagagttttagctcattccagcattaacccaaaagtccaagtccaaagtctcatccaagacaaggcaagtcacttctgcctgtgagcctgtaaaatcaaaagcaagttagttatttcctggaaacaatgaaagtatggaaattgggtaattctatctgttccaagtgagataaattggcaaaaaccaagaggctacagaacctatgcaagtacaaaacccaacagagaagtcaataaatcttaacactccaaagcgattttctttaactccatgtctcacatccaggtcacactgatgcaagaggtggactctcatgatcttaggctggtccacgcctgtggctttgtagggtacagccctgctctgggctgctttcacaggctggaatttagtgtctgcagcttttccaggtgcacattgcaatctgttggtggacctaccattctggggtctgtgaccctcttctcacagctccactaggcagtgccccaaaggggactttgtgtgagggctccaatttcacatttcccttctgcactgccctagaagaggttctccatgagggctccacccatgcagcaaacttctgcctggctatccaggtgtttccatacatcctctgaaatctagttgaaggttcccaaaactcaatttttcactctgtgcaccagaaagcccaacaccatgtataattcaccaaggcttggggcttgcaccctctgaagcaacttccttagctgtatgttgacctcttctagccatggctgagactgaagcagctgggatgcaaggcaccatgccctgaggctgcacagagaagggccctgggcccagcccatgaaaccatttttccttctaggcctccaggtctttgatggaaagaattgctgtgaaggtctctgacatgctctgcagacatttcacccactgccttgggaattagcattcagctccttgttaattaggcaaatttctgcagaaggcttgaatttctcccccagaaaatgaaatggatttctcctttctattgcaccatgaagctgaaaattttccaaacgtttatgctctgcttcctcttaatgctttgccacttagaaatttcttctgccagataccctaaatcatctctctcaagttcaaagttccacagatctctagagcaggggcaaaatcccaccagtctcttcactaaagcacagcaagaatcatatttattccaatacccaagaaattttttttctccatttgaaaccacctcagcttggactgcgttgtctatatcactatcagcactttggtcaaagccattcaacaagtctctgggaagttctaaactttcccacattttcctgtctacttctgagccctccaagcctctatgaaggtccaaactttcccatatttttctatcttctttagagccctccaagctgtttcaatctctgcctgttacccagttccaaagttgcttccacattttctaatgtctttatagcagtgcaccagtaccttggtaccaatttactgtattagtttattctcacagtgacatgaaaaaaaaacctagggtgaataatttataaagggaagaggtttaattgactcacagttctgcattgctggggagacctcaggaaacttacaattatggcaaaaggcaaagcaggcactttcttcacagggtggctggatggagtgagtgctgagcaaagggggaaaagccctttataataccatctgatcttgtgagaactcactaacatgagaacagcatggggataaccacccttatgattcaattatctcccacttgttctctcccacagcatatggagattatggaaactacaattcaaaatgagatttgagtggagacacagccaaaccatatcaacacataataagtttcacaggtgactcagtatttgaatatgcagcattcaaaacatcacaatttaatcttgacattgttcttccatcataacgcaggttgagttgtttttttccctgcccatttttctatgtgcccagacatattgtagaaaataaagttgctgaatgactaagtgaatgagttgtcttttaaaaaggcacatgctcatagaagagttacattgttactaatagcataatataaaagaatatatcaaataatgtttaaactctctgaaaatatggagttcattaggaaggaactggttaaagagtaaattagattaagacttatgtgcttgaagttctatatgaaaacaagaaaaaaaataaggtcatccactgctacactcaacttatgagtgatttgtcatgctttccaggactaaggagataagatcaattctttgtaaagtatcataaatcctactaaaaactcttggaaaaatattggtgtaaactcctctaagtagaaaagataagaataaatttgagatgattaactttctatcaaaacatttttcttccattctatagactagtgttttgtttatatttgtcttagtaattaaataattatagatagtttcagaataacttgctggtatcttaacttaattgatcttgattaagtaatcatgtttattttaagatattaattgctatgtcaagtaacagtcaaacataattatctttgctaggttttaaaatttgtttctaacatttaatatttgagaaattatgagtcatataattaaattttgtttaaaatttaagctatgggaacactttttacatttaataattataatttaaaatccttgccaaaatttccattgggcatctagttgattttacttgtcattgattcaaaataacaagcagccacttagtagatgtgtgggaggacatttgggtattttgtaattaactcaaaggcttttgtatgaaaaaagtgatgtcaaaaaaatctgaaaattatgttcatgtgtattgagatgagtgcattgggaaatttatgaaaacagaatcatttgcaggattaagaaaaaagaataaataaaatgctacataatatgatctacatttctgaatgtttatgactaatcaaatattgatgcttgttaaaaagcctttaaaaaaatacaaatagagcaaaggaagagcaagattgtgaaatataagcctacgctgtttatcccccaaaaggaataccaaattttaacaagtatctttacacacacacacacacacaccactgtcataagaaccaaaatttaagtgagcaatcatagtacatggttttaatatcatatcattaaaagaggcactgaggaggggagaagagacagtcttgaattactgatgccacctctccttcatctaatagcagaggtcttgtggtgcagaaagagaaactgtgcactttagggaggaatattgcagtgactggggactttacattgaacttagtcctgccctgtcatagtggagaatgaagctgtgctgggcttagccatcccttgcacattgagggagcatttggaccagacctagccagaggggtgttctggtggtcagaacttgagtttctcagcaagccttgccatcacaaaccgaattgctcggggtttctaggtaaacatgaaaggcaatgtgagacacgaggaatgcaattgctaggcaactcctagtgctaggctgggcttagagtcagtgaattagagtggcatgtgacctaggcagacaccagctggggcagctaagggagtccttgtgccacccctctcccaagcccagacagtgcagctcgcaacaataaagtgactccttccttcttcttgaggcaaggaaagcaaagagtaaaagggacttttattatgcattttggataccagctcagccacagtaggatagggcaatgggcagaattgtgagtccccctttctaggctctatctcacagatgacttatctagatacaaccagggctggaagcaaacccatggccttgaagggaaggaaccagttctggcagttagtcataaactgctgactaaagaaaccttgggctctgaataaccagcagtgactcatgtagtgttccatgggtggtgggttctgagatacgctggcttcgggtgtgacccagcacatttccagctgtgctggctacattgaaagactccaactgtttgagaaaagcaaaaggaaaagttaaagaaacattgttttctaccagctcatccacagcagttggagcaacaagcaggcccttgctttccttgtgtacagacctaggttcttggacatcatttatggacctgccctaggccaaagggaagaccactgccctgaagactgagtgctagacctgacagcagtcaccacaagctgacttggtctttaagtgaacatcagtggtgatctggctgaacacccatgaactggcagtggttatggccacagggagaaactcctctgcctttgtaaaggggatggaagatgtagaaggactttgttttcttgtgtgagtgccagcttagccacaatggaagagaacatcaggtaaactggtgaaacttttgatgccaagtcctggctcctagacatcactggacatctccaagtcctggggaaatccatcacccttaagaaaagcatcttgggcaagacccagtgctgtgctggcttcagatctggtgcagcacagtctcagtgatagtggccatggaggtgcttgcatcacaacatccccggcctcacatggctcaacacagaaagagagactctgtttatttgggagaaagtaagggaagacaatatgagtctcttcctggtaatctagagaattcttttggatcttatttaagactaccaaggcagtagctctaggagtccacaaaaaccacagtgttagtgggcttgaagcccaaatcctttcaaatacctggatagccttaccaagaaggacaatcccaggctgtgaaaactacaataaatacctgactattcaaagctcagacattaatgaacttgtacgagcatcaacaccacccaagaaagtttgccctcaccaaatgaactaaataaggcaccggggaccaatcctagaaaaatagagatatatgactttttagatagagaattcaaaatagctgtgttaaggaatctcaaagaaattcaagataacacagagaagttattcaaaattctatccaataaatttaacaaagagattaaaataattaaaaggaatcaaccagaaattctggagctgaaaaattcaattgacatactgaagaatgcatccatctttgaatcacagaatgcatcaagcagaagaaagaattagtgagcttgaagaaaggctataaaaaatacaaagtcagatgggacaaaaataattaaaaaaaacaaagaagtatcactacattatctagataaatagcctcaaaagcactaatctaagagttattggccttaaaggggaggtagggaaagaggtataggcagaaagttttctcaaagggataatatcagagaactccctaaacctatcaaaagatatcagcattcaagtataagaaggttacagagcaccaggcagatttaacccaaagaagactatgtctaggcatttaataaccacactcccaaaggtcattgataaggaaagaatcctaaaagcagcaagagaaaagaaaaaactaacataaaatagagctctgtattagtttattcttgcattgctataaagaaataccagagattgagtaatttataaagagaagagttttaactggctcacagtcatgcaggttgtacagaaagcatgatactactatatgctcaggttctggggagacatcaggaaacttaccatcatagcaaaaggcaaagggggaacaaatacctcacatggcaaaagcaggagcaagagagtgagtttagaggtgctacacacttttaaacaaccagatctcaggagaactcactctttattgtgaggacagtactgagggaatgatgccaaaccattcataagaaatcagcttccgtgatccaatcaccttccaccaggccccacccccaatattgtggattacattttaatatgaggtgtgggcagggacaactatattattctgaagctggcctctcccaaatctcatcttcttctaacatttcaaaatgcaatcacgcctttccaataatcccacaaagtcttaattcatttcagtgttaactcaaaagttcaaagtccaaagtctcatctgcttgaatttctctcctgaaaaagcttttttttttctctgtgatatggccaggctgaaaaattttcaaacttttacattatgcttcccttttaaatataagtttcagctttaagtcatttatttactcccacatatgaacacaggctattagaagcagccaggtcaaatcttgaatgctttgctgctgagaaatttcttccaccagatgccctaaatcatcactctcaagttcaaagtttcacagatccccaagccaggggcacaatgcaaccaatttttttgctaagtcataacaaaagtgaccttggctccatttcccaataagtttctcatttccatctgagatctcctcaacctggacttcattgtttctatgactatcagcattgtggtcacaacaatttaaccagtcactaaaaagtttcaaacattccctcatcttcctgtcttcttctgaaccctccacactcttccagtttctgtctgctacccaattccaaagttgtttccagatttcaggtatctttagaaaaattcccaactccttggtaccgtgtttttttttttttttttttttttttttttttttttttttgtgaaatagctgacactgggaaatttataaagtaaaaaggtttaattgtctcactgttatacaggctgcacagaaagcatgatgctggcatatgctcagcatctgggaaggcctcagaaaacttacaatcatggtcaaaggcaatgggggagcaattatgtcacatggcaaaagcatgagcaagagagtgaggagagaggtgcaacacacttttaaatggctagatctcagaagtactcactctctatcagggggatggcaccaagaaggatggtgttaatccttttatgagaaatcttcccccatggttcaatcacctccctccctggccccatctccaatatatgagattacatttcaatgtaagatttgggccaggaagcacattcaaattatatcaagctccaacaggtctggcagcagactttttctggaaaccttacaggccagaaaagagtgacatcacatatttaaagtactgaaggaaaaaaacttttactttcaaatagtatatctagtgaaaatatacttcaggcatgaagaagaaataaagacattcccagacaaacaaaagctgagagatttcatcaacaccaaacctatcctacatgaaatgctgaaaggtgtttttcagtttgaaagaaaaatatattaatgtgctaaaagaaaccatcttaagataaaaaactcactggtaatagtaagcacacagaaaaacagaatagtacaacactgtaatggtggtgtgtaaactgctcttaagtagaaagactaaataacaaaccaataaaaaataatgatgaaaacgaggaaactactagaactgataaacaaattcagtacagttgcaggatacaaagtcagcatacaaaaatcaatagcatttctatatgtcaccaggagacaatctgaaaaagaaataaaataatactcccatctacaatagccacaagtaaaattaaatatctaggaattggcaaaaaaagtgaaaagtctccacaataaactcataaaattctgataaaagtaactgaagaggacaccaaaaaatggaaatatatttcatgttcatggattggaagaatcaatattctcaaaatgtccatactacccaaagtaatctacagattcaatgcaatccctattcaactatcagtcacgctttttcacagaaatagaagaaaacaatcctaaaatgtatatggtttatcaaaagacctaaatagtctaagctattctgagccaaaaggaaaaaaatggaggaatcacttcaccttgcttcaaattatactacagaactatagtaaccaaaacagtatgtacttgtacaaaaacagacacatagaccaagggaacagaatagagaactcagaaataaattcacacacctacagtgtactagttttcaacaaaagtgccaagaatatacactgaggaaaagccactctcttcaaaaaattgtgctaggaaaacttaattcagagatgctgaagaataaaactagacccctatctctaaccacatataaaaatcaaattataatggattacatactttaagaactcaaactataaaattactaggagaaaatattgaagaaactctccaagacattgatctgtgcagaaatttcttaagtaatacctcacaagcacaggcaaccaaagcaaaaatggaccaatgggatttggtcatcaaattaaaacttctgcacagcaaaggatacaataaacaaagggaagagacaacctgcagagtgtgagaaaatatttgcaaactacccatttgacaagggattaataaccagaatacataaggagctcaaacaactctatacaaagaaaatcttataatctgataaaataagaacagaagatctgaatagacatttctcaaaagaatacacacaaatgacaaacaggcatatgaaaaggtgcttcacatcactgattatcagagaaacacaaattagaattataataagatattatctcatcccagttaaagtaattttttttaaatgtcaggcaatgacaaattctggtgagtatgtggagaaaagggaaacctctttcattgttggttggaatgtaaattagtacaaccacaatagagagtgctttggaggttcctcaaaaataaaaaaaaaaagaaagaaacaaaagctattatattatccagcaattctactgctgggtacacacccaaaagaatgaaaactagtatatctaatagatattggctctcccatgtttgttacagaactgtttacaatagccaatatttggagacaacccaagggtctttcaactgataaatgcataaagaaaatgtgatacatatacacaatgatgtactattcagccatattaaagaatgagatccaatcatttgcaacaacatagatggagctggaggtcattatgttaagtaaaataagccaggcacagaaacacaaatattgcacattctcatttattcgtgcaatctaaaagtcaaaacaattaagtttatagagatagagagtaaaaggatagttaccagtagctggaaagggtagtggggtttggggggaatgctgggatggttaagagaaaccaaaaacaattagaaaaaatgaataagacctactatttgatagaacaacagaggactacagtcaataataatttaattgtacattttatagtaactgaaatagtataattggattgtttgtaatacaaaggataaatgtctgagtagatagatacccaacattccatggtatgactattacacattgcatgcctgtaccataatgtctgatgtacctcataaatatgtacacctgctatttacctacaaaaattaaaaattttgaacaatatgcttagttcatattaaccaagggtggatataaattttagatatactataaattttttgaaatgttaatctagtgagtgtgactttgtatacaaaatctagatagatatgatgtcaacaggatttcacaggaaaagttcaattaaaaaaaagaagttggctttttgtggtggttgctgttttggtttgagcattaccaagtagtcggctctatgaaatccaaacgaatccaccaagtcatatcaatatcacaaatttatttaagctctggtagacacaacagagtagagcatggacttattaactataattttatattatttaaacattagatgatcaagtgaaatacatttgagaatgcaacagccaactatcaaatcaaaacatgatgaataagtttgttctattaatattttattgaaaatagtgagttatcttaacctcttttagatttgtaattaatgcagaaaggaaagggaaaatataattacaaataaatgtttagttatttaagcaaacatgtacatacacatctgtctaagcatatttagatgaactaaatccagatttagaaatacagcctttgaagaaccacctgaataaatgtttttctacaccttaaaatatactttattacccagaggaatatgatgaaactaatgcttaatgaaactacttactccctccaaaatgtgcctacatttcaattgtataaaaatgcaaaaagcctattttcactttattgttacatattttaaaagtactaagtatttgaagggcactgagcatttaactttaacatctccctttttgccagttagaaaagtgatatgaactttttattgagttgttgcaccccactgatttcctgaaatactcaaaatgtcatgtattttgtaaattttaatattttgttaaacgactagaattactctaaaatatcctaaagcaacacttggaaatcatccttcaccagagataagaagtgttcatgagttctctattctgttccattggtctatgtgtctgttctagtaccagtaccatgctgttttggttaccgtagccttgtagtatagtttgaagtcagatagcatgatgcctccagctttgttctttttgcttaggattttctggtctatacaggctcctttttagttccatatgaattttaagatagttttatttttaattctgtgaagaatgtcaatggtactttaataggaataagcattgaacgaataaattatttggggcagtacggccattttcacaatattgatacttcctatccatgagcaagggatgttttttcatttgtttgtgtcctccctgatttccttgagcagtggtttgtagttctctttcaagaagtccttccttcctttgttagctgtattcctaggtatttttctctttgtagcaattgtgaataggaaatcattcatgatttggctctttgcttgcctgttgttggtgtattggaatgctagcgacttttgtacattgattttgtatcctgagactgctgaagttgcttagcagcttaagaagcttttgggctgagatcatggggttttctagatacaggatcatgtcatctgcaaacaaaaacaatttgactttctctcttcctatttgaatacgctacattttcttctcctgccagattgccctggccagaacctccaatactatattgaataggagtagtgagagaggacagccttgtcttgtgctggttttcatggggaatgcttccagcttttgcccattcagtattatattggctgttggtttgttctcacttatacatgggagctgaatgatgagaacacatgggcacatgggtgggaacaacacacactggggcctgctggaggaggagggtggtgggagggagagcatcaggaaaaatagctaatggatgctgggcttcatacctagatgatgggatgatccatgggacaaaccaccatggcacacgtttacatatgtagcaaacctgcacatcctgtacatgtacccctgaacttaaaataaaagttgaagaaaaaaaagatcatacaaaaagccctggctgacttgagtactagtttgtgcacagagatgatggtatttcagagcaaatgtactgaaatcttccatcctcaatacactacaaaaattttcataggctgggcccagtggctcacacctgtaatcccagcactttgggaggccgaggcgggcagatcactaggtcaggagattgagaccatcctggctaacacggtgaaacctgtctcaactaaaaatacaaaaaaaattagcccggcgtggtggcgggcgcttgtagtcccagctactcgggaggctgaggcaggagaacggcgtgaacgtgggaggcggagcttgcagtaagccgcgatggcgccactgcactccagcctgggcgacagagtgagactctgtctccaaaaaaaaaaaaaaaaaattcatagtagtcatagtttttatatcactttagagtcaatattcagaataattagaaacttaacaataaagcaaatttctctaccacacacaataaaagaaatatccatgaggaataatagaataaaccgtaagtcaattccagaaaaagctctgcctttttgagtaatatattgatacttaagtatcactaaaactgttcgaaggctatatttaaatatccagaatctttaaatactatttattcactgccagcatcactttattatgaattctagaggtagtgtacaacctgaagtatcacaattgtgcaaaaaaaattataataaaactgaaaaggagtcaataacgaaacattcaaagaaacccagccagttacaggacaggctattttgtacgtctttaaaaatacgctactgcattgttatcaatttctaaattcccagtctgaagcaatgtaaaatttacgtagttgtttatcattttaaatgtttacataatagaaatatttttaaagttcatttctctctcatgttcaaagataatggaacctttccctcaactttgctcgggaatcttcactaattaaaatttatatttctggttcattattgttatttaaatttaaaggaaagagttggtaaattggtacatatttataatataatttattcattaatcattggagaggtattgtgctaagagtgaaagagtacaaaattttgagccatgggcaatgacttaaatcctgtttcttttgcttaattagctctttggccttagaaatttatttaacctcctgattttcagtttcttcattaaatacttgatgagtatttgaattaaaataacaatactttatagggttgctgttataattaaataaaacattgcaaggcatgcagcagacactgtatttgacatttatgtggcttttaaaaaaatgtcattaatcctttattaagggccacctcaacacacttgtgatttattttgttcatgggttaatgcacactcagataaaattgtagaaaatactaaacatatagaaaacattaaaaataaaaatcacgcaggtataatcattgctaaaatggtggtgtgatacagtgatttattacaatcattttattacttgatgtcttcctttttttaacttaacattataccatgagctcttccagtgtcattaactattttttgatattttgatttttaatggtatattccactgtatgccttccattgtattttgatttctttgagtaaattaacatttggaattatgtgttcattggccgggtacagtggctcactcctgtaatcccagcacttggggaggccgaggtgggcagatcaggaggtcaggagttcgagaccagcctgaacaacatggtgaaaccccctctctactaaaaatacaaaaattagccatatgtggtggtgcgcacctgtaatcccagccactcaggaggctgaggcaggagaatcacttgaacctgggaagcggaggttgcagtgagccgagatcgcaccattgtactccagcctgggtgacagagtgagactcagtctcaaaaaaaaaaaaaaaaaaaaaaaccagaaaaaagaaagtatatgtttgttgaaatataatatcttgtgctatttttacatgtttcacatcagtttaactgtggtggtaatcatttaaattttgcaggagctatagtacatcaatgaacttacattcatatactctgttgtttttacatgatagagtttaagttctaccatatgcaataaaacattttgtctacacaagtgtacagttatatttttaatgtgcgtgtcttgctagaacacatttaatagtaatcgttgccatattttgaaactatattaatccatattttatgaaatactgttatagtttatcaagagaaaaatgatgttttgtttaacataaattacttgatcatattagtctattgagcaacagcttgtaacccccgtgaatcaacggaatttctaaacagctaaatgagtcactgttactgaggttgctcctttgaggtgccattacaaaactgtaactcttcactgtatgcaaaagtaattaggtgatcttactgatcattatagcattagggtaggagggagagagaagataattttttaaatgtcatgaaatttaatactgggaaacctgcatattttagctttatttcagctcaattttctaactatgcctaccccagggtactccagcataatatttttaccttccaactctcaaacagctcagttggtgagaagattgttaataaccataatgagttattctctgtcataatctaaatctatcttctcaagtccaattatttttgatgaatatattctgctaacttgagcttgaatggaagcactgttctataatgaattaactatagacatagaaacggtattatggggaatgcatatttagaacataaataagaagagagaaaaaagaataaacacatagatatgattcatttgaaggcctctttttaaaaaattgacatttttaaattgaattgtaaagataataaaaaatatctttgatgagtttttataatttatagaaattaccttacattgttttcaaattgatgacagagctaactgaaaggtttttgtaaaaccagaattaacctttactttttattcctgggcacaatattgaatgaagcacagaatgagtgttttaaattagctctcatttgttttgatgactgtttttttctgggaagagcttgatcacatgcttacaatttccatttatgtattataaggagcaatgtacggctgctctgtttactttgtgactttggccaggatacacaaacctaattactatttttcattaagtttttaattgctattaaattagtattttagtaaaataaaatttaatttataaatttaaggtaaatactttaaaataaaataatatttagtaattaaatatcgaattagtattaagggagatgaattggtgaaaaaatatgaagttgatatttgatgatataataagatgtaataaaagtgtgtggagtttgttggagcataactcaaaattgtatgcaaagaaagcagtctgcgttctttattaactatttggcataataaatattgcaggcttacttgaagtcccagatacaagaattgccgtaatgagtcagaatgatgtcgattctaaaagaaaagtggtgctgtatatgatccagtaattttatttgatttaggctaggtttaataggaatccctactgagaacttgcttatatttattgcaagcttcaacagttattcaccactatcaccattcctcaactttccaccctacttcctatgttctcagcctttctctgtcactaggctcagtaggaaggaaggataaatggcaaatgttggatgggaccaatatttaatagggttggttaaatagaatatttgaaaatcataatattaaacaaatgaacaatgaaacaataaaattttcaaactgtgtttgatatgtggaaaaaataactaaattaggccttcaaattaaacttgattatatatgtgtagataaaatgtagaatgaattgtaaataacgttctgaaatgtgacttaaaatgtcctctttaacattctaatgctgattacattaattgtaatgtagattacagtcactgtgtgctttcattagaaataaagcttaaaaactaagtcatgtcactatgaaacttcttattgcaaattataaatcagaagtttctctgccatagtcattgattttattagagttgagagcagttcttagtaggcacgtcttatgtaatggatgtgagcagcggaaaactagtaaatacatctgagaattgcccagttgtggcttatattctaaagagcaggaagaaaagtaataaactgcttgactgtctgactgctgatgaccaactgcaagactggttgaattttatgaatttatgtctaaaatataggagtacattttttcagcagccaaaatgttattactattttatttgtgtagtatcttaactatcctttaatctcatcaaatagtgaaaagtaaattagaaaagtgaaaggcaatttttaaaaaacaaactgagggctgggccctgtggctggccaggcgcagtggctcagccctgtaatcccagcactttggtaggctgaggcaggtggatcacttgaggtcaggagtttgagaccagcctggccaacatagggaaaccctgtatgtactgaaaatacaaaaattagccaggtgtggtggtgtgcacctgtaatcccagctacttgggaggctgaggcaagagaatcccttgaatctgggaggcagaggttgcaatgagccgagatcacggcactgcactttagcctgggtgacagagtgacactccatctcaaaaataaataaataaataaatacgaaataaacaagctcaggaatttagagaattaattcatattatttttcagaaaagatctgaatgcaagctgtgatgaaattctgaaaaattttattctaacttgaaaccaaaaatcattctaccttctgaatatgaattgaatgcttttgaatggggaatgtaccacaatgcatgttgtccctactatcccacaagaggaaatggtagttagacaaacgctgtattaggaatgaggaaagtagggttctaggcctgcctttgccatgatttttgagcacttggggaggtgactttactttgccttggttttctattctgtaatattactagatgaccctttaggtgtcttcagttcttttcaagaaagaaaaacaatcttcaattcattttaagggaattggttttggaggaaaagcaattgccctgacatttattgaacagtccataataaagtaaaatagaaaaaataaagagctattattcagcattattccctttataaggtcaactaaaaactgacaaactcatgcttgagttctgagtggacactcatttaaagtatcatgaaccatgtgcagcaattatagtaggatggtaatacatatttacaccagttcagttgtaaaagaactctaaagtttttacttatgtttgtaaagaaatcaaaaagctattttaaccaaaaatcttttaaataattttaattacatagacacttccatatttatttcataaatacccattttgtctttaaattttgccagtttcatggaaataataataatagagtgtaacataaaaataaggtaaagttttgtaagatcctaatgtaaagaaaatactataggcttttcataattataaatatgtgcttaagatgagaataacagaggcagtcatgagaatgtaaattagtccttttttatgcagattatcttagctaaaattgaacattccctattccacagagaaaactacagtttaaatgcatgttcatgcaaagtaaggtagtttttaatgctgttaggtatgattcgtgtgcctcatttaagactgaatggcttttcccgcagaattgtagtatttacaatgcataaatcctttctcatactgcaaatacagtgcaaccattaccaactttgtgagataggaatccttccaaattatttcagtaacaatgtggggagttaagtgaataacttcctcttttctttggaaaacagtttcacttttaagcactaaaagcattcttgtcatgccctgggaaataaacttccaatgccattaactgttctgtcatattgcaaatggagagtctgctatttcttaaaatcaagaatgaaagtttcagcgaaattagtgaatggtcatctgactaattctggggagaaatagttacattttctttatataaaagatgttcactctgataatttatgttcaatttatcaagaccaacaaatgtgaaataccttctttatgtcgtattagctcagcttgataatacccaagtgctaagttaattaccgtagttattagagtttcatggagtggaaacatgaaaatccttagccacaatttaaatcacatttttaggatgcttatatatctcccaatacatgaagagaatatttagaagacaagagagcaataattcatttttttcaaaataatataataaacccgtcagttaattttcagttattgaaatgcccttcaagtatttttaatattgtcatctagtggaattaatttaattgttgtttcctcatatcgagtgcacaggcatgaagtgattagacttactaactactgggctaagtagttgtttatgtgatttcagttattgcacatacatttacaaaaatttgtttttgacagtcaactatattagatgttttgagaggtagatgttctgcatttgaagattacaaaaaatactgtgtgtttggttggtagtttttttcacttaacccttagaagtttggttcagcaggctaacatgaatacttcaaaactgaaaacattttggaaaaaatgtctcaaacatacggtaatgctattatatgactgtaaaagtgcactgcttttggtattttagataagttaaatattccagaatgcttaaaatataagaaaaacaagtatgccgtttttcatcacttcattctatttggtttgctacattattttatttgaaatcaatcatactatatatatatttacttaaatttgggcatatgcatgtacgtgtaagataattttatgagtacattatgtacgtaaataaacaaatgcatagtttgaatatatcatggataatttaattatttcatctatgccaatctggtattacaggctatgttttatttctattttgttattaattaaattacactctatttaaatattttaacacctttcagggtttgtttttaatttttaataatttttatatggtgaaaatttgctaatttaaattttaaaaatttaataattttatatggtgaaaaattattataaattattgaaaataaggtgatgtgcaaaaatagactttgtggtctttttcacttttgtcttttaccttaggctacaattgactttataaaataatatattatcataggttcattagtaaagtgtgagcttattattcaaaaactgttgtctactattatgtttgtgtagacttatgactgaaatgactgattgtaactatagattaaattcaattgttaccatatttacttactaactcaacttcctcattcttcccaaattccaacaaatatattttcagaacacaatgaatccaattagcttcacaggtaaactataccagtcttttgggtctgatctgttttgttgttccttaacttgactcatcatttcaacatattgaagcttgtgactcctagtatcatgcactgacaaaaactagttggtcttcctagaacggaattttgtaggtaacctggtgtatacacacacacacacacacacacacacacacacaggtgctatatatacatatatataggtgctccagggttgggttcatgtatatttaaaatcattacatcctcttgctgaactgaccacttcgtcattatgcagcgactttctttgtctcttatagtttttgtcttgatacctatcttgtcttatataactgttctgctctttttttttttattttcattggcaggtatatttttggcagatatatttttctatccccttatttcctggctatgtgccttcataggtgtgtttctttataagtgtgtttcttttagacaacagatcaatgagtctttttttttttcaatccattaagccattctatgtcttttcattggagagtttagtaaatttacatacaatgttattattgataagtaaagacttgctcctgctgttttgttattagttttcttgtggatttgtggctttttctttctttttgctttcctgtattttgtttattgaaggtgattttctctggtgacacaaattagtttcttgtttttaactttttgtgtattctttgtatgcttttggtttgaaattaccacgaggcttgtaaatatcatcctataagtgattatttcaagctgataataacactgtttgcatgaacaaaaaaagcacacaaaaagaaaagtaataaaaacaatgccttaattttgtttgcctgtttttttactttctgttgtttctatttatatcttattgtactgtctatgtcttgaaagttgttgtagttattattttttattgcttcatcatttagttttttacttaggaaaacagtagtttatacactacagttacagtgttataatactgttttagctgtgtaattactactagtagtaaattttatactttcaggtgattacttaaggcttattatctttcttttctttctgactgaaatatttcctgtaacatttcttgcagggcagttctggtatttattatattctttagcttttgttttgttttctttggatgatgttggtctcatagaattagttggggagttgtccctccttttccatggtttggaatagtttcagaaaaagtagtagcagttctcctttgtacctctggtagaattcagctgtaaatccatctgctcctagactttttttggttggtaggttatttattactttctcaattttagaactcattattggtccattcagagattcaacttttttctggttcaggcttgggagggtgcatgtgtccagaaatttatcagtttcttctagatttttctagtttatgtgcatagaggtgtttatagtattctctgatggttgtttgtatttctgtggagtcagtggtggtatcccccttatcatttctgaatatgttcatttgaatattctattttcttctttattattctagctagtggtttctctattttattaacttttttcaaaaaaccagctccaagattagttgagtttttgaagagatttttttttctatctttttcaggtccactctgatcttagttatttcttgtcttctgctaactttggggtttgtttgcttttggttctctagttctttcagttgtgatattagaatgtcagcttgagatctttctagcttttcaatgtgggcatttagtgctgtgaaatgttctcttaacattgctttacctatgtcccagggattctggtacattatctttgttctcattagtttcaaataacttaatttctgtcttaatcttcttatttacccaggagtcattcaaaagcaggttgttcaatttccatgtagttgtatagttttgagtgagtttcttaattttgagttctaatttgattgtgctgtggtctgagagattgtttattataatttcagttcctttgtacttgctgaggagtattttacttccaattatgtgatcagttttatagtaagtgccatgtggcaaagaatgtatattctgttgtttttgggtaaagagctctgtagatatttatcaggtccacttgatccggagctgagatcaagccctgaaaatttttgttaatattctgtctcaaggattgatctaatattgtcagtggggtgttaaagtctcccactagagttgaacaatgagaacacatggacacagggaggggaacatcacacactgaggtctattgggggatggggggctaggggagggatagcattaggagaaatacctaatggagatgatgagttgatgggtgcagcaaaccaccaagacacgtgtatacctatgtaacaaacctgcacgttctgcacatgtatctcagaacttaatgtataataaaaataaataaatagatctctcactattattgtgtgggagtctaagtctctttggaggtctctaagaatttgttttatgaatctgggtgctcttggataactagctcttcttgttgatttgaagcctttaccattagtaatgcccttctttgtcttttttgattactgtttgtttaaataatctttttttcagaaactaggattgcaacccctgcttttttctgctttctatttgcttggtaattttttctctatccctttattttgagcctatgtgtgtctttgcatgtgagatggttctcttgaatacaccactctggtgggtcttgactctatccaccttgccattttgtgtcttttaattgggggatttagcccatttacatttaagtttaatatggttatgtatgaattggatcctgtcatcatgatgctagctagttattttatagacttgttaatgtagttgcttcatagtttcattggtctgtgtacttcagtgtgtttttgtagtggatcataatggtgcttcctttccatatttagtgcttctttcagtagctctttcaaaggagacctaatggtgatgaattccctcagcaattgcatgtctgaaaagtattttatttctccttcacttatgaagcttagttaggccagataagaaattccgggttggcaattctttctttaagaatgttgaatattggctcccaatcttttctggcttgtagagttatcactgagaggtcctctgctagtctgatggtcttccctttataggtgacctggcctttctcatgggctgtccttaatatttttttccttcacttccaccttggggaactgatgattatgtgtcttgggtttgatcttctcatggagtatcttactggggttctccagatttcctgaatttgaatgctggcctgtcttgctaggttggggaagttcttctggatgatatcttgaagtatgtttttcaacttgattccatttccctcctctctttcaggcaccccaatcagttttaggtttggtctttttacataatttgatagttctcagaggttttattcattcctttttattctttatttctctaatcttgtctgcctgtctaattttggcaagataatcttcaaactctgtatcttttcttctgtttggtctatccagctattgctacttgtggttgaattgtgacgttcttgtgtttttcagctccatcgggtcatttgtttttctctctaaactggttattctgcataacagctcctggaatgttttatcatggttcttagcttctttgcattgggttggaacatacgtctttagctcagcaaatttcattattacctaccttctgaaacctacttctgtcagttcagccatctcagcctcagtccagttctgagtgcttgctaaagagatgttgtgataatttggagaggaggcactgtggctttttgagttttcagcatttttgcattgattctttctcatctccatgagcttatctaccttggatcttagaggctgctgaactttggatggagtttttgtggggtcttttgttgatgttgctgctttctgtttgcttgcttttcttttaacagtcaagctcctcttctgtagggctgttgcgattgctgggggtccactccagaccctattcacctgggacactcccacacctggaggtgtcaccagtggaggctgcagaacagcaaagatggctgcctgctccttcctctgggagctttgtcccagaggggcactgaacttatgccagctggaatgctcctatataaggtgtctggtaacccctgttggagcatctcatacagtcaaagggcatgagatcagggacccactcaacaaagtaccctggatgccccttggccgagtaggtattctacactggggaggatccccctcatctggactgcctggacttctcagagccagcaggcaggaaaaactaagtctgctgatccatggagactgtggctgcccatctcatcaggggctctgtctcagggatatcagagttctatctgtaaactggctggaggtgctgaaatttcgacaaggaggcccgactcagtgaagagggatggatcctagtcccatctaaagaagtagtcaggccatgatctgccacagccactgtgcggtgctgtggggaatttcttccggtccaagcagcccagtctccctctcactggcagggaaaaaaaagcctactgaagctgcagtgttggtggttggccctccccctgggatctcagtcatttaggcactctccaacctgctgccactggccacaacccaagtggctgccgagagtctgcacagctctgtgcttgggacccaagtccttggtagcctgggctcatgaagggatctcctgatcagcaggttgcatagatccatggaaaaagtatgatttcccgagtttggtaacacaatcactcactgcctctcttgggtggaggtgggagctccccttgccccgtgtggctcctgggtgggccattgctcaaccctgcttttcctcactctctgtgggtcatgccaacaacctagtcagtcccagtgagagaacctggatacttcagttgaaggtgcaggattcactcactgagttcatttttcttggtgagagctgctgaccaccatttcttctaatcagcaatcttgacttctcctccatagtaggattttttaacatgtttcattttgcaattgatagaataaatagagaaaaaaaatctgtaagaaatagtgggtctaaacaataccaacaaacacattgacctacttggatacttatacatagacaaacactatatcccaaaactatagaatatgcacctttttttaagtgcacatggtacattaaccaaggtagaccattgatatgttctgtctgtgtccccacccaaatcttatcttgaattgtagctcccataattcccacatgttgtgggagtgacccagtgtaggataattgagtaacggggatagtttttgcccatactgctctcatgctagtgaataagtctcatgagatctgatggttttataaggggaaagctctttcccttggccctcattctctcttgcctattgccatgtaaaacatgccttttgcttccaccatgattgtgaggcctccccagccacgtgaactgtgagtccattaaacctctttttctttataaattacgcagtcttgggcatgtctttatcagcagtgtgaaaacgaactaatacagtaaattggtactgagagtggggtgctgctgtaaaaatgcttgcaaatgtgggacatgactttggtattaagtaacaggcagagattggaacagtttggagggctctgaagcagatagaaaaatgtgggaatgtttagaacttcctagagacctaatgaatggcttctaacaaaatgctgacagtaatatggacaataaagtccaggctcaggtggtctcagatggagatgaggaacttgttgaacactggagtaaaggtgactcttgctatgttttagcaaagagactggtggcattttgcccctgccctagagatttgtgtaactttgaaattgagggagataatttagggtatctggcagaagaaatttctaagcagcaaagcattcaaaaggtgacttcagtgctgttaaaaacattcagttttaaaagggaaacagagaataaaagttcagaaaatttgcagcctgatgattgatagaaaagaaaaatccattttctgaggagaaattcaagccggcttcagaaatctgcataagtaaccaggagccaaatgttaatccccaagacaacagggaaaatgtctccaaagcatttcagagacatttgatcacagacctaaaggcctagaaaaaaaaaataggtttgtggtcccggcccagggtccccctgttatgcacaggctagggacttggttctctgtgtcccggctgctctagccatccctaaaagggaccaagatacagctttggccatggcttcagaagatgcaagccccaagccttggcagcttccacgtggtgttgagcctgtgagtgcacagaagtcaagaattgaggttttggaacctccacctagatttcagagtgtgtatggaaatgcctagatgtccaggtagaagtttgcttcaggagcagggtcctcattgagaacttctgctagagcagtgcagaaagaaaatgtggggttgaagcccccacacaaagtccccactgaggcagtgcctagtggaactataagaagaggatcaccatcctccaggccccataatagtacatccaccaatagcttgcaccatgcactgggaaaagccacagacactcaacaccagcccatgaaagcatccaggagggaggctgtaccctgcaaagccacaggggtggagctgaccaagactatgggaactcacctcttgcattagcgtgacctggatgtgagacatggagtcaaaggagatcattttgatgctttaagatttcactgccccactggattctagaattgcatggggcctgtagtccctttgttttggccaatgtcttccatttggaatgagtgtatttatccaatgcctatactcctgttgtatctaggaaatagcaaacttgcttttgattttagtctcataggtggaagggacttgccttatctcagatcagactttggactgtggattttttttttttttagatggattctctctctgtcgcccaggctggagtgcagtggtgtgatctcggctcactgcaacctccgcctcccaggttcaagcgattctcctgcctcagcctcctgagtagctgggattacaggcatgcaccatcatgcctggctaattttgtgtatttttagtagagatggggtttctccatgttggtcaggctagtctcgaactcccaaccttagatgatcttcctgccttggcctcccaaagttctgggattacaggcatgagccactgcacctggccttggactgtggacttttaagttaatgctaaaatgagttaagactttggggaactgttgggaaggcatgattggttttgaaatgtgaagacatgaaatttgggaggggcaggggagaaacgatatggtttggctctgtgttcccaccaaatctcatcttgaattgtagctcccataattcccacgttatgggagggactcagttggagacaattgaatcatggtggcagtttcccccatactattctcatggtagtgaataagtctcacaagatctgatggttttaaaaggggaaacctcttttgcttggccttcattctctcttgcctgcttcagtgtaagatttgcctttcactttttgccatgattgtgaggcctcctcagccacgtggaactgtaagtttattaaacctctttttctttataaattactgagtcttgggtatgtctttatcagcagcatgaaaatgcactattacaactattttctaggttattaaaaaacttattgaattcaaatgaattgaaagcacacagaatatgtttatttatgttaatggaattaaaatataaataataagctgtcttggaaaaatcacaatatttggaaattaaacaatatactttgatgagacaatgatgaaataaaaaagtaagaaaatattttaaatggaattgtaataaaaataaaatatatcaaaatttatgggatgcaactaactaaaaccgtgtccagagtaaatattaaaactttaaataattatattagtgatgaggggaaatctaaaattagtgttgtaagattttacattaagaagctggaaaaataagtgcaaaataaacccaaagcaaggataaagaaattatgaatttctcaacaatatagaaaacaaatatttgagaaaattaacaagccaaatgttcatcttttgaaatatttaataaaatttgatataccctcagctagactgatcaaaaaatatatgaaagcaaaaatcaccattatcagtaataaaagacagtatcttctcagatcctacagatggtgaaaagatcatcagaaaataattatgaacaactttttcccaaagaaattaaacaatttagaagagatagacaaatttattgaaaggcaggagctaccaaatctctctcaaaaggaagatacataatcgaaatagttctgtgtttattaaagggattaactttgttgttaaaaatattcccctaaagaaaactccagttctagatggcttctcaggtgaagtttggcaaatatttatgaaagaaaggataacaattctacataagttgttttcaaaaaatacaagtggaaagtaatcatgacaactcatttttaaggccagcattattctctttttttccttttttttttttttttgagacagaattttgctcttgttgcccaggctgaagtgtaatggcacaatcagggctcaccacaatctctgcctcgggggtacaagtgattctcctgcctcagcttccagagtagctgggattacaggcgtgtgccatcatgcccagctaatttgtatttttagtagaggcagggtttctccatgttggttatacagtcccatgggctgtacaggatgcaggatgctggcatctgctgggtttctgggtagacctcagaaagcttacaatcatggcagaaggcaaagtgcagtcagcactgtacataactggagcaggaaaggggggtgctacacacttttaaacaagcagatctcactcactatcacaagaacagcatcaagaggatggattagcgcattcatgaaggattcatccccgtaatccgatcacctcccaccaggccccctgcctccaacaccggggattacaattccacttgagatttgggcagggtcacagatccaaaccatattaattgtcctttccaaattcaaaagccaaatgtaaatagtgctttcttttttttctttttttttttttttgggacagagtctcgctctgtcgcccaggctggaatgcagcggtgctatctcggctcactgcaagctccgcctcccgggttcatgccattctcctgcctcagcctcccgagtagctgggactacagcgcccaccaccaagcctagctaattttttgtatttttggtagagacggggtttcactgtgttagccaggatggtctcgatctcctgacctcatgatccacccgcctcggcctcccaaagtgctgggattacaggcgtgagccaccgcgcccggccaaatagtgctttctgaagaatactttgaatcactaaacccaaagcatgagaacattttgcatcaaatgtgatatcaaaattgagtgcattatttcaataatacccataatatcataaaatataaaatgatgaattaaaagtttggcttttctgtacattgtattttaactttggatagctttgggtgtttaaaaatactttacagttacatgataaagaatagtatgtaacataatattcaataatattattcatgggttatttttagttgctaaggtaattcagaggcttttaaaaaataacaggacttaattgcaatattcatcaaatactacttctaaagaagaaaaatagactttctactgcctattgctgactgaaccagtgtaaggtggtcattacactcattttactgatgtggcaataaactgataatacaaaaaaatgctacacttactggttaattagaaatcctacagcaaattaaagtcacttgtcattgtttaatggttgttgatatcatgagctctgtattgctgtacaggcagcattttaaaaaacaaagaatatttttgtgccactgaggacagtttgtttcattgaccgagaattgtgtttttttcaacattttattctaattgcaatcctagattagtaataacaatttgtttaaacctgatctttgttaaactaggtaacctatttaatttagacttcaaatcatataagagtaagactatggaaacttgaataatttaacctaaaatacaattatggaactatggattgattaatggtctggtgtagaataaacatactttattaacataaagtatagctgtatttatacctataaagtagcaacatttaatgatactttcttagaaagtccccacactcaccaagttcttgtctgcctacctatgtaggttccaaattactaacttggtgatgatcgcttaattaaattggtgtccagcaaattccagtagatattgtagaaatattaggtgaaaatgggattactcatcttatggtattttttcctagtgtatcctttggctgctctggttagttcacatgaatagatggaagttatcagtcttcacagattattcccaacaagacagaagttagtcacacaagtctctaataaaaagttaaaatcttgattgaatatttcaaataactcagctatgcatttgtaccacatttaactaaacactgatgtgtcagaccattagatgagtcatatatttctcatttattgttttgaaaagaccaaattatgaactctacacagaagcctttttttttttttttttttggctgaaattagcatatcagttacaacctgatacagccctaaaacacaatattgacagtcttcattggggcaattgggaagctgctgaaagtgcaagagatcaaaaagagagatcaaaagcaattttacagcatcttatttcttttcatgagagttcagcttagaacattaatcaaatagtgtgtataagacctttatcatacgaaatttgctatcagagattaacagatacattaaatggaacagtttgactggaaatatttgtataatgaacattcaattctgcttcggcatgacattaagaaaaacgtctttaaaatatatatttactctcaaattgatagcgattagaaaataataaggagcatcagcagagtgcatttaatcatgtctgtgaacctgatatctgaattttgaaagactgggattttctctattacttaaaacatattctacatcatccaattaaaaatgtgatttaatagatagttctcaaaagtaatctaaaggttaaaaacatataagcatttagaaagtagaaaaatatttgtccaaatgaatttaatatcataagagcaaattttccttctgagccaaaacagatgaattatgctctgacagtgatctttattgaattgtgctaaaatatatttcgatatactgtaattttttctgacttcttctcagtaaatgcagatggcaacagttcacttgtaaatggtttcgaagaagagatattgaagtaatattctctgaaatctattctttgcagatagctatttctattactctgctgtatattccatcttctcagtgtactccattgatgtgtgtgttgccagaatttttgtccatcatttaaatagtaatttcatttcaagtttccttttcatcatgataaaatgatcaactatatgactgcatcacaattttcctagggaagcattactgtgatattcacagagtagtttgctactgtgtgagaggctaatatatttctctaggaagaatattcaattcataaaaattaaatgttattaatgagttacagaagccctcagagaatgttgtttaaagtataattaaattgaacctcgctaattcacaatgcatgttattttgaacctgcattgagttaatttgtgatggtcccatactttcttcttgaaaaatagtttttaagataattaaatggggttggtatttaagaaagactgtacagtgtactaaaaaatatatatttaaaataatattttagcaacattcattcacatcgaaatcctgaaaatgtttattacacttctgtcctttgtgcattgtttaaaattgatttactagtggttggtggattttcatatacttgtgtgtgtgtgtgtatatatatatatggatgtacatatatatgtttgtgtgtgtatatgtgtatatatatacatataatttaacaaagagcttgaaataattaaaaggaatcaagcagaaattttggagttgaaaaatacaattgtcatactaagaaagcattagtcttttaataatagaattgatcaaacagaagagagaattagtgagcctgaagacagactgtatgaaaatacacagagaagaaagaataaagaataaataataaaaaacaataaaacacgcctacaggatttagaaaatagcctcaaaagagcacatgtaaggggtattggccttaaagaagaggtagagaaaatgaagagggtagaaagtttattcaaggggatactatttaataacagagaacttcccaaacttagagaaatatatcaatatccaagtataagaaggctgtcgaacaccaagcagatttaacacaaagaagacgacctcaaggcatttaagaatgaaatgtccagtggtcaaggactaaaaaaaagatcctaaaagcaccacagggaaaaagaaaatacaatggagctcaaacatctagaagcagacttttcagtgaaaaccctacaggccaggatagactggtaagacaaatttgaagtgctaacaggaaaaaaaacaaaacaaccaacaacaacaacaaagaaaacccttctaccctagaaaagtatgtctggttaaaaatattcttcaaacatgaaggagaaataaagacttttataaacaaacagaagctgacatatttcattaacaccagacctctcctacaaaaaatgctagagggtgtacttgaatcagaaagaaaatgatattaataagaaatcatttgaaggtacaaaactgactaggaatagtaaatgcacaaaaaaccggaatattataacactgtaactgtggtgtgtaatctacttttaagtagaaagacaaaatgataaacctgtcaaaaataataatttagcaacttttcaagacataaacagtacaataacatataaatattaacaacaaaaatttgaaaagcaggggacaaagttaaagcatataatctttattagtttactttttgcttatttgtttatgcaagtactgttaagtttttaccaccttaaaaaatgaggtataagatagtattcgcaagcctcatggtaatctcaaaccaaaaaacatacaatggatacacaaaaaatagaaagcaaaaagctaaatcatatcatcagggaaaatcaccttcattaaaatgaatgaagctgcctttctaaaaattgttatcagtgagacaattacaaaagtgaacaagatctgagctaatctacccccccatcttacctttcccttaattattcctgggctattagtacaaggtaactttgagagacatttagtctgttgtttaaatgataataggtcttacccaaaactcaacagggcttttgtaaagctaatgggaggccatcagtctaggctgaggagaggagccgagtcctgctgaggcgcagacatgaaagattttcggccattaatctaaagattataagatctgcagcttccccaattattccgccgataacaccactattgtagattggccttttaagatatatttttcttttttttttttgcatatctgacacccatggctccacctggaccaaccaaccccacccaattcatcctgcaagaggacagctatgaccctctatgatttcgtttccaccccaagcaatcagcaatgagcactcattacctggccacccccacccctttccccaaaatgcctttgaaaaacacctaactgatgagctttggatgagatgatttgagtataaactctgactcccacatggggtggctggcatcatgtctattaaactctttcctgcaatggcatggtctttctttatgcagcaggcaggaagaacctcttgggaagttataaatttgggggctcatctgggatcccctgaccacagtttgttagtccccccaccagaatgaggaacacagaggtgatctctggcagctgcttatttaactgaagcctatctctggtgctgtctctgctgatgaggtgctgttgacccacagggcttgggcctaattgcagtggagaaatagtctggaacctacctggtgaacatgctaggcactaccatcacctccacccttcccctgatctattggccttactaagatgcactgtagccctgtcacagggactggccctatcacaaggattttcagatggggaaactatctcctcagttgggtgaagaatatgggactgtttgaaggaatgctcctctggtctggaatcggtttggaaggccttctgttcatctttgttgtgtgtgtttgtatttgtggatggtatctctgaagaaattgctgatgaaagtccagcaggcttaactcagagaagcctccttatttgtctggtcacatttggtaagccctgaagcaattgttagtggaagtcaacaggcctgactaggggtgattatcccctcttcaaattgccctacactacccattgaattctcagtcagaggtccctcctcactttgaatggatcaaagaaaacagggagcaaaggaaattggtcaatattgggtgttcagcaaggtgactaatgtctgtcccttttgttatgtgtattttgtgacagctgggatggaaaatgttaatttggttcccccaatgaggtttccccatgcagcccattgggtggcatcttgcaaaattaagaggcttttgcctaaggctccatgaaatggaaaaaggtgattttcctttgtgactatagtgcagtgagcagggtcgccagggccccaagggaaagggaacttggaaaactggcatgccagcaaaagaaatagaatgaatttcttaccaatcaggcttctggctcctctctctctttgtgcaaaccagttgagtgatctgtaaaaatcactgtttattaatgagaaaaaggatttgtgaggcaagtctgagactgtagtgaatctggtgtaccttgcactatgaattagtctttctatgccattctgtcataaagaggggtaccgcagaatagaatgtgtatttaggacccctatcagcttgctactcaagccagcccggcaggttcgtcagttacaaactatgctacagatccctggagcaaaaactagataaaggtttcttcttgtcttgctttacatccttgagagcatgactttatgactatgtggggtactctcttttgggcctgtaccatctggagggctggaatatttgagtttatgtcaggtagccagtctgagaggacaagcggtctgagatgaatcagcatgttcttcatcctgaatatgccaagcccctgggtgagctttgtcttaaaagtcctcatctttgttgggattttatcatcttttgctatcttaagcccatttctgaaagtaaattcttgggaatcatggggatcatggggattatggagatatctcctctactctctttctggaaacaccttttgctgatatggtaaaagcctggaaatttgagatctagactttaccagactttttgaattgagtcgctattggaactgaggataccattaaaagaaaaaggttaaattaaaagaaggatccataataataacatggttcctgagcagttaaaatcctttgcaagcttgaaaatgttcaagactccctcagggaagaataacagcagtcacctttgctctgggtcagttgctaactctttaccctctccaattggtggcctgggttcagttttggctttggagtgagtcctttgaggtttaatacttgtagaaattttgccatttattgatattttttccctccatggagagcttctggtcttgaattttcttttatctgaactacctttggggagattctagatcttgtaaaaatcacttaccatttctttggagacgcctcgtgtgcctgttgctaagctgtccccttagtaatggcttattgatttcacataggaggttacctttagtaaaaaagattcaaggccaggcgcactggctcacgcctgtaatcccagcactttgggaggctgagttggtcagatcaccaggtcaggagatcgagaccatcctggctaacatggtgaaaccccatctctactaaaaatacaaaaaattagcagggctttgtggcatgcacctgtagtcccaggtatttgggaggctgaggcaggagaatcgcttgaaccggggaagcggaggttgcagtgagccgagatcacatcactgcactccagcctgggtgacagagcaagactctgtctcagaaaacaacaacaacgaaagattcaaatgccagaaatattggctatttatcctggctaaaataaaatattttaaaaggatttttctttggagagctccatagataatggagctatatgcatgcagatgttgttttaaagtccctgccctgcctttaaacacttctcagttgatggaactctgtcttgattctctgtttctgtctgtgtgtgtatctacatgtatatatgtagtgtttatttaaaagagctctaatgaattggcttaatgaataataagcgcttagatcaaatttcagaaagaaactttaacatgttttaggtcatgtgactgataatctttgaaaaataaagacagttaaaagattactggtaaactaaaataaaaatgtttttaaagtttatacatttggtgtaaattaggcaggtcagatatggtttgctagatgctttaaggtaataaacggcttctatgacttttaataattgttgatttgtctgttttacagtcattagattctaaataaggtctggagacatacagagttagccagattccctggctaggctgggaagagtcagacattgtatgcagctttgtctttgtcatgggctctgcaatgttatacgtggttaaaattgcttgcttaccaggttttttaccaaaactaaaagttgctaagggttaacagcatagcatgtacttgagactactggaaaaacaattttacattcatgttgtgaaaggaaagtagaatttgtttttggtaagaggttataagaaggcatgggaatttttgttgttgttgttaaagggcatgtaattttgtctagctcagaagtttaaaaaaaaatttcttaaaagagtaatgggacaaaacaaatttgaagcaagttgcaaagggtttgtgaaggattgatcttgtaaatgaagttctgtgggtgttaacaaatggctaaaatttgaaggagatgatctagtttttctgtaggttaaacattaaaataaagtacactaatggtgggcaagaatctgtgcccatgtgtctgaataacatgtttttcttagagaatggacctgctgtttaagagaaaattgtaaagagttataagaggtttctgaaaattttacctcatggtcaaactgattaagatggtatagatttgtttgtaagattttattaataattgggtttaacatctataagacatgaatgcaaaggtgagattttgtgctctcttttaaacaatattttagtgtattatgaaaatattataaaagatttttgtatgccttttgaataaacgacagaaattagaggggggagagagaagacatccagttgttttcaagctgtctttattgagtcctgtttggaaagctgaatctcccctctatcagcaagtaaagaattttgcttttaaaattttctttagttatccttttgggctaaataaatgacttacagttacttgggatttgttttgtaatatcaagtgtttaaacatttgatatttgacaaactttccatggtcaaattgtaaattaagcccttttttgatctaatcaggctttaggagcagatattaaatactctaaagtccaaaagagatatatttggcttatttggtatatcaaaatcatacaggaagcattgtcaagtagaaaattgtgtttggctttcttctttgggctgtatttgcataaatgtgttattggtgtgtgttccagaattgtgtgagattcttgtaattctgatatgtctcagtatatgtttttagtaataattatgattgttatgttattatgtgccacagagatgaccagactttaatcatggctgttttgagacttttttcagccacagttgttttattttgatttttttcaggttggttttataatcagctataggactctgacgggtgcacttgaatgcaggtttgtgataactttggagattgtgacattaaaatagaagaaagaacttccaagactcccatagggagctaatgtgtatgaatatcaagcagaacaggaattaattacatagactgaattaatgaaaaaccaaaataatcttcctacgaatttgtttaaaacattgctaattttttttttttgttttggagtccagcaaaccttttttttttcttgtgagatatctacagctttaaataatttggtaaagtaccctcctgtgagcaaaatctgaagcatatttctctctccctgatttctccagaacttgaaaactatttccaagtgtacttaatttatgacaggtatagttatttgcataagttcgataagaatcttttttcttttgtaacaggaaaaaattggagacactggttattttaccatggcattgaatgaaatggcatacttttagattcttttaaggagtcaaagttgacttatagagccaataaaagtcccttgggaaaactgacctcgtaacttgtctacacagtccctgtttaggggtcctgccatgtggtaagtaaagaatgtcacttcctgacaggcccaaaaagccgaaattatcttggcaccttgaggtgagaaattcacccaattaatacagttatttgtaagcatagataaatctgtggctacacttaaaggctttaaaaaagtttaatctaagatttcctatggaataaaattccagcaatgcgaatttaaaaagggactgtgtggtaaataattattcttgctgactttatgcaaatactcaggccaagtatagtaagactaaaacttattttacaaataaagtagtcttgctgtgatttgtttttagtaaaaacaaggattggagagagaaaaattatatttcagaaaaaactatagtacacctcttattacattctagtcccctattttgagtttttataattttctgcaacttggaatgaatactaaattctttccagactacaagtctccatactaatgctttcaaagttttgtttcctttttcttttttgacttggcctcaataaaattgtcactacctctttcctgaggccctgtaagttaaagcttattgcttgtaatacaggagagagaaaaatgtgtcagattgttactactgtcctcctctatacctaaagatgctttaaatctaacacctggataaattgtacccaacattaacctttgtttttcttctgtctctataaaactgcctcttattaaaattagtttgccttcataaaatagagaggtctagccaatctgaagtgctacctcctcatgtgggaaacagctgtttaactgagctgatctagtctcgggacttagacactgactcaaaagatattcaactataccgaagatggtatatttaatttgctctttcctgtttatcccaatctgtctttctaacaacctatggtttgttgttcacttaagtgctgtattagaactgtgggtgagaatattaatgtttttgtcatacaccagtgagtacacgcagatggctgcaaagcagcggttttactcatattctcctgggaccaacctcccccaattgtaccacccgtcagcaggaagaagccagagtagtcattgctgtttttccatctctgtgaccaacatcttaagaataaggtgaataaaagccaaagggggattgaaacaacctttgcaaaaaatatatcagtgagaaaattttgactatgaggaactatatgccaaaaaattggaaaatctgtaagaaatggataaatttctgggcacatgccatctaccaagattaaaccatgaagaactctaaaacctgaacaaaccaataacaaaaaatgagatcaaaactgtaataaaaattctcccaggatataaaagcccaagacctgatggcttcactactgaattgtaccagaaatttaaagaactaaatccaagcctgctcaaactatccctaaaaatagaggatgagaaaatacttccaaactcattctacgaatctaatattagcatgataacaaagccagtcaaagacatgttaaagtaaaacaaaacaacaggccccaatgtctctgatgaatattgatgtaaaaaccttaacaaaaaattagcaaactgaattaaacaatacactaaaaagattatttatcatgaccaagaagtctttattcctattacacaaggatggttcagcataagcaaatcaatcatatcaatagaatgaaagaaaaaaaaactatgattatttcaattgaagtcaaaataattacattcaataccccttaatgagaaaaactctgaaaaactgaacacactaccacataataaaagccatatatgacagacccacagctagtatatcacgctgaatagtaaaataataaaagcctttcctctaagatttgcaacatgataaggatgcccattttcaccactgttattcaatataatactggaattcctaactagagcaatcagacaagagaaatacataaagtacatttaaattggaaaggaagaagtcaaattatctttttttgctgatgacataattccatattgggaaaaaactaaagagtgcaaaaaaaccattagaactgataaaaaaaattagtaaacttgcacgatatgaaataaaaatacaataatcagtagcatttctatatcccaacagtgaataaactgaaattgaaattaaaaagtagtcaaattaataatagccacacacaaaagtaaatacctaagaattaacataaccaaagaagtaaaagatcgctataataaaaaactataaaacactgacaaaaaaaatttcagagaacaccaaaaaaggtaaaatattccatgttcatgaattagaaaaattaatattttttaaatgtccatattacacaaagccactacagatttaatgtaatccctatcaaaataccaatgacattctttatagcaatagaaaaaagaatcctaaaattcatatgggaccacaaaagacccagaatagccacagttatcttaggcaaaaagaacaaaaccagaggaattatattacctgccttcaaattatgttacagagctatagtaaccaaacagcataaacctgacataaaaacagacacatagaccaaaggaacagaattgagaacctacaaacaaatccaaacacatacagtgaactcattttctccaaaaatgctgagaacatacactggggaaaagacagtctcttcaataaatagtgctgggaaaactggatattcacatgctgaagaatgagactagatccctatctctcaccatatacaaaaattaaatctaaatggattaaagacttaaatctaagacctcaaactgtgaaaccattaaaagaaaagtattaaaaggaaacatttgaaaaatgctcaacatcaatccaggcaaagttttctgtaataccccacaagaacaggcaatgaaagcaaaaatgtacaaatggaatcatatccagttaagaagcttctgcacagcaaataaaacaatcaacaaagtgaagagacaacccacagaatggaagaaaatatttgcaaattaccccccagacaaggtcttaacaagcagaacatttaaggagctcagctcaaacaactgtattaaaaaaaacaaaacactaataatttaatcaaaaaatggacacaaaatgtgaatatacatttctcaaaagatgacatgcaaatggcaagcaggcatatgaaagtgtgcacaatatcattgattatcagataaatgcaaataaaactacaatgagatatcatctcgccccagttaaaatggcttttatctaaaagacaggcaataacaaaaactggagagggtgtggagaaaagggaaccgccatgcactatttgtgggaatgtaaattagtacaaccactatagagaacagtttggagggtcctcacaaaactaaaaatagagctactatatgattcaacaattctactgcttggtatataccccaaagtacagaaattggatatctccaccccttttttgacaactctgttcacaatagacaagatttggaaacaacctaggtgttcctcaacagataaatggataaagaaaatataaaatttatacacaatgtagtactattcattcacataaaaaatgagattcagtcatttgcaacaacatggatagaactggaggttatcatattaagtgaaataagccaagcacaataagatcagcattgcatgttctcaattatttgtgagatctgaaaattaaaacaattgaactcatggagatagagtgtaggatatgattaccagaggctgggaagcatagtagagaaagtgagtgggtggcagggatggttaatcattccaaaaagtagttagaataaatggataatacctaatatttgatagtaaaacaggatgactatagtcaataataatttaactgtacattaaaaaataactaaaagaatataattagattgtttataacatgaaggataaatgcttgaggggatggataacccatatttcatggtgtgattgttacactttgcaagcctgtatcaaaaaatcttatgtcctctgatatggcttggctgtgtccacacccaagtctcaccttgaattgtagctcccataatccccatgtgttgtgggagggacccagtggagataattacatcacggtggcaggtttttcttgtgctgtttttatggtagtaaataagtctcaagagatctgatggttttcaaaagggcagttcccctgcacatgctctcttgcctgctgccatgtaaggcatgccttttttcttctgccatgattgtgaggccttcccagccatgtggaactgtgagttcattaaacttctttttctttttaaattacccagttttgggtatttcttcatagcagtaagaaaatggactaatgtagcaaattggtaccaggattagggcactgttattatattaagatacccgaaaatgtggaagtgactttggaactgggtaacaggcagagattggaacagtttgtagggctcagaagacaggaagatgtgggaaagtttcaacgttcctagagacttgttgaatggtgttgaccaaaaagttcaggctgaggtggtcccagaaggagatgaggaagttattgagaactggagcaaaggtgattattgctatgctttagcaaacagattggtagcgtttttcccctgccctagatatctgtggaactttgaacatgagagagatgatttagggtatctggcagaataaatttctaagcagtaaagcattcaagaggtaacttgggtgctcttaaatgcattcagttttattcattcacaaagaaatggtttgaagttggaacttatgtttaaaatgggagcagagcataaaagtttggaaaatttgcagcctgatgatgtaatagaaaagaaaaacccattttctgaggaaaaattcaaagctggctggagaaaatttcataagtattgagaagccaaatattaatcaccaaaacagtaggaaaactttctccaggacatgtcagaggtcctcatggcagcacctacagtcacaagctgggggtgtctaggaggaaaaaaattgttttgtgggccagatccagggttttgctgctttgtgcagtcttgggacctggtgccctgcattacagccatggctaaagggggccaatgtacacctcaagacattgtttcagagggttcaagccccatacattggtgtcttacatgtggtattgggcctgtgggtgcacagaagtcaagaactgggaatctccacctaaattttggaggatgtatggaaattgctgggtgtccaggcagagttgtgctgcaggggcagaatcctcacggagaacctctgctagggcagtgcagaagggaaatgtgaggtgggagtccccacacagaatccccactgaggcactgcctagtggagtgatgagaaaagagccaccatcctccagaccccagaatggtagatccaatcacagcttgcaccatgcacctgaaaaagccacagacactcaatgccagcctgtgaaagcagccaggagtgaggctgtactctgcaaagccacaggggcagagctgcccaagaccacgagaacccacctcttgcatcagtgtgacctggatgtgaaacatgcagtcaaaggtgatcattttggagctttaatatttgaccacctcactggatttcacattttcatgaggcctgtagtctcttcattttggccaatttctcccatttggaataggcatatttacccaatgcctgtacctccattgtatctaggaagtaactaacttgcttttgattttacaggctcataggtggaagggagttgccttgtctcagatgagactttggaccgtgaacttttgagttattgctgaatcaagactttggggaactgttgagaaggaatgatttgttttgaaatgtgaggacatgagatttgggagttgccaggggcagaatggtgtggtttgcctgtgtccccactcaaatttcatcttgaattgaagctcccataatctccacgtgttgtgggagggaaccagtgaggggtaattgaatcatcagggtgggtttttcccatgctattcttgtgatagtgaataagtctcaagagatgaaagaaagaaagaaagaacaatgatgtgaaataattaaaacgctaatacattgctgatgggaatgtaaaatggcgtagctactaaggaaaatggtatggtgattcataaaaaaaaaaaaaaatattaaacataaaattaccatatgacccaaccattctactctgggtatatactcaaaagtagttgaaatagagattcaaacaggtatcagtacccatattcatagctgcattattcacagcagccaaaagttggaagcaacctaagagtttatcctaagagcaaacagcaaatggagaagcacttattctagaaaatctactaatattctgcaagaatagtgagagcctgtggcatttgaatcataatccatatctcgccacacaatttagtgtgacaaaagcttcatcccttccagggtcattcaaaaatgcagaactccttttccctccaactccaagtctagggttaaggtatcttccactgaggcacaggcttccaggatttctaatttctaacaggtctgtgttgcagaagctctattataggttaagaacactgtgcctagttgcccatactccaattcacttatagagtagaaatcccatgctgggttaggcatgttaagaagaccagaggatacttcacctgtctgctaaaaagcagggttatacatctaaaagaagcaggctactgtcctcatttttatcgtgagagcagtggcacacatatattgcccaggggatgataaatacagagagctccaaagctatcctcaagagaagggactcatttggagcaaagtatgggggaagttcaagctaagggagttgtcaaaaacagtggagattttgctggtaaggcaataagaagaagctgatagctccatgagacaaaaaaataaaaattacattaaaatttaaaagactgtagattagctgtaggtttagcagagacaaccaggaaaaagtgcagagaaaaagcccgcttgggtcagaaccaacatccaaatgttgccttaaagactacccctgcaaaggggctcacatttgattgtatcagactgctgagcaatttatgccttaggacattgccaaaaacaatcaagcaatcagccagtaatgagtggagcctaactggctgagaacggataccaaatgaagcaagtagtttagctgaaaaatcagggaaagagactgtcaaataaaccttagctaaaattactgacatctcagtgtatgtccatatttaaggccgtaccctctgatgcatgacatcagaggtaacacattcaatgggatatagacttcgccaaatattctagccaagtaacaaaacaagcaaataaacaacaacaaaatcaagtcccagagagggtagtggtatcagtattcacaattgatgcaatatataatctaaaatgtctagtttttgataaaattatgaggtattctgtgacaaaattatgagttacactgtgagctctacatgaaaaaaagcaagcaacaaaaactaactgtgagagggctctgttgtcagatttaacagataataactacaaagaagccattataatcatattcaaagatttaaaagaaactctgcttaaataagtaaaggaaggtaaaatgccaatattttatcaaatacagagtatcaataacgaaataaaaagcacaaaaataccaaatggaaactctggagttgaaaagtacagttatcaatatgtaaaattgactagagtgattcaacagtgcatttgaaccaatagaagaatgaatcagaacactcgaatttaggttgatagatattatgcaatctaaagaaaaagagagaaaaaagaacaaagaaaaaggcatatattcagatcttattttttattctatctgacaatgtttgccttgttttttgttgtttaatctattcacttcattgaagtaaaaaagaaataaagaacaattatgaggaaagtgggtatcagaaagaaagaagaaaaaggagtggaaataatactagaagaaataatgttattaaatttctcaatttgataaaagtcatatatacacaataaatttaatgaagtctgataaacacagagatccacatggacacatttcagtaaaaatactgaaagataaagaaaataagaaaattttggagggaaaaaaaagactttcagtggataccagaaggcaagaaggcagtgaaataacaaagagtcgtaagaaaaaaaaaaggtaagaaataattttttatccagcaaaatattggtcagaaatgaaagtgaaatacaaaccttcctagataaacaaatattgagacaatttattgctagcatatccatgttacataaaatactaaaggaaattcttcagactgaaagtcagagactcaagatagtaatttgaaaccacattaaaaaacacaatattggcagtaaaagcaattatgtaggtaaacgtaaaagacagtataattttgttttttcttttttctcctcttaatgaatttgaaaaacccttgtataagacaagacaagacatatgcatctatatataaacaattgtataagatatatacatatataattatatatacacaattatatatcattttgttcagtctataacatatagaaattcatatacaataataatacataattacaacattagcacaaagataggtagaagcaaagtattggagtaaggaaatgatgccagattataactagaattcacaggaaaagaaataaaagaacaaaattgtaaaataggaaggttaaaaaaatataatttataattatgtactactccccttttatcagcttcattaaaaatacataaattaataattatggcaatgtagttattgaattttttacatatatatgttacagaaaagtaaatagtaaatataggtatataggagtaatatctctatgtcccatggaattaacttacattaagtcaaaaacaactatgataaattaagtttcaagcactagacactaagagaataacactcatacacacatacacacacatatacatacccgcacatgtatagtgaaaaatatcataaaaagcattaaaatattacactagaatgtattcacctaatgcaaaagaaagctgcaaggagaaatggggaaaccatgaaacacatagaaaataaaaagaaaaatgacggatatcagttcatgatattaataacaaagtaaatggattaaacaacataaaacaaggccaacagtgtcagaatacaaaataagatctgaatatatgcctacagtatgaacaacccagattcaatgcattgaatgtaaaattacggaaaatcattatactatgtaagtaagaatcatgagaaagctgaagtgactacactaatatccggcaataaaagactttaaaatatgttaccagaaataaagaggaacattttatcatgaaaaaatggccaaactatcagaaaaacataataactacaaacatacatgcacctaactccagtgccaccaaattcatggagcaaatttgacagaattgaagagagaaatagacacttcaataatagttagatatttctatatttctttttcaataatggaacaactaggcagtagatcaataaaaagaagactcaaacagcactctagcccaactagaaccagcagacatgtatctgactacaagagcagaatacatatactatgaaactgcacaggcatgattttccaggatagactatatggtaggctataaaagaagcctcaataatttgaaaagattgaactcatccagaatatgtctttttatcaaaacaaaagaacattagaaatgaataacaaaagaaatttggaaaattaacaaatatttagaaattaaacaagatcttcctaagtaataaattggttaaagaagaaacaacaagagaaattccaaaacatttaatggtgaaatactcaatgcttttcccataagatcagaagcaagacataggatgtccatacttaccacttctattaaacattaaacattgtactagaggttttaccacaagtaactaggcaaaataaataaataaataaaagatactaaaacatccagattgcaaagaaagaagtagaattatctctatttgaagatgatatgagtttcttatacagaaaatcttatgaaatctattaaaaacttgttaaaactaatacttcagcagtgcttcaaggtataagagcaatatattaaaaattgagtgtatttctatattctagcattaaacatttcttaaaaaattaagagaatctcatttacagtagaataaaatgaaataaaatgctgagaaataaatttaacaaaagtccttcttatcttctaaaaattctaaactattggtgaaagaaattaacaatctaaataagtgaaaagacatcccatgtccttaatttgtaagacaatattataagatgcaatccttcacaaattgatcttcagattcgacacaattcaacttgaattttgcagaaataagacgctaatctggagctgggtgcagtggctgacgcctgtaatcccagcactttgggaggccgaggcgggcggatcacctgaggttgggagttcgagaccaccctgaccaacatggagaaacctcgtctctactaaaaattagctgggtgtagtggcacatgcctgtaatgccagctgcttgggaggctgaggcaggagaattgattgaacccaggaggcagaggttgcagtgagccggagatcgtgccattgcactccagcctgggcaacaagagggaaattccgtctcaaaaaaaaaaaaaaagacgctaatcctaaaaccatgggaatttaagagaactagattagccaaaataattgtgaaaaataagaacaaagttggataactaagccttttccattttaaaactttcctcaaaccaatagcaatcaatggacaattgattttcagccaattaaagtcaataaataataaatagtctttccacaagtggcattgggattgctggatatccacatgcaaaaggataatttttagataccttccttacaaaatgcatagaaataaccactccaaatggatcattgaccttaatatgagaacagaagctataaaactattagaaatcacaggagcaaacctttatgactttgcattaagcaaagttttcttagatctgacactaaaagtacaagcaacaacaaaaaaatacattatacctcatcaacttcaaaacttctgtacgtcaaaggatatcatcgagaaagtgaaaagacaaaccacagaatgtgagaaaatatttgtaaattgtatatcttataagagtcttatatttagaccataaaaagaacttgtaaaatccaacaatagtaatgcaaaagatatactttttaaatgggtaaaaaatacaaatagacatatttttccaaagaatataaacaaattactagtaagtatatcaaaaaatatttaacttcattagcagttagggatatgcaaatctaaatcacaatgagatagcacttcttactcctaagattgctgtaataaaaaagacaaataataacgaatcttggtaagtgcgtaaagaaatgggaacattcatgcatttctgatgtttctgtaaaatagtgcacccaatttggaaaacaatttggcagttcctcaaatggtaaacagagttggtgtaagacccagcacacaaacttttacataaatgttaataaaagcattgttcatgatagccaaaagataaaaacaacccaaatgtccatgatccgatgaatggataaataagaagtagcatatccttataaaagataatcttgggtaataaaaaaagaactgaagtactgatacatactacaacatgaatgaaattcgaaagcattatgctaaatacaacagaccacttacccaactgtccgaataaaggattgcatttctattatttgtacagtataggcaaatctattgagacagaaagtagattagagattgcttagggctctggagtttgacaggaaatgggcagtggctgctaatagtttctttttgaagtgataaagatgtcccagaattgagatggttgcacaatgctgtgaatatactaaaaaccactgaatttctcatgttaaatgggtgaattttaagatataaattacatctcacgaaaattgttaaaaaggaataattataaattatatcattttccagtgaaaatgactttgcatcaatttcttcatcacaaataggctacaatctcgatattgaaactatgatgtattattttttgtgaaatttcaggctgccagataaatggcttttctgatgaccaggaaattaaattttgtttgaaagtaaagttatatgtgtgttcatgtattttcatgcctgcaattatggtttaatattatctgaaatatataaaactatattcccaactatttctcaaatataattgtgcaaaaaatatagaacattttaaacgttaatctcctagggacacgtttattttaagtgagctctaaataaagaaagataaatggttatctaatgcggagctattagtcttactataacttattttacatcctattctttggtactaagcatgatagggtaatgacagtcactggactctataacaaattgaatctctatttttattttttaaaattatgtacaaaaacttgaattgccattatcactcagcaagcacacatgttcagagagaagaaaaagagaattttttttttcttttctggagacctaagtgtgaaaacaaattatactaatcatttataaagttatttgaaattaactagtggttgcaacccaaagttaagaaaatagtgaagattatatggacagtttctttctctaaaaataaccaaattcttccttcctgttctgctcttctcttaataccatgcacctgaacaaaaatcattatgtcatttttctagctttgtgaaggtagaaaatgtatgaggctaagtgtcttagaaaacctttgtattatcgtttatcctatggtttctgtaaataaatgatattcttatctttttaaatatttccacacattattttcaaaattatgttttgaatttgataactttgtattaaaaatatttcaagcagtgagtccacaaagaagcatgtattatttggatgcaatactatttaatttgattaggatatttttctggaaaaaataattctgaattgaataaaggaggcaaaagataatttataaaaagtaaaatttctcaacagttgacatcactcattgctgttttttatatttacgtacaataaaattcactcatgttctatagttctaccagttttgacaaatgcatacaatcatgtatctatcaccattttcatatagagaacactttcattactcccaaaatttatttgtgctgctctgctagtcaacattacctgaattcccagctcctggcgatcaccggtatgtttttcatccctataagcttgccatttccagaatgttatataataggaaccatacacgatgtagactgttgattatggcttctttcatttaacaaaattcatctgagattcatccatgttgctctaagaatcaatatgcttctttttattgctgagtagtatttcagtgtgtggctatgacacagttcattcttttaccagctgaaagacagtaagggtcatttctaccttttggtgattattaataatgatgtttaacttgcacataaaaatttctacgataacatacgttttcaaatattttgcataaatatgcaggactggaattgctgggttttttttctgtttttgtttttcaagtgtatgtttagctgtataggaagttgacaaactgttatctaaattctctgtgccattctgtgtcagcagcagcatcaactgaagattctagatgtttggaatacttaccagcacttggtatttttagtttgttcttttaatcactcaaatagaatggtatctctttgcattttaaatttgtgtttctttaatgtctgactgtgctgagcctctaattatatgcttatctgacatattcatgtcttctttgatagtctatacagatatttgccagttttttaattgagttcttcattttcttattgttgttttttagttttttaaatttcaactattatttttgattcagggggtacatgtgcagatttgttacctgggtatattgggtgacgctgaggtttggggtatgaataatctcatcatattcatagttgttcaacgctttctcccctctctcccttctaatactcttcagtgtctattgttgctgtctttatttccatgagtacccaatgtttagcttccacttataagggagaacatgcaatatttggctttctgttgctgtgttaatttgcttaggataatggcctccagctgcacccatgttgctgcaaataacatagtttgttcttttaaagactgcgtatatcctatggtatatgcgtgctatatataagaaatccagtccaccactgatggtcacctaggttgactccatgtctttgctattgtgaacagtgctgtgtcaacatgcaagtgcatgtgtctttttggtagaacaatttgttttcttttggagataatactcagtaatgagagtttctgggttgaatggtaattctgttttgtgttctttgagaaatcttcaaaatgctctccacaaaggctgaattaatttacattcccaccaatagtgtataaaaattctcttttctcctcaactttgttagcgtctgttgttttttggctttttaataatagctattctgactggtgtgagatagattctcattgtggttttgatttgcatttatctggtgaagaatgatgaggaattttttttatatgtttgttggccccttgtatgtcttcttttgagaagtgtctgtttatattttttgcccacttttgaatggaggcttttgttttttgcttgttgtttgtttatattctctacagtctagatagtagacctttgctgaatgtatactttgggaacattttctcccattctataggttgtctgttcacctggttgatagcttattttgctttgcagaagctctttagtttaattaggtcccatttgtcaatttttgtttttgttgcaattgcttttaaggattcagtcataaattctttgcaaaggctaatgtccagaatggtgtttcgtatggttccttctagaattcttacagttattggtctcacatttaaatctttaattcatcttaggttaatttttgtatatggtgataggtaggggtccagtttcattcttctacatgtggctagtcaactgtcccagcacaatttattgaatagaaagtcctttccccactgcttaattttgtcaactttgtcaaatattagatggctgtaggtgtgcaactttatttctgggttctctatttctgttccattggtctatgtgtttgcttttgcatcagtcccgtgctctttttgttactgtagccttatagtacagtctgaaatcagataatgtgatgcctccagctttgttctttttgcttaggattattttggctatttggcttattttgtggttccatataaattttagaacagttttttttttcaaattctggaaaaatgactttggtagtttgataagaagagtgttgaatctgtattttgctttggatagtatggccatttttatatttattcttctaatccatgagcataggatactttttcatttgtttgtgtcatctaatatttcttttagcagtgttttgtagttcttcttgtacaaacaagcctcttgctgccttggttagatttattcctagcttttttttttggctattgcaaataaaattctattcttgatccagcactcagctttaatatatagaaattctactgatttttgcacattgattttgtatgctgaaactttgctaaatcttttgtgttccaggagcctttcaatgttctttagggttttctacatattgaatcctactggccatgaatcgacataggttatcatcttcttttcctaattagatgcctttagttctttatctttcctgatttctctgtctagcacttccagtactgtgttgaataggagtactgaagatgggcatccttgtcttattctagctttcaaaagaatgcttctagtttttgcctgtttagtatgatgttggctgtgggtttgtcatagatgactcattactttaaggtgtgttccttcagtgactaatatatgaaagtttttatcatgaagagatgctggattttatcaaaagctatttctgtgtctattgagatgatcacattttttttaaatttacttctgtttatgcggtgaatcacatttattgatttgcatatgctgtaccaatcttgcatcccaagaatgaaacctacttgatcacagtcttcacggtcaattaattttttgaagtgctgttggattcagtttcctagtatattttttttgacaatttttgtgtctttgttaatcagagatattggcctataattttcattttttgttgtgtctttgccaggtttttgtatcaggatgatgctggcctcatagaaggagttagagaggagtccctaactactagaatttttttttaatagtttcagtagcattggtaacatctcttttttgtatgtctggtacaatttggctctgaatccatctggtctgggttttgtttttggtttgtttgtttggtagtgtttaaaattactgatacaatctcaaaactcagcattgatctgttcacggtttcaatctcttcctgattcaatcttgggcgattgtgtgcttccagcaatttctcaatttcctctaaattttctattttgtgtgcacagaggtgtttatattttctgaggatcttttgaattcctgtgggatcagttgcaatgccacctttgtctattgtgactgtgcttatttgggtcatctcctgttaatctagctagtagcctgtcaatcttatttatttttttcaatagtttgtatgatttcaatttttttaatttattgagactatgctttatatattctgtatatacatgtatattgggtagagtattctgtgcatgtttattaggtccaactggttaagtgtcaaattcaagtccagaatttctttgttagttttctgtcttgatgatctgtctaatgctgtcagtgggatgttgatatcccccagtattattgtgtggctttctaagtctttttgtagaccaagaaaaacttgttttataagaagaaaacactccaatactgggtgcatatgtatgtgtatagttaagtcttcttgttgaattgaacacttaaccattatgtaatacccttctttttgttgttattgctttaaactctgttttatctgatataagaatagcaacccctgttcttgtgttctgtttccactgtagatctttctctagatctttactttgagtctatggatgtttatgcatgtgtgttgggtctgttgaagacagcagactgatagggctttttaatgcagcttgttactccatatcttttaaattggaccttcaggccatttaaattcaaggttaatattgatatctgaggttttaatcctatcatgaagttgttagctgtttgctttgtgtttcctattttgtggttgctttatagggtctttgggctatgtatttaagtttgttttcctgctagctgctatgatttctatgtttagaacttcctcaataatctcttgtaaggctggcctgctggtaacaaagtttttcagggcttgcttgtctgtaaaatcgtttgtttctcctttgcctatggaacatagtttggtgggatataaaattcctggttggaatttcttgtttttaagaatattaaaaattggcctccaatttctgttagctttaaggtttctgctgagaagttcactgctagcctgatggggttcgtttgtatgtgatctgacgtttttctctagttgcctttaagttttttgttgttgttgttgtgtgtgtgtgtgtgtgtgtgtgttaaacctggacagtcttgtgaccatatgctttggtgatactcattttgtattatatctctcagatgttctctggattttttgaatctggatatctgtctctctagcaagatcagagaacatttattgaattgttacctcaaatattgttttccaagttacctacattgtccacttcttcctcagggatgccagtaatttgcaggtttcttcgctttacatcatctaatattgctcaaaaacattgcttatttcttaaaattcttttcttctttatttttatctggctatgttatttcaaaatactggtctttaagctctgaaattatttcttcttcttggtacagtctattgataaagctttcaattgtattttttaaattccttaagttagtttgtcaaatccagaagttctgattgctttctttcaagatgtttatctctttctttatttcccggattgctttagaagttatttgtgttcattttcagcttgtcttggatctcactgagcttccttgaaatccatgctttgaattctttttgtgatttctgcatttacattttggttaaggaccattggtggaggggtactgcaattctatggtgatgtcactgcattcatatttttcatagtgctagaattattgcattggtttcttctcatctgagaatgttggcacttctaatttttgtaattttgtgttaggatattttcttttgttttttatttcagtgtaacattattattttttttctttccctttccctttcctctcctccctacagggtgtgactgtagtgaatgctgggtatggtcacttgtctttgcttctgtaaccctatgtagtttcgttgacaggttttatattgatgtgtgtagttcaacctacaagccagtagatggtacttatgggtgagagctggctgtacccgatgtggctaggtatatacatgatccttgtttactgggagaagctctctctcatcttaggcaatgggctgatctgtggagtgcacagttgtctgagctccttgctctgtcctatgttaggacaggtccaagattagcatggcctgcctaaatgtcccctgatgtcaggcacaaacaccagcacttagcaaggatccagtggacagccactaaacacccaaaggtgtgtctaggcatggagctgggaaacctcctcagccccaagttctctggacagggattaggggaggcctaaattcctaatccaggtcagagagcgagtgctccacatgcctggagatatgcctgggtgtggagcagagagagatgcctgtttgtgaagcagagagaaccacccttcaccaagatctctgcatagtaggggtgggcagctccaggttgctgaaccaggtgagtgagtgatctgaatgtctgaagatctgcctgggcataaaatgtagagggcttgactgcaccatgatccatggccaacaaggggggtgttgctcaggctactagtccatgtgagcaagtactccaaattcctggagttctgtctgcatgtgttgtgatgaaagccccactgcaccaccatctatgcacagaaataggggcaggtaaagctgttgatccaggtgaggaagtgcttcaaacacctggagatctgtttgggtattgagtgcgaagtgcctgctataccacaatttatgtccatgaaaagtggggcaactcagattgctgattcaagcaagtgggcgctccagatgcttggatttctgcatggaggtggaacggagagggccctgctataccacatctcaaggggagcatgctgtggcacccattaatggcatacgcaagtcagtttcaggttgccagctggccttgaatgaaagtgtcatcatccaggagaaaacacagctatagcagctcttctcctgccccagggcttcaacaggggagtgtacaattctggtacctactgctgtggtgctttctacagttctggctatggaagcccctaccctgctccagagcaggtgttccaatctctggcctgagattaaaatacctgcatggccatactgctaggtctcaaaggaatggctgattttgtatgtgcctggattataaatggcatcctgctgtcagtccttggcctgggcaaatttctgtagtttttcctggtgttttcccctcaggtctccaagcctctccccaggttagcaccaggactttaaagaaacaaaatattctccctcctcttgggttgctcagatccccagtagaaaggtgagtcacagagggaggctctctgtctctctcatgtactggggcttcacttacttttatcaactggatgccatcacatggactgctttcccatgtcctccccgctggggcccccttcacaatactggtggattctcatttttcttcttgaattaaagctcacaaagttgatctttatgcactatcttgctatttccaagtcactgaggcatgataaaaggatttaatcagtcatcttggaaaaaaaatctattgttagtttacatccttttttaaatatataactcccttgtcagaaatgtgatttgcaaatatttttacccagtctgtagcttgccttttcattcattcacattgccttttgcaaagtaaatatttttaattacaaataagctcaacttagcatatttttaaaaataaattgtgcttttgatgttgtagttaagaatgctgcctaactgatagtcacaaagattttctccaatattttctaatagaagttgtatagttttacattttacatttagacttttgattgattccaggttaattattttataagattaaagatgtgggtcaagttttaattttctgcttataacctataatcattctgttggcacttgttgaaaagtctatactttcaccattgaattcagacctttgttgaaaatcactttagaattttgtggatctatttctggactgattattgtatttttattaatcattttgtatttattattttgctattattacattgtaatgattaggtacgtgctatagtaaatcttgaaatcagatcatgtgagtccacaaataggttttttttaatcaaaattggttggctaatctaattcctttacctttccccataaattatagcatcagcttgttgatatctgcaaaaacagaagatccatctaagatttcctttttatttagattatgttgactttacggatcaattgtgggaccactgacatcataacaatattgaatattccaagctaagaacatggtatatctctccatttaattagattttctttatttttttcatcttttttttaattttaagcacacagattccacacacattttgttacatgtatacctaaatgtgtctgtgaatagatacagtgttgtttattttcaatctgtatgtctttcatttctttttcttgctttatttcattggctagaacttacaatattatgtcaaataggagtggtgtcaaccttactgtttctgatttttggggaaaagtattcaatatttaacctttgaatatcgtgtcagctgttatctttgtgtaggacctgcatgtcaatttgaagatattcccctgtttctaatttgctaaaattgaatagttctactaatataaattttgatctagttggttgattatgttgctcaagtcttctatgcatttactgattttctattttttccatcaagttctaaggagtattgtagtctccaagtattactgtggatatgtctatttatcctttcatttctagcttattttgcttatattttgaagctctgttgtaaggtgcatacacacaggattgatacgtcttcttagagaattgatctttttattgtcatataatgtatttctttatactggatagcatttcttgctctcaagtaaactttatatagatatagtaactccatctctatttcactaaaatttgtataatatttttattgatgtttgatatctattgacatttgaagactatagagaaatttcataaaaagagtattataaactattatagtttacagctaaatacttggatctctagtttattatgttcctaacttgtattttaagatgattccagcaaataaagaataccgaaatcacttatttttgaaataattatgactatattttattcttgaaactaaggcatatcttagagttcaataaactatacttccaaatttatgtaatttattattagctaactattttttagctataattagttcattatatattcttataatttgttttccaattaatttctcttttatgtcctctctcagtgctagttagaagccatatttcagctgacttgcatgtatagatgaatgatcatagtttccttgagggtcacagatacaataaaaaatacctacatttgggatactaggccaaaggatcccaattatgataatgagacctcatccacccactccaagtcatttatacttccctaagaattactgacaaattaaaaataccaactctataaataatggaagtctttaatgcatttgtatataggttgttaccttttttgtcacaatgatatttaagtagctaataaaaatatgcctttgaaatataaattttattatttttttcctcaccccaacaactgcagaaataactgttcaaccaactgtggaagaggcctctgacaactgcactcaagaatgtctcatctatggccattctgatgcctgctggatgccggcatctctggatcattccagctcttcacaagcacaggcctctgctctatgccacagcccaccactgtcacaggcctctactcagcaccacagcccaccagtgacacagaccattgttctctgccacagccctccagtgacacagaccatcgcattgtgccacagcccaccaccgatacaggtgtctgctctccaccacagtcctcctctagtgcagggtactgcacttcaccacagcccaccatcagcacaggcctcagccctctgctacagccctcctttagcacaggctgctgcaatcagccacagctcttctctgccacaggttattgccctccatcgtagtcaggcccaatcatcagtcagtttgcagcaaggttgggtgcaaggtgctaatggactatgctctgttgatcagggagtgcaaggtagtgcaacatctcagttttacaccatgtctgaaagacttcatcccagtgatgattcaattaaagtcattcctttgacaaccttcgctccacgccaacaggccagaccgtccagaggtgattcccccattatggaaacacatcccttgtaaagctaaaatagttacttcaaattttcagaaaagatgtatatagtcaaaatttaagatacaattccaatgagtattctgattatcagatttgtaaataactatgtaaatagaaacagataccagaataaatctacagctagacccttagtcaatagttaaccaaaaaattgcaatttgtttaattcagaatgtgtatttaaaaagaaaaggaatttaacaatttgcatccccttgtacagtaaggcttatcatgacagagcgtactatttctgatgtacagtattttttgttgtttttatcatcatgtgcaatattactgatttgtttccatgctgattgtgtggaaccagtatgtagcaaatggaaagcctagaaatatcttattttctaagtttacctttagtttacctaaacttttgttcagataatgttaaaaggtatacgtactctagccttttttggggctttctttttgatttttgtttgtggttttcagtttttttgttgttgttagtgagtctcccttcaaaatacacagtaggtagtgtaaatactgcttgtttgtgtctctctgctgtcatgttttctaccttattccaatactatattgttgataaaatttgtatatacattttcaataaagaatatgtataaactgtacagatctagatctacaacctatttctctactctttagtagagttcgagacacagaagtgcaataactgccctaattaagcaactatttgttaaaaagggcccctttttactttaatagtttagtgtaaagtacatcagaaataaaactgtatctgacattttaagcctgtagtccattattacttgggtctttacttctgggaatttgtatgtaacagcctagaaaattaaaaggaggtggatgcatccaaagcacgagtcacttaaaatatcgacggtaaactactattttgtagagaaactcaggaagatttaaatgttgatttgacagctcaataggctgttaccaaagggtgttcagtaaaaataacaaatacatgtaactgtagataaaaccacatactaaatctataagactaagggatttttgttattctagctcaacttactgaagaaaaccactaataacaacaagaatatcaggaaggaacttttcaagaaatgtaattataaatctacatcaaacagaattttaaggaaaaatgcagagggagaaataaggcacatgactgcttcttgcagtcaagaagaaataccaataacacacacagaacaaaaaccatcaaaatctcatatatgaaataaaatatattcttctaagcaaagaaacagtactattcatagaaaacattagttttctcctgttgtctgttatttccttcttttatcctcttaactggccattatcttgtatgtgcacattttataaatgtacagaaacatcaccaacttgattttcttccatagcaaaactgagaaaataccttgtttcagtataacactaaaccaagagacaattgatgtttaatgggggcggttggggttgggggggagtcaatatctcctattgattaacttagacatagattttgtaatgtataacttgatatttaatttatgattaaactgtaattttgtaacataaactgtggtaattgcataatttcattggtgaggatttcctttgaatattgagaaagtttcttttcatgtgcccagcaggttaagtagcgttttcagaatatacattattcccatccattgtaaagttccttaagtcatatttgactgggcgtgcagaataacttcttaactattaactatcagagtttgattaataaaattaattaattttttttctccttcgtgttgttaatgttccaagggatttggagcatactggttttccaggtgcatgtgaatcccgaaggactgatgatatttgaatgtttattaaattattatcacacaaatgtgttgatattgtggctattgttgatgttgaaaattgtaaacttggggaagattaagaaaagaaccaatagtgacaaaaatcagtgcttccagtagattttagaacattctttgcctcaaaaaacctgcaaagatgatgtgagattttttcttgtgttttaattattttcacattttctctctgcaaacctttagttttctgatgatctacacacacacatacacacacacacacacacacgtgcacacacacacatttaaaggatataaaaagaagaggttgaaagattattaaataacttatcaggcatctcaatggttactatctatgttagtgaaaatcaaataggactcaaagttggatatttgggatttttcttctgacagtataatttattgagttactagggaggttcttaaatcctcatatctggaaacttgtgaagttttgacacctttcctatagatataggaatgaaccaatacgcttttattaccctttctaactctgattttataatcagacttagattgtgtttagaatattaaatgactgggcaccctcttcttggtttttaccagagaggctttgaatggaagcaggctgagagtagccaaagaggcaaggggtattagcccagttattctcccctatgccttctcttcctaagcgtccactaggtctggccttggaaatctgttacttctacggcttcagatctgatgatatctttttcatcacattacaagttatttctttgactgaatagacagtggtataggttgacacagcacacaagtggctattgtgatgtatgatgtatgtagtcccacaactgcaaaacgtcttactgaagcaacaatcgaaaaatggttctgttttaaaaaggattttgtttgatttgaaattaaaacttcaaactgaatgacttatatgagaataatatgttcaatcaaagtagttattctattttgtgtccatattccattagattgtgattattaattttctagctatggtattactatatcacacttgtgagtatgtattcaaatactaagtatcttatatgctacgtgcatacacattcttttcttaaactttacctgtgttttaactaatattgtgtcagtgtattaaaaattagcttttacatatgatatctacaatgtaataaatttagagagtaattttgtgtattcttatttacttaacattttacttttaattatgtaaatttggttagaaaataataataaatggttagtgctattgtgtaatggtagcagttacaaagagcctctgccttcccaaactaatatttatcacacatggtcattaaatgggaaaaaaatagactaaacaaatcacaaattgttcagttcttaaaatgtaattatgtcacacacacaaaaaaatccttttcaatcctgagaaaattaaaggtgttttactcacatggatatttcaacattagttttttttgtttgtttctttttcatggtattactgaaggtgtgtatactccctaatacacatttatgaaaatctacttgtttagacttttatttatactcttctgatttatattttttattataattattatttcttatcttcttttatattttttggaaaccaaatttatagttagtttaggtaaactttttattatgaccattagaaactattttgaatgtttccaactggctcaattggctgggaaaacatgggaacaagagaagctgaaatatatttctgcaagaacctttctatattatgtgccaattaccacaccagatcaattttatgcagaggccttaaaatattctttcacagtagctttcttacactaaccgtcatgtgcttttagtaaatatgatttttaaaagcagttcaagttgacaacagcagaaacagtaacaaaaaaatctgctcagaaaaatgtatgtgcacaaataaaaaaaattaatggcaattgtttagtgactgtaagtgatactttttaaagagtaaactgtgtgaaatttatactatccctgcttaaaatattaagatttttatgaaatatgtatttatgtttgtattgtgggaagattcctcctctgtgatatcatacagcatctgaaagtgaacagtatcccaaagcagttccaagcatgctttggaagtaagaaggttgactattgtatggccaaggatggcagtatgtaatccagaagcaaacttgtattaattgttctatttcaggttctgtattgcatgttttcttattaatatatattaataaaagttatgagaaataaa

SEQ ID NO: 118 - DNA, 68596 bp, Homo sapiens
cggggcttggcgccgccgtccgtgagcacccaggccgggaccccacatccccaggccagccctgaccccggcggcccctccgccgggattcctttccgaggtactggtgccggcccaagacccgggcagcgctttgtcgtgtccgcccctcagtgatcagctccgggtccccctgctcggccccgcgcgccccaagcgcagtccccggaagtgcgcgccggggccccagcaaaggtaagaggtgcccgagagcgctccctgaactctgggggcgcccggcatccccagcgggctccggcttctccgaagcgccctcttttcggaaacacccagagcacttctgacctgaagcagctgctttgttcccaagtccctgcccaggtgttgtaggctgggtcccacagggaactctgcttcccagcgctttcttttttgcctcctcttcctcccactttcctgtttcttctctcgccccccctgcttctttctggatagaacaactctcaactccctgcctctgcagcccagcttcggaaagcaggtcgttcccaaatctagcgcttctctcctgtgcctctgggagctgggctgagcctgactggcttctatcccaagcctgcgcggggcggacctgccagaaatgtacgtgctgcaccgtggactatttacctggtttgtttcggaggcagccaactcgccgcgcgcatttggcgacccccaggaccccgaaagccgagtgcatcagggagtgaaaggctgttggcgccccctaaagtcccagtgggacgctttgcttttggagaggggcgcgcagacagtccacgctgctctatctgggaggtctgcgtgggggtccccacccctactattgaggggtaaggggaggtgttggcacgcagtacggagcgcgttgggacatggaggaaatgaggatgtcctggaaggagaggagtgccaaccacatcgtgctggcttgccatgttgttcttattaactgcctgagttctcataacaagcctgtgtgtagggactcttacccctattttacaaacgggcaaaatgagatggggccacacagctagctaggaaagggcccagccaggatttgggtcctagctggtctataccacacatacacttcaagtccagccctacagaagattcttctttttagtctgagcaagaaccgtccccccaactcccccgccccccccccacctcctttctcatagtacaagggaccaggctttttccgttttgacctaatataccttgattatattcaaacccaaactacttattatctactgtcctctgagttcagcggcaagcactgaggtttcacctttgaatcttattaattcatccccttcttgtcatccagtctgtcacgaaatgtgtaatactgttcagaaggctggcttgaatctcctttccataaaggcagtcaagcgcagtggctaagagcccgggccctggagtgagaccaccagcttgaatcctggctggggccttcctgtacctttctgtagctggatttcctcatctgtaaagcagggatgctagggcttaaagtaatggttttcaacggaattttgattttacttcccaagtgacatccagcaatgtctggagacatatttggctgtcatcatgtaagtagaagaggatcttattcatctggtgggtagaggccagggatgctgccacatcctgtattgcacaagacatctcccccctcccccactccgcttccaagatttaagaattatctagcctaaaatgttaatagtgctgaggttgagaagcccaggtttaatgtttcacttcatgaagagtgccattatttccagctctcatccttttatctgctctagtttggctgattataccagtctctgtcccagtctttccctccattccagtgccagaattctgttgccaaatccacagcaggtcatgcggctatattgccttagcacccttgttggtcccctattgctagcagaagggatgggaattgggaatctgcaggtgttttacaagcactgaaggtaattcctctgcatgttaaagtttgaaaatcactgtctttacagaataaaatgtaacccccgaccttgtacacatggctcttcacaactggcctcaccttatgccacttcgtcaatgttcctgacattcccccaacccactattcttttggtattctaggtcctgactttttggaatgcccttcttcctccttggctggcaatcaatctttgagactagaagttaagtctccttttgggtgaagcatcattcttcagttcctacagaccattttgttgctccctgccctgccccaggttgggggaaagcctcagcctcagcctcagcctcccctctcccctccttttttttaaaaaataaatatgtatctcttgcagtattttgtttatctctcccctggtcttacatacttagaatctagcttagtgccgtcgatgctcacagtgatggtttcaggctttggcgtcaggcttcttgcgttcaaatctcagttctgccgcttattaactctgttaaaagttaattacttgaccttggtcaagttgaatcagtctctcaaagtcttcttggtaagaagaaatagcgtaccttctctgcagactagtatgactaactaatggaataataatcattcatcttaatactgagtgcctacctaattccaggacatggttcaagtttagcattttatacatttttactcatttaaaacctataatgtcctttacagttactactggtattgcccttttttccagacaaagaaacagaggcacagagaggctaagcactttgcccagagtcatggagctaatgagcggtagggccaagattcacgcacacatctggatttcaaaacacatactctttacactatgcgggtaaagggcttagcccagtgcttggcatataataagtgctcagttaatgtgagataaggtttgctaagtgcattaatgagagcctaagtccattgggttttccacctgcatcatgcttgtgatttaagactatgccattatttttacaactcttgctcctttccttgcctcctggccctgcccccagccacagaggggcaggacattggggttagttcctagcaccactgatcttgatgctaaattgagcctatgtacatagtcagggctagaagaggattaacttttttgggatggggggatggagtcaacacacacctgcctggaggagagaggtgcagacttggggtcgaaaactctgtgactccagctttgtctttactgtgcatgtgccttttgcagtgtgcacctagcatataaatattggtgaaaccaattgatgcatgagggatggatgaataaatgccaccagctgagtgtcccacattatacttgatcagatgcaaagtacaccttctctccatgtattgtaaggctcatttatctattgaaggtaaaactggctaagggaatttaatgacccatatggggtgttggagaagcagatttggagccactcacttaccctctgggtaagttgtgtttgacactggatacttggttacaactgatcactaaactaacttggaatcttctattgcttctaatgcagccttggctttgaaaaccgagcccacttgctagtcgctgggccacttgctctgtgggctagactgccttacacaaatacctgcacatttgtgtactctggcttcctccacagctgtcctgcacagctgtaatccccctgagtttgcttgttttggcaggttgtctccaaaacttcagtggggtgaggtcacctaacctggcatgtgtaaagccttgtgggttttttaggggccagggaaacattctagtaagtgctgcttttgagggtggagtagggtgagaactctcctatccattgacatccaagactcttcagatccccatggtgaggtcctcaaaccccttggctggtccctggcctgttaggaacagggtcatcgcctgagctccgcctcctgtcagatcagcggctgcattagattctcataggagcatgaaccctattgcaagccgcatgggtgaaggatctagtttgtgcactccttatgagaatctaatgtttggtgatctgaggtggaacagtttcatcctgaaaccatctccccctatccgtggaaaaattgtcttctaggaaactggtccctggaaccaaaaaggttgggaaccgctgccctatagcactgccttccctttcccacaccagactcgtactgtctcctggcattatcccctctcctaggtcactagctggctgacctgagagacaaattcctgtaggattttaatgccttgaataaaagttagacccaagatctttgggcatcacttgtatttatactgaggcttttatagcttggcacagaagataaactagcccagggtagaaaggttagggggatgtcaggattggtgccaggtcttgaggcctctgatgtcacacttcgttggctgccactttgggtagcacctcttaagtgacctgcagcagactttctaatgaagctggcccctgctttgtgtctctagttctagggagatacactttgccccatttacgtcttgagctgtattctctgtgaaatgcactctgttgtttgactctgtgtgaaaccctgtttagtgctgtaaagggcatttggattcagactagagtggtggcagaaccttgaggtattagtgtggacttggaatacacgtgcaatacgtagctctgtgcaggtgccagagacacaaagatgaagacctggtttgtaccattaagattgcagtccatgacatatgagggacgtgtgaatagatcatcagaatgtgttaaatagaataagagatctgagcagagaactgggagctcaaaggaaccagcaccatctctgctagaagagttaggaaaggcatcagagagaagaggatgtttgagcttggccttaacgtgtaagcgggagcttggcgggtttgaagggactggtgattaaagagcattacagataggaaacagcatgtgtaagagtcaagaaagggcctggaagacatgtaggcatatggtggggactggagggcagagatgggcctggggaggtgactttgacattttaccagtgcaggagtctgtctctgtactgttttgagacaatggagtgggcatttaaagctcaggtgtgctgagctctttgaataggggctctgcctcttatctctgctggccttgtttcctcctggggcagtggaaccagagcccacgggtcagggagagacactgtctctagtaagcaaagaaatcacaatcaaaaacaaagctgagctgggaggttgtgggtagttgttttgttttcttttcaaagtcctagctgatgagctatgtgagtggcccctccagagtctaggttttacctttagagcatccaaaagtctgtatgaattgctaagcaattgctaaatttctccagacttagaaagggatggagaaacagagggaaagaaggggagatgggggagagagagagagagagagagagagagagagagagattgagttttgatgctaaagtctgtttcacataaaatccagcctgtgatccagcaggtcaacagctattaggattcacacatttcctgggaattgcattcccatttgcagtctttctttgagcccaaagccatttgcatgtgctgattgcactgagctccccacagaggatgggtgcatatgcttattgattagacaattgatgtaggtccttctataggtcatccccaggctttactcatttattcaccacttagtgaccccctggcacataggaggcacttagtaagtgatagatgagtgaatgaatgctctagcatggaagtcccattcctggacctcaagatgctcatggtctgaaggaagagatagaaaagaaaacagacaacacagtgtggtggattagtgccatgacagagaagatatgagtagagaagaagactcaatccagccagggatcagggactggagacagggagaagaatcctctcttctggggaccatccttcctccagggaagtggtcccaggagtggttcctagagatcaattataacctggggtgggtgccaggcactgtgttaggggctttagctgacttaattgcatggatcctgacaaacaccctctgaggtctgtattagaggaggaatcagggtcacacccacaactaaaaggcagagccaggatcaggtccagggcaccaaactctgagccctttatcccgctccagatagtctccagagagctgttatcatcaaagatacttttagaaaatctgctttcgaaaaagaaggtgaaagagtgggccgctgtggttgggataggaatggccatttcctccccgcttttccccctttccttctccccagcctggcatctgaggctgtgcctgggggcagtgagatgctctttgttctggggttcaaaaactctcttcctcctcttgccccctctttgatcaccaaggcagcctgcactttgccctccatggtgagaggagagggaaatgctgcttagtagagaagcaaccataaacttgcaaggaaaagaagactttacaaaacacctgctgtaatttaagcctctccccttttgccttgccccctcctgcccttgtcattcagatggggctggtggtagctgcagggagcagacttcaggggatcttgtttctgcaaggggactttgatcaaaagggctgcctaaagctgtctttctctgggcacctccacaaacacactcatcttgtcaagacaagacaggccatagcagcccatgggaggagacgggtagggcctgttactggaagaagcatttctttcctgagttcccccatcctgagtgccacttggccaagcaacctctgacagtggcatccttctttgctgcactgagatgtcgctatgaacctgagagtgggcggaatgagcactggaggagagtcagcaatgccatttacttgctatgagacctcggtcctttaatctcctagtgggtcagtcacacagggcaggaatggttggcctggacattctccagtgttagaccctgctgcatgtcaaaagcagggtgcactgtaggatcttgtggaacttcagaagacaatgactggacatttagtctgaaaaagacacacatgaaagtaaaagtgttcctgtgggtgtgctaatgtgctcacagagacagcttggtggccttggtgtgtctgctcagctcaagctgccaacacttattgacaccttcatgtgccaggcacagttccaggctctggaaacagggatgaacaagatactctttgtgcccaaggagctcagcaatccagtgtggagacagatgaggaaatcagagatagtaatgcaatgttttgctgtccatctctcattacagtaagttctctgaaatcaggacatatgtcttgttgattcccaaatcaccagagcctactgtaaactggcctatggcagatgctcaatcaatgaatgttgtactaccctaaagtaccacactagaggcaatcacagggtgctatgtgcacccacaggagggacacctaaactcagcttggagagcaggtgagtccaagacaacatgcatcaaagaggctgagatggagcatccaggctgatgagaggagaagtggagcctaggcagatgggccggtgagaagtccagcatgtccaggtgagcaaaccagggctgcttcaagaagggaaggcagataggcatggctggggacaaaggaagtcagcctgtgaaggggcaaggtaatcacatctggatttgttagagaattggaattttactttgaagatagtggggagctactgcaggatttcacacagaggagagactgggtcaaagttttgttctaatactgttctggcaatagagtaaatattggagaagaataagataggtggcaaaaagaccagttagcatgttattgcagtttaggggatgaaaaagcctgagatttggagtcagatacatctcagcctccttcccagccacactccctgtaacttgggctgtttagcaaatgtctctgagcctctgtcttatctgaaaacagtggactctacttcctcccttatggatggtatgcatggtagacagggttacatacaatgaagtatgggaaatgtctactacagtggtttatttgtaattggcaagtcatactagtggccagtattatttttaatattgttgtgacttactatcatctaggtgagaaataatgagattctaataagacactggtaattagggtggagaattgggcagactcaagaaagcctttggcaataaagttggcatgatttggtgactgattgaacaggggagtaagggaggggcaggagtctaggatgattctgacattttggcctggcatccagtgggaaggatagtggggctattcattaggagagagaagggacagggaggagggagcagcatttataggaaggatgatgaactcagtttcagatatgttgagtttgaaatattaagatagttagggagagatggctagtgggcagatgttttctaggtttgacattcccgagaaaagtcttcaagatttacaagaaagctaacttttttttttttaagagacagagtctcactttgtgaccacgctggcatgcagcagcacaatcatagctcactgcagtcttgaacttgaacccctgggctcaggtgatcctcctgattcagcctcctgagtagctgggactacagttatatgccactatgtccagctaatttgtaaaactttttgtagagcagggtctcactatgttgaccaggctggttttgaacttctggcctcaagtgatcctcctgcctcagtcccccaaagtgccagaattacaggcatgagctacggtgcccggcccacaaacaaactttaaccaaaggtagtgaagtcatggcatggatcagttggttacggagggttatggagtatgggaagaggaattataatagctaatgtttattgagtgtgtactgtatgttctaaacactttacgtgtattaatcctctcaacaaccattgttaggaaggactactattgttttacctattttacagctgagtaaacctaggcacagagatggtaagtaatttgcccaaggtcacacagctataagtcatggacctaggattttaagtcagctatcaggatgccaggcatgtgccagattgcttccgagagtggcagtactagggcacaacactgacctcagggaaggaaggagagaacccagtgaagtcaacagggaaggggatgtgcagaaaggcaggaggaaatgggagactgggatgcggaagaggagagtttccaggagagggggatcaacagcttcaaatgatatggaagaatgagagatctgaaatgttcacggatttggaaattccaaagctattgacgacttggtgagaggagtctaacagatgaggggagtctaacagatgaggggagctaatgaacaaatgtgaggtgaggaagtggacataccaaactttagcaattgtttttagaggcttgtctatgaaagtaacatgcaagaaaagacagcagctagaggtattaggtagagacagtgttttaaagatggaaaagaccagcacgttttttttggttttttttgttttgttttgttttgtttttgagcagagtcttgctctgtcgcccaggctggaatgtgtggtgcgatcttggctcactgcaacctctgcctcctgggttcaagtgactctcctgcctcagcatcccaagtagctgggattacagacacacactactatgcctggctaattttttgtatttttagtaaagacagcatttcaccatgctggccaggctggtctcgaactcctgacttcgtgatctgccctccttggcctcccaaagtgctgggattacaggcgtgagccaccgtgcctgcccgaccagcacatattatagagtggtcacaaatggactatgcacgctgggagaggtgtctccatgtttgcttctcttttccacacagatttctaatatttctcttcatattctggatggcttccatgttgatagttggatatcattaaagaaattctggacaggtgtttcaggtcttcagcttttattagatggagcagagaaaatgtctttcacaatgcccagtggtgacttatcacttgttgttaagtccagaccatgtcaaattcaggtgcgttcagtatatcacccactcaatttgccttcaaagtattcctcaatagagcatgatgtactgaagctccacttcaggcatggggaattggcatctgctgtgtagatacttggaggtaaggatggcaacagcaccaaggtttcaggaggaaggaagaggacctagaccatagtggggttatggggaggagacaccagctttggactggagaagagacacctgcttctctgagcaaagggaaaggtagttggggatgaaggcaaatatatgagaggagacagagagttgtttagaccttgtaggaaatgaaaggtccattataagatttgctggagtgacaaccctctgcttggaatgaccctagaggatttgaccactgccatttaaagttcttaataatggaaaaataggggcatttcctgtgaattctttgttaccaggtttagagactgcatcccagagcctcccagaagccatcccagaagatgtttttatctaggggcaaagacaatctctgttttcatacttaagattcttttgttcagaccagaggcagataccatagagggttaaaagcttgacttaaacaagaaattcagctttgccttggttcatgttcatgatgctgacatccctgaggctcagggctggaattagaatttggctgccaacttcaaatatttgctttggttgaaatggcatctttgctcttcttggaaacatctcagtgaaatgcacacaccttcacagagggcctttatggaaagggctctcccaaagggcaccatcctgaatccaaaaggccacacgggaaatggccttggggtatttttctttccccacacaaagcagcagctcagctgaattatttgtttgatcttgagccttcaggtatcaggaaaagtaaacagtacatcattcaagagtcacatttccagcttgaaggttccctggaggacagcttgaaggtactggaggacactgtaggaggcaaggaaggatcatccctgccggacccctccccactctcctcccagccaggtctctcacctggatgtgggcatgtgcagagtccctttggctgggtgtgggtgtgatggacagacagggcactctccttagggactctttcttccatcagagggaagaagctgcaggtgttttgccccacttttcctcagtagacaaagagtggtggaagtgcttccccaggaaggtgtggctgggatgctgtgtggctccgcacaaatgtggttcggtgaagttacataatcccatacttggctttattcctattccacagggtctgaattttctgtcatgaaaaagtcctatgtacatgttccacactgattcccacaaatgagtgcacagggctgtatacatgtgtcagatatccacatctaagctatcactggtgcttctgcccatccaaccttctggattgtggcagggtgcaaaagggtttgggaggcagtacactgtgtgcccataaagcaacagctgtgataccttagattctctttcatttgtatttgatttattagtaaaaaaaaaaaaaatatatatatatatatatatatatatttttcatttagccagtcatcagttcatttaataatttgaacaactatgtggctggctcaaggctagatgatggtaaagtgatggtgattctgacagtcttagttcctgccttctgggggctcacagttattacgggatgggcattcaagaagtaaatacacagataaaatacatgatgattataaactggtaactgctatcctggacaagaacagggtgctctaggagggaatgagagaggtttaggttgggggtgtccagtaaaggagaaagatctgtaggcgcatattcattctttacaacatgctgtctattgaagggatgtcacagggtgctaagggaactctaaggaaggagtgcctgacccttgaatagggctgaaaagcttcggagggaagggacatttaaacataatcttaaagaatatgtgaaattttttcatgtggaaagggagtagagatgttacaggtggaggcaacacgtggtgtttggggggactcttaatcagcaagagtgggacataggggagtggcaagaaatgagcaaggaggccaggcagggtggctcacacctataatctcagcactgtgggaggtcaaggcaggcagattgcttgagcccaggagttcagcaccagccaggccaacatggcaaaacctcatctctaccaaaaatacaaaaatattagccaggcatggtgatgtgagcctgtaattctagctgtttgggaggctgaagtgggagaatcccttgagcacaggaagtggagctggcagtgagccaagatcacgcttctgcattatagcctgagtgacagaatgagaccctgtctcaaaaataaataaataaaagagaaatgagctaggaaagacaggcaagggccaactactcaatgtaggttttttatgagaggcaagtcactgaagggaatggcaacttacccagggcctggcagactttttctgtaaaggatcagatagtaagtattctaagctttgtggacctacagtctgtcatagctattcagctctgccactatggtgcaaaaggagccacagacaatatgcaaatgagtgagtgagtgtggctatgtgatagtaaaactttataaacaaaaacaggcagtgggctggatttacccatgagcagtagtttaccagcccctgctctagagtgataatgctggtgggtgactctgtgaatgctgaattggaggatggggagagaatggaggtagggagccagttaggagctattgctttaattcagggaacttaaggaagggacgatggggagaaatggtttgtggtgtgctccaaagtgaaaatgacaggactgcagaccaatttgatgagaacatgtctagttgtttctttaatgctcagtggactgattcttccagagaaggaaaaaaaagtcttgggtattctgggtgtgtgactcagaatcatgcgcacatctgggaggtcacctgctggtcactagacatcgtgcttggtgcattacatagattatctccttgttaagcataattcttaagaattctttagaatgttaagttgtatttcctatttcaaactgaagtttgaaaattgcaagtcatttgcctaaagctgtatcgctggtaaatggagctaagatttaacccaggtctggtgtcaaagcctgtaccattcctgagatgcagaatcttttctcctcacccggtgggtggcatgaagctccatccatgaacctgtgcagctccattctttcccctctgttccttctaagacccatccagcaaggaggacaagggaatgcacgtagggaggacaaataccaaagtcggctgcaagtgttaatctgttttaactgccagcctgtgtgcatttcctagggttcctataataaaatatcacaaattgggtggcttagaataatagaaaagtatcggctcatggttctggaggccagaaggccaaaatcaggatgtcagcagggccatgccctctctgaaggctctagggaaagatctgtcccagggttctccaatggcttctggtagccttaggtgttttttttttttttttttttggcctattgatggctgtcttctgtgtcttttcacatcatcttcgctgtgtgtgtgtctgtgtccaaatttcctttttataagaacaccagttatattgggttgaggcccgccctaatgcctttgtcttaatttgattaaatctgtaaagaccctatttccaaataaggacatattttgaggtgttggaagttaggagttccccatatttttaggggaaaagacacaattcaacccctaacatgaccctttcccaagaagaattcaggagcttcctctgaccaagatccctgagtggatctcaattcagttccttctccaaggtgtcttcatctgtggtcagtttttccatccacgtcgtatatacactgcttgggacatgaagattttgtctatatttacatatgcttttattactacagttcagatggatttctgttcaaactccttagcctttgcatttgacagtgttctctcatcttcattcactgcattttccccccagcctcttctttccctacttggcactttgctcattcattcattagttcatataacaataagtgctaagttcctgttgcattctggggactatgctaagctccaaggatataaaggtgaaaagatgaaaaaaatagttcctgctcttggcgatgtttatgggaggccacacaagcaaatagagtggagaaattgaatagggaagtgtgagtgcagcttcccagcttagcatcctcagtggctccctactgttgctaggagagagtctgagctcccttgcagaacacaccaggcctcccatgacctggccccagccccctcaacagtttcctctctcactttcccttcctttcactttgtgcctcactcattttcatccacttgctcttccccagctatacaattctctctctcaaatcgtgtctttctccaggaatgctctttgagttgagaggtgctcatcctcccccattctcagctattatctgcttgattaactcctacttctttgagactgacctctgggggtacctcttccaggaagctatgaccccttcctctgccatccttatagctccttgggcttccccttggtaacaacctctcctccccctaggagacactgactgaggcttatttatctttgtaactgcagtgcccaatcaaatgcctgtattaataggagcttcattaattaatgagtgaatgaatgatttctgtgtcctgtgctttgcttctgccctccaggctgcactttccctttagcctccttccccggaatcacatgtctggtcaccactttttctctaccacaagtccagaaatctcactgcttaaggcctcctttctgttgtgctgacacctcagttacgctggccctaatgatcagtggctacacttggctacccaaagaccatcatctctttggtctgccctgcttcccacagagaagccttcttatttgcctatgggaagatggttctcatcgggaaagcaaaacttcctctatggccttctctgtttctccagtcccaaagtttcccctctcccaattccaggagcaagggacacactatttctgcttcattgattaattcaaaaagcattttttttattctcaagcttgtatctggagttgtggttgaattactctcacccttttctacttctgcctttctaaccaaaaagatctgtttcttacatcttttcctgcttcatattttgggtttttcctatatattaaatgttacagtgatttttggaaacttttcagcattaaaactcttcaatgaaatcttatgtggaatattaatgactataacagagcaaaccaacattttgttatatatattagcttgataaatttagtttttaacatacagttaatgaaaacaatgagaatgttatgaaaatttgaaattgagggtttgggatgaacactgtagcctcatgacattctcactatcaagtgtacccctgtattttatattgactgtacaacatgcaacagctagatattggaaattatagcacttttaaacaagataccttacagattcaggctattctgatttcaatgatctagaaacatgaaagataaatataggaagaattggttttaatgttgactcactaacactatgtaacaattgtttaattataagaggtctaatggaaaggaacagattctttcacttagattcaccaatttatatctttggcagaaaattcttcccaaaattatgttgtatcatcatgagaggttaattatgttgttaatttttttttcagaaactccagtgtttgtttctctgtagtaatcacttaaagcctttaacacagcaaaacatgtttaatctggcattttgagctcaaacttcagttgtcagtttcatcatggacgctatcggccacaagagaagcagtaatagaatggccctgcattactgttggtcttgatcagtctaacatcaaaataagcatgctactagtaatgctaataatactaataataatgctactggtaatacttaccatggtacagcatgttatgtggtcacatattaccgtatagtttagtattacgtctttataagagcatacattccagggaagtccctgagcccttcctggcctttaattgagcatggcgctagggggccagggtgatggtagtgtacttgctcatacagttttacagcataagaatacttgcatggatccgaacagttgaaagatctttttggaactacagctttcccaattaatgacacatctacatgtgttcaaacatattcatggttttggcaggagaacctttattctgaagcgggcatgagtatattataacctgtggctcatgtaaaccactggggtctatgattgttcacatttggtatcacacacttgtctgtgtttaccattttaaaaatatttttaaatgtaatttgaatcaaacatttctagaacccttgaaatgaataagttgacctccattgtgttagaataaggtgtaagaaaattgtggtctcaggtgggatctttagcagggctggcttgggaggacctccctgttttgatcaggtaaacatctgcccaggtcagggctttcacctccggggagctcagcagtttgtctgtgctgaattcaattgaattgacacggggcaggtcctatgtggttgtaggactagttccccctggtgaggaatgattaggaaggtctcaggtagaagccgcccacctccccaagaagccacacaggtcccacccagggaggctggcacaatccccacccagaacttctctccccccagctccttgcggggtggggtgggggtgctgctctgggcttctagacttccaggtcaaggttttttttgtttttttttcacccactcacctcctgctgacttcctctgggtccctgtgcttgttctctggttttaataattgtaatgaccttaggagtcacttttgggactgggaagccaacacagaaacaaatcagatgaccaggaatactccttgttcccattcgtgtgttccttggtcaggcgttacttctgcgagttctacatatttgtagatgtctccggtgtactgggtttgggaagccccactgattaggaatagaatgtgggcaagtgattgcctttttaaaatgtcctgaattaaggatccacaagtctgtcagcatggtcttccctatttgcaattctagagaaaaaaaaagccatacaggattcggtcagaattattcaagcgcatgtatcgtggctgaccaacagggctgaaattctttttatgcccagtgtggtatggatgttgtgactgacttccattctatacagccatttcctgccagtctccatgattttttattttccagtggatacttgcaggctaatgttccctgtggttccagggatgggcactttcccttcacatttgatattttttctcaggattgcctcatctagcttcatacgtctgcagatgactcccaagcacttttaactattaccctggagtcacaatatgattccaacctacctttccaaaattattcccccaaactttgttacatttcctacaaaccagccaaactccaagttcttgggtctccctacatcttctccatgaagggtgaatctgtaagggccttattttcaaagaccttatcacccaatggaaacatatgaaatgcacatacttttactcagtgcgaaagagtggcacacagggttgcaggagtccaaaagagggagtgattatgcacgcaggagaggatcagagaatgttcttgcaggaggtgatgtgacatgaactttgaaggatgggtaagactcggaaatgcagtgatgcaggaaaacacatgccaaacagagcaaaacccagaagtagaaccaagtgggaaatgaacggagaagacagtggttctgtttgcctgatgttgggctgtgatggaaaggtaggttgggaagaactcatgaagcgctttgatttacaggctcacatttgaatttcactctaggcagtgtggatcctttggcaattttggaacagatgagtggcattgttagaacactgtttccaaatgctcagcctggcaccatgtattagtccgttttcacactgttgataaagacatactagagactgggcaatttacgaaagaaagagtttcattggacttacagttccacgtggctggggaggcctcacaatcatggcagaaggcaaggaggagcaagtcacatcttacgtggatggcagcaggcaaagagagggcttgtgcagagaaactcccatttttaaaaccatcagatctcgtgagacccattcactatcacgagaacagcatgggaaagacccaccctcatgattcaatcatctcccaccaggtccctcccataacacatggggattatgggaactacaagatgagctttggttggggacacagagccaaatcatatcacaccactatatgagattggggtgcatgggggaagaaaggagagaaatttctgaattagaggagtgacagtgggatggagggttagaaaggataggaggtaggatttttccggacaacggagaggaaggatccggggtgatcctcaggtttgagcctgtgtgactggaatcctcaggatactatgaacactgtagagaaaagaggaggcaggtaagctgggggaatgaacttagaacatgttgagctggagggatctctgggaagtgcaagtggagactcctcccccaataacctcagtgttctggactccaggtcagcacagtctagcttcctcctccactcctcctagttaggaccagcccaccttgatgcccagacttatctgacttgaggcagtaaataactcagcaggtctccctgaccccatgagggcatagagattagggcatcaattctgatggactgatcttgagaaccttcctgcctatgtccatctcctgtgtcttacctcacaggactagcttttgattgtctctgaaaattagtggtccctttctgaggttccgactcgtatagtccctcttgggacagaaacctctgcctccaggctggtgctagggccctaatacttatggacagaatctagagtctgaaaactggtttttaaagataacttctgagttttctatctgttgcatcagccaaggggacatcttgtggttgccgattgttgacagttttaaagctctgcaggttggctcagctctattgtatgcaaggcccagtccatccccatgcctgtgttgtcctcagggaggggccctggccctctctgcacttccagatcctacttcacattcaatatcacaccatgcgagtgactcccaggaagtatgagatgtccagcaggtatacaacacactctgcatcttgtactcactcgggacctttgatgaaagcatcttgcatgctgcgtcccaggtttttgacaatcctgtggattctcacccttctgtccctaccttggttgtagggaaccatgaatagacacctgcctttatgttatactggaggtctctggactgctggtgttggtgtcttctgtttttattgctagctgcatcttgattcgtacagtgccatcatccgattccatgggagcttcctttgtgtttgtagtttggggactgcagaaataaaccaaagttggagagagtcttggagcatctacagcctccatgactgacttagttaaacatcttcaatcactttcttctcattctgaagacttcacataattaaaaccatgcccagccaaacgcaaaataaattttgcacatgctgcttgaattactgtgcaagcttaccccagtgtggctttttccgagattaatatttcaggaaaactattcctctgggtaggctgaagccagcagctgtggaaactcaacatttgctttatacaatgaaactttaggacagggctgcttttcacatttctcagatgtgcttctcatttggaaaaaataagtactcttggcaaagtctacatggaatgagccccagcttgtgcttccgtctattcagataggaaatgatgagaaaatgtggctctaaatgtcatcatgcaacattggcactgaaaaataataattgccatttcttgagcacctattactctgtgccaggtatcttacaagccctgcatcctcacaaacaccctgtgagtgtgccacacctaggtgtgtctatcttctgattcctgctttgcccttgatagcaggggctgacctggaaggctgccttccccaggctccatacctatggtttccttctagaggaaggttgctgcacctgtggaaggttgcaaggtagtgaaaagaggaaaccagagtatttcttccctctctcccttcttaaatcatccctgccagcaatgtctgcatctcctccatggctccagctcccactatttgtgtcctccatggttcctggttcttcctggtgactctggctcctgggctttggcaacattgcctcctacctttatgccttcaattacccactgcctactattgctaatatctgattacttcatgaccccatcccaagaccttactccaactaattttatctttttaaagtcatacaaacttaatttttttatttttcatttttaaaaattttttaattttttagttttcccattttgcctgatccttagtaagtatgcaaggttatatgaacttaagaagatctttgtactcttgacttcattatctattgcaataatcttcaaatctcagcttttctatcagctgtaacctatatttctatcttcaccactgccaccaattccctgcgttaaattccttctgctgcaaatactgaagcagtgtctatttctttacttagatgctgattgatggattgaggtgggaatcattagcctcgttttaaagatgaggaaatgggaagtcagggaggttaactaacttgtctagtcttaaagatagggcatggtggagcttgggtttaaacctatgcttggttaatcctgaagcttgtgcactttcttgtatatcagcccatgttctgtttactggcatcataccaagtttaatttcttgtgtataatcacttcatattctggaaaaagaaaactctcatagttttcttcaggatttcccaagataaaacattttctatcccttcagctgttcctcatgagaaagaggatatttcccctaatatcctggttgaacttttagatcaatatttctcaagatttaatgtgcagattatggttcaggaagactctaaagattatgcattaaaatgtatttttaattagactttttttggagataattttaaatgtatatgcagttgcaagaaataatgcagagctcccatattccatttagctagtttccccagtgatgacatcgtgcaaaactgtgctacaatatcacaaccgggatgttgacattgatacagtcaagatacagaacatttgcatcatcacaaggatttctcatgttgccgttttttagctacaataactttctttctcaccccaatccttccttaacctctgaaaactactaatttattccctatttctataattttgtcatttcaagaatgttgtataaatgaaatcatacaatatgcagccttttgggattgcgtttttaaattcagaataatcctctggaattcatccaggttgccttgtgtatcaacagtttgttctttttttgttgctgagtagtattacatggtatagatgtactacagttggtttaaacatttactcttcgaaggatgtatgaattatttccagttttgggctattgcaaatacagctgctataaatattcatgtacccagtcccaaaaagttgcatattgtgctctcatttatacaacatgctgtcattgaccaaaacttcattaatgtggtgcaggactgtatttcattctttaggcagcagtaaatggtgttgtattttttaactttagtgttcactcttagtatatggaaatacagttgatttttgtaagtttatgttgcctgcaaccgtgctgaactcactagttttattttattttattttttgttggtgggaatggagtctcgctctgtcacccaggctggagtgcagtggtgcaatctcagctcccagtggtgcaacctccacctcccggattcaagcaattctcctgtctcagcctcccgagaaactgggactacaggcacatgccaccatgcccagctaactttcatatttttagtagagacagggtttcaccatattggtcaggctggtcttgaactcctgaccttaggtgatccacctgcctcagtctcccgaagtgctgggattacaggtgtgagccaccacacctggctaaactcactagttttaagaggtgtattagtctggtttgcagaaggaacatctgaggctgggtaatataaagaaaagatgtttatttggctcatcattctgcagactgtacaagcatagcatcagcatctgcttggcttctggtgaggcctcaggaagcttttactcatagcggaagactaagggacagcaggcatgttgtatggtaagaaggagcaagagagatgctaggctcttttaaacagtcagctctcgcataaagtaatagaatgagaacccactcattaccacaagggcaacaccaagccattcatgagggatccatctccatgacccaaacacctcccaccaggtcccacctgcaacattggagaacacattttaacatgagatttggaaggacaatgtccatggcatacctggaggttttttgggtaaattccttgggatctctattgacagccatatcacctgcaaatagggacagttttatttcttcctttctcatctgtgtgtcttttagtaccttttcttgcctcaaggtaatggttagaacttacagtgttgtgttgatttaagagtggggagggtgggcatctttacctagtttctgatcttaaagagtaaacattgagtatttcatgatgaagtataatgttagctataggtcttttgcagacgctctttatcaagttgaggcaattcccctctattcatatttttctgagaatttttaaaaatcatgaatgggtgttgaatttttgaaaaaatttttctgctcaattaacatgactttttttctttagcctattactaatggcagtttatatcaattgatttttgaataagccttgcattcttgaaataagccccatgtagtcatgtcataaaaagtcattacgaaaaaaaatcctttttatacgttcctgaattctacttgctaatattgtgctaaggattgtttttattttatctatgttcctgatggctttgagttttctttttttgcactatctttgtctggggttggtatccgtgtaatgctagcttcatgaaatgaattgggaagtatcccctcttctctgattttctggaagagatggtgtagaagtggtgctaattcttctttaaacatttgatagaattttctagtgaaaccatctaggcctgaagttgtttttttttggagcgggggggttaaaattacgaattcaattctttaatagctatagggctattcaaattatctctgtcatattggatgagttgtggtactttgtgtttttcaaggaactggttcattttgtctgaattgtcaaacttatgtgtgtaggagttgttcctagtatttccttactattttttgtcatctgcagggtctgttagtgatatctactgttttgtttctgatattggtaatttgtaacttctttcttttttggtcagtcttgctataggtttgccaattttatagattttttttcaaagaccctctggtaattttctttgctctaaagtctactttatagacttaatagatatcaatgtagacttgttttctattggttaatggttgcataatataaaaattttatcctttttctttaaacctgacaatattgtttttgtgctttgttttatttgggggggaggtgtttttgctttgttttgtttttaagacagggtcttgctctgtcaccaggctggagtgcagtggcgtgctctcagctcattgcaacttctgccacctgggctcaagccatcctcccccttcagcctcctgagtagctgggattacagatgtgcaccatgcctggctaatttttgtattttttgtagagacggggttttgccatgttgcccaggctggtctctaactcctgggctcaagcaatctgcccgccttggctataaaaaaccatgtaccaactatacactataagaaactaacttcatatataacaatactggcagtggctgggtgcggtggcccacgcctgagaaaataatcaaagaaaggacttttatagtttcttatagtgtatagttgggacatggttttttttaaaaacattttatttcaatagctttagaggtacaagtattttttggttacatggatgaatcgtacagtggtaaagtctaggactttagtgtacccatcacctgaatagtgtgtgttgtacccaatgggtaggttttcatctctcactccctctacccttccccattctgagtctccaatgtctattatatcactgtatgcctttgtgtacccatagcttagctcctacttgtaagagaacacatggtatttggttttccattcttgagttatttcacttaggataatggcctccagttctatccaagttgctgcaaaagacattatgttattctttttatggcattcaactgatgaatgaattacatacacatcacattttctttattcattggctgaggttacttaagttgattccatatcttgcaattgtgaattgtgctgcagtaaacatatgtgtgcaagtgtctttttatataatcatctcttttcctttgggtagatacccagtagtgggattgcttcatcaaatggtagatctacgtttagttatttgagaaatctctatatggttttccatagaggttgttctaatttaccttcccatcagcagtgtataaacaagagttccctttttttttttttttttgccatatctatgccatctattgctttttgactttttaataatggccattccagtaaggataagtgatatctcattgtgagtttaatttgcatttccctgatgataagtgatgttgagcattttttcatatatttgttggccatttgtatatcctcttttgagaaatttctatttatatcatttgcccactttttaatgggatttttttttcttgctgatttgtttgacttccttggagattctggactgatctttgacaaggcacacaaaaacataaactagggaaaggataccctatttagtggatggtgctgggaaaattggatagtcacatgtagaagaattaaactggatccctatctctcaccatgtacaaaaattaagtcaagatggattaaagacttaaatataatatctgaaaccataagaattctagaagaaaacctaggaaaactattttagacattgaccgaggcaaagaatttgtgactaagaccccaaaagcaacagaaacaaaagaaataaatggaatccaattaaactaaaaggcttctgcagaaaaaaagaaatattaacagagtaacaaacaacctacagaatgagagaaaatatttgcaaactatgcatccaacaaagggtcatttttaaaatccactttgccaatagctatctttaattggtgtatttagattatttacacttaatgtcattactgagatgttagggctgatgtttgccattttgtcttttgtcttctgctttttgtttgtttgttcctctgttttctttttttagttacttgaacattgttttagaattccattttgatttgttcgtagtgtttttaagtgtatttcttcatatagtttttctagtggttgctccaggtgttactacatatatatatttaccatctgctggtgccatttcaccagtttgagtgaaatataaaaaccttaccatgctttgcttccctttgccctactccaaagtgggtcttaaatatttcctttacatacattaatttttcattttaacttaattttattttatttttgagacaaagtctctctctgttgcccaagctggagtaccgtggcacaatcatagctcactgcaggcttgaattcctggacttaagcaatcttactgtctcaacatcctgagtagctgaaactataggcatttgccaccatgccctgctaagtgcttttttaaattattgggaggctgaggtgggaggatcacgaagtcaggagatcgagaccatcctggctaacacagtgaaaccccgtctctactaaaaatacaaaaaaattagccgggcgtggtggcgggcgcctgtagtcccagctactcgggaggctgaggcaggagaatggcgtgaacctgggaggcggagcttgcagtgagccaagatcgcgccactgcactccagcctgggcaacagagcaagactccggtctcaaaaataaataaataaataaataataaaataaaataaaataataattattattttttagagattggggtctcaccatgttgcccaggctggtcaaaactcctggtctcaagtgaccctcctgcctccacctcccaaatcgctgggattacaggtgtgagcaactgcacctggcttcctttatatacattcagaaccacatcagaaagtgttaacatttttgcttcaactgttaaatacgaaaactcatgaggaaaaggaaagcctattgtatttacctatatttgtgctttcttctttcttgatatctcatgatatctttttaaaattcttttctttctttttagaggactttagtaattctttttgggtaggtctgctggtgacaatttctcttagttttccttcattggagaatgcctggtttcccctacatcttgaagggcagttttgctgggtatggattctggattcacagttcatttctttcagccgctgaaacatacattgtgctacttactgccttttgacttccatggtttccaatgaaacatcctctgtgttctgaattgttttttccctatagctaggacgccgtttttctcaggcagctttcaatgtttttgtctttggtttttttttctttcttttttcttctttcttttttctttttttttttttaaagacagggtctcactctgtcactcaggctggagtgcagtgcagtggggcaatcttggttcactgcagtctcgatctcctaggctcaagtgatcctctcacctcagcctcctgagtagctgggacccacaggtgcatgccaccatacccagctaatttttgtatttttagtaaagatggggttttgccatattacctaggctggtctcaaacacctgagctcaagtaacctgcccacctcggcttcccaaagtgctgggattacaggcttgagccaccacactcagcctatttagtctttagttttcaaaagtttaattacagtgtgtcttcacatggatttctttggctttattccatttgagatttgctcagcttcttgaatctgtaagttcacgtttcttgacaaatttggattttttaaagccattatttctttgattactttctcagttcctcttcttcctctttcattctggagctccagtgacacaaatgttaggtcttttgtaataatctcacaggtccctaagattctgttcattttttttccagtctatttttcctctgtagttcaactaagtaatttctatcattctgtctttcagatcactcattgtttcatctgcctcctccatttactatcaagcccatctgtttattttgagctttttattttggttattgtatttttttactgtgtggaatgtacttaataaacgttggcttttattattgttgttaataaaaataaacataaccttttcttttaattaccagacctacaataccaagtttcactcacataaacactggctgtgttacaagtatttccttattcaattcctttattcctttagttcttttcatacgccaagtgtcctgtcctttctttattttaaaatgttttttatttcaatcgtttttggggaacagttgctgtttaattacatggataagctttttttttttttttttttttttttttttgagacagagtctcactctgtcacccaggctggagtgcaatggcctgatctcggctcactgcaagctctgcctcctgggttcatgccattctcctgcctcagcctcccgagtaggtgggaccacaggcacccgccaccacacccggctaatttttttgtatttttagtagagacggggtttcaccgtgttagccaggatggtcgcgatcttgtgacctcgtgatctgcccgccttggcctcccaaagtgctgggattacaggcgtgagccaccgcgctcagccattacgtggataagttctttaatggtgatttctgagattttggtgcaagtatcacccaagcagtgtatactgtacccaatgtatagtcttttaccccttaccctcctcccagccttccccgaagtccccaaactgcactgtattattcttatgcctttgcgtcctcatagcttagctcccacttaaaggtgagaacatacaatgtatggttttctattcctgagttacttcacttagaataatggtctccaactccatccaggttgctaagaatgccattatttctttcctttttatggctgagtagtattccatcatatatagaatattatatatatatataactacatattatttatccactcattgatgggcatttgagctggtcccatatttttgcagttaccaattgtgctgctacaaacattcatgtgcaagtgtcttttccatttaatgacattttcctctgggtagatgctcagtagtgaggttgctggatcaaatggcagatctgcttttcgttctttaaggaatctctgtactgtcgtatagtggtcgtactggtttacattcccaccagcagtgtaaaaatgttctcttttcaccacatccatgccaacatctattagtttttgatttttaaattatggctattcttgcaggagtaaggtgagtactccttggttatgtatattcctaaatactttatttttgtttttgcagctattgtaaaggtgactgagttcttgatttgattctcagcttagtcactgttggtgtatagcagtgctattgatttgtatacattgattttgtatcctgaaaccttactgaattcatttatcagttctaggagctttttgatgagtcttgagggttttccaggtatatgataacatcatcatcaaacagtgaccatttgacttcctctttaccaatttgaatgacctttatttctttctgtttctgattgctctggctaggacttccagtactatgtttaattgaagtggtgaaagtgggcatttttgtcttgtttcagttctcagggggaatgctttcaacttttccacattcagtataatgttggctgtgagtttgtcatagatggcttttattaccttaaggtatgtccctaccatgctgattttgctgagggttttaatcgtaaagagatgctagattttgtcaaattttttttctgcatctattgagatgatcatataatttctgtttttaattctgtttatgtggtgtatcacatttattgacttgtgtatgttaaaccatccctgtatccctggcataaaacccacttgatcatggtggactattttttttgatatactgttggattcagttagctagtattttgttgagggtttttgcatctatgttcatcaggcatattggtctgtagttttctattttgttacgccttttcctggttttggtattaggctgatactggcttcatagaatgatttcaaaaggattctctctttctctatcttttggaatagttttagcaatattggtaccaattcttctttgaatgcctgatagaattcagctgccaatccatctggtcctggatttttttttttattggcaacttttttgttattgtttcaatcttgctacttgttattgatctattcagagttactgtttcttcctggtttaatccagagagggctgtgtatttccaggaatttattcatcccctctagattttctagtctgtgcgcataaaggtgttcatagtagccttgaatgatcctttgtatttctattgtatcggttgtaatatctcctgtttcttttccaactgaatttatttggatcgtctctcttcttttcttggttaatctcatgaatggtctaacaattttgtttatcttttcagataatcagctttttgtttcatttatcttttgtattgttttttgtttatttcaatttcatttagttctgttgcgatccttgttacttcttttcatctcctatgttttgggtttggtttgttcttgtttctctagttccttaaggtgtgaccttagattgtctatttgagctctttcagattttttgatttaggcatttaatgctgtgaaatttcctcttagcaccacttttgctgtatccaggggttgtgatagattgtttcattattattcagttcagacaatttttaaatttccatctttatttcatcgttgacccaaagatcattcaggagctgattacttaatttccatatatttgcatggttttgagggttccttttggagttgatttacaattttattccactgtggtctgagagagtagtcaatataattttgattttcttaaattaattgagacttgttttgtggtctatcatatggtctatcttgaataatgttctgtgtgctgatgaatagaatgtatattctgttgttgttgggcagaatattctgtaaatatctgttaagttcctttgttctagggtatagtttaagcacattgtttctttgttgacattctgtcttgatgacctgtctagtgctgtcagtggggtattaaagttccccactattattgtgttgctgtctatctcatttcttaggtcaggtggtaattgtcttataaatttgggatctccagtgttgggtacatatatatttaaggttagtgttagggttagggtttgctgaactaccgtgctccaggctggtactggggagtgtctgcaaatagtcctttgatgcgatctatcttcaggtctctcagccatggataccagcacctgttctggtagaggcagcagtagagtgaagtggattctgtgagagtccttggttgtagttttgtttagtgcattggttttcttaagtgctggttatgcttatagtgaagttgtcacacagacagattcaggacctctggttagccaggatgttacagatagtgaaattagctgttgttttctcctttcttggagcagggttgttctgtcatgagttactgtaatggcttgagttggttgccctccagccaggagctttcaagagagcatcagctgtggttatattgggggatgcaagcttgccctaaggtcacctggataacttcgggtttctcaggcaatggggggtgctatagagctcctgcaagtttatgtcttttgtcttcagctaccaaggtgggtagaaaaagaccatcaggtgggagtagggctaggtgtgtctgagctcagactcttcttgggtggtgcctgcagagaccacctggggggacggggcagtggttctcaggccaatggagttatgttccaaaggggattatggctgcttctgatgtttcatacagattgccagggaagtcggggaaagccggcagtgacagacctcacccagctcccacacagccagcaaggccagtctcactcctgccaacagccaacagagctgaatttatttacaggcctctggtgcacagggctgagatcttgccccaggctacaagcctccctgctgagaaagcaagcagggctttcaggcctcacccctccctgactgccacagcttctgtgctcatctgcacctcctattcgcctccacccctcagattctgcctaggaatctgaggaaaattcatacttgatcaaaattattacaaagttcagctgcaagtctctttctccccgtggcccttccccaattccactggctgccatcccctaggaaccctgtgagataaagtgagaaatggcttcgctgggcttccctggggatcaggagtgcctacagggcacttcccactgcttcttctacttttatattttgctcagctctctaaattcatttcagctctaggtaaagttaaatccttcttccatgatctagatttccaggttccccagtgaggatgtatgttcagaggcagactttcctcccctcacttcgggcactgactgtgtttttggctgtttcttggagtttgcagtggcaagccactgctttcaaagggtttgtgaattctttcagttgccctggtatgttcctgtggtggttcttggagcaaaatttcacaatgtgagtctccaaacactcctcattattgtatttttttaatcataaaattctattttttccttatatcttctctttatttgcagagactttttatttctttgctgaggcttttaatttctttatttgttttaagcatgtgcataattgcttgttgaagtatttttaaaatcatggtgtttaaaaatctttgccagataattctattatccctatcatcttagggttcacatcaattgattgactcctccttactgctggatggggatgggagttctggatcccatgtggtctccacagatgtggggctcgtaaccactggtagtgatgagagtcctgactaggctgcctctgacaccccagtggagagggggagggggaggaggatctagttatttctaggagggggcggatgtccaggcttcccatgtagtccttactgatattgccagggaaggtagctcattactagcaatctcagatgaaagtctcatctctccccttgtgccttctctgacatcactctggcaagggtgttggagtttcttgctatggtctcttaagggtgaaagtctaggctatctacccaggctttgctggtgtgggtgtgggtgtggatgaggccatgggttttttgttttttaaaatgatgtttggctaaagtagagtggctattgtctaagagttttctgtcttgctagaacactcctttcctggtcctctggctagagagagcaggcatttgttgggagtctgtttgtctgcaccagttgtgttgggtttctggattgctggcttcttcagctacctcatctccttggttcttagtgtgcattatcctttacctggactactgagttgaacccccaacaagtctttcagaccatctctggcttctccaacacatcctgcacacttctgccagtgttttcttcctacaaggcagaactgaccatgtcactctcctgttaatattatttactgtccataaaataaagctcaacctctgtaaggcactgcagatccaccaaaatgcaattccatctttgcctttgcagctttgacttctgttcaatttctctgcctatccctttgctcctgtgctaaagatgtgtcgtgtactttagctcctgctcttccttctgtctccagtgcttttctttactctagcaaagtatagtttcaaagttaagagcactggagttggactgactaagtttaaattccaactttaccattttctagctaggtgatcttaggcaactttacctctccatagctcagttttcccatctgaaaaacaaggataatagcatctacctcatgggactgttatgaaacttaaattaagtagcacttagcaaattatctggttgaagagaaaggtctcaaaaaatgtggactattagtataattccttattaaattaatactcagtagttaaattaatatgcagttgctcaacattcaatttgaatgttacctctctatgaagtctttatgggtcctctgcattgctaccttattattgaaattaattattcttttcccaactgtccacttaatttacatcgcatttacatttgattctgtttgcagtgcaggtaggtagatcgctgaccacatttgctcatttctggattattcattcaaaggaagcactatgagtcaatcattgggcacagaggtgagtaagatgtggatcttccttcagagaattctcaattccttagtagctgcagattgcttgctaaataaacggttctggtggggcttaataaatatttattgatttaagacaagcaagctctgccttgggataggaaggtaggcagcctccaggctaaacagcatcacagtgtgttaaagttagaaactttttgtgaaccacccttggtactgacctctgcatagtgctaagtgaaggcttcaggctctgtgttagagccctgctgtaacagcattggtattcctgtggtctgtggccaccaccacgtaagtcttgactaggaccatatcatttcttaaccctggtccttttatgttcaaatcaagacaaagatttttcttgaggtctcaggagttatatcagtgtcattgaggacattgttcattctgttttaaggcccatgtctgacaatcttagcctcacacaccttgactcccatcattgagacagaatttgttttaaagcacttatgtgccaggaactgtgttagctaccacaaatgcagaaggatggaacacaagagccccctcaacagccaggagctcatagtctccatgctggagcaatcgttagaagcacaaagctgattgtttcactatggccaccttaccaacaatgctttggtagacaggctggataggaagccagatattttaggccaaggagggactgatggaagaaatggaaagaggaaatataagttcctatgaagatgtatggctgtgaagggaagtagaatgggtgataagaaaccacagtggaggttgagcaaagggaagattgcttaaaggtgggggaaattaggtaagtttatagtagataaaaggagataagggcagtagatcaaaagatagagagattgagatagtgatttggaaagaataagcaaatatttgagaaagaacaatagatattcatgtacacatacatatatacatgcgtgcatacatacatatatacattgtatatttatatatgtatgtatataagtatagaatgtatatatgtatgtgtgtttatatatatgcattttgtatatggggcaagaaggtgaggagaaaatgaaagactaaaattttgagaaagagaattatacatatatatgtaatcactctatatacatattatctatttatctacctacctgtctatctatcaatccatctatctgcctacctatttatatagagagatggagatcagccagaaaagggaaagtcaaagaagaatcattcattaatggaaccatgtcctgtaggaagaaggaggaaataatttgaaagcacaggtgaaaattccttagagacagaaggaaggaaggtcagaatgagatggaagggaggaaagttagagttcatgtagggtgccctctatttctctggaaagctgagaagatggaatgagaagattgaagaatgagaaagtgagaaagtaagatgtcagggacatacatgtaagctttcctagcagcactgggggcctccattgattttgtaaactcagcatttgcaatgctgcaaatatgaatgattatattttttcagaagcactagcctgtagggaggagagcaagcaggtgagggttggagtgctttgggagttaggcgtgaggttgaggagagggcagcagaagggtcctggtgagagcagcatgtagtgtagttgtagtagccaggctgtgcagagaaaagatgaatctaggatgacagtgataaactgagtgagcagggaggggatgagaagatagaagcctcagagagcttggggagcacgtttactttgattcaggtatggagagtgcatagcagtattctcagctaataaagatatactcagctaataaagcagattctagctgctaataaagatatacccgtgactgggtaatttataaaggaaagaggtttaattgactcacagttctgtatggctggggaggccttaggatcatggtggaaggggaagcaaacatgtccttcttcacgtggcagcatcaagaagtactgagcaaaagggggaaatgccccttataaaaccatcagatctcatgagaactcacccactattaggagaacagaagcatgggggtaactgccccatgattcaattaccccccagctgggtccctcctacaacagttggggattataggaactatattacaagatgagatttcagtggggacacagccaaaccacatcagagaggtaagatagaggttccgattggagagtgagatttctcagtgtgagtcattcatccagcaaacagtccctgagcattagctctatgcacttattgtgggaaactctgagaacaaagataagaattaaggcatggtccctgcccttacggagttcacaacccagtattcagaggtaaaacctttccaggtgatgacaaggtccaggatacatctctggaaatgattcactgtgatggttgggaggggaaggttgatggggcagtggaagccaagtggctggcaggctggcatgttagatgtatcatccccaggtgcttatcagtgctacaaagaaaatcggggtttctctcagctcagttatttctctggggccatgtgtatcctctccccagccggtgatataaggactgtttttccatttgagcttttgctcttcagactccctgtgactgtcctagggtcagtgcctgatagttttcaccagtgtagagtggaaggtcaatgggcctcaaagacctacttctgcactttggtacatgagtctgtagacagttacccatcccatgcttccagtttccttttctttcttgcccttattttcttgacctgtaaaattaacgtaggatagtgacaccaatccattttggggaagaaatagctgagatgtgtctctataaagtaatcaataagcagaagtcggaagccacagtagttggaagggtgtgatgatgacgaatgaatgagtgtgcacacgtgaagtggggacagctcaatgctcagagctccatgactgatttcattcttcctgcaagcttctaagtgaagctagacacagagaggagatttcctacctgggcctagcagaggccttgacactttagcaaggaaggcatagggtgtcggaatctacatatcagcatttccaggattctagttcctacagagctgtgtgagacttcatttcatggcccatctgggcattgctagaaggaaacagaattccctcccttcctgttccagagaggctggcctgcaaacttcactgatgaggggccagattgggacatcccacactagctgttttgtggattttggctgacaggagcagagaggaagcatgtttctttgatcttttacctcttgcatcctttctggtatgaccctgggagactggtttatctggctgtctagttcaaattccagattacactctgtcaatgggctttctcctctctggggatgctattcatccttccaaggatccagacactagccaccaaagcttctctgctgggttcacacacataccaggtctaaggtatgatgtgatctcctgggtatatgatggtttttgtgctgcttcttttttctttcagagtctgagaagccaactggggccaaacaagttttagaacctctactggctgatgccaacatcatcagagatgaactgttcttaccagaaacttctctgctcctgacaccccacctctccccaggtagctaaagggataatgagattattaccccctgaacactatgtatgggggtgacataccaggggacactcagttccaattgcaatatcataggcacaatattagaagaatatttggacactttgatagccaaagaaaggcatttggaagattaatagggggcttcactgcaataggtctttcctttgcttaaatcatgaattttttattaaattttacacaaatacattttttcatctattcatacgatctttttcctgttaatctataaatatggtagagtacacttatttacaatccaatttttaaaaataaatgcaataacatctcttacttaaaattaagccatatcataatgtgatatgaattagaattttattgacttcaaatttaataccgctaaaagataactctgccatcattcttattaacttaaaaccaaaatttgattgcaagattctttaaataaagtaaccttcaaaattccctgttttacctcaccaacacaatttttaaattgtggtaaaatacatataacaaaattcgtcatcttaaattacttttaagtgtatagttcagtggcattaagtatatttacattattgtgcaaccatcaccatcatccttccccagaactcttttcatcttgcaaaacagaaactttgtaccctgtaccctgttcaataattatcttttccctgctcctgttcctgacaaccgctactttctgtctctatgaatatgaccactgttggtgcttcatacatgtggaatcatataatacctgtcctttttgactggcttatttcacttagcctaatgtcctcaagtttaatccatgcttatgccttcctttttaaggctgtgcgtaatattgcattgtatgtgtagacaacattttatttattcatccatctgtggatggacatttgggttacttccaccttttggctattgtgaataatgcagctctgaacattggtgtacaaattctgttcaagtctctgctttaaaatcctttcagtatatacccagaggtggaatggctgggtcatacaataattctatttaaacattttttaaggaatagtcatcctattttccacagtggctgcacaattttaccttcccatcaacagtgcacaagggttccaatacttattttctgatttttgatagtagtcatcctaacgggtatgagatgatatttcattgtggttttgattttgatttcattaatgcttggttatgtggagcatcttttcatgtgcctattgactacttgtatatctttggagaaatattgcttcaagtctgttgcccatttttaaattgagctctttgtttttagttgttgagttgtaggagttctgatattaggaattaggataggtagcagtctggatattaaccctttatcagatatattatttgcaaatattttctcccattttgtgggttgcctttttactctgttgtgccctgtgatgcacagaagtttttaattttcatagagtccttttctttttttttacttttgttgcctgtgcttttggtgtcatatccaagaaatcattgtcaaatccaatgtcatgaatctttacccctgttttcttctaacagtcttctaaaatttttagctgttacatttaggtctttgacacattttgagttaattttttatatagtgtaaggtaagggtccaacttcatccttttgcacgtggacatccagtttttccaacaccgtttgctgaaaaggcagtcttttcccattgaatggtcttggcacccttgcaaaaataatttgaacatatatatatgtaagggtttatttttggatgttctattctattccattaagctacatgtctgtttttatatgctaggcctacactgttttgattactatagatttataataagttttgaaatcaggaagagtgagatgtctaactttgttaattttcaagattgttttgactgtttggggtcccctgagattccatatgaatttcagtatggatttttttatttctgcaaaaacatcattgagattttgggactgccataaaacttctgaattctttcttataggaaacatttgccagacagatgaagagaaggggggcatttaggcaacaggaagagtgtgaccaaaagcatgaagaggtgaaagagcttgctctacttgggggaactaaaagtaatctagtattgttgaagctctaagcattcttattatctgtgtgtatatgtgtgtgactgtcagcttggataggagatacattaggaggtaaggcagaggtcagatattgtgaaagtggatgtgtattgtgttaagaggtcaatggaaattcattagagttgggttgtggagtgatgtgatcatatttgtactatagaaaaatgaccctgttaataagaatgggtgctatattgagaaggaaggaggtatcatcagaaagaccaggtaggagattgttgcaaaactcccagaaataaaatgataagacttgcaatctggtaacattagtggagacaggaaggagggaatggttttgaaatacacatggctcactacaaactcagacatattccagtagcttcactcttttcctgggtcttgaagtcctcagatctgtagaacagcctctgaactcagtttgatggctctcaccattcacgtgtatcatccagttgccaccttttaggaacacaaatgactgttgaaagaggcgctgtgttctggctcagcggctcaagggtcccttaacagcagccagtctcttttcaaagtccctggagctcccactccttctcctgtcactctcagagcctctggccgctccaaggactttatggttgtttctttgtgcctgtgagttggttggtgttttcttgttttggtctttcctgaagcctgctgaaatctaccagccagagagtgttctgttatagcccattctatttacctcacggaactgccgctctccaggccttctaattgtggcccatgttactcatatctgtgacccactgagatcccaggttcattctccaagccttgacacccttctacactctgtgactcaattgcctgccttgagttcatagcagcatcgaatgagctgttcatgagcagttcatagcagcatcgaattgggtctctgccacctctctcccacttcgtgcccaggagctctctgtaaagcctttgctgagtaactgggcaatgctaatgccaggcttgtgctgcagcagctggggagaggatgtgctcctccagccagaggctggagcactgagatcccaagtccctgttctgatccctggtgggatggttctatggatgggcagtctgggccatgtgtgtgttctactggcccatcacagtcacaggtggagtcatggagctagaggcagggagcagctcgagctctcaaattcctgtagatattttagaatgagaactgctttggcagttctgggatagccagctctgaaccactgccaaaggcacacatttagtgacctgagggatgaggcaaactgatcaaggtacacaagtgtcatcagtgcaggctcccgggaaagcacagcaggagaggagagggctgtggcttgtagttaaaacgcagtgatgaatgtgacgatgatttgaacccgatgggctgtgcctcaaaggtgaaccagggagaatcaaataaagagttccagaagtggtaagggggaattgtttactgggaattaggaagatacagggcagagaaaggagaaaggtcaggaaaatcagggatgtaaggagtttctacttccttgaaagccaggaagctcgcttgaacaaagagcacaagaccccaaatctttgtggccccactggctgggagagctcgctggtctttctttaggagcctggctagtttttgcaagcatagttttcacaagcaattgaaggataatttccttagctctatagtgaagctatacccccaaaaaagtggggctggccagagagggtctgtagtttccaaagccccaaaggacacctgcaaatcagctgttgcaaaaatatgtctttaggagtccaggctacctggaacatggcctcaggacagcagaatgtttcttatcactcactttatgttcccaaacagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcaggtaggtgcctggtttccactgggccaggactgaggtctggggctgggtccaaggttgtctcctgggtggccatctctggccttattctcagtaaagacacactacgtaatcaaagctactgctctgctttgctgagctttgagatgaaaggtctccaggttgggagttaagcttgtcattctctaatttgaaaaatgaagggttctaagagctttgtcttgcagaaaatgtttagctgctcaagtgagtgattgaagtggcccagggctactgttggcttctgtcactatgcattaactctgaccaaggagggggctgatggagtacctcagcctggttattctatgcagttaacctcacacaggctgcctgtgtgtgagactgtgtgtgtgggagagagagtatatgtttatatgttctgtgtttggggcctttctgaggtatttgacgaagctgtagatgagatgaagacagaaggcatgcggagtatggaagagtctgatatttgtcccttcgttggttcaaagttgcactctttagtaagatggctgattttctcctcaagatcatttcttgaaaacagatgttgttcatataaaaggagtcatttaaaaatacatgaaaatgctcactggtttgaatgactaaactgttcctctgttgcttgaatgagtttttaatttcttgatacttttcttttgtttttgttttgttttgttttgcctgatgtctctggatatattgtataaaaaggaagggactagggtttcaattggatttcctttgggcgaggactagttttactttctaattctctaggcagggttgacacatggtggtctaagagttgaaatgcaaacctgacattatgatttacagtggcaattctgagccaagtggagggttccatgagccaaggaagttcatggcttctctttgtaagaggatcttggatgacgcgcaacctgatttcagaaaaaaaaaggactgctcagggtcttgttctgggcaagctgcagcatgtagtctgcttgtgcctcaggtccagggctctgccttcttagatcagtgaaggcctaggtcaccagtcagctcctcttccccgttaaggaagtccagggcctccttctccaggcactcacccattagaggaatctcatctttgctcttgcttcaaggcaacattggagagaaaggacacaagagctggaagagaggtttgaaattcagacatcgttttcacaagcaattgaagcataatttccttagctctgtagtgaagctatcccccaaatgaagtggggctggcagagagggtctgtagtttccaaagacccaaaggatacctgtgaatcagctgtcacaaaaatatgtctcgcatgagagcaaacagcactgcacttcggatctctgatcagcacaggaggtacctggcaattttccatttcagtcaacatgaccctgaattgtgaccactgaaagtggtaactcattgaatagtcctgtgtttaccatgtgtcttgtgatcttgtcaaggctgaaaagtacatggccctgtttttctctcccctccaaacttcctccttcctgccccatactcatgaattaaatactacttgggatgcaggaagacaatgcttctttaagtaagtacgggctgagataaaaagaaaacacaaggaaatggaaaagcagtgtggctaaaataaaatttggatgcagtgtgtagactcagtgactgaaaatctattctgaaatggggaacactccctgattataagtgaaattaataaagaaaatttcaaatatgtatttaaatattcaagatacaaataaccattgtttttagtgaagaaaatcaaataaatggattggaagcaatgatgaaaagtatgatggaagaaaattgtggaaaatgtcctaatcttgtagctgtctcatgtcctcattctgctctatcagatcttcaaccccgcagggcccctggcccctcgtattttctcccagtgcatctgttgcctcctctcctatccacgtggtcccttatttcagcaacacatttgctaatacacataactgccttattcttttgtgtagcttctgagtaaaccagtaggtgaaaccccaactctgagtaaatcctgctcactttcttgtgtgtgtgtgtgtgttctttgttaggggggtgtctaaggtgcttggtaaccttgtgggagagatggagacagaagaaggcacgtgagttgggagagtctatattcgccctttttttacttcaaagttgtactctttaggaagacggctgactttcttctcaagatcatttattggaaacagatacggtttatataaaaggaggcatttaaaattacatgaaaatgctcaatggtttgaatgaccaaactgctcctctgctggttgagttttaaaatatttgatattttgtttttgttttgcctgatggtctctggattttatgtaaaaagaaggggactaaggttctgattggatttctctttgggcaaggactggttttactttccagttctaatctagccagggttcatattagatgacttaagaaaagtgaccctttctcactctgtacaagttatcaaacaccagtataatttgccatttgaagccactagaaattcatagtctccaatctcagctgagcttttcacatcataccttaatctccctgtttacttctggacacatcttgtgcccattcttcacaacaaacatttcaaaccttgaccattccaataattgtaaatatctgcttaccacaatgggccctacaagtaaatgacaagtgtcaaactaggggaaaatgaaacattaatgaagaagagttaaagtttataacaaataaagagcttttataaatcaataaaagtgtcccaaaaggaaagtggacaaaaaacaagaatcaacagtttgcaaaagaagaaatacaaattatcaataaaacataaacagctcaaattctggcagaaaaatgcaaaatggaaactgcaatgcgattaacatttttattttatacatttctcaaagacttgactgattaagtatgtaattttggtcttggagaaagtctggggagatgagtacttacacatcgtgctgatggaattgtgaattgctacaacctctctaaaaaataatttgacaatatccatcaaagcccttaaaaacacatacgctagccagaaatcccacttctggaaatgtctcctaaggaaagaattagggatataggcagaaattttactgtgaggatgattgatctcagaattatttataatacatgtagtaaaatattagggaaaatttgtattaattgaaatagatgtttatgacatgctactaggtaaataaagcctgttgccacacaccatatatattataatcccatttatatatgtatattcatatgtataggtaaccacatttttgtaggtgaaggtatatgtatttttaattttcttttgcttaactgtatttttaataacaattcattgatattacttcataagaaatgttattttattaaaatattatattttgaattataccatacatatagtagacaattatcacacctctgtctttcctaacttcctgagcttcttatctaagtgtcctgaaaataactatttggttgtgctataagcatttcaaattcactccagcctagaatagaatattgtccttctctttaaatatgctctttcttttatatacccatctagggcatcacctaatccagaaataggatttttaacctttgatgcatcttcttcactgcccatatccaactggtttgggtcgattcattttgcctcttaaaatgtatggcgtccactttagtcccaccatcattgattgactggctccaagccccatcatgttttcgcctgccttatcataatggtatttgctgtggtcttgcctccatgatcttgtttcacagtctatattttgtagcaaaatgatgtttccaaaattcggatgtgatgatgcaattctttttattttttagcatcccttagtggattctcattatctctgggataaaatccaaacaattttgtgtggtttaagagtcaggattgttttcaactgcaaaaaatgaaaacctcaacttggtggcctaaacacatagacgttatcttacccacatagtaagaagtctggaggtaggtggttgctaacattggctcattagcacaaacatgtagaggcctgtctttttctttctctgtctggcttattttactcagtgtaatatattccagctttatccatgttgtcacaagtggcagtatctccttctttgttaaggccgaataatatttcattttgtaaatataccacagtttttaaaatctattcatccattgatggacactttggttgtctgcatttcttgactattatgaatagggctacaatgagtatggagtgcagatatctctaaagatactgatttcacttcctatgggtatatacccagtcagagacagaaataaaaatactgtatgatctcacttacacataaaacctaaaaaaaatgttgaatacatagaaacagacagtagaatagtagttatcgggcaaggaggaagatatgagaagtatgtccaaagatacaaacttgcagttttctgggatgaataagtctagagttctaatgtatagcatgaggatgacagttaaaaatattttatagtatactgaaaatttgctaagacagtagattttaggtgcttttaccacacaaaaaataaaaagaaggtgatgaacatgtttatgcacttgactggagtaatcatttaacaaagcatatgtgtagaaaaacatcaggttgtacaccttaaatatatacaataaaaaatgtaggggccaatatctctgtgattctcaaagccttttttctgtgtttgtcatctcatggctgccaaatggctgctgttgttcaggctgattcaagatcaaaaaaggcagaaaatggaaggaggttccagtagatctcctctcagatttcattggccaggactgtgtcacatggtcatttctagctgcaagggaggctggaaaaatgagaattttagctttttcaatctttagatcagtagttcatatcaggtgtgattttgctctgcaaggggacttctggcaatgtctggaggtattttggggtgtcacagcttagaagtgcaggctgctactggcatctaatgggtggagaagcatcctacaatgcacaggacaatctcctgcaacaaagaattattggggccaagacatcaatagttctgaggttgagaaagcatgccctagagcagaggcaggcaaggaagaaaggacttgatgatggtttgaggcatcccactctgaaggtccttctgtggcttaccagagcttttaatgtctgacctttactactccatgcttttatttagtcactaccctctctgaccaagacctctgctccagttattctaaaccacttgccaggttttttcttacctcattgcttttgcacactcttttccttttccaagaattctcccttttagtcctggactggctgactccctcccagtctgcagaactctcttagggtcatctctcctcaatctaccccacctcgaatcaatgggcttaggcacccacccacactctcccacatatgttttatttccctgtatattagcacttggattggaggacttaagatttcttttttaattgtttgtaaggaactcattgggaccagaatatgatagtttataatgaagataatatcattaataatactgacctcattaataactcctaacaaggttgttagaaagagtaaatggaatgattactcattttaatttaatgatttgaatatttagcatatttgcctggctcactcttctatttcctttaagttttttttttctcaaaagtcacctttgggtaccccataaatatgtgtagcttctatgtacccataaaattttaaaataaacaaataaatcaccttctccttaaattttgctcatcactctccacttctccccaaaacacacattcagcatttcatatccttcttcctatttttcccattctttcctccttatcaccttaccatcatccaccatactatatattttatttatttgtttagtatcatctcccctgctggaactcctaggagaagagagatttttgtttcttttgttgactgctatatcctgcgcatgtagaatagtgcctggcacccatcagatgctcagttaatcagtgaatgaatatggctcaataaccaaataattataaaaagacatgtagcaaggagtcttacccaagagctgcttcctccatccagttcccaaacttgacccatcatcaggctcttatgcatccttccagagttctttatgcagatattaagaaaatacaagggtatagttttctcctcctccatttcatgcacaggtagcacaccatgcatactgttttgcccttcacgtttttcactgaataatatattatggagatattttagatcagcatgtggagacctttctcattcttttagacaactatgtattattccattatatagatagacatccatagtttaaccggttctttacttatgtccagtgaaaatggtttaaatctttccaaactgagcaacaaacagagctgcaataaataactatgacatgtatgttcaagtgctgttgtagagtaagtgccccaaagaagaactgtgggaacaaagtatgtgtaaattatcaactgagaaaaatattaataacttatcttttaaataattttaccaatttactcctaaaagatatatgagaagcccctgcagcagtgttttcaaacttttgaactttgacaatctgatagatgaagaacgatatctaagtgctatttaatttctgcttctctagatcagaggtcaggaagctttttctttaaagggtgagacagtaaatattttcaggtttgtgagccagtctctgctgtaacaactcaactttgcattgtagcacgagagcagacatagacaatgcacaaatgaatgggcaaaattgtgttccataaaattttatttacaaaaacatatggctgggcagacttggcttgtgagccatagtgtgccagtccccatttttcatatgttgaagagccatttgtatttctttttctgtgaactgtccatatgtcttgttcattttttattgatctttttcttaatactctttctaggcacttttcctatattagtcctttgtgtctgttacatattacagatatttttcttaatttatcacttgtcttttgactttgcttatagtaatatttttcagagcaggagttttgggtgattatttttccctgtttaaccaatattcattgaatgtgtaactgcaagtacagttatgctgtttagtatttaaccagaattcgaatcatgtttcccatgacattggtatgagggaggcagtctctcaacagtgagggagcctcaccccccacaacttaattgatgatagtcacgaatttgggcatttgagaaggtattgtagttctgggttttctcattaccctttatactgtgaatcctgtgagggccaagggcctttgtgtccttagcctttaagctatgcccaaggcattggagacttgcagtaaatgtttatagaatgaatataagtaaccatgtattaatatatataatttgtaaattttttaatatttaactttttattgatgtataacatgcatacagaaacatatgcacaaaacatttatggaaagcttgatgaattattacaaaataaatacacttgtgtaaccaagaaatagaatcacacttgctcatgcccctgataatcacattctccttctccttccaaaggaaaccaagatcttaagaactaagtatagatcaactctgtcatttcatagaagtgttttattacagaacattaaaaacatatacaaaataccaaaaagtataatagacctgtcacccagctttaacatctactagtcatatgctgtttttgtttaatctatatttcaaaccatttcccaccccccacttcattaggtttttgattattttttagataaaatgcatacacattgaaaggtacaatcttaattgtacctttttgacaaatcagtatacgtaaacttcccctcttttaagaattgaattaccccccttaacaatcattaatatgcatagagattacctcaaagtattatttaagatccagatttttgtaaaataggtgtgagttttgactgagaatttgtatttctaacaaagtacagatccgcagagcacatggtaactacagtgtttcttttatctacagtaaatacaatttgatgaataaaattaaggaaatttgacctagggtgaaagaacggatcaaaacaactgtacaatatgctatctataggagcatttggttaacaataacataaactaaccaaacaattttattattttaataaccaaaattagcaacaatcttactattgttttcatagaagtgctccctcaaaataaaaaattttaataacatgagagggtattggttaactggttaactggttaacagcaaatatttgaaagtaaatgtctgataaaattaagtagcgggtatcttttcaagcccatcaataatcttacatagttacccaaaattcagtcatttacacagcaagtgcagataattttcatagcttcctattaaaattatattttaatgcccttatacattttaactcagttttcttataaaattcaccaacttaaatttttataggacatatgataagttccccttaaattcaaggtaaatttactgaattttattaggcagtgtctgtgtgtccaccacccagtattatttgggttcctcgatttgcacaggcatcacagctagggaaacaggaattcacaagacacgacacaggctctcctctgcatctctttcctcctcagggcatcagttcatcaatcaatcaagtcatgtgagagtagaggttatatattttgtggcacagagggtatcattcctcccctcagaggaggaaaagaccagaaggtctatctgggaacccgccccgatagtcacgtaggttcttttctattttccctaagcgtccgccagcttgagaaataaagggacagagtacaaaagagagaaattttaaagctgggcatccgggggagacatcacatgtcggtaggttctgtgatgccccccaagccacaaaaccagcaagtttttattagggatttttaaaaggggagggagtgtgcaaataggtgtgggtcacagacatcaagtactttacaaggtaatagaatatcacaaggcaagcggaggcagggcgagatcacaggaccacaggactggggcgaaattaaaattgctaatgaagtttcgggtaccattgtcattgataacatcttatcaggagacagggttttgagagcaaccggtctgaccaaaaatttattaggcaggaattttccttttcctaataagcctgggagtgctataggagactggggtctatttcacccctacaggccgtttatagacccatacccccaggcatgtattctctttcccagggatgttccttgctgagaaaaagaattcagcgatatttctcccatttgcttttgaaagaagagaaatatggctctgttctgcccggctcaccggcagtcagagtttcaggttatctctcttattccctgaacaattgctgttatcctgttcttttttcaaggtgcccagatttcatattgctcaaacacacatgctgtacaatttgtgcagttaatgcaattattacagggtcctgaggtgacatacatcctcctcagctgacaggattgagataaaagtaaagacaggcataggaaatcacaagggtattgattggggaagtgataagtgtccatgaaatcttcacaatttatgtttagagattgcagtaaagagaggcataagaaattataaaattattaatttggggaactaataaatgtccatgaaatcttcacaattcatgttcttctgccatggcttcagctggtccttccgtttagggtccctgacttcccgcaacaaaggtcctcttagggaacacttactgggagggctgagccccctgaggtgtgaggctctgatcagcaggtatagacttttcaggagggagggatgaggcagccattctgaacctgcagctctactgtctcctgtcccatctcaagacaattctgaagggccgttttgggctgtctggatggtggagattgaggaacagtttgggctttgatgtggctcagatgaggtgtgtcatagagggcccctatactcagtatctgggctggtgcctttgaggtcagtaggttgcctctttgtatccaagtccattttcactagggaggaggctggagagtctaaatggcttccagaggccccctctgattatctctggaagatgggcactgaaaggggcaaagtcattatctttggaaattctagaaattctacttggaaacctgggaagacctcttgcctggggcctgaatactcaatttgcagtcctagccacatagatggttggtaggcatagagctgggtttgcatttatatcagcacaaccttgcatcaggtttgaagaagtggccaggactagtgtcttggttacaggctggagaacatcatgaaagcaaacttcaggcctgttgactttcatcttggcaatgattgttgggtcctaggcaaagtgctggaatgcagcatgagtctaatccatagatccacctccacacgtcagttatccataaggtaagagggagcccagtttatgtcttgatgggaggctctgccaggtagaagaatcacatctcaggtttcttgacagctggctgacttgttgaacacagatccaggacagatctacttttggatgtgtggacaggcattagcctttcagttttgctgatgcttcaacttgaagtctcctaggaaactcctgtggtaggttcttcctctgcagttcttgccttgcctttgcctttgttctttctgtgagtcttggtaaacggctatggagtctggagttgctggggcttcctcagtcccaggttctacttttccttcttatttggcccaagggttgtgaggcagggccccaccccagcacttcactgggcaccttctggtcctggccatgtgtcctaagacttgatagttcttacacattctcttggaaatgaattaaatttgtttcttccaaatctcacagtaaaattgctgctccagaaagatgtatcatggatattctgcttttgtgcatcctccctgcatagaattgaggctgtgcctactctggtttcagaagcatgcagcagagtacataaagttaatctgcaaaaggtttcagacactcatcagggagcttcctgcatgggctgagaaatgccaagaccccacgcctccagtaccacccctaaggaggggctcacaatttgtaacatttttaaacagttggaatatcctccactagagagggtttggtgaaagtagtacttttgtacacagatgatagcaagataaattagtgtaacacttttcaaaacccacttggcaatgtgtatcaagagctataatagtatgtatcctgtttgacacagagattcctttcctgagaatccattgcaaggcaataaacaacaagcaaaaaaggaagtagcattaagcacaaaaatatttcttgtattactatttttcaaaaatatttcctcataacaacctaaatatccaaaggcaggaaggagtttttgtaaactgtggcactttcactgggaagaatactatgtagccattattaggcatgatggagggagaccatggagcaatattgaacagtgttatatgctgtgtacatgtgaagtgtacatgtacagtatatgcagaggaaaagatatgaattatatatacatgtctatatatactctgactataagcaggtaaatgtgaataagtatgtgcatgtttatatgatagagaaagaacaaaggaatattcactatactacacactgtatagttatattcaggttgtgaaattatggtgattttataattaaaaaaattccctacccttttttttttctgagacagagtctctgtcttccaggctggagtgcattggcacgatctcggctcactgcaacctctgccttccaggttcaagtgactcttctgcctcagcctcccgagtagctgggattacagacgtgcaccaccatgcccagctaaatttttttgtatttttagtagagacagggtttcaccatattggccaggctggtattgaactcctgaccttgtgattcacctgcctcagcctcccaaaatttccctactcttttaatgttatactggcacatatttatacgcatacccacatacgtacacatacatatgtatttacatataacaaatttattagctgaacttttggaaatggtgtcttcataatttagttcaatgaatattgtgagatatgcaccatgaggcaacacactgtgctgaatgcccagagaatcgaaagtgaatcaatcatatggattctgccttcagattcctcactgtcacgtgggaaagataatggttatataactaattatagcgcaaccacataaagtgctgcccagactggaggggctaattaatcacacccttcttccaaactcaaggacccagaaaagcattcgaattttgaagttgacctcatcagtgtcaatttcagcagtggtaatgctggatggaataatgtgtcagggccttctgcctagtccgttgagttctagggcagctatgggattgtaggtctttcccttgcaggggaagaaaagtgagccagtggattgggaggaggggcagggcaatggatgcttccttgtgggttgcctattgcctgtggaaggggatgaaatgagtgaattctttctttttttattttactctaagttctgggatacgtgtgcagaacatgcaggtttgttacataggtatacatgtgccatggtggttttctgcacctagcaacctgttatctaggtttcaagccccgcatgcattaggtatttgttctaatgctcttcctccccttgccccccaccccccgacaagccctgtgtgcccctccctgtgtccatgtgttctcattgttccactcccacttatgagtgagaacacgtggtgtttggttttctgttcctgtgttagtttgctgagaatgatggcttccagcttcatctatgtccctgcgaaggacatgaactgaaatgagtgaatttaaaggagcacacatcagagccagccaggtaggaacagagatttctcaatactccttcctggagaagaacaagtcagagatggaaggaaaaggaaggaagcttcctccagcattttagagagggcagtaatgttagtggaggtcttccctttccaatggggtggggcagaatgccataaagatattttgtttgtttgtttgtttgtttgtttgaggcagagtcttaccctgttgcccaggctggagtgcaatggtgcgatctcatctcactgcaacctctgcctcctgggttcaaacgattctcctgccccagcctccctagtagctgggattacaggcacccaccaccacgcccagctaatttttatatttttagtagagacagggtttcaccatgttggccaggctggtctcaaactcctgacctcatgatctgcccacctcgacctcccaaagtgcttggatttacaggcatgagccaccgtgcctggcaagagatgttcttacagtgcctaaagagtttggagaagagattttgctgagcactccctgacaacacacaaaccccgtgattctctttaatgcccactttttaaaattttattattttggggggttaagatagttttttattaatgaaaatttatggagcacacgtgaaattttgttacatgtatataatgtgtagtgatcaagtcagggcatttagggtgtctgttgcccaagtacaatacatttttattaactatagtcaccctgctctgttatcaaacattgaatttatttcttctatctaactgtatatttgtaccgtgtatcccgcttctcttcatcctccctcctaccctccactcacctttcccagcctgttatctgtctttccagtttccatctgcatatgatcaaactttttagctctcacatttaaatgaaaacatgcaatatttgtcaaaaccaattttaaaagccttttacttttcacttaaggaattggaagctccagagccaagaagaaagcccaggcagagagaaggttgcacttgcatggagaccagctggcctggtctgggctggctgctgctgccctatcctgcaaggagtctgttgggcatgatctgacctctgagggtgcaaatgaaattagcttcaggacctctacatagggcctcttcctgcccgtgaaaacaatgaccctgcaggaaacaagatacagcaatacatttatttttatttattaagggaaaacaactgacaatagccctccccactctgcttcctgggtaattaacagctgtctggatctggtcaagaccagggtggatcactggccaagaggaagtgacctggagcagaaagtattataggagagaaaaaacaatcaccttggagctccagttttgaattttgtgggaaaaggatgaagaggcatgacataaattgtatcagctgtgaaaatcaggcctgagtcaccagcttgggatccagtgaattcccttacccagtctggttgctcttactgggcttgtccaggaatccacatccggatgctagagacaaaaggggatgttttctgatctgggaggcaggacaaggtggactcattaagctacagaggcagaacagtggtttccaagatggagttcagaaactatctttgaagttaggcctatgtaataggtggggtgagggcagtatatgaaagctagaatgacttgtttttctccctttaatatcgttttctattttggtcaaagcatgaacttttgagtatcaggcagaattacatttgacaccctcatcttggcttccacttttaaacaagagtaacactacttaccctgctgaacagtggtaatggctgacggtattacagatgatcagcataaaggaattattccagatcttggcaaagagaagcattcagtgaatgatagctctttcactcactctatgtatgtatgtatctatcatctatctaatgtcttcctccctctttccctcttttccttcttgccttccttcctgttctcatccctccctttgttccccatgagtgcatatctatgtctctttgtgcatgcatgtatgcaatatgtatatctgtatataccctaatatttttaagcattcttagattgcagaataggtaaaagggtgcatgtagagatgccacttgtcaagggcctgggaagtagaaggagtatagctcaagctctgctatgtctgttcagcatttgtaggttttgacttttatttcactggattatgtggccattgttattatgttagaaaccttcatggtctgaaaacccttgtagggaacataggagtctctaagaaatggagatagatttatggagctccagattcatactccagggaggacagggttatgtttgctgccttagtggatacataagctatctagaggctttaaaagacagcctatcccaaatttatttctaacctactaacatggattggttaaattaagttcttttaatgctacacacttctactaacacaagagaggttgagttattgcatgagttgggcaataaagcaagtgtaactgatgtactgtttctctgtcgtgtcatctttctctcactctgggatccagacagattttctcttggttggggaattgtcttccttgggttgaggggactgagggaagatgcagtattggtatctccttctgaatcatggctccttctgaacctaggcaggttctcttcaaggcttcatggtgtaggagacagaggacaagactttggtctgaaggatcatcctcagaaaatggatgtacagtgccaatcacgggagctcgcctgctgattcccacttactctgcctacagggtcctttcctctatccatgagagcagagccagcttcccattatgcggctccttcaagggcattatagcagaagtgggccagtccctctctttggctcatttcattctagctcagaaaagctgtggcataactataattggctcaatttcttttgcttgattaaggaggcaaagccaaagtaaggccagaaatcaaaaccttttttgttgccagggcatactaagcagtacaaactcatttctaatttatatactcaaagccatacctcctaaaccaaagtgtgtgaaggattactttaaattcttcttttcctaaggggagaatttccacaatatgtagaatttttatttcatactcataataaagtgatctttaatagaactctaagaaaattcctttagaatgtttcatactaacaaaagaaggaattaaacatttgcgaagttcaaggcatgtcacttgagcactacatcaatgtaagaaagactcagttttattgaaggttaattatctattggaaaaaattcactaaggggcccacactctggcattccagcagaggagtcagggatgaacatgaagaggagggtgtgtttgtgggtcaagagtggacaatgaagtctttggcttgtctggactaaaggctcctgtggaagagtttggggggatatgattgaaagggagattggaaccagatttctgacagccttgagtgccctcttttttttttttttgtaaaagtaataaggtaaataataggagtcagatcttaaaatgttgccttgacagccatgtgcaaaattaattgaaggtggaaggaagtggaatccagagttagaaagctgcaggtgcggggaaatggcagtgagtgggaaagagatggaagggacatgagaatggctgagattaattaatttatggcaagaagccaaagagtgagtcaaaaaatgactctgggcattgggcataatgactgaagggagcctcaggcagaaaggggaaggttgaaaaggggagggagggagggaggaagggagagagggaaagaaagggatagagagagaggtaagagagagaacttgctgtttgagataaaagagaatgagatcgatgtgaggtacattctgtatgaagttggaaggtacatgggagtttttaaacataaaaattaaaatttacaggaaatgtatctcttaaagagatggatgaatttcctcctttcccctcaatttgtttatgtatttaggtactcatgaataaatatcacttattgccagaaggaggcatgattcagtgacagttctatttctgatttttatttgtatagctacgggtgttgggaaactttgttcacataaacatgtagacaaaaacaaaagaagttttgttataattaagtcactccagtctttgaattaagttttcatcgtatgccaaaaatcagagtgatccgtcatcaaaagttattttgatttatcagctgacaacatgattaggccttccttcagttttgttgaaaaccaagaattggaaacttacttggaaaagaatgtgttaccagttattaggggcttttgcctcctgtcattgacatcaatttttcaatatttggaacagttattttgcttggtggccatttttgcactccgggcagtgcaccatagtaagatgggatgtggggtgggggaagggtttgactttagcgaaatgggggaagcaatgggtggtgtagaacaggtaagactgtgccttccaccacaggcaccttctcaggcggatccaatataggaaagaacaaagaaaatggctgtgtaaggtctagaaatagatttccttaaaaccagctatgcctgttcacctcttaggcacatgttcccactgtgaagactgcttatctcgagtacggccgagcagtgagatgaaactcaggcccttttagaccaacagggacttaggcatagtcagtggactgatgagtctgtgggcagaggcagcaacctgggctccctgaccagccgtcaccctgagtagaatgaccttattccttcctgatgcaactagtggcagaaaatcaattctgttagcaattgggagcagatttctgaagcagagtcaagtctctttcagaggaaaagggctcctagggaactctggacaaagtagacaggtccaagacctgacccttgggagatattttatcttgataaacagcagaacccatttctccagcaaatgggcttcattttgctttatcccagtgattttgacttttttattatcactagaactaggttttgtgaagaccattctggactgaccctttatggctttttggttttccatttcctgtgcccactgacttttctccaattctgcactctctgagattgccccagtggtgcctcatgcccacttccattatttcactcggttgtgctcaattccaattatgtttattgcatgtccttttctcctatcagtcttgaaggtccagtgaggttgtgattggctcaaggtcatttaactaataaatgagagtgccttcctcccactttacaaaagaaaggcaattattggatttaacccaatccagggaggccaagtccagggcttttatttgccccaagacatgttctctctatctgagggcttaagaattttctaagttgatctagaatctagataagactcaggcccattccagcctgtcatcagatagcatgtttttatacacattgtgcatgttaattataatcaggcagacatgagcaaatcacaaataaatgcagattggtgtggagttcatgggctgttctggtcattatttcctctgggaaaatataaatctaaagataaaggtgaggcctttgatgtgatcccatagcatctggcgtaggaatatgctatttgtaagcaaatgagtctgagaagaccatctttttaaaaaaaaaaaaaaaggtgtgtgtggtgcaaatttaaatgtattaagtcactcagtagtgctacaactagagatgtacagatacattgacaacatgtagttcacttttaaaagtgaacagcatctcaatctaatggtgagacattaagctaattgttaaataatatctaaaacagatcttttcctgaaacagtgttgctagatttaaaaaaattaatacacattatatacagctgttttgaatcaacataaaaattgaagaggtagtgcagaaggttctcatatccctcccttattagttttttgtttctgttttttggggttttttttacttttattttagttttgggggtacccgtgcagttttgttacatgggtaaattgcatgtcactgaggtttggtgtacgaatgatcccatcacttaggtggtgagcgtagtacctgataggtagttttccaacccattcccccaccccaccctccccctctaatagtccctaatgtctattgttcccttctttatgtccacgtttacccagcttttagctcccacttataagtgacaacatgcagtatttgattttctattcctgtgtgaatttgcttaagataatggccttcagctgcatccatgttgctgcaaaagacatgattttattccttttatggctgcttagtattccatggtgcatatgtaccacatttcctttatccaatcctctcttgatgggcacctaggttgattccatgtttttgctattgtgaatagtgctagtgctacagtaaacatacaagtacaggtatcttttttgtagaaagatttattttcctttagatatacacccagtagtgggattgctgggtcaaatcatagttcttttttaagttctttgagaaatctccatgctgctttccacaggggctgaactaatttatattccactttttttttttttttttttttttgagacaggatctcactttgtcacccagactggagtacagtggtacaatctcagctcactgtagcctctacttccctggctcaagcgatcctcctgcctcagccccagaagtagctgggactacaggtgtgcaccagcatgcctgattaatttttgtgtttttttaatgatgggttttccaccatgttgcccaggcttgtctcaagcttcctgaactcaagtgatctgcctgcctcagcctcccaaagtgttgagattataagtgtgagctaccatgcccagcctggtgttcccttttatgcacaactttgtcaacatggtatttttttacttttaataatggccattctgactggcgcgagatggtatctcgtcgtggttttgattttgatcatgatttctctgacgattagtgatgctgagcattttttcacatatttgttggctgaatgtatgtcttctttgcaaagtgtcttttcatgtcctgtgctcatttgtaatagagttattttttgcttactcaatttttttaaaatagattctagatattaggactttgtcagatgcataatttaggaatattttctcccattctgtaggttgtctgtttactctgttgatagtttattttgctgtgaagaggctctttagtttaattagatcctacttgtccatttttctttttgtcacaattgcatttggagacttggtcataaattctttgccaaagccagtgtccagaatggtatttcctaggttttcttctagggattttatagttttaggtcttacacttaagtctttaatccctcttgagttaatttttgtataaggtaaaaagaaggagtccaggttcaatcttctgcatatagctagccagttatcctagaatcatttattaaatagagaatcttttcccctttgctgttattgttgactttgtcaaagatcagatggctataggtgtgcagctttatttctgggttctttatcctgttccattggtctatgtgttggtttttgtaccactaccatactgtttgcttactgtagccttataatataacttgaagttgggtaatgtgatgcctctggcttttcttttcttcccaccttaggattgctttggctatttgaacgctcttttggttccatatgagttttagaatcatttttttttctaattctgtgaaaaatgatgttggtactttgataggaatagcattgaatctgtaaattgctttgggcagtatggccattttaacaatgttgattcttccaatccatgagcatggagtatttttctatttgtttgtgacatttctaatttctttcagcagtgttttgtaattcttgttgtagagatccttcacctccttgggtagctattttttaggtattttattatttttgtggcaattgtaaatgaaattaccttttgatttggctctcagcttggacattgttggtgcatagaaatcctactgatttttgtattgattttgcatcctgaaactttactgaagtcaattatctgtttgaggagccttttggcagagtttttagggttttctgggtatagaatcatattgtctgcgaaaagtgatagtttgacttcctctcttgctatgtggatgccttttgttttttttctcttgcctaattgctctagctagatcttacaagaccaccttttgtttacccagaaaggaacgtttaccaagcactttcacttgcattatctacactgatcctcccaacagccttgtgtaatatatgacacctcagcattgacactgatgctgtagaagcaccaggaaatgatgagaagggaataggctttgaaactggatagacttgggtttgtttgcctgggcctttctaccttgtcatgtggcctagggatgtaacagtacctctttttgcttctgccttttatttcataaaagacaaccaacaaaggaggaaaggaggagaagaaaaagaagtaagtgggctattttaaagattgaggctgatgatgtaatggatttcatgaaattttaggaacatatttggacaatattttttaattttctttttatttcaatagttttgggggtacaggtggtttgtggttacatggataagttcttcagtggtgatttctgagattttagtgtacccatcaccagagcagtgtacactctacccaatgtatagtcagagaaattaatttggatgacaacatcaagattataaaaaattttaacaatctgaaaccagggtgagacaaaatgaagtttttgtatttgaattgaaaagaatcctaataagtagcacacagaaatagaaaacacaacttaatgccattacctttgtgagcgtgacctggaacaagccactagaccagcatgtaggttagtgttgacttgccatataagggagaacactgtggtcttcagtaggcttgaatttacctaatcgtcctagcatttggtcgaagtgtctccatctcatcctcatgctcacaaaatgccccatgactccctctctcctagggctggttgcccccacaatgtgcttccatcattaacagcccattgttttattttctgtccattgctttcgtctgtctccccagtagactaggtgcattctgagaacaagaactgaatcttatttaagtctttgaatttccagaacctacaaaaattgtccaaatatacacaaaggcataagaatgatataatagactgtggggactcaggggaaattggtgggaggggggtgagggataaaagaccatacattgggtacggtgtactcaaggccaggcctgttcctttgtcctcgtaggtacctagaatgaaaactgttcactcaaagactcccattctgttaagcacatcttacaggggtcacaactaggccccctaagcatactgatcattaacagaatgactgttatcttctctcaccaaggaaagagctctaatttctcctcccctttcagttaacctgctgaggccactcctaaatacctatactggctttcaatgtgtgactgattgcaactattgctttttacaaaactaccccaaaacttagtggctgaaaacacacatttattatctcccagtttctacaggtcagaaatctgggtgtggcttagctgggttccttggttcaaggtttctcacaggccactgcaaggccaggactgtggtcccctcaagactagatggagggatgattcacaaccaagctcattcacatggctgttggcaccattcctcaaagggtgttggccaaaggccacccttagttccttgccacttggacttccccataaggcagctcacacatggcagctggcttcatcagaaccagcaagtaagaagagccccagagaaggagagagtaagagaacaagacaaaatcacagtcttatgtaacctaatcttagaatcacccattgcttttgccatatcctacagtcgtccctcggtatacgcagggcattggttccagcatccctgtgtttaccccagtccgtgcatgcatacttaagttctgcagatgaccctgcagaagccacatatttgaaaagctgacactccttatatgtggatttctcatctcgcaaataatgtattttcgatctacatgtttgtttgaacaaaatccatgtataggtgtcctgtgctgttcaaacccatgttgtccaagggtcaactgtatttcttagaagtcactaggtccaccacttgaggggagaggattgcacaagcgtgtgaatactaggagatggggttcatctcagaagctgtctaccactgtgatgaaagggtaattcagtgggggtgtatgagcaaattctcaagtaaagctgttttggcctaggtgaaaagaggctttagatagatacatctcttaaacaaatgacacctaagcacggctgcttgcgtacagtaggtgctaaataattactgtttttctttcttttaccttttcatttgggaataatctctaagttaaagttgcaagaagagtgaaagaatttcatatacctttcacagattcaccgtttgtcaataattatattttgaatacattataaaatatgtcacattggaggacaatatttgtaaccatcaaaactttggggcctggtgagaagtgtaggctggagtcatattggatctctgcatatggagttgtcatctctcaaatgcttgcttcttcctcttcttcctccagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaacccagctctgctaatattgtgatttcagagaaaaagcaggacatgccccttttctagccaggaggattgctcctttttggccaaatgtatggagaagtagaaaaatcaaagcagttcatcaccctttccaggtctcggaatggtgctgaaaaatcctctccaacactgtggatggagatcggagaaacgcgactgtggtttctcttgatttctgaggatctcagaagtttcagcagacttccttgctctgtgttattcctttgcaaaaggaaagatcattatagcatgagggctgggaatagcagggtgaacttaacccaataaatgcaatttcctaaatgacttcatgctatggaggtgattctgattcaaatagcatgatccatgcttattatttaaggctgatttttaaaatcttgtgttgcaagggcaacctcgtccattttaactggcacctcagggattaaaatcctactttttagtgtagttcccacctcattcatgaaaatgaatagaactattgtattatgggagatgtgtcagtgaactagaaaatgtcaataacctcaaaggatgaagggtttttattttaaatagtttataaaatatatattgacatgcatatttgaaaatgctgcataaaaataaaagtggtgtgttttccccctctttggagacaagaaaattttattatgactctagataattgtgattttaaacactttgtttttttttttttttttaattggatttcaaagaaaagaatggaaatgagaggtaaggattaaagccaaagttaggatgggaattaaaaaaataaacattacataaaatctt

SEQ ID NO: 119 - DNA, 15299 bp, Homo sapiens
atttgaaggggctttggtggtgttcacagctgcctctttggcacctcctcccaagccggagtcaaggaggcccctgagccttggaccagccactgccacctccgacctgctcggccagaagctgcccagggacaaagcagagtgcaggtaacatccagagggggcactggaattctatcgcttggttttatttgcttattcctggtcctctggacctagagatggtgggagctcgggctggggattttaggtttgggtctgattatctagcaaaggtggttacagttaggaggctagttcacaaaagccagaccagtgagagactgctctttggactctccctttctgcacagtcctggcttaaacaggtggtaagctctctcccaagaggaccaccctttggctttagctccagggtctccttcttgcagtctcccacacagcagttcccatgccattcccagggtctggggaaaatgggacaccctggatgggagaagtgagaggtttcactaatcagggtgattttaaaggtcaatgagtctcactggacttagagaacaatggcttgaggacattaatgagatccaaggctctggcatttatcacataacatgtacatcaatgtacggccaggttcggccttttcattcttttcggattgtgtttaattgctgacagggtgctggtttgagcggcttcttttgatggaatttgatacaggttgaagtttggggatgttttgttggaagggaatgggaaaagggagtgacaacaagccaggaggcccaggcttagcaggcattttcttgtccattttacttggaaaggacttgttgctctcctattaactacagccagaggagtctaaggccaggaggaggctcaaagggaaagccatttgctcactggtccagagacccatattcagaaaagtaccaagtctcaaagtttgattctagcaaaaagctgatgagtttcaggaaaaaaaaaaaaaaaaaaaaagcctgctgactactccaaggttgaagagtaaattctgcaactgcttactttttcctgggtatcaagaatccctccaagctctacaaacattacttaattaagtctccagtcttcccaggggaaacaagctctttcgattattggatctgatttcaattcccctcccacagactgaaagtcttcattatcatctttcttccaagggttgctgaaatatacaaggcttgcctttctaatttgacaggcatcccagtcgagatccattgcaaagcattgcagaatgtcgatcctcttctgttctttctcaccccaggcctcactcccacccctctgtggcaccttccttctcttttcccctcctcttctccccccagtcccaccacaccttgcctttgttctatttttgcaggtcatttatcttcaggctttgagatctgcgtggggggagctgttgcagcagcccaagccggtgagttatgctgcctgggggtggtttgcgttcactgacgggatctcaagcccactgctttgccccagctgagctagaggtgtgataggtggcaggcaaaccctatgcctctgttggcagctgggagggggatgtcacactggttcccaaggctatgtggcggaaggcagcacattttaagggagcaggcaaagggatcagctctggggctatttgagagatttgcgatcttaaaacacgtggaaggagttaaggtttcttgaagtaactcctgggaggcaggaattttccatctgtcatctacacgtgtgtctcacaacacctgaaacagtgctgggctgaaatcccagatcctaccactcacttactgtgtgactttggaacagtagaagtccctctctgagtcatactttctttacctgtatgatgagaataataataatattcacctcctaaggttattgcaagtctccaatgggatatagcaaaatgcctggcattcagtaggtgctcaataaatactggcatgactgctcagattttcactgttccgaagtggtgaggttggacctttctctccatcgattatcatatcgctgatcatcccactccatcatgctgtgtgctatgtccaggagatatgatctaatgtctaatattttcatttgaggggctggtgctcctttcccctccccatcccagcagaagactttttatttcatctgctgcatcaggatcatgaagtctctttttgatcgatactccctaaatccacctcccactacccacctccttgggtcattcctgcacaattgtcgtatttattagatctcttccatcattgtaagagagatcaatagttactggttcgatttcaatgcatgcctgacaaagtgtggttacacagctgatttctctcactgtattcactcatctcagcccatgaatgttggctaatcttgctgggtctgacaaagtgataaacctgtttcactgagacagagctggccactgtggtaggcagtgaacatcggctggagacacccaggtaagccccaggatcagaccctcgaaatggagtggggtctgttagtgctgtgaagcgcagcctcatcagtccctcccagcctggatccagactgatgctcctggcaggaggacgatggcctaggtccatgaggcacatggcttggctcagggggctcctccgagtccatccaggtcatcccactggccagagcggctggccacaagccgcagacatatgcaccgaggcaatttgttgatgcattggcttgaactgccatttggtccctgtcctattcctggacgatttgatttaacttgacagcggtttactgagcagttattatgtggcagggtctcttgcccactggtccctaggaacaaagggcagactcagagagcagcaggagggagagaattggtgtttgtgattcacacggtatgtcagcatcctgaatcaaaatctactctccctccccacttctctctctcttattgtgttcacttcccttcccttttttccctcttcttcccctcctcctcacccccttcccttctattcccatttgtcctctccccatctctatgtctcatcttattttttcttcccatatggtcctccacctctctctgctttttctcggtgtctcggtctctttttctgtgtgtgcagttctcacctctgccattcttttgggcccctgtctttttctctgtgtctatatctctaactctctctttttacatctctctctctatgtctcttcatctccatatctctctagcttatcctctttttgcctttctccccatcccttaattgcaccagataacaaaaagggtggcggttccatccaaaccttgctcttgaaaaacgttcttttaaatatgcagtgaatgatcccaccaggaccactgcctgcaaggccgtctttccctctggtctctgcacagcaaatgcagccgaccaccaaacgggaccctcatccgattctgtgctttgatctttgccaggctaaagtgtgggtttactttctgttcagaacccgagcctccttcccattgatcattcgtctttcgttacgatgctaacacctaacaaggggcaccgcttttccaggttcaggggctccctttgccaaccacctggagacccacaagggtgaactttacactttcgagtgtggggcaaaagcttctgaaatggtttcaacgtcaggaatgtgagagtttgggaggttatccgaaagacactcgatacatatttaggcctcaggatggtttgtggcgtggtcagcagactgactctgaaatcttattctgctgtttccttgcttcttggtcttggcccagtcttttagactctgagcctctgttttccccatctggaaatggaactaatagttcccaacccactggattctcttcaagagaagagagaaataattgagataaagtggacagcaaagagcttgtcccttctcatagctacaccctaaatgaggaatgcgatggacttagagaattccaactctgccatgctctgtgaccacggagaggcactttgtcacttgatcctcaccttcccatctggatcccaagctgtaatattagcccctgccccgtagggtccacgggaggcacctggagtgcacggggctggtgcagaacagcgtctcagtccttgctggctgttaggatggttgtcattgcagggtcattgaaacaatggcatctctttagtgggagtcacggttcaggtgtgggaggctggagttctgtctccatttccctcgtgactcatgatatgaccttaaacaagtgacttcatttctaccttttcccatttcctctttcatcaaataggggtaatcatatgcgctaaagtgctcagagagataattgcaatgttaaatcaagccattattattccatgctggctttttaaataaaaacgcttgcggctcctctgagccctcagctgactacaatatagaaatatcatcgagaagccaagacgtcaaaaagatcattccctttcaaggaactctgggccctgggtgaaaagagggtctaccttgtgctggccctttaagcagtgctgtctcagtgcaggaagatgatacaccccaatcacagatgagaagactgaggcttgtggaggaggtggcaccaaatgaccgcagagcccatgcctttccctctcaaggaaaaggtaaatcccaaggcaagcctccccaggtcctctcagtatttgccaggagagcagtccaggcaactagaaagggctcagggctgaagaatggggccagttgcttcctgcctcttccatcaggaaacccacctgacctcctggcaagagatccatccactagcaaggcataaaaaatgttttattatttaagaatatgttcaagtgcctgaggactcaagaaaattagcttaaaaactattagaatcataaaatgtttataaaaccagtcaaagtacggtcagcaaaccttgtctgtaaaggaccagagagtaaatattttgggctttcttggccctacagtctctgtttcagcaattaactcagcttttgcagcatgaaaacaaccacagacatagatgcaaacaaaggggcatgggtgtcgtattagccaaggttctccagggaggcagagccaacaaggtgtgcctatccgcagaaagagattgacgtaaggaattggctcatgtgattaggcaggctggtgagtctgaaacaaccccacctgttaggggagaatcaccccactgccccatcagcccctctttcccctactgggctattacaaagcacccgaggtagcagctgagaaaaagcttcacaaactgccaagtgcaaaggacttttccttgtgtggcctccgggtccttggccaagtctgtgaaagaagaccatgcaggccctccatcagggtcagatactgacatcatgcctcccgcttaccaagggggcttgcttcccacttctcatcccgatgatcggcaaagttcctttcctccttggcccatccctaatcagacatgataggcaggcagggctctctcttatgtgtgacttcccagctccattccttggcaaatccccatcagaaaggtcgaaatgcttcccctggggcccatctgacattgttcagtaatgtatttatcctataaaaggaaggaaataggatcacctatgaaattgtgagggccaatgtgtctctactagggtccccttttaacccggagggatctggacaggagcccaactcccccattcataactccaggtgaacttggatgagcaagttcccctttctcagcctcagtctggccctctgtaaaatggatattaaaagaaaaacatgcacctctggggctgctgtgaggattggagctaatatgtacaaagcagtaatgcacagcctggcacccagtaggctcctgagaatcggtggctgttgctgggttgacaggatcatggatgaagggcattcagcccagaccaacacccagcaggccctccgtccacggcagtgagtcatgcagcagcattttttgtttctgcagtgtgccaagctctttatgatctctcctttttgccctcttcttttcctatcccctacagctcaagtaagactagactggagtcttcatactcccctctccaaagcacctactatgtgccaggtgcttcaagcacaagctaggtgcttcaaatgtgatcatttatttagttcctatgtccaccctctgaagcattattattagccccattttgtagctgagaaaactgaggcacagtaaagctaagtcattttcctaaagtggtggtaagtggtgggctgagacctgagcccactttactgaccacttggtgatcctgcttcggggtcaggaaagaatttgaggtcctacctctcctttctcaacagctgtgtcccttccaccccatgctgcttctccgagttagagtgggtaattcaggggctgcagactcacttgtctgtcaggcagtcggcagtgagggaagccccaggtggttccgcgggtggcgatgggcagtatggctcttcctctgtgactgttgccatattggaatacaggctcaatgtccccaggccttttgttttttcaagacaaattgaaaattgagatttttttaaatgtaaaaattgcctaattttaaaatattgcctgtttattttcataactaattggtgtgcagctcctgctctcattctagccctgtatgaggtactgggacaccattcattcattcattcattcattcattcatcaatcactcaaacttccttagtcttccagtcacatttagatcaaatgcaaactctcccttggcctatgagagccggcattatccatcctctgcccacctctttgctttttcaccccagtctctcccttacgtcccttcatgcaccctggcctctttgtcatcctcaagcacaacacactcgcacctcagcgacccccctacctgcccataagggactgacaggtaagtggtaattttgtgatggagccagcataggaggccgtgggagctcaaaggagggaactaatccagatagacttcctggaagaggcaactgaggctgagttttgaataatgagtaagaattagccaggtcaaagtgtgatgggagtggatgagtgggttgagaaagatgttcctgtcagaggaaaccctttgtgcaaaggcttggagggtggggtgtgtggagcatttgttttgaaattgcaggtggtttggtcaagcccaggatgggcagaactcacatccaatctgtctgggtgctgtgtacttgctgggatagcttggacagactatatgatctttctgtgtcccattttctcatccataaatggggagaatattagtcccagtcttacggagttgtcagaaggacccccttacaataagacacacagagttctgagcacaggggcaggcacacagggagcactagcaaatgtcagctgttggtattaggagagcccggggctgctaggtgatggggacaatcttcctctggaagccagtggacacagggcagaggtgcagtcagatctgcatttcagaagggtcctccagctgctgcgtggaaagtgtctaggagggaaagattggaggctactccagaaccaggtggagggtccacctggagggagaagctggaggctggagatgagaggactgaaggggcctgggcagtacacagcagttacgaaggtagctctggagccagacagcctggtaggaatcccagctttgccacttactcactgtagaatcttggcaggctctagaatcttaactcagtttcctcatctgtaaagtgggcatggcaacagcaccagtgctgtagagtttctgtgaatatgtatgagttaatccacgagaactgctcagaacatcgtgagtacttcattaccttcagatcaaccagaattatcattcaatataaagttaatggatgaaagacaaggatgccaatgctgtttttgcctgagataaagagatcttaacgtgagtcccctacctttgcagctaagctgtgtgggaagccttcggccaggagttagatggtgtggtaggcgccccctccccagtaggttaattcactgctgatcttctaacaggccagcccagccatcactgatatcagagaaaacatgagctgcccgctttgtatggctcactggtggggaactgtaatccactccgcagctgacagactcaaggggaagagaaagacacaggagggacacaagtccgcttccctgacttttccactgagcctccctggttcaggggagccgaccttgccagcctcaagcgaggcacatgggcctgagcttatgcctcgaattgctatgtgacctcaggagatttactaagcctctctgagcaccagttttcttgtctataaagtggggctagtgatacccacctctcacagtttgtgggtaggctaagtacaatacacaggtcaagggccttgtatataaagccccttggatctcacggagggtgcagctgccactgaattgaagttgctctagaaattgtagtcattaagtgtagggggtcaaacagagcaggccttgcaccccagcttcactattcgaggtagaacatgggcaattcaccagaccagaagtgcccgcttccctgaaggaataaatgaggtgatgaattgaagagcttagagcagtagggatctgataaatggcggctgggatcactattaggcatgctctggtgggggagcctactgcatgctttaacggggagaccctgctctggctacagcgtggggttctggggcccgtggagtggaagcttcaaaacactctgagcacctgagcaaacacggcagtttgcagggatggggaagttggaggaaaagaggacagccttttctgagagtaaattggtgttgtcaggttacaaagaccatgctgggcgaagcatgaagcccctggccagggtggggtggagtgtcttagaggatccagttgaaagaactgtactgcgcccccataaatcaaatatcgaggccctgagtcttgatgtctgatttataaagcgctgactatgaaacagacaactttttttttttgagatggagtctcactgtgttgcccaggctggagtgcagtggcacaatctctgctcactgcaacctcttcctcctgggttcaaatgattctcctgcctcagcttcctgagtagatggggctacaggtacatgccactcttcccagctaatttttgtatttttaatggagatggggtttcactatgttggtcaggctggtctcaaattcctgaactcaagtgatctgtccgcctcagcctctcaaagtgctgggattacaggtgtaagccaccatgccctgcaaaacagacaacttttaacagagtatttatgaagcattaattcatctgccaagaatttatggaggacctgcgatgtgctggccggggttttaggagctagtatacagcagagaataagacagggtctgtgtccccaaggagctaacattctattggggaggcaataaccacaacatacacaccaccaacaacaaccaagcatcagatagataggagactatgaggtgggagtgttctgatgcaaacaaagggtgatgtaagagagagaccaaggaagcctcattagacatagtgatcagtaaatgcctctctgccaatgtgacaactaatttaatgacaaagaaggaactagtgatgtagaagtctgaggtcaaaatactgcaggcagaagaacagaaagtgcaaaggccctgaggtaggagcaagcttatttgaggaacagagtgactatttcagagaaaaagacaagacgtggaaccaaatcctgaagactcgcatagctaattaccaaatagtagactattttcatggaagaggcacatgttgctgggagaatagaaaggaggagcagctcacctagcctaggcaatcagggagagctgcctgggtgaagtaatatctaatccaggacctaaatgacaggtaacagaataggagatgaagggttctccaggcggagggaacagcatgtgcaaaggcctgggggtgggtcagagcctgatgcattcattaagggaattgcaagaagctgatgtggttggagcccagagctgaagtgtgggattgtaggaaagggactgagggagccctgacatttaggcagaagggccagcctgaccccacccaatgggtgtgttcacagaattgatattgccaagaccggcatttcagggtaggaaggaggaatcggagaaggaactggaggcaggcagggaggccagcagggagagggagtgaaggtggagccgtggccaaggtcagtgacagtaccagagtgggagagaaaaattccaaagccctcacacagccgaaaggactgacatgggacagtctgggacacagggacaaagacctcagagaactcagaaaagcatttagccaagtatcttctggcttggcgggtggccaaagtgggttttgaagtctgaaagacccagagcaagtcgtggcttgtccacttcctagctgtgtgcaaccacttcccagctctgagcctcagcttccccatctgttgaatcaaactagcacagcccacattgaagaactattgtgcagattgaaagtgaatgtgcaggaaagctctgggtatacagtgggtgctcattcccttccttgacccttggctttgggcctctgctttacctccctgggcctctgttttcttgactgtagaatgggaatcagaatgctttgcagtgctgtgggcaggagttagagatgactttgtgggctcagaacacagtctacagagtggtgatcacagatttcattatcttctctttcttcctccccagcaggaattgctgagacaggatggcctggcaggggctggtcctggctgcctgcctcctcatgttcccctccaccacagcggactgcctgtcgcggtgctccttgtgtgctgtaaagacccaggatggtcccaaacctatcaatcccctggtaggtttcaggcaaggttcttcaatgcccaggtccttggacctgtgcgaggcagcccagagaggggaggttgcaggcctgggcagctgtgtgctgtcttgtagatccatcccacctgtgcagggtggtgggtgtcctgccctatagatggcctggacaccaggggctgctgtgtccccactccagacctcgccatcatgggttcacttaggccaggacaagagactcaggtgtccagggagagtgatgcctggcaacagggagtgtcatttctgaggtggtgctgacttcggcagtcagcagctctagattgacttttcagggcttctttttcctgggctgatgagcacctccaaatctagacagttccatgagaggagctgtctccaacacccctaaatgcaaagatctggctgacaggatcaaagctttgaccctctcctgggccttagcacctcttgaccctaccttgtcggctttcctttgagttaagttcccccacatgtctctcccatgacagcagaaaggctggaatagaagtaccaagggcatagggacagaacacagactttgattctgtccctttctagctccatgaccttggaactccctctctaagcctcggtttcttcatctgcaaaatggaggtgattccatgagatagtgaaagaagttatttaattatttatttatttttccgagacagggtctcactcagtagcccagacttgagtgcagtggcatgatgtcggctcactgagacctctgcctcctgggttcaaatgattctcctgcctcagcctcccgagtggctgggactatgggcacccaccaccacacccggctaatttttgtatttttagtagagacggggtttcaccatgctggccaggctggtgttagactcttgacctcaagtgatttgcccacctcggccttccaaagtgctgggattacaggcatgggctatcaagcccatgccagaagttattatttatttatttatttatttatttatttatttttgtttgagacagagtcttgctctgttgcccaggctggagtgcagtggcactatcacagctcactgcaacttccgcctcctgggttcaagtgattcttgtacatcagcctcccgagtagctgagactacaggtgcacaccaccacacccagctaatttttgtatttttagtagagatggggttttgccatgtctgcccggctggtctcaaactcctggtttcaagtgatccgccagctttggtctcccaaagtgctgggattacaggcatgagccactgcacctgacaaaagaagttatttaatacataattctagccactgagagatgcacacaatgggccaggtcctgcccgtgcccaatctcaaagagcaccacgtttaagcatgaagactcatggcactggacggcctgggttcaagttccatattctttgctattgtcatcgtcattatgattgaatgctcccaatggccctatgaagtgatgccattgccccccaccccaggcctgatgaaccctcctgtgtcctctcctgtgtgttctctgccatgctgcacttctctgtcccactttaccaagagttagcagtgtgcttcacacctgcagaagcctgggagagaatttgtatttttagtggagatggggtttcctgtctgggagtcagacgtggagggggaaaggtgagcacgcagaacactacgggaagatcttacttccaattctggcaattgccacctgcagccatgtgtcctgggtctaaagccatttcacctctccaggtctgtcttctctttctcacaggcacaaagtcccctacctttatgcaccaccagtagtatgaacatgggtagcccagggcttagcagtggcgttcattttggttttctcagacactggacaggggagcctggggcagaccagtgcatgtgttttgatcatttgccactgtggtctttttgggtcttttgcagatttgctccctgcaatgccaggctgccctgctgccctctgaggaatgggagagatgccagagctttctgtcttttttcaccccctccacccttgggctcaatgacaaggaggacttggggagcaagtcggttggggaagggccctacagtgagctggccaagctctctgggtcattcctgaaggagctggagaaaagcaagtttctcccaagtatctcaacaaaggagaacactctgagcaagagcctggaggagaagctcaggggtctctctgacgggtttagggagggagcagagtctgagctgatgagggatgcccagctgaacgatggtgccatggagactggcacactctatctcgctgaggaggaccccaaggagcaggtcaaacgctatgggggctttttgcgcaaataccccaagaggagctcagaggtggctggggagggggacggggatagcatgggccatgaggacctgtacaaacgctatgggggcttcttgcggcgcattcgtcccaagctcaagtgggacaaccagaagcgctatggcggttttctccggcgccagttcaaggtggtgactcggtctcaggaagatccgaatgcttactctggagagctttttgatgcataagcacctcttttcatggagtagagtcaggagaaacccctgacaccttttcaggttggagtgcattcattcatcctcttatatgtgccccttccccatgctcagctcagcattgtgtacaaaatatccaagcccagcctatctctcttctgcgtgggagtatgttatttctctggggtctgtgatggggaagggtggatgtcccttccccacaataggcttagtgcttggctcagacacctagactctaaaactatcagcagcggcagcagcagcagcagcagcagtttgtgatctgtccttccaacctgttcacgtgactcctcaattccagggaaccagagcgatgtgttctttgtacctgtaggtctatgatgtccaaacttaacagatcacatgcccctcttagaagaaatatgagcatgctccctcatgcagatagtatacacatcataaacaaagagtagaactttaaaagaaggtaaataatcatacacagaaatcctaacattatattcccaaatctcaaaagatctcctgtgcacctgactttggagacgatgctttaggtaaaaagcttaaacattgccttatattggatcaggaacccttacagtagagggtccagtcttctagtgggtttaatgtttagtcagtgtactctgagtcctcattgttcagaaaagcacctcttgaagaactgacttcctgaactcccagtcatgttggtaccctggacagtgcctaactccttacagaagggagtgaaaacctctttcggaaatgattgagagcagcctcttgaatgcttaaatgatcaaggagggagaaaggcaaaccaatttgttctgtgcaacaaactcaaaatgtggaccagttccctcagccctcattaaactaattaaactgatgggtatcatgcttctactccatggtgaactgaagcagagtcaagctgatgaagttaagcacaaccatgttcttgagcagctgaattggctgccaagagtccaagccatctggcccaacatacgcactgggcattgggtaagggactccagaagcagcagctagaaagagaaaaagccctcttcaatccccataatgcttctttcctcttaatgtctcaaaataaaaccagaaagaggaataaaatgattaagtgcttgaggccaaatgagttcccttgattcaaataaccctgaatcagaggcagagacctcctgatgtcttggtttccatcaaagccctccctgtctgtctgtctctcttttgctctctcattcccaggcactctcttttggtttgtgggtccaggagatgaggctggataggagaggaaaaggcttgagtctggataatttgtataagatgctgctgagcacatctcttcatgcgcagtccccaggtatctgatgatgttctgaaatggatagattgttttagagttattttgtgtcctttaaaaaaatcccatttatgcaatttacttggaatttgcttagcctttaataggcttgtgtaatttcctgctcctccagtacaataaataaaagaaagatgctga

SEQ ID NO: 120 - DNA, 21581 bp, Homo sapiens
aagctccgggcagggctgggaaggaaaggtaagaaggtgagcccgggggcgctgcgtccgccgccttccggtgctgtccgcaccctcgcacctcgcggccgcttcgggcaacttagcgggcgcggcttctgctgggccgccgacccctgcgagcgcttgcgtctcgctgccccgcgctgcccgcgccgctcccttcccggctccggtcaactccgcgccctggggtccggggtctggggtcccggctgtgtcgccgctcacagctcggaggtctaggggatcctttgctgcggttcctatccgcgccgacccctgaagaacgcgagtcgtatgccctagaggcttctgggcgaatattcctcccagatcttttcctgcaggtcctactctggccccaggcaccctggagccgaaataaacaggccagttttgcaagggagaaaagccgttcctaggggcccttgtcagtcctggggaagtcatgccagcgccgggagtttccttcccccctactcccgcccccggtctgtaagcaaagggcctgactggtgtcagtgctctcacactgttctcacagagttgggggtacaaaaaagctgcctcatcaaaggtcgcgcggacctgttttctccatttggggatccccctgccaaaaaagaaatttgccaacccctaaattgtcttatcaccatgtcggttacagtggtatagttttgagggtctgtattttaggcaaagatgaaaggcacaaccaaaatacagtaagaggggcagtgccaaaaatttagccagaagacatttgcagaaagtgaaaaattctgtttgtaaataataaatggaaaagtagaattagaagcccacttttggacgcaatttgatttactaaacttcgttgcttcctgacttttcactctaattccggtagttagatattttgaatttgcaagcctacaaactgcaattgagttttatagcagccttaaaaaattattgttgcctgttcatactaagtttagtggctattttttttccttcttgtttttaattctacggactgttgcatgaaaatatcctcttgtgagagtacaataacttggcattgttctttgtgacaatagaaaaccaaacaagaactacatgagacagaaaatataaacaaaaaattggatctcagtttccatattcgcaaaatgaagagctctggctgatcccagattccagatatctctgaggttctgtcctgaaaaatctgtgtgtgtgtgtgtgtgtgtgtgtgtgtgtgtgtgtgtgtgtgtgtcttcaggagtttgggatacaaatattaattgaaatctaagatattctctgtcctcaaaattttatacatttaaatgggaaatatttgatagttgagtttctttaatcatatcagtccctcaaaatagctgaatcatggtgcatcttctgcctctaaatggttacattctatgctattaaataaaaatgtgtcatgggaaacaaaagtcccatacttttcaccacaagactgactaatacggttgacacactagagcactgatgcctgcttattttgaaacagtctccaggaagaattaagaatgttatgaagcatttgctacagtatgtgagcataacacataagcaacatggcaggcaagaaatttcaaaactgctttggaaatatccatgatagatctgaaagtctgtaaactgcagttgagatcacattttgtaattatggtcattggtcagttgggattatgagctccctcgagagaatgtccctccaattaatagaagagtatatcgaatcaccgattcgattgttttaaaggaagagagaaaatgtttctcccttttatctaagtagttataagaaaaagtcttacaaggaaaattacatcaggtgttttctaaattaaataaataaccgaaagttcctgactgaaattacctataaaaatgcagggtcctcctccaacccagagaatccagggattgattcacacagacttttagcgagactttcttactttgtgttcttcaacagaataataacctccagtgactctggcacactgaaattggctaggatgggatcatgaaggaaggtgttgtggggtagtattggaaggacaagcaactggctaagcttacagaagaatctccatccctctgagcttcatcttccactctgaacaatgctgacaatagtatgtaggtttcagagttgctgtgactcctaaatggatctgttttaggaattagtacctgcacagagaaagagcacagctgatcttggttcttcctgtcttctttggaaggtgtttgtttcctagctgaacaaattgcagctgaactgtagataacagcttttgcttttaatttcaaaattctgtgtggcaaaatcttgataattgttgaatctgggtaacaggtatatgggaatttgttgtatactattttctctatttttgtatgtgttcaaaattatcagaaaaaaatttaagtgtgaatctgaaaaaaaaaccccacactttgagttatttctagtccaggatttcattttacattgtctgtttcattttacattgtattttttaattagtgaatatttaaatatagagaaatataaattatgtactatatagggagtggatgggcagcgactggtcctggagaacaatccatggcagtcttcaattttttgtgtggaatattttttattatgaaacaatctaaagaaaatatgacagtgttgatggttgttaattctggttgttgggttcatggatttttttaaatgtttatatttaaaatttttttacattggtataaaatcaccatattgtttcccaaaatcattataagaatacaaataatgcagctgtttttaaaaaggtaaaaatagtttctatcccactatcaagatatattcatctttaacatgaagtgaaaatcattgcgtatgtctttctatttttacacaaataggatatgttggtcgggcttggtggctcacgcctgtaatcccagcactttgggaggctgaggcgggcggatcacctgaggtcaggagtttgagaccagcctggccaacgtggtgaaaccccgtgtctctactaaaaatacaaaaattagccaggcgtggttgcgtgcgcctgcagtcccagctacttgggaggctgaggcaggagaattgtttggacctgggaggcggagcttgcagtgagctgagatcgcgccaccgcactccagcctgggtgacagagcaagactctgtcttaaaaaaaaaacgatatgtcaaaagattaaaaagaaatgcttttataaaaaatagaattgttaaataagcaggaggccattagcctgagtctttctccctactttgagtccctgtgtgaaaaactaactttgtacataaacgaacagaaaactaactcaacagtgtattttttgtaatagccaggtttcagccaatcacaggcggccagctcatcacattatgcccaaataaagcagatgcagagctgtagccaatcgagtgattttggttttttacttctgtcatcagtgtataaaaactgcagctcatgctgctggatagagctctgtgaacctcttctggttgtgagtgctgcctgattcgtgagttgtttgttgctcaggtaaactgttaaattgaatttatctaaagtttttcttttaacaggatgatactatatatgctttttaaaataaaaaaattatattttaacagaagaaactgtagtgaaagtgaaggaattgctgaacttgacatcagtatttcttcattcttagagataaacaagtcttccaaactaagagaaaagtttctgaatacatcttgagatcaagattttttaaacatacattaatttagacagtcagaggctccctgttataaaggatggagcactgggcactcttacattacctatagtttcacttctactcatatcccagtttttattctttctttctttatttattttttgagacagagtctcactctgtcaccccaggctggagtgcagtggtgcgatcttagctcactgcaacctccgcctcctggattcaagcaatatccctgcctcagcctcccaagtagctgggattacaggcatgcaccaccatgcccggctaatttttgtattttcagtagagatgggcttttaccatgttgcccaagctagtgtcaaactcctgacctcaggtgatcctcccacctctcctcccaaagtgctgggattacaggcatgagccactgcgcctggcctattttttatttttttaattttggagacagggtcgcattgtgtcacccaggctggactgtagtggcatgatcacagctcacggcaacctcagcctcccaggctcaagcagtcctcccacctcagcctcccatgtagctgggactacaggcatgcaccatggcacccagcttttttttttttttttggagagttagggtctcactgtgttacccaggctgatctcaaactcctaggctcaaggcatcctcccacctcagcctcccaaagtgctgggatgacaggcatgagccactatacccagccccaattttaaaaatatgtttatattgtgaggatctataacatttgcattgtgttttgtaaacttcatttcagatacaattttttttttttgagatggagtcttgctctgttgcccatgctagagtgcagtggagcattgttggcttactgcaacctcagcctcccgggttcaagtgattctcctgcctcagcctcctgagtagctgggattacaggcgtgtgccaccacgcccggctcatttttgtatttttagtagagatggggtttcaccatgttgctcaggccagtctcgaattcctgacctcgtgatccaccagcctcagcctcccaaagtgctgggattacaggtgtgagacaccacgcctggccatttcagatataatttagtcttagttttataactaaatgaaatcacgatgaatcactggttcttttaccatggcatctcaagtatcaacttttgattcatcctttgattggctagattttgtcagtgtgtctgtttgtttccaagaagggctcatttcctgtgtctttttatgtttgaaatgcccatgtttctttccagacagtccctgactcacaatggtttgacttaaccatttttcaactttataatggtgcagagacaatacacagtcagtatgctcaactttcggtgtggttacacccaagtaaacacatcatcgtcataaattgagaaactgtaagtcaaacgtgtgttttcaacttacgatattttcagcttaccatgagttcattgtacattggggagcatctgtacttgaatgaccatttggctggctgtaccatttttgagccagtttccttacctccggattatatagccttcgctccattcactgctagcatctaatgtagctgtagagaagtctaagtttggtttcaaaatttctggctgggcgcagtggctcacgcctgtaattctagcactttggaaggtcaaggcgggcggatcacttgaagtcaggagttcaagaccagcctggccaacattgtaaaaccccatctctactaaaaatacaaaaaattagccgggtgtggtagcgcctttaatcccagttactttcgagggtgaggcaggataatcgcttgaacccgggaggcggaggttgcagtgagccaagattgtgccattgcactccagcctgggcaacaagagcaaaactccatctaagaaaaaatttcttccttgcaattgatttgctttttctgcccggagtcctaaagtatcctttatattcctgaagtgtagtaattcaggctatatccttgttaagttctgtatcaatttttcatggaacctggtgcattccttctatttctgttctttctattggaataatctgttgttcttaatttcagggtttttttttttcccattatgaatgctttttctttccaattttgtaattctctacttcaaagacaccaattattctcacactgtctcatctttattctccataatgattgttatcttgttttaatttctcctgttttcttcattcactgtacttgtcaaaatgattaaaatgtaactgatttataaatgaaagtgtagcatggtataaacagaagcaggttagatatgaggatatttggattctaactcggccaagtctttcttaaagaggttttcttgcttgaaaaataggaaaataactaccccttcctcctgcccccagtatttttggagctatgaaataatatacatgtagtagttcacacaggttctgacacagggttgctactcaacagatgctggttattattacttactcctccattcaagatgcaggaggggtggtgttagaattcaagttccaaacacatgttacattataattgttctggaagtcacaatgcatgaaggagagctagtaccttttcctctatgttataaagaaaatttaacctccatgagaaaaagagataaacagaagcactttaaaacattctgtttggaatttattttgtggaatctcagcttattttctgttgtttgagttcattttcaagtttatattaaatcttggtaatgcatggaaacccaccaactagtggagcatccttgatcaatacttggtcagatatgaaaggaaatttaagataatgattctaatctcattaagactttagactgttttaaaatgtagcatttctttaaaatttagtatgcaacaactgacttttttattatactttaagttttagggtacatgtgcacaacgtgcaggttttttacatatgtatacatgtgccatgttggtgtgctgcacccattgactcgtcatttagcactacgtatatctcctaatgctatccctcccccctccccccaccccacaacaggccccagtgtgtgatgttccccttcccgtgtccacgtgttctcattgttcaattcccacctatgagtgagaacatgcggtgtttggttttttgtccttgcaatagtttgctgagaatgatggtttccagcttcatccatgtccctacaaaggacatgaactcatccttttttatggctgcatagtattccatggtgtatatgtgctacattttcttaatccagtctctcattgttggacatttgggttggttccaagtctttgctattgtgaatagtgacgcaataaacatatgtgtgcatgtgtctttatagcagcatgatttataatcctttgggtatatacccagtaatgggatggctaggtcaaatggtatttctagttctagatccctgaggaatcgccacactgacttccacaatggttgaactagtttacagtcccaccaacagtgtaaaagtgttcctatttcttcacatcctctccactggacctgttgtttcctgactttttaatgattgccattctaactggtgtgagatggtatctcattgtggttttgatttgcatttatgtgatggccagtgatgatgagcattttttcatgtgttttttggctgcataaatgtcttcttttgagaagtgtctgttcatctccttcgcccacttgttgatgaggttgtttgtttttttcttgtaaatttgttttgagttcattgtagattctgggtattagccctttgtcagatgagtagattgcaaaaattttctcccattttgtaggttgcctgttcactctgatggtagtttgttttgctgtgcagaagttctttagtttaattagatcccatttgtcaattttggctttgcaacaactgactttaaatgagttttaatggctgggcacagtggctcacgcctgtaatcccagcactttgggaggccaagatgggaggattacttgagtctgggagtttaagaccaggctgggaaacacaaggagactccatctctaatataataaaataaacgaaataagtgttaggtagtttatttgtagataaggtgtatttttagttagtaatatttaaaatagatcacagttttgaaaactggacttaaatagtgttaacattggaatttcactaaaatgcaggctccatgaggacaggtttttaattaataataataattattattattattatttgagacagagtctttctctgtcgctcaggctggagtgcagtggcgtgatcacagctctctgcaaccttgacctcctgggctcaagtggttctcctgcctcagcctcctgggtagctgggaatacaggtgcatgccaccatgcccaacaaattcttttaatttttttgtagagctggggtctcactttgttgctcaggctggtcttaaactcctgtgatcaagcaatcctcccacctcggcctcccaaagtgctgggattataggcatgagccactgtacctggccctgaattattgcatatattaattcacaatatttttaaggccatttgagagctaatgatacagttaattatgttataatgcatgttttgaaagtaagcattattccaaaaaattgacgtattagggaacgatttgggcataatacaactttcatgtttgcttacgcatgttttacccagaaaaaacaatgggtgaattcattaaattgcaactagctgacctaagccatgtagggatacacaaaatgcaaaatgcaaaatgcaaacacatacctctcaaacatctaccagctatcttggtttgccatgtattattttgaaaatttacagtttgctatcctttcacacttgtgaactttcctatataaaaacatgctcattctaggatttaagggctgagaaagagcacagtttttattccttcttccaccgcttcaccataactcacaaatggcaaccattcccattccacctccctagcaagtttttggcctttttttaatatcaagtgccatatttgtgtatttttaaccatttaagatagatagatgtaactgtgctattgtttttattaaattcctatcttttaaagaatgtgccactgatgaagattttaagtgttatatcactaaccccattttcttgtgagccctgtggttgttattgcacagtttagtatagtgcagtgactgtttaggatcacatatgttgttgtgttacagtggaattgactctagttgattaaagtggcgtagaagtgctattaagtgtcatgttgttgagacaataagcgtgatatctacatctggcattctctctactaaaagagtcctaatgtgactcccctgacccaaatgtgtggtccacctggttatttagccagaaaaaaagaaaaggcagagattatggccaattaactatcatacatgatcttgttagggttgtttgccaggaagtaacttgaaaacttgatctaaacataggaaaagtgagttcattttctgcatataggtcacttagagtaaaggaaagcaaaggtgtcccattgattcatataaagaaacgactgcttaatgtatctagtttctcttgcatctttcatcaggaatctctcttcagtaaacttactgcatgatgtcatagcagctcatcaaaagggaatggcttcctgcttatgcctttaaccatttccaggatatggagaaatcagaagaacttgagcagagcctgtcaattatttaaaaccatctaatggcaagcttgagaagtagagactttactgctgcttcttaaaattaaggattttcacaactatagggctgagtgactcaactggtaggacctaccctcctatccctctgtgcctcaaaaaactgtagcttcttaagaagacatttaaattatttaatctaaactgaagaaagaaaataagaatgttgttgatttgttttgttccagtaagtccagatatttattgaaattgtacatgtagcaggatatttcggtggtaaagagagcagacactggcatctgcctgcctgggagtgaatctgggctatatcttcgtgtttccctaggcaaccaacttaactttcctaatacctcaattttcttatctttaaaaactggacaataaaactatctgctcagtaaatgctagatgctagtagtagcatatgaggatcaagaagatgacagctggatattgccttcccaatgctgaagtcatctggccttggtggcgtcacacaatttgaagaaatagagttaattcttttgagtttctctgggctgtattttgagggtcaatctctgaatatatgtaaaacattaagtatttgccctatctttatggctcaatgttacaaagaactgactgatttgaaggtcaaccatgaaaacatggtattctaggaattttggagattggtatatcaatgtcataactattctggaagttgcccatgtgttcaaatgcttaacagtatggtgactacctgactatgaaaggaaaacctcttcagtgacactgggaaccacagtgaatttaatgtaattcccagggtctctcatagggtcttgttttccaggttctatcaaggaatgattctcagctgattttcctgatttaaatctagcaaggattgagtgtcttcagcttcacagatctatattctaattctattataaaatatagattattaatgaaaagcctcatatacagtgagcacttataactgtttatgtgtgtgtttagttttctgttgctgtataaaaaatgactacaaacttagcatcttaaaacaataaatatttgttatcagtttttgtggatcaggagtccaggcactgttgaactggatcttctgctcaggacctcccaagcctgcagtcaaggtgtcagacacactgagcttcttatttggagtttggggtcctcttccaagcttctcagatggttcacagaatactgttccttgaggttataggactaaagtcccagttatcttctttaagctcatagaggctgcctgccgttcctttccttggaaaccccacaggcagttcacatatggatgtttgccttcttccagtaggagcacatcaatcactctgacatccaatctctctccagtcctatgatggagtcctgtataacttaacataatcataagagtgactattccaccaccatttgccatataatgttacctaatcaagggagcatctatcccattccattcacaggttctgcccacactgaaggagagggaatgatacagggcatgtataccaggaggtcaggaatgttgagagcatcttagaattctgcctaccactgtatgtgataaaatgagagatcaatcatgggtagagataaatgtgatgttagctgaaacatgagaacagaaaaaagtccggtgtagcctgtcggcatgttctctgatttcttcaagtctcaaggagactccaagatctcattgataagggggatcaaaagcatgctccagcctaagagattagtggtacatgaagagtctccaagtattgtgtgaaagcaaaggctggtgtgaatatactctggaatccatatcagaagatgaaatgagaaaattaaaccatgtaatataattgtttgggaaaggggaactgtcctcaggcaaaaggaaaaaggtgatacttcccttggtaggataaaggagccaagtgctgtagtggggttggccacccctgtaggcagaaaccagatggtgacatctatgctttgggtaacatctgactgatggcagcatatgaatgttgtaaccaataccatttacatttccatcaacactctgttctgaatcttggataattcttccacatttatacacttatgcattatacatatgcaatgtttgcatagcatcatgccaagtcttttcatttcttctctctgttacttgagagactctagaccagcactgtccaatagaaatataatgcaagccacataaacaacatttttttaaagtaagaaccagtgaaggcagctttaataataggttttacttaacccactatttctaaaacactgtcatttcaatatgtaatcaatataaacattaatgacatattctttacttttttttttttttttttgaggctgagtctcgctctgttgcccaggctggagtacaggggcatgatctcagcttattgcagcctctgcctcccaggttcaagcaattctcctgcctcagcctcccgagtagctgggattataggcacccaccatcacatctggctaatttttgtatttttagtagagacggggtctcaccatgttggccaggctggtcttgaactcctggcctcaagtgatccatcctcctcagcctcccaaagtggtgggattacaggcgtgagccaccatgcccagcctattctttacttttgtacagtcttcacaatctattgtgaacactttcatttctccctatgctctttttcaataatcttaacaaccctagtttttatttagcattgacctgtgtgatagtaactgctaaatctctctccctttatcctaccccttatcctctgctgtaaattctgctactcagagcatcagattaaacatggctaaaactgagttcctttttcctctgactttttccctaacttcaagatcttgtataaccccaaaatgtcttcaacccttcttcgttcctctgtttcaatagatcctttcacctcttcctcatagtctaatacatgcttcccttttttttttaattcaacatctaaactgttgattcaggagctttctgatttattaagccttatcccaagcttatttcaaacactgtttttctacctgtgcactcttgtctttattagtgaatgtttactaaagaccactttgtgctagacagaggaaaatttcaaatatatttatataaatatatatatacacacacacaatgctctatcaataaagctgttattctacacacacacacacacacacacacacaaccatctatgttcatttttttaaatgcttgaatatgtaacccaactgaaaaaattaaaaaattgtgatgctttaaaaaggaaaaatatacataatggtcagtatgacacaatctatgatggaggctatgtagacagataataaaggccattaaaaactcagcttacaaggtgcacttcaggccaccatggtcagggaaggctgctgcaaaatttccacaagcttcatccctcttggactgatgagtgtacggaaggaaaacgtcttttcaccgaggtaaaggatggaagtgagaacacatgaagaggaaatgtacctttctggctctttaaaaacaaggattaaaatccagatcctttattctgtggaatgttctggtgtctcttttccctcccccacccccacctgtcacctccttcctatctcttagatttgttcgacacttcttaaccctggttgaacatcaaaatccctgggaagtttgtgaaaaaaattcagtgccccggcgacaaaacaggccagttaagtaacagtctctggagctgggccccagtcaaacacctggtgttaagacctgcagtcttaattcagttctgccactcggctctatattttgacccatgtttggaatcatcttctactccacatcatacagagtcatgtcattttagagctcttatgatgttgtccaattctttcattttaccaatgaggaaaccagtctaaggagatgaaaatcacatagctatctagggatacagctaagactagaacccttctcttgggtggaatcttagttccattataagcaatgtgacattgaacaacttagttttttgctgaatttaaattttcttatgtgtaaaatggagataatagtactttcctcctggggttgttaaatgagataattttaaaaatatgcctggcacatagttgctgggtaaatgtaccacctcaaggacaagtcaaaaaaactaagaaaatgataatttagcttagggaacacatgccaaagttgagagctgatcccaattaatgagtagaatattgatggaattttcagtttgtgggttgcttagcaaccaaaactcactcaataccactgactacccaagttgttgtttttaatcaaagcaataaactgttcttaaggagttcaaggttgtgaacagacaaaaggattcccttatgcatttggggttgtgccaggcattttgaaaaagtgatgccccagctcctctgtgtttttgcacttaaacatcttggacatttggagccccccaattctgtgcccatagatgacagaagatgttacaatatctgttacattggatagagagtgagaagggagaaggcagagtgcttgcacttctgtaccaatgtattaagccaaacttattgagtgctaaggctcagaaatacaaaagcatttgtctttgcccctgctgcccctgagaatttcagtctaggagaggaaaccagtcaatattgaataatacagcaaattattcatgagcggctctctgtgtctccagcagtattctaagagttacagactgaacagtacaagaacttatagggtaagtctgaaatatccatggttaggatttttattttcttggcaaagcagccctggaagaatatcccacttgggttccccaaaacattaatatttgattcacagtcttgagagctggcactgaatgttggagagggtctaaagaggggcggacgggaattggagctccatgccaccacctgttttacctgaagccagagactcaaccaatctgtgcccttcttttctcatttgtaagctggacatgatgatttagattctgcctccctcgtggcaatgagataataaatgcagaagttctgttgcaataaatgcagtttctagctaatttgccagcaggtttactttgcatttcattgagcatccttgtatcttcatttacatttcctattcctttataactcgtaatcttaacaatttaaagagaaaaaaacccagatgagcttggaacaactgtgtttatttgcacttaagtttgtcttcatcatttgtagctcagtgtgctaacttactttgcagtgaagatcaactctagtgcttaggaaagaaatccattgtgccactttggcatgtcagcatttatttacgcaaaacatgacctcaggcttacaggcctttaaggcagacagctggttgatgaatcatgttggacattcatatagtgctgctggcacatgtcagaaggacactcctgctcatcacctgcccctgtcagttcttccacttctaataaagcatatctgttttggtgaccaaataaaaacacaagtgaagaagggctgggtgtggagtaatttaatcagggcaagtcagcacgctgcattgagcagtacagtatcaaggataaaaagatggtttggtaacagctgaatgaaacgaagtagattagtaaagatggaagcacagttccccttataatcataatgggtcatgaccctggaatgcagaagccccaatatatcctacaaatcaagatttttaaggagacaggattcccagaagttcccttctgaattgccacgaacgttttacatggcctttctctattagcatcattttaacatttcgctgaggattataaatttttaaggaagttcaaaccaaagttcagagctccactagcaaatctttttaaactggctttcgtgggtgtgtttggtatcctgaagaattgattgatttaaaataccctagttttgaaacagcagggagactgacatttgcagcctggtattttgcagttctcactactcattgtatttgaacaataatttttctttgttgtaatacccagtagaataaaattttgtgctttgtttaaaagaggagaaattgaacatgttcaggatgctggcctgtcttcaatttcatcaccatcatctcgtagattgattgatggggagaataattagggatatgcagcatgtttgaaatgtatttgaaaacaagcaaaaacaacaatatgactataagttgtaagtctaagctttttttttctttttttttaaatgattcacctggcagtgttcttgaagtcattacttactgagaaaagaatcactatccaagatgaaaaatcaggaacttcaacaacagctcctttatttccatttctacttctgttggtgattacactgttccattttttactccagctaagtcattttcacctctgtattttttctcctatggggcaagatctgtgatatctgatagtttattaacaggtgtgctggaaataatctatttcaaaaataaaacactaaatatagcacacaagttcaaggcttttgaatgttaccatggttttaaaaaatcaatgtcatgaatgctttacactgaaatcatttattgttaggaaactgggtggcaaatgatacatatatcctgtagctctgtcatcatggctaatgctctcctgactcagattacatattagcatttccaccatatggctgaaagggtagagaatgtatgtgcagaggaacagagttggtaatatttttgaccatctgataaataaatatgtaagtaacaggaatattaatatttatttcatcatatgatgcaagctttaacctgaaataaccactaatacaacaaagtagtacatttgtttctcaaataatttcaatctaatttattaaatatttccatagtcaattaatgctcttagaatgtgacttctaattatgtttcttatgtttattgatatagtagggttccttatcatgccaaatttaaaaatctttcctgagaggccacacgattggacccagcatatgggcatgagcgccaaagttctgctctgccagtgaccactgtgtggcctgggataaattacctgacctctctaagcctcaaattaatgtgtaaagagtgaataatctattatcagacagtatccctcaaagggtgggccatggaggaccatggattaacacatcagaatcacatggggagcttaaaatacaaacatctgggccccacccgcaatgattctggttcatgtatctggaagcagtccatgaatctgcaaatatatatatgtattaatacagagtcttactcttttcgcctaggctgaagtgcagtggtaagatgatctcggctcactgaagcctgtctcccaagttcaagtgattcttgtgcctcagcatcctgagtagctgggatcccaggcgcacgccaccacgcctgggtaatttttctatttttagtagagacagggtttcgccatgttggccaggctggtctcgaacttctggcctcaagtgatccacccacctcagcctcccaaagggctgggattccaggcacacgccacctcgcccggcccgcatttttagtcactgtcccgagtgattgtgaggtacactgaatcactcccatagagacgagattaatatagagcacttagctaccttgaaaaatatgtagctaattttaataaatatactttttataccatagaaatttaacacccaacagcatttgtgcttaaaatactctaacttcatagaaaatgggaggtcagcttgctaagtaatgctgctgatcattaaatataccccacaattctcctttttgtttaattagatcctttatctttttttctcttgcataggaaataccaaaatatttgcagactggatccaaatcaggagcccagatgaacttaaagaagcgagcatgggattcttagtttttcaagatccgtacacacgaagcctttaatcagcatcaactccagtgtccgttttctctggttttgtgaagactgcacaaaactctcatgatggagaaccaaaggacttagttacctgtttcagtgtcatctaaagtcaactgaaaagtgaagcaggcagtaatacagccatggaaagaaattcaagtttatggaagaacctaatagatgaacacccagtctgcacaacctggaagcaagaggccgaaggagccatttatcatcttgccagtattttatttgtagtaggtttcatgggtggcagtggattcttcgggctcctttatgtcttcagtttgctggggttgggttttctctgttctgctgtctgggcttgggtagatgtctgtgcagctgacatattttcctggaattttgtactgtttgtcatctgcttcatgcaatttgttcatattgcatatcaagttcgcagcataacctttgcccgagaattccaagtgttgtacagctcccttttccagcccctggggatctctttgcctgtcttcagaacgattgctttgagctctgaagtggttactttggaaaaggaacactgttatgccatgcaggggaaaacttccattgataaactctccttgcttgtttcaggaaggtttgtacctttggtgcttgcatgtctttcctcaagtattagttgtttgtgtttctttccactatatttttccatctcagtatcacatagtcctgggtggcatttagcaccctgaggcttgaggaagtctttgatacttgagtcacagacatagccatttagaatatatggcattatttacttgaagcagaaaataatcaagagccttaatatttcatcttagaaatcaaattacataaagtatgaatttgtttatgtgatatgatatttgtttcctaattactgaaagtcgagaagaggatgatgtcagcttgaattaatagaatacttatattggcgtgcaaaatattttaaagactctttgatagggctttcttttaagtaacagaaaacatttaaattttattattatctttttttcttcagtaaattctagcaattgcccatgagaagcaggctggggagacacttcaggaacatatatagaaatctaaactttgaaaacaggccaggtgcggtggctaacacctgtaatcccaaaaacacctgtaatcccagcacttttggaggctgaggcaggataatcacctgaggtcagcagttcaagaccagcctggccaacactgtgaaactcccatctgtactgaaaaaatagaaaaacaaaattatccaggcatggtggcacatgccagtagtcccagctactcgggaggctgaggcaggagaactgcttgagcgtgggaggcggaggttgcagtgagctgagatcgcgccactacacttcagcctaagcaacagaacgagactctatctcaaaaataaaataaaataaactttgaaaacaaagtttgggagaggaaacaataatgggattactcatggttttcaaaaagttaaaaatgtggcttacaggccaggcgcggtggctcacgcctgtaatcccagcactttgggaggccgaggctagtgggtcacttgaggtcaggagttcgagaccagcctggccaacatgttgaaaccctgtctctactaaaaatacaaaaaacttagctggacatcgtagtgcacgcttgtaatcccagctactcaggaggctgaggcacaagaatcgcttgaacctgggaggaggaggttgcagggagcccagattgtgccactgcactccacgctgggcgacagagtgagactctgtcaaaaaataaataaaaaataaaaatttggtttacagaggtatttgcagaactcctctatgttcttaaatgtttccctacttaatttaaaatctgacaaagtccattaaaatgttttattgaagtataatatgcacacataaatggacatatataaatgtacaacttgatgaattttctgatgaatttcactcaatattccagaatcctgactgtataaggaacatgataacatgaatcttacaggacattatgtcacttattataatgtatgaatttaatattttgcctttcaaaatcataaagggcaagagtcatcagggatctgaaatacacttcctctaccccccacccctccccaattatgtgctctctttctccttcccttataaatgttgttcttgtgttttgataggatcagagtgacagttgatggcgaatttctgcattacattttcccccttcagttcctggattctcctgagtgggattcactgagacccacagaggaaggcatttttcaggtaagggataccagaacacacagttagcactccctctttcaaacagatgtttgtttaaaaataagtaaacaaataaacaacagtggataagacaagaatattttaagactttggaatgtactttgcagcatacatgactttcccaattctgctggactcttgatgattaatgccactttataggtccagcgatgagaagaacaggtgctacatatgacaggaaggaggctgtgatcaatactttaagctttactttgcataactgcgtatttaggaattaaaatataattgagatttgactaaacactgctaatgcgacgtctagaaaacatcaagaacaaaaaactgcacttactaaaaaataaatgatttttaaaatttaaaatgccagtggatttcagttgttttacagcaacagaatgctaaacttactgtcattactctgctgccacgtctggcagttttgaaagataatcatttcagcaggtttcatttattttgttacacagttttctaacaaatatatgtgtgtatgcaacaaactcaaatatgtatgcaaattaggtatataaattctgttttctactgcagaaactgcattagggttaaatgtccacagtcttcagaagtgacttggaaatatttctgtaacatcagccaactttttttttttttaagatcaagtagttctcccttcaataaaagaaatgtagatactggaacttagaaaaacagacagattgaagatggctagaacattgtgattattcatattataaattacgtatgtagtaacgaattttgtagtttctatttttgcaatatattgtaggtcagtgggctttttcaacctaaaaaaaaggcagcacgtgaaattaatttaacaattggggtactaaaaatgtggcagaagttttcttgcttccacatctgtttatgtgtggtcttgtgttttttaggtaaccctcactgcagaaactgattgtcgatatgtgtcttggaggagaaagaaattatatctgctctttgctcagcatcgctacatctcccgccttttttcagtgctaattggcagtgacattgcagataaactctatgccttgaatgacagggtatatataggaaaaagatatcactatgatattcggctacccaacttctatcaaatgtcaactccagaaatacgcagatcacccctgacacaacattttcagaattccagacgatactgtgataaatgacatcaaagtctgaaatttataagtataaaaaaagactctctcttcatcattccccagtgaaatagcaaaatacaaaaaaagagctccctaatgtttttataaatcaaattcagaagcgagatgccattgccaactgttttattcctttcaacaactgcattgtgaataaactttacaaatttttcttgta

SEQ ID NO: 121 - DNA, 210998 bp, Homo sapiens
gcgcccggcgcagctcggccagagcgaccgcggggctgagcgcgcgtccgcccagggggctccggaagctgccccggcccgcggcctcctccctcgctcccgcttcccctttctcgctcaccgccgccctccttccccagctccctcgccgtccgcccgccccacagccagcggctccgcgccccctgcagccacgatgcccgcggcccggccgcccgccgcgggactccgcgggatctcgctgttcctcgctctgctcctggggagcccggcggcagcgctggagcgaggtaagcgccccgaggggcggggcgggcagggggcaaagttgccgggagagcggggcagccaggggtcggggctgaccagggcgactcaggcaccacccgccgggatgggaagcggtggtggctgtccaaaatcggggctaggaaccgcacgtccccttggcccgggctgatgggagtgtggaggcggggatgtgttgaaggactcgggcgcttccctgcttcggctgcgggctccctttcggtcttccccggctgcggggctgattctcctttgcagccaaagaggttctccttggagtggggtcgcctccaaaccccaaattcccggcgcttctctgcaaccgcacccggggctaggtgccagataattatcttcctctccgggagaggacaggaaggggggtgagaagctgacccaccctgcaactgaggactagactcaaacagtgcatttgccgctccccccgacaccacagaaacccttgactcctttggttcaggctaccccgagggtctgtgttcctggatcgatctcagccaagcgtcaggataccggacttgggtgtggctttcgctagaggccggtggagggggctgagggctctgagaacttggtaggggagggagaagagatgttagttagcagttgggaacctgaacgggctcccctctactctctcccctactgcctagcatctctgatcactgttaggaatggggggtgaggggtgttagtttcatctaccacgtgtttgttgaaggggaagaggggcccaaatttagcagagaatgacagctcctctttctcagacctggaaccataccctctctccaccccggtaaggtaccccaggaaaagttatgggtgggggagagggccagatagagagaggggtgcaacgcctaactcacccaaagctaaccctcagagcttcgggggttttctcaggcacctaggagacccgaaaatcaatgggagggttagttggccacaggacccggccttcttgcaaggtcccagaaatgcgctcctcacgtgtaaaaaagcagacagctgcagggtctgcccaggctgaagacagagggagcgcaggcactatgcttatctggggctccgcctctgtcatttgcaccgtcttgactcggagttgggggacaggcggtgttcttctccggggagttctggacccccagcgcgcgcacctgctttcagcaccaaaggccctggacagctctcagctccatgggccctggctctgggtccctttcccttcaacccttcccggtggcctggagtgcccccctcagcataaatcaggcattttatcccccatctccccgtctttttaaatgtagagcccagagtgcagagcaaaggaaattgttcatcaccttttgtttaacaaagcatatcattgaagaacccccaccccttttttatggggcaataatgtccacaatttacaccaggtctggacagtttctctgggaaagatagggaaagagatttggtttaaacaaatcgtttccaccacagcatggcctttcttaattagctgtctctttctaacaatggcttggtggccttgaactgagtccagctctccctcccccacccccttttgaatctgtgttgtgactaacacacatataaaaagaacctgaatctacccagcagcttactggattttctaaagcagttctacctctgagaactccactctccaatacaccaccttgcagggaaaaaaaaattgtcttaatggcacgtattgaattgtcatctaagacaaggatttcctattctgtttccttcacgggctgcaaacacattgtaagagcagggggagacatgtgtgtgttttaatttttaagacatttcatactatttttccaactgctcaacaccatggctagccagcatattttttaaattgacttcaggtcaccaccaaattaaagtcaattgatgtgctacttcagaaagctcattaataagtgtgtggttctgactctgagtcataaggagggagtgatactggccaatgagcattgccgagtctgatggtgcatttggagacaattgaccttccacaataaattctatttttaatgtagagcccaacatccactaatgtcagatggagaaccattcacctaactcgttgttgcgaactagttcttctgcttgcggtgaagtgaggggatttgtaaatactcaaaagggacttgttgctacattctgatgcaggtcacgtggttctctgggccatttcgctgtaaggcatgaataagtataaagtataacttgtttttgaagagcctccttattgtctcagatatgcacatggggaataattgtaactacatgcaaagactgcaaagcctaagaataatttcttttctttttctcttgaattaataaggcaaattcagtattgctcaataaggctcaaatttgctgcttccccagtctctaacgtgtgttgtggttagattcacttaaagactattttcattatggattggcattattttccatagagttttgcccgttcctgccaggggccaccgtatctaagcttgagggattcatcttgtgttcatatggctcagttaggtattaagaaaataatgttacattcctttccttccccttccagggcaaaaggatattttctgatcagagtggcttgttttcttatttttgcttacaagtccattcctgcaagctgttcaaatgagctcgatttactggccctcctattctgtccagagacaatttatccaatatacctactgtgcagacctccactaggggcgctccaagatctagctggcgactaagggcagaagagaggggaattctgacctgtgaacaaccaggtgtgtgcaacaccaaaggtcagcagaatggagctcctctcagcctggaggccttgctatcatctctcccctccctctttctgattactacattttattactgtttctcagagaaaaattattggtcacccttgacacacgcagtgaaaaagagaaagaaaaggtaaaaagaagcccggagaatgctccaaggaaaatgtcaatccaactgccctttttgtatttttgcagttttcttcatgaagccaaattgcaaaacatccaagaggctgtggaaaggctgttctggggagtttgactgaactgggcactggaattagatttataaagtccaggaaaagaagtgcagctccataattagagtgacctgggtccagaggccagctccattgtctattaacacatggccttcagcagaactattttatctgaactcccatttcaccatctgaggaatgggggcagggcaaggaggactgatgataccagcctggaaggatggctgcagggattacataatgcatgtaaaagcagctggcacggagtaggtgctcaagtaatgtttatttctttctttccctgctttccaaagggcaaactgctcctattagtagacaccaagaaaacaaatctctgcgattggcatgaagcagatgttggtgtaaatattgggataattcaggctaaagtagaaaggggttgaagggcatagtgagtaactccagttacctgtattctcacctttggcagatgagaatttgaccttgcctggtgcagacacccttcccttccaaactctcatgctgtttctttttgaacctaaatattaccatcaggaatcagagttcatggtactggagatcgagcggatgcaggagagcaggttaatggttgggaagaagacataagaagcaagtcttctggaaaaagatatttgccctttcattcattcatttgaatttaccgagcacttcctatgtgtcttagttcaacctgctataacaaaaatgccttagatagggtggcttaaacaacagaaatttatttctcacatttctggaggctgggaagtccaagctcagggcgccaacagactcagtatctggtgagtgtctgtcatctctctttctgctttgcagacagccactttctagctgaattctcatatggccaagagggacagagagcccgggtctcctcatcttagaaatgaactaatctttatcatgggggccctatctttatgatttcattttaacctaattaattcccaaaggctccacctccaaatgtcattacattggtgataaggccatcaacgtattgatttaggggggacacagacatttgatctatagcactacgcatgcggtagaccttgttttgggtgctggagtactataatatgataaggctcctgccccagtaatggcagcctagcaagagacatctgcaggtaaactactaccatccgtgccatgtggtaagttctttggtggggggatatcagacatctatgggacctcacgtggatgtgtttaattctcaccaggggtggtcagtgaaggcttcctggagcacgtagcatttgaactggccctgaaggggataggacaggtaccagcagccagaggagaaatttctacagtaggatagggaaaatcctgaaggcttcactctcagaacacatcacacccccgcggaattggagagaggaaacagaggagcgagtgggaggagaaagtaggcaggtgcacatgctcacgctcaaaaaaaagataatctgtcggacctgcctgtcctccctgctctcccctgaacttcacgggctgggtagacgagagctggaacaaaggactttgagccgcggtgttcgctgttgtccactagaggttgtgatgacaccgaaggaatcttctcagaagggagcgaggcccagctgctgagcacagacagcatcacacaaccctgggtaaacactgctttagtggatttgcatgtttgcataatcctctggttactgtagttccttagaagcatccctttggtggctgtgacaagagggagcagggcagggaataggactgctttgaggaaagggtaaaagtatggtgagttgggaggaggtcagtggacgcacgagatataatttactagaacatggcaaggactgagtttaagcaatgcaaacagcatttattgagtgttgattttgtgccaagccttataataagtgctttatatagatatgtgcagagaattctcacaatagcccatgagagagatgcagttgttatctgcattgtatggactggggaaactgaggtactgagaggttaagcaatgcctaacatcacaaagggattgaagtccagcctcagatccaggctggtgtcagaatcatgacatcaagtcccactactaccttttatatcctgcattccccaagaccacatgcagattctgatggttcataggaagggatggtgtgtgtttgccagatgcgcatgggatgtgtactcaatgcctaacacagtccctggcacacatagcaagcatttaagtaaagctggtcaaattgaagtgagtcataaggtaaaacaggttacaattttatttataggcaactaattcacaatcattatagttactgagcatttactatatctcaggcacttacgttggttattttaattaattttaacaatatcatttcattttatagatgaggaaaccaaggcttagagaagctgagttatgcataggtaaggtttaaatccttggtgccttccaagctgggtccttctgtatttctaaatgaaatgtgtgagaaagaccgtttcaccattaatgtgcagatagtctggatgggtaagtgcaccaaactccaaacactgacaggacagaaaccaaaaccaaccctcagtagttcccaaaaaagatgaacatagggattattctttccagttgaggaaaggagaagacctcgtaaaagagagtgagcagtccagctggttcattggttgacaccgagattatgtgactgcttgcaatttctcaagtttccaggtcacccaaccattaatggagaactcacattgtataaaattggtttctgtaagcccctaaattcaggacctaacctaaaccatttcctatctatgagtctcaatttttccttctgtaaaatggatcacaataatcactaccacattcatcaagctgtccttacagggctgggatgggacaagagagttaagatgctttgcacataccaagaaatcagtccttgaggaagtaagtgctggcatggaaggctgaagacctcaaacacccccatgtgtttcttcctgggctggttatagccagcattatagcaaatataacactgctgtttgccattgattgtggacctactctgtgccagggggctgtctttgtgcttttcctgtattcacgtatttgatcctcatgtgttcctatcaggtggtatgataaactagattttacagataaggcaactgggtcagaacggtacaagcacttgctcagggtctcatggacaatgagcggtggagtcaggattcaaccccagaacttttgattccaaagcccacgcttgttctaaatactggggcatgaagatgtgggtatcacatagcacagagcaaaatggaaatggagagctgatgcaagcctggagatcaaggtggtttgacaggactccaagaggagagatgctttctcatccagtggcaaatgccaggtgtcccaagtcagctttctgagacagaaaacagtttatcccagcctctttcatacctactttgatggcttgtgcgtgagccttattctcatcttactcatgctattcctgcagcctggactgtcatcctagaggagcgcatggctggttgtgtagagaggactaaatcaagttcccaactggctgattttaacagtatgatcttgagctatttactttagttctctaggcctgttttggcctgatatataaaatgagaggattagatttacattacaagattgttaagactcgtcaatatatgtgcatattcatagctcattgcaagcactcaataaaaatttgccattattgctctactattaacctggtaaacttctattcatccttcagaacccagtcctaattctccttttctgtgaagtcttctcttgcttctctcctgtctatgccaattatgaatgatcctcttgaccccttatcacattttatccctctactatgggtaattcatacactgataatgcctgagttgccaatttacataactccctccccctaaacaatgaactcttagaaaacctcaactgaatcttactcattcatatgccccttagcctgtatctaatcaggtataaattctcaacccattatgttaaatgacttttcctcttaatcttagttttggggaggtgaagttagagtcctgacatctgaatttaattcctgactctcctatcctgtgtggtcttaggcagcctgtataaaccttgattttttatctgaaaaatgggaataataatagtgtccaacctcataggattgctgtagaggaaaaccaatgagataatagatgtggaatcactaagtaactctacaaaaaaggaggaagagaaagaaaaattaaaaagtgggaggagagaaatacactttgtaaagagaaaagaaaaaacctttgtgcaaacacaaaaccacaagataggccattcatcgggtcctcactaaagccatctttctttccaaaggaaatattggatgcaattgtttgccctgtgcctaagctcatttcaaagcagaaaccttctggacatcctactgcttattgttgaatctgccttctcttaggtctctggcagctgcaaaaacagcaaatgcccagctgaaaactgggacagtatagcaaagtgaataaaaacccaggctctagagtcagagcagcctgggtttcagtctgttgcttcttattagatgtgtatccttagtcaagccactttgtcaccttgagctggcaccgggccttgcataggagtgagggtctatgatctgcccacttctcagggataatatgatatgggagagaggttgtatagttagagtaggcctccttggtgtctgtaatattaatcagattctagcagttatttgggattcttatctgcctcaatcctctccctgatattttcattttattgaggaaagagacccagagacaagaaagggcttactcaaagtcccaactgtgagtggcagagccaggacttgaacccctcactcatgtcttctgactcccatgctaaagtgacttccacctactttcaagaaaaatggaatccctatccctctcaagtttatgtcctgagacccaaggagtgtggcaatggaagttttaagggtatctgttttcagtaaaccactggcgtctattacccacatgggacatttacattatgtggccatggaagactgactgcatgaaagaggctttggtagaagtggaaatcaagccatagctccctcctctgctgacttggcacttgaatcttcaaggcaccagcagataagcttgcaccggggaatggtgccatccaagcatctggcttgagtcaagcaagcaagagttaaatgaagaggctcaaggagacccaaggcccaggctaggtatccctcctaggcttcctcactctcaccatgggtcatggatagtggctgattgagaaacccactggggatctgggatgtggagagcagggaaggattgagtgaggcatagctaatgtagttggtgccagcccggagcaagtagtagggactggtgatgttttggggctggagattagaacaaggtaggtggatacagtatagcacctggggtctggagctcaggacaagtcttagtgggtataagcctctgggtgtcagtttccttgtctggtctcacctattcccagtttagcttagtgtcataaattggtgagttcacattgccaaaatggaatgggctcttcaaagccgtacaccataataaaaaagacacagaccctggagtccaagagatatgggttcaaacctaatgctgtgatcttgaacaagtcacttaactctgagatgatgggagtgggtggtagtgatgaggatgaagaggggaattatgagttgctgttgttactgatggaccgagctgattctcaggtcagcgatggcttccaagagaggaaatagtatattctaatgtgatttttgtggtatagtgctatggttggaatatttatgtcccctcccccgacaccaatgtataggttgaaatccaacccctctgctgatggtattagcagtggggctttggggaattgattaggtcatgaaagtagaggtcccatgaatgcaataggtgctcttaaaaaaagaggcttgaggccaggtgtggagactcgtgcctgtaatcccagcagttgggaggctgaggcaggaggatcacttgaggccaggagctctagaccagcctgggcaacatggcaaaaccccatctgtacaaaaaattctaaaaattagccaggtgtggtggcatatgcctgtagtcccagctactcaagaggctgagatggggggatccactgcagcccaggagtccaaggctgcagtgagctatgactgcaccactgcactctagcctgagtgacagagcaagaccttgtatttaaaaaacaacaaatggagagacacaccttacccctttcaccatgagaggtagaaatgttgaaacaagaagctgtgatgtataagaaacaggctctcaccagaccctgaatctgccagcacattgatcttggacttcccagtctccagaactgtgaggaataatgtccagttgcttataagctacccagtttatggtattttgttgtagaagccaaaaagggtctaaggcatttagaacaaagactcattcaggatagctgaagaataagaaggtttgctctaaggacactgcaaatattgagccaagaacattccaggactctctccacttctctcttgcatgcatctgcttctccccacgcatctgttcattctggcttcctctctattgcctaactcctctgctcactcaccatagatctctcatcacctccacttacccattcgctattatggcttctccagcataatcaccacatgtgcactctctaatatggtagccatgaaccacatgtagatatttaaatttaaattaattaagatcagattgaattaaaaattgagttcctcagtcctactagcgacgtttcaagtgcccagtagctatgtgtggctcatggccgccatattggacagcatggagagagcacaaatgatttctgcccagtcctttgtactgggcaactgggcaataggttggttcttcatacttaatccagtcatctctaactggtatgggaagcatgccatgtgacacaaaaccataccttgggatacagcaatcgccactgatggtgtctcacacactttcactgctggccttgatagctgcttctcaattcttctcatttttaggatgtggctctgcaacccttttgccagttaagacacatattcatcaagatgtggcctgtctgataatcacatctgagaaaactgggaagaatcctatcatcattgtaactatctgttgacttgcctccctccgtgctgtacaatgaaattttcggggttaggagttgacttttattatctctctattcttagctattcagttgaataaatgagtgaatggatgaatcaatgaatgaatgatatgcagtcttcagctatgactcaaaagtgtttggacatagaacacaaaagtctttgcaaaaaatgtgcagtcttcacattatttgggtaaatgacttaggaaaaaataatttagggtaggagttgtgggtgatagagagctagaaaagaggagcctcataaactggtgtatttagacatttaaaagtgatccaggcattgaaaatcaggttggagtggaaaatgaagagaagcctcaaggtggggtcccaggagctctccccttttcccatgagagattcatctggaatgatgacagtggatttaagagcaataagggaggttggtaggaacacagaatgtggctccatgcatggttttggtaaccatttttctacaaagttttaatattatggaaacagggagagatgtttagaacaatgtactcagagtgagcattctgaatgggggactcagcacaggattaggactgaggtaggactgactgtggatccccactctgccaattctgtgttgtgtcatgctggggcaagtcactgaatctcctcaagcctcagtttccgtctgcaaaatgagaatagaattcttcccttgcccctctctgcagggtggatagagagaatgcaatgcatgtcactactatcctgcacaactccagagggagctatttatactgcagtgtatgtgaatggtacccctggaattaagcagtatacaacctatgctgccatatgtggcagccctgaatatggaagtatgccaccaaactatgaatcaatttgcagaggaagaaggacagagctcccaagacttttcattccctaaggacttctgatcaggcctccaccttctatgcccccttttaaagcaggtttaacagagtggaaagctaacttggggccaaccaccttggaaattaatgtaaaatatgtggaatcaagcctagttttccagggcttcaggaaaggaaatttgcataatttatggcataagtaaaaaatgatatgccaggttaatttgcatactttaacttcagttggggttaaaaacaaagtttttgttgttgttgctatttgtagttgtggcttttaaagaaagcctctcttgttaatccgactgtgtaagcttgagtaaattacttaacctctctaggcctcgatttcctcaactgtgaaatgaaaatgataaatggacttacatcctgggattgtggtgaggagttatgaggtgactctgtaaaacttgtagaatagtggctggtacgtagcagaagttcaataattatacagtatatgtaatatataataacatattatatcattatcattaagtatgcaatgtatcttgtccacttgatattacaagaaattctaaaaaatgcatatcattgtgtacccacatgaagttattttgagctcaggacctagaattgtgctagaacacagcaagagctcagtcgtgagacgcatggctgccctacaatgaatgcattattatcattattaatcactgccccataggtgcatgtgtttgaaagcctttctcccctctagactgaggtccctccaaggcaggcactgttttatctccctcccaatccccacctctcaacactacatctcccagatagtagaaactcaataagtgcagacatgtcgaatgaataaatgctgaagtgttattgttcttaattagtatgcaagaaatgattcttattagcatgcatatgaatgaatggctgtcttccttgcagactagaaactcctcacgtctaggtcaccaatatttggctcagtgcttggcgtatcagatagtcagcaggtgctcatttggtgtatgatggtgcttaagacctcagaatttaaggtccaaggcctgactctgcatcccagctttatcatttactggctgcataactttggcaagatatttgtgctttatggaaatagcatgtgcaaggaaaataactaactgtacctttttcattgagttgatgtgagacaaaaatcaggaatttttgatcaagagcttagcacagtccctgacacacaaattaggtacccaatatagatactactgtgaataaatgaatgcatggcctttcccaagtgtcttgatacaggaaaggggccctggtgtataataaccagctagaacagaatttacaattttatgatccccatagagaaaacattctgtgggaattcaacgaggagcattgactttacaacaaccacatctatgcacaccttcccaatttaaggtatgttattatctcatttgataaaatggaagttccaagcagaaggcaggggtccaagtgagtaaatccatcattctctggctgttgttttataatcaaattttatctcagatcagccataaaaccctagaggaggcaccacatgggcgtggcctgtctgccgggagcctttccatctgtgaatgagtgacgtcaggagcaacttcttagcaaggggcttccagacaacagtgcttgtgtctccaccagactccttccctgtttctaaagaaagcagacccctgggaaggctgagaaggaaacaaactcctataatgcactagaatccttattaatggcttcatttacagaatcttgcttaattattagcagaaccttcaaaggtgccttacagccatttgattatacataaagaagctgaggtcagatggctaagcagtgctggagttgtgactcttttattctttcatccaagacctactttctctttatttcagacattctactctgtaccaatcacttgataagtactagggatacagagagaaacaaaacatatccttgccctcaagaacttatctaaccattcttcaaactcaggtaggaccaagttcttttcttctgtcttctcctcacttctacgttgtcctgatgacttccgggcagggggcaactttctccaagggaccagggttgggagccatgaatttctgggaccactccctatagccctagttgctattgaaacaaagcaagctcgtttgatcttccttaacttcaacaagaaaaaaaaatctagttgatgttcctttaatgggtgaaataaatgtgtcactttaagagaacctccaataaccatcccagacttcacagaggcagaggagaactccaacggggcctgctgagagcgacgttgctgccttcaattattgcaacaatatgttggcatttccttcttttgtgaatgtgggaaaatatatcctgagcagaactgcagagaattatatagatgcagctgagcatgtgtatagatataaataatatgcacactatttccataaagcataaacttggacaatcagttaatgaggtttggccagaaacaaattaattcctttgggtcctggggtagttttattctaagtaataataaaaataaatagtcatttcttatgcttagcacgtggcaaaggatatccattattgcatttgattgtcaaaaacaactccgaggacctagtactatggaaaattacttctgtttttcagcaaactgagggtcagagaaactccaccatggaacagtgccttggtttttatttatcctgacattgacattttggaagagaacagacccattactttatagaatgaccctcaatttgggcatatagacttttgattcttacaaaatgtcagcatgcagcccatattggcctatcacttgcctttctcctttttgggtgtctttgctatgattgaaacaaggcctagaattcccccaagtcaggctgtcttcactggttccctctaccccagtgtctagtaccaagcaagggtgcccctctaccccacttctgggatccctaaccagatgcctgcctccctctccaccccacttctgccacaatgcttccacggcaccaggctggtacccttgctatagtaacgagcctgctctagtcttagtatttgtttatgcatctctctttcccactaggccatgggaaattcagaatctgattcactgattcaaccccaagaagcaaatatttaataaatgtctactttgtgggctctgctgtaggtgctggaacaaaaactaatagtgccagccctcaagaaatgtatactccctgtgatctttcattcatttactggcccaaaacattcattcatttattcaataaatattcattaatattttgtgtgctgggctgcataccccaaagcatgcggatcattcaatgtttgcataatggggtagaaacaatggtctactcctacaataaaagaaaaaaaagtttaggcttattaatctctgatagaggccagctgtggtggctcacgcctgtaatcccagcactttgggaggctaagaaggcaggtggatcacctgaggtcaggagttcgagaccagcctggacaacctggtgaaacctcatttctactaaaaatacaaaaattagccaggcatgaaggcatatggctgtagtcccagctacttgggaggctgaatcaggagaattgcttgaacccaggtggcagaggctgcagggagctgagatcgctccactgcactccagcctgagcaacagagcaagactctgtccaaacaaaacaaaacaaaacaaatctgtgatagtaaacaagattaagggcttccaatgaacttcagacattctaatgcacactatgtatgtgaaggggttaaaaagagagctgggggattctgagagcatctagaatctcaaagagaatgggaatccctctgtcacactgcccttgggggcaccagccacagccagacaccttgatctgacatataatttctcagcatgaattaccagaaagaccacccagtgagagtcagagacctgagttctggagatgacacggttgccaaaaatatgctgtgtgaccttgggcccatttctgtccctctctggtctttagtttctccatctctaaatttagtggcctgggctgaatcatagtttccaaaatggactatgagttaaaatcacatgaagagcttttaaagacccagaaacccagctatacccctgcctactgagtcggacccatgattgagctatacatgctgccttctggatttttctgaggccatcagtaaacttcacctggatgattcgacccccaagccatgaccttttatgattcctttgttcatgataattatgtccaccatttatatgccaggcatatgctaaaccctttactcacatgatctcatttaagccacatatgagaccagtggggtggggcctgatacttccattttacagcaggaaccactgaggcttggagaggttaagcagttctctcaagatcacacagctagtaagatcctgcatgcatatctgtgtctatgtgactttaaaagaatttgccacctctctgtagtacgaataggggtgggaatctactcttagcccaccatattccctccccagaggtagccctgttctcctgcctcctctattccctgaaaatctagttaactcttttaataagccaaataaatgtgccctgtgaagtgtgtgatcgatcacaccctggctgcccatgaaccaagcacaggtttgccgcacaccggggacagcctccctgacatgaattattgctaccatcagccctcctttccgctcctacacttgcaggggaacggctgagccagggacctgtggacactcaggattcaactctgggcttggccagagataagtccttagagtttggggcatttgaacaactgacaagaagccagcatggccagaatatcctgaacagagaaggaagtgggcaaatgaagttaagagaaagtattaaagaaaagcaatgattcagttgttatacttgttagagcataataaagcaaactttattcaggaccaccacattgatggggaccactgcaatgggattttgcagtgggggagattgggctaactccaaatataaatgggaaagttggaatttatagccaaggtgcagagtaggggtggggaggttagtggatggaaaactactgaaaggaaacatcaggggtaagggagattctcctaaatccacctaacaggattcttgctgaaggcacaccagcatgatcagacatcacctggagatggtggaggatgagggacctgatcagatatggaaggttatcagatatccagagcatagggttcttgctaaagtgactagcaggattctttgctaaaactggattccataaagaagtgcacaattggcctagaagaaggttcaggagcctgattaaagtttgatcaagcagagaatcattgtcagtggccaggcccagatcctatagggcagggaggacttgctgagaggtgttgggagtttattctcagctgtgcttaggagcacgggaggggatttttgggttggataatgctgtctatgatgtgaaaatgggagcattaaagacaaaagaggaatcatttaggaggtcctcacagataggacttgaaggagttaattctacctcacacctcccagcttaagatagggtcacctcttctagcctctccgctaaggttagggacaatttgtgtattagtttgttttcatgctgctatgaagaactacctgagactggttaaattataaaggaaagaggtaattgactcacagttctgcatggctgggaagacctcagaaaacctacaatgaaggcagaaggggaagcaaacatgtccttcttcacatggtggcaggagagagaagtgccaagtgaagggggaaaagccccttctcaggccttgtgagaactcactcactatcacgagaacagcatgggggaaccacccccatgatctaatcacctcccacgagatccctctcccaacacgtggggattacaatttgccttacaattcaagatgagatttgggtggggaaaatttcattccaccaagcccactgctcctggtgcaatttctcttcaattgcaatgggagggaggctgatgctctgcacttactaaaacatccacaggattcccagcctttgaccctttggctgtgtctaaaacctccaactcatctgcagacttgccgtcttaaacatggctgggtgctttgaaagattttctctgttgctcccccatagtgtctagaatacagaaaaagcagcagagaggagaggaaaagaatataaatttgggcaaatgatgattaaatccacccctccccgcctcccaaaccccgatcagactgtacagaaagaatcttatatatattatcactggctctcagtttaatgtagggccaacattgctgggtaaattaaacaacatttataatatagctgaactataaaaatgtgcttggggcagaaattagacataccaagctttttccagcaaaagacatttttacaaatgcatgagaacctgaaccaatttggaagccctgtcattttgatttaaagccggggaagtggggctgatccctagagaggagaaacaataatccaggtgagaggagattttaaaattctggtcctcattactgacctaacttggactcaaaatgtatcatgtagagaagagagttgacccataactgagaactgggacccttccttcttcacctgcataaccagcaaatctcatatgatttccacatgtaccctcttccagggagccttccctgcctgtctcagctgagttaggggcatcgcattggagtacccatatccactttgttttagttaactattgttgtgtaacaaaccatccctgaaattcagtggcttaaaataacaaatatttactattatctcacatgattctgtggtttgactgagtgcagcttggagattcttctgctcagcatggtgttgaaaagagccaaatcatctctgagcctccaaggggttcaactgcatgtctggtagcttgagctgcttgtcacccgagcatgtaagttttccctcatgtgacttggccttctcccaccatgggagctggattccaagagagagtgtcctaagagcaaaagtgcaaagtgaagctctctaaacatgacttggcagccatctataacctaccactcccttgtactaagtcatgatatagtgctgttcccatgtactgagcgggtactatgctaggtattcggcactctgtactccatcattggtttatgtctgtgtctctttgcacaaaggaacccttgtctaattcatttctgcaacgaaggatgtgcagttagttcaggttcaacagaaaagccatagctctaagtgttcacgccaagtgtggtcactcttaacccgggagattatggtgagagaattcaggaatctaagggccagcatcagtattcttttatagtaccagcagtaaaaataatagcagtagtcataatgatgattaatagtagtaggaagtattaacaatagtataatttctactgctctagcattaatacatgtaattctgccttacacttaagaggaatttgaccacttacaaaataatttttttccgttaccttactttgctattcaacaactttgtgaaatggcccaggaggatttttgttataagtcatagtttataaatgaggaaactgagtctgggaaggaacagaaacttgtcaatagtcaattaaaattgatattgtcaagtacctactatttgccctctacaccaatgacttaatttcctccttgcagcaatgttgtgaggtagataccattattgccaccatttcacagatgaggaaactgaagctcagagaggcgaagtccttgacttgtccgggattttatgtttcctggctgggatttgcatctgaatcagtctaactcttgagtcaaagactctttccacaatgctacacttaattcctcccagattaccattttctaaattactttgagctgagaaaacattcacataaaaatacagtcaatcctcccctctgtatctgagagcttctcatctgagtattcaaccagctgtggattgaaaatattctttaaaaacaatgaaaataacaatacaatgatagaaaataatacaaacttaaaatttaaaaaccaatatactataacaactatttacgtagcatttatattctattaggtattataaataatttagagatgatttaaattgtatgagatgatgtgcataagttgtacgcaaatactactccattttctataaggaacttgagcatccgtggatcttggcatcctgggggtcctggaacgagtctcacatggatactggcagacgactgtaatatgaaaaatcagaatgagggactcttccatgaaaaacttccaccaggtgcggtggctcacgccggtaatcccagcactttgggaggccgaggcgggcgggtcacgaggtcaggagatcgagaccatcctggctaagatggtgaaaccccatctctactaaaaatacaaaaaattagctgggcgtggtggcgggcacctgtggtcccagttactcgggaggctgaggcaggagaatggcctgaacccgggaggcggagcttgcagtgagccaagatggcgccactgcactccagcctgggcgacagagcaagactgtgtctaaaaaaaaaaaagaagaaagaaaagaaaaaagaaaagaaaagaaaaacttccaccagttttaaagcccgctttgaccatttggaagtttttattcttcacccattgttagttcttggtggtttccacatagctgaggttaccacgaaacaaattttcagataaacaagttgtcatatgtgtaaagttacatgaggttattgagtccaattttcccagggattaactcactttgaagttataaattatgcacttgatgggagcaaagatatatacatatatattttagcacctataaaacccatcaactggtacttttggaggacatactgtactaaaaggcaggatgatgataggttaagcacgctgacttaaaatcaggctgcctgagttcaaatcccatctctgccacttatctcaggcaaattatttcatctctctgtgtctcagttttctcatctttaacaggaatttataatagtaccaatttcacagggttgtggaggagattaagtctatagttggccttggttcatgtgctcatctttgaacaagtcgctgaggctggaaccatgtaggaccctgattggccagccctgacctcccccaacacatggactgaaagagagaggtggggacttgccaaaggaatgtcaggagatgttcgccaagagaaaagtcacagagaagtccagcatgttaaggaactaagagttttctttttatttttttcctgccatgtctcaatcaatatctgaaagactcataaaggaactgagtgtgtgctaataataaaatgacccaattgtgaattaagcagatatgtttctctccagcagggttaacaaagtggcttgcatccagacccaacactgccatttactaccttaccttctgcaggagaaagcatggaaagtgtgcagaaaaagatacggggtgtggcaagacagaggcatgtcagtttagcagtgacttgtcattggttgtaaaacactatcctataaatgtaggatgtttgagcaataggtccatgccaggtctctctaagaggcaaacatttaagcaacaacctcttgtttaatgagaataaagaaaatctgccacccagaaatagcctttgacccagcaatcccattactgggtatacattcaaaggaatataaatcattctattataaaaatacatgcatgtgtatgctcaatgcagcactattcacaatagcaaagacatggaatcaacctaaatgcccatcagtgatagactggataaagaaaatgtggtacatatacaccatggaatactatgcagccataaaaaggaatgcaatcatgtcctttccagggacatggatggagctggaaggcattatcctcagcaaactaatgcagaaacagaaaaccaaatactgcatgctctcacttgtaagtgggagctgaattatgagaacacatggacacatggtggagaacaaaacacactggggcctgttggagggttggggggtgggaggagggagagcatcaggaagaatagttaatgaatgctgggcttaatatctaggtgacaggatgatctgtgcagcaaaccaccatggcacatgtttacctatgtaacaaacctgtacatcctgcacatgtatccctgaacttaaaataaaagttggaaataagaaataatttgccatcaactaagtcctttcccttctctgagcttcagtttcctaatctgcaaaatgagcaagttgtaccatctggcctcacaggacacttccagtccttgtgttcaagtgattgtgactaaatttaaatgtctttaatgacagcttgaaagtcaggagtgagggcacatccactaactcactgaatgatattaagcaagtcactccatccatccatccatccatccatccatccatccatccatccactcattctcccctgtccatccattcatcaatgcatccagttatctgtccatccatctacccacctcttcatccatccaaccgtccattcatcctttcatccattcatctgttcatcacatcctgtccatcaatttatcaatgcatccttttatctgtccactcatccacctgttgatgaatccattccttcatctgtccactaatccatccttccatctctccatcaacctgtccattcatcaacccatcctatgcaaagccattttaagaccttggtttgatctaagcagtattattctggagtctcacactcacgtcatagcatatacatttaaagaattcttattgtaacatttaagaagaagtattaaagttatgtttttgaaactatattgttaccagtaactctctcaatttacatatacctgtagtttcttgaaaatcatcaagcatactcaggaattcttgtgaaatgagactctaactcatcaacttttttcaaatataatgaaacttttatgaacactaaatttaaaaaacactgaggttgatataacggtatgttgtggaggcatttaatttaagcctttattaattttgcttttgcagttttcttttactattttggagccgatatattactttcagctctcaggcattttcatgggctcttaaaaagcttgtaggcctcagggcctaatgggtaaaataggcccatttccaaagtcttttaacatccctcctgcatttcccagatcctaattggatgaagacagacagattatgcaaaaggcctatctggtcaacccaagataataaaatagatgtgtaaaggaaacatacatgaagcatcaacctcacactaaggaaactgcttcacgtttgccctccacccctttaggtattcctgtcctgaatagaaacaataattctgggcagatgcggggtgaagataaggatgatttcaagggttcactgtaaatcgtaatgagtacctactctagcagggagtattttgattgctttttgaaatgtgaaatcgcagatttatctcctgtgatcacattgggaacattttttttcctatataaaaagaggtttcaagaagtgctgaaaggtttaggataatgaaggcaaattacttttacaacagcagggaattgtgagcagtttgtgtgtctttgaacatgggaaaataagagaattctccagggagaaaaactcccagtttgtcactggaaaaaattcgtgtgagacaaatatggcttaatgcttcagcatatatatgaactggagcccttggtgaatatcctagcctgtctcccttttttaatgatgaagcatgttccacacagggagtggaggtaacatactcaagatcacaaggcaagtttgtgcctagacagaccaatggctgaccctggcccaatgtggttctgctatcacatggtgtgccttgtcctaaaatagtggaaaatgcataaatgagaacggtatgcttttttacaatttgctttttttctttattagacatttttgaacatttgggagatgtgttgagaaagttaattaacccatcctcatcccactgcaccaaggaatcctctgttaacagcctgtgcaaatcttttctttcttttgttacaattttgaaaagcaattttctctttatgtttctatatgcttcttgagtctccatgatatacagacttcccatggcattcaattctgctcaatcgtctgttgctattggaccaaattcttccaggaataattaccatgctggagttcatggtgacgtgtatgcagtacactcatgttgggtatctcctggatatcaggaactgtgctagttaatgagggaaagaagttaaccagaatggaatcactgcctgcaagagacttagaggctggggggaggttctgtgtataaacaattttgacaaagagcaatgtgtcctgtgatagggataagacacagaagtccaggaatgcactgacccagactgggagtcaagggaggcttcctggaggagatgatccctcctagatcccaaaggatgagtaaaacttggcaatgtaaagatgagagagaaaggcattgcaagctcaggaaagagcaagctcaaggcttgtaggcaagaactttggggctgaaagcaaccttacatgccaccatactcccataattcctatgtcacagatgggaaaatgaagatctttttgaagcccttggtgccattacacaagatagcacattctgttgttctttttggcctttacaaaagcaaacgttatttgcagtgggatgcaaatggaagacaatggtattgtctagcatgattatcctgcagatctttgttataactagggcatcctgaagttaagaagatgtagattaaatgtgtgcatggagtgctatccttacccctgaattcagaaagcctggcgctacagtcactgggtggcaagattggattgcaggtcaactgtttgtgatccactgtaactttaatcctggccgagctgatgacattttggaatcagcaatgaatcaaccattggacataatatgcactaggctcttagaaaagagttgagggatcatggggaagagatgttcctggtagtgtaggaaatagaacacaattgtcaagagcttgcactctggacttgtacctaccttgatttgaatcccagctcctccacttacaagctgtgcaaacaaagcaagcaactgcatttctctgtctcctcacctgtcaaatgggagctggaatagctcccacctggagggactttgtgtagatacaaaagcatgtaaagatcttacttaagtgttcagcatatcctaagtgcccagcaaatggtgtagttcgaattatcttattttaatccaaaccaagttccctcagcttccagaactggttggggtcagctttatccactgacatgttccttttaataacagtttttgctggacaggacataaagaaatagaaagatgctctgtgctgcaaagcctcccaggcacaactgggaatgactcagtgtggggagttattttggttcactcttttgtctgctctgctctggttgttcagataactggactttgcctgactttgcaagaccagccagactgggcttacctgacgtgccacctcaaactctcaagctatctttgatacactgccaatgagttaaatattccttgtatgataaagcaaagagggggtgatgaaagtgtggtaaaactcttcagagtattaggaattatatagtgacttaaaagcccagcttggaaagtcagaggaagcttagttctcatttcagcctcgccactgcctacctatgtgaccttggtcttaccagcacctgtctcctaatctcagtttagtcatttcgaaaatgggggtactcatgcctgtctcattaggttatcatgaagattaaatgagatcataatatgtaaagtgtttggcactgtgcttggaatgtagtaagcactcaatatattctagatattctattatgttgtatttattcacttatttagcaaaaagaaatatgtaaaaattatcactatgtgtcaagccctggggtggaagctgatgatacagtgacaaaatggatgtggtctccatgctcaatctatcacagaagaaagacaataagtaagttaatatgtgtgtgtatgtatacgtatgtgtatgtatgtgtgtgtgtgtatatgtatagtgtgtatgtacatatatatagtgtgtgtatatatatatatagtttgtgtgtgtgtgtgtgattacaaataggaataaatgctgtgaaagcatcaatcagggtgctgagatcaggtggtcatggaaggcttctatgaggcattgacctttaaactaagatctgatggatgaatagggagttatcaggccaagagcaaaggaaacagcatatgcaaagccccaaggaaggaatgagtgatatagttttgatctgtgtccctgcccaaatctcatgtcaaattgtaatccccaatgttggaaattgagttggtgggaggagatttgatcatgggggtggtccttcatgaatagtttagcaccatcttcttggtactgttctcatgatagtgagtgagttctcatgatatctggttgtttaaaagcatgtggcacctcccctttctcttcttgctcctgctgtggccatgtaagatgtgcctgcttccccttcaccttccaccagttttgtaagttttctgagacctccccagaaggagaagccactatgcttcctatacagcctgcagaaccatgagccaattaagcctcttttctatataaattacccagtctcaggtatttttgtatagcagtgcaagaacgccctaatacaatgatctcactctgtctgagtaagaactaaggccaatgtagctggagcatggcaaatgagggcaagcctgctcagaaatggggtggaagacaaagtcaggctccagaacacacacagccttgcagcaaaatttggaggcaacttaagaacagtgggaaggaagccactgagaggtgttaagcagaggattgtgtgatgggtctgagcttcaattttcaaaactcactttgactgctgggtggagaatgaatggtagggaaagaccaggcagaaagctggactcatctcagtgaggcagactggtggtttggacttgagtggaccctatgggtacagggagaagcaacaggttcaaggtctattttgaagttaaagtctatagacttgctgatagataaaatgtggggaaatgggagaaaatagattcaaggacgtctcccaggttactgcttgagtgactggctggatcagatggtacctttgccgcaatagggaaggctttagagagtaaacaagatcagttgtaaggctcttgcaacactaacgttgaatggaaaatccctattgtcagcaacacagtgcatagggcatgtggatgcatcttgtttgctgatacattttagagagatgcatgtagatagttttaggtatagctacacccacttccatacagacactacttctttcacatcatcttattttatttccttcaagccactcaccacaatcagaattatttgttttttttttcttgttatttatttcttttcattttatctctccgactagaatggaaggtccatgattgtgaggcacttactatcttgttccctattgattcccagcaactaagcctggttctggcacatagtaggagctccataaatgctcattgaaaacaaaattttttcacattgctacgtgtacatttaccttctattgcatgacaggtgttcagtttcacataactaaaatggccaagtgggttttcgcaggttggggaaagcccgagcctggtcttactgggtgagtaagtaacattgtgcatacattgtcatccttcccaggaggagagaactgcaactctgctgaggagacagacaggaggggtcctggtatagtgacaaatgaaaggcatgagctttctattatggaaatggggtggctggtggccttccaggaagactcaacaatgttgattgactgtaggaagagttaataactactcccagcccagtcaactgggctcagttgctaagcaactacctccccagggttatataatatgtaagagaaacacttttttttctaaatggaacacaggcttccttcctaggtgacagagacttttcaccttgatctttccaatctccagtagacttgggtgacttagacatgcgagtggcctttgggttgctttcaagctgctaccaaagagaatgccgccatccaataaaggatggatttagagaaaggggtaaatgggcaatctgtgtagcttcctttacttgcatggaattcctaggcaaccctggcatggtcgtctctctctgtggattctctagagggctttggtgacaccagatctccctgaagatttgaccaaacttatagatggactggggcaaaaggagaagctactggtctacctagggttttcttaactcatgcaattatccatctctttgctctttgagactacaaatgtgtacaaatcagacacaactgagttcaaatcttggcttccactgggcaagttatttaatcatgctgagcctctggttttgcttctgtgaaacagaggtgatcagaatgataacaattatcatgatgatgacaatgaggctagtcttaaaggcttagcaaggctctggccaatatctaatggataatacatgtaaaagtacttcagaaagtccataaagctatataaatgttgattgtcactgagattatccaaagactgtaagcttagattcagggattcctttgaaaacttgtggtatggacagtcattgcaagagcacagatgttcagagagacaatggggacaacaagcataaaataaaaccaggaagtatcttggttagtttatgctgatatgataccagcatatacacagactgggtaatttataaataatagaaatctgcttctcacagttctagatgctggcattggcaggtttggtgtctggtgagggctgttctctgcttccgggatggtgcctgttgttgcatcttccagagaggatgaacactgtggcctcacatagcaatagacagaatggccaacagggcctcgctagttccctggagcccttttataagggctctgatcccattcatgggggaagaatccttgtgacatttcctttaggacctgtgaagctgagactgctcccggtagacattcccacctcctcctgtctttaataacaaaatcttcacattagctggagatgtggccacctggaatatactgcaattctctgcctcccttgtggttggatgtggccatgtggcatgttctggccaatgggaagctggtgggaatgttcccagtaacttggagagacaactggataagcagagtcattggaaacgtcatgacacatacagcttactaaggacaagtcagagattatcagctctggacaggtctctaaaataatcttctgcccattgagaagatgagaaaattgaggcctaaagaatggaaaaggatggtccaaatcacttacaaattagcaatggagaaaattagcccattaccaatcaccaaccaaccttttgcaccaattactgagttaaagcctatggcgcaaaaatgaagaaccatacccagcgctcaaagaacccagggcctgttgcttagtagggactgaacacagctcccaacttccagctactgtttaccttctgggctaatctttagtctgtttttttcagaatagaaagcctgggagggaaaggtttttctgagaactgatttaacttgtatctattcatccgagagaaaacccagagtttgatgatgttgggagccactttatacaaaatgacaacttaaaggagaggcaaaagtaatctctttaattgcattggttcaatttgtctacctgatgcttttggggagagattaatttaattgattctctcatatgtgaagttccattacctctcgatgcttccagggcatatttatgcagcaaaacttaagcaaagagaagtacatccaggactagaggcaaggattcatttcagactgtcagtgcagctttttagcagtttggtgaattcccttctcctaagttatactctcagcaaatgggtagagtcctctttcagcatgacaagactggaagttgtagattcagttctacaagacttgaggccgaactaaacaaatgaagaggaggaaagggagctgacagctctagagcacctcccatggccagtgagtctcatacatctcatattcaccaccttacatctgtgtttatcaggagtaaggtgcttggctgagcatttcacatgagttggcccgtttaaatctcacaacagccctccaacttgatactgttattttacaggtgaggcactgagactacgtagttaagctactgagcaaagatcacaccaataggaaatggtggggatgggactggaatgtagcactgcttcccaagcattcctgaattcccctccttccttctccctgcctcaaacaacttcctccttctaatgtatatatttccttttaacttcccttctttcttccagtattgaactttggaagtgtgtgtatgatggtgtgtgtatatgtttgtgtgcgtgtatgtgtttgcatgtatgtgtatgtgtgtgtatgcatgtgcatgcctgtgtatgtgtgtttgtgtgcatatgatccatcctttcagtaattttttttgagcactgactatgcaccaggcttggtggttggtgcaagagacaccgcttctgctttcaaggggtgcacaggctgacagcaagtccttctttcttcagtcccacctcaagttagtggacaggacttgtggaatccccaccagccacctccttcccagtatcaccttcctgggctgagatctcactatttctgagctactggagtccctatgtgagaaggggtggaaggagatgaggaacgcaatgtggtgcagtgggcatagcccaggctttggtctcagttaatatgacttggaaagccagcttggccactgctcccagtgtgccatcagccttctcagcctccagccagttgctggatttgtcattttaaaggacttctctcatcatgcctatcccctgattaaacatactctgtgcctctgtccagttccagctttcatcctggggttctgggtaacatatctaacctcactcctacaatcgctctctgcttgaaccacgtggatgactcactatcccccaaacacattccccacctctcagcctttgttcaagctggaccttccatatgacttacctcctccagtcaaaaccccaaccagtcaaaaccccatgcagaatcccagcccaatccaaagactcctccggttcccccaacagggctggttcccccaacaggccttcttgaagccttatgggtccttgcactctttttcctatgtcatctaggttttgctcctcagtgaacttgtcttttctctcagctgaactgtaagctcttcagagagagcatgttttatgcagctcagagcccgagcctctggcagagactggcatacagtagacactcaataaaagttaacgtaattgattaaaatgtctctggaggctgggcacggtggcttacgcctgtaatcccagcactttgggaggctgaggctggtggatcatttgaggtcaggagttcaagaccagcctgaccaacatggtgaaaccctatctctactaaaaatacaaaaatacaaaaatacaaaaaaaaaaaaaaaaaaaaaagaggaaatttgccgggtatggtggcttgtgcctgtaatcccagctactcgggaggctgaggcaggagaacggcttgaacctgggaggcagaggttgcagtgagccaagattgtgccactctactccagcctgggaaacagagcaagactccgtctcaaaaataaaaaataaaaataaaataaaataaaacgtatctggaggcggtagaagggtgggatgttaaaaagcataggctttagcaatgactacttatatttaaagcccatactaccactgcttgtgacaactgccttaatttctctgagccttggttttcttatctttaaaatgagaaaagtaatatctgccttccagggtagttgaagttggtcaaataagctaatacctccaaaaacattttcacagccctggcccagagtaggagaccaatacatagtaactgatattattattattttattatttttctaaaaggaaggcaacagctgagtcagattttttgttgttgtttgtttgtttgtttgcttgagatggagtctggctctgtcgcccaggctggagtgcagtggtgcaatctccgctcactacaatctctgcctcccaggttcacgccattctcctgcctcagcctcccaagtagctgggactacaggtgcccgccatcacgcccggctaatttttttgtatttttagtagagacggggtttcactgtgttagccaggatagtcttgatctcctgatctcgtgatccacctgcctcggcctcccaaagtgctgggattacaggtgtgagccactgcgcccggccaagtcagatttttttattctctctcatgcctgcatctatctgcacatacattcctttaaacaaatggttaaatctctgaatcgtgtaaaagcagaatctattgctagatgatcccataggaaaatgaaaaggtcacttccccatcctcctgagccacaggaaggtacagctgaagcagcacaaaggttctcatgggtcttcataaattcatgatggcacattccctaatagacagtgaaggaggcacgggttgtctatggaatgttcctaacccttgagattgatggatgagagggctacccagcttcctccccaaaactctcccttgaggacactgtcaggcacagaatcctaagctagagcgacaggaaggtgacaggggttaactctgatattcttttttcagtaaacaattcatcaattttatgtcttactttttttcagatgaggttagtggcagaggggagggagaatttaatgatgatgtgggtggaagggcaggtctgctattcaatcacaaccacacaaaaatagaggaaacctttagaagaatgatcagcccctggatgatttagagtattctccactaactgtagtatcgagcttgcataggacgagtcattagtcatcattaactaaagttcaaaagaaataatttaataccttaacactgggctgcaataatttttcctaattgtaatatttagagagcactatttagttttcaaatttgtaacaaagtttccatatattgcagaccacttttatttttctgcttacaccactgaggacagattatcattgcagctcccactggtggagcaattcctagagttgctttggtgagaagcagctccactgcaaatctgtgcctgcaacttagagcttctgcctttgtgtttcattcatgaatcatcagggtgtcagtgtctagaacatctctctaggtcctagaacactgtggagtacaaaagtgtggctccttagacatttgttgaaatgaagctgtcagttgcaagttgctcactttcatctctgtgccatgcacctttgactggaatgtccttagccctctctggacccctccagattgagttagatgaggcctttttgttctctgcatcccagatatgttccttcacgtatagcaccattgggcatgttgtgattgttaactaatagctctatccccctagcctctgagctctctgagatgagggttgtttattgttcacatctttggcaagcagcaaatatatagaaggtgtaggtacaagcttcttgaatggatgagtcaattcatttggatttatcatttgtcacatttctttcctctctgagcctagtcttcctatataaaataaggatgtaacaatcacaggaacacttactaagcacatgctgtatgccaggcatcatcttctcatttaagtcttacaacaactctagaatatggacactttattactccatgctacagttaaaaaaaactgacgttcagagaggtgttggacacgaccagggtcccacagttaaccaggtttggaaccctggtatgtttcactcaagagctcaagacctgaaccatcatatggacctctaagtgaggtgcagaaagggttattttgaacaatgtagaccccttaagagctgaagaagagtaggagcagagagagggagagggtaaggtgatgtttcaacttttatttctggtaatttgccctacatttgatgaggcaagagggttgttactgccatggctttgaatgggggagaaagcttccgaaatgcttccccaagtgtttcaaatctccagacaccctaattctagaacttactctgcaattctagtacccactcctctgtgacctcaggaaagtactcttccattcctacatcttattgctttctcatgtgtactatgaaaatttgattagatactgccattcaatacatagttcttgagtatctacaatgtgccaggtactagagtcatagaaaggtacaatacagacatggtccctcttgggactcttaatccatatgggaagtcagtcatgacacagatgatcatacacataattactaactactattgtgatgggtgcttgaaaataacagtatagagggctttaaaataatagccataccacaaatatagcacttactacatgctagtcatcgttctaggcactttacatccattagctcaatatataatcaaattgaattatgaaacagatattacaaatatcaccccattttacagataaggaagctgaggctagaagaggttaaggagttttcccaacatcacacagctataagtggtataacttaaatccaggcattctgatgccagagcctttgttcttaactaccaagatctattgctgtgagagtatctaatatccatttctaatctagtctggaagtttggtaaggcttccttttttttctgagagtggacagaggtgaagcagtttcctaggtggagagcaggtcgaagagtgttctgccagagggaacgctatatgggaaggctccaggcaggttggagctcatcacatttgccaaagacaggagcagatatgctctaatgagctggatccattttctggaccttctgacagctttttcaagaaacttcacagcaatctgtgcagtggttctgttcactgcccctgcccagctctatctctctttctgataaaagacctcacttcaaacctatgtgacatgtgccagccagaagcccacttggcttgtcatgtgaacagacccatgtcaggtaatcaagagataactgaaccaccagatctggttccctttcatccttgttttcccattcattattcctttccattggtataactggcaaataaatctcaatgtcaaatttaaagagaagagaaactcgctttatgtggcagatttcactgcctcttacttgttcaagaatagggatgcctgtctttggtacagtccatcaacttaaacactgccaattaccaacgccttcctggcattcaaggccctttcaagtctggtgactttttactctccaagattatcttcagtgacgtacatgcatcaggatggtcttctcattgccagtgagtagacatcagttgttactagttctgaattcctcacctaaaatgtgctccccactcctcttctcctcctttgtgtttcagctcacaactgaccttcttcctcaggtttaccttaattgcttatctcacaaagccttgcttcaattcagttttgcaaagctttctaactacaccatgcctgtaactcttttatccctaaactgctgtttctgtaagtgtgagtcctggaccacctacatcagaatcacccagggcaactattaaaaatgtggtttctgattctccatcttaacctctccgcagcaaaatctcggtggtgggggatggggaaagggaaggctgaaattggcattttagcaactcctccaatccaatcacactgctctaactaaatttctttattcttgaattaattgtaattctcccgagagtctcttcaagaatcaatttagcagaatctcttcctcctcaagagaatgaatcttttttttcttttcaagcatttcccagtgactagctagtagtctgtgtaatgatttgagataccaacgctgtccaggccaccattcccactcatgggaaccatcatgtcagaacttcccagtccctccaggtgtccagtttatgctctggaactcatccttcaccctcctgttacagtgatcttcccctaaaagagcctgcaatgtgtcactctcagcatccaataacttggcctctcctatagaataaatgtgcaactccttcactctacaaacataacccttcacaactctgccatatcataaatttccaggcttattcccaccactctaggcaatgcttcactacctgtctttgcaaatacttttagtacaatctggaataacctcttcattctactccctttgaaaattactgcttgcccttgagggcccaaccccaatcgtcccttttctgagaaaatgtccagaaccacctcctttacccccaattcctgctccagagaagtgacagcacctcaccccctatgatccaagagttctgcatagtatataatttttaaaacattgaattaagtgcttactatatgccagccactttgttacatcctttgcatgtcttatcttaactacctttcaaaactcccatgcagtagataccatccccattttgaaaataaggaaactaaaacccagaaaggtaacattccttgtccaaggttacacagctaatgagatgaagagccaggattcaaaaccacagccatctgattaacactaaactgctgccaataacatgagcgacctaaaaatcccaaaaagcacagaatggcccttgtctgtgacgaaacagtgagatggtctagacatccataatatattacctctagcgtagataatcacagtatcctaggaaataaaaaaacagcacccatttgagttgctgtcacataacctagagaaacttgttttaaattaaattatcagagaaagttagatgaactcagagtaactgagctatctctttctggacagaaaattcaaaatggcattgaagtattggacttaaagctaatcttctaggcctgatgaagccacagtgatttattttgaaagctccagggacaatttatttctaatagagatctctggaataacccagtgttttgtgaacctcgacaacgcttattttcttcttaatgcatctaaaattttgtttaaagcaaaaagcataaattcaatattagctttactaggggttggcatatagggtcactcttgccaaaggtagacgttgggacagttatttttctcttatggtgctctttttctgttttgttttgttttgttttcaagtcacttgcacccactataattgttaggagataactgggaaggagaaggcaccacagtattccattcatcttgctttgacaccacaaggcatggtaaccaccttagttagaggcaggatgctgtaaaatgattgtaagctttgcagggagacctcatatattggctttatcaattgttgcttcatcacctgaagcaagacatttagcttccctgaccctcaatttcttcatcaatgaaatcaaatatttatcttacaaagttgttatcaggatcagatgaaataattcacgtaaagtacctggcacatcataagtccttaacaaatgttagctatcatcataacaacacttaaggtgtttattgatatgggtggatttaaatcttccatcttagtatttttttctatttgcccttctgtttttcttcctctattcctcctttccagtcttttttcaaattattctaatattttagaattacattttaatttacctgttggtttttttgctatacatttttgcattttgggtggttgttctaggaattacattatatatccttaacttttcatattctacttaaggttaccactttacatgaaatttagaaaccttgcaattattgaccctttgacccctcatccaccatcctttatgctgtggtcgctgtgtgtaatacatctacataccttataagcccacaggcaatgttataatttttgctttaaatattcatgtgtatttttttttttttttttgagacggagtctcgctctgtcgcccaggctggagtgcagtggcgcgatctcgactcactgcaagctccgcctcccgggttcacgccattctcctgcctcagcctctcgtgtagctgggactacaggcgcgcgccaccatgcccagctaattttttttttttgtatttttagtagagacggggtttcaccgtgttagccaggatggtctcgatctcctgacctcgtgatccgcccgtctcggcctcccaaagtgctgggattacaggcgtgagccactgcgcccggccatattcatgtgtattttaaggaaactgagacaaaacattagttggttatttacattgactcacatactgacaacttccaatgctcctgatttttcctgaagaacttaatttctatttggtgtcattttccttcagcctaaagaatttcctttagcttttctgggtgatagattttcttagttacttttatctgaatatgccgttagtttacttttcattcttgaaagctattttaccttggtatagaaatctattttgaaaaatattttctcttttaaaactttaaagctattagttcttggcttctggcttccataatttatgatgagaaatctatgaggtttcaacttatcatgcatatgcatacaatatgtacacagtttcaaatacatcctgtatatgatatgtttgttttctttagatgttttcaatattttctctttattttaggtttttagtagtttgactatgacatacatagtcatagttttcttcatatttatcctgctggagttggctaactccttgattctgtaaatgtatgtttttcatcaaatttgagaatttttcaactattatatatttaaacatgtttactgccccattctgtttttttctacttcttgactctctctctgtgtgtgtgtgtgtgtgtgtgtgtgtgtgtgtgtgtgtgtgtgtgtgtgtgtgtaatgttttgatatttcccgcaaatccctgggttttattcttcttaatcttttttctttattttcttcagattgaataatttctgttgacctatcttcgagtttatttacactttcctctgtcatcattctgtttttaagctccatcagtgaatatttaattttagatatagttttcaattccagagtttttatactttttacttcattactgatactttctatcttttcattgatttcaactatgtcttcttttagtttattaggcttagttatagttacttccttgacatcttggtctcataatttcaacatctagatcatcatggagtgggtcttagttgatgtcttgtttcctgagcctgtgtcaaatttccctgattcttcatatgtcaaggtattcagggttgtaacccatatgctgccaatactttattgtagaaactttagatttggttacatttctttgaagagtgttgatatttttgtttcagttggcaattgatttagttgggctctagcaaatggatggatgaaaaggagagggaaggaaggaaggatatatggatggatggatggatggatggatggatggatggcagggaggaaggaaaaaagaaagaggaaagaggaagtcaaggaaggagggagggaggagagaaggaaggaagaaagatggatagatggtaggaaaaaaggaaagaaggagggaggagggaagaaaggaagaagtaaggtaggaagaaaaaagatggatatatggatggagagatagatgacaggaagggaaggaaaaaagaaagaggaaggaggaaggggaggaaggaaggagagagggagagaggagagaaggaaggaagcgagggagggagggaagaaggaggaaggaacaaagatgaatagatggatagatggaagaaaggaaaaaagtaggaggaaggaaggaatgaaggaaagaagggagagaggaaggaaggaaagaagggagagaggaaggaaggaaagaaggaggaaatatggatatatgcatgaatggatggcaagaaggaagtaaaaagggagagagggagggaggaaggaaggaagggaggaaggaaggaagaaggatgggtcaatgaaaaaaaatatgtattatgaagctgtaaataccatgcactatgttagcaaaaaatatcatttgtttgtgaaccaaggtgaggaattgggaggatgacacttagtccaaccacctgggaagcctctcagtagagatgaaccatggccctccccctgcccttcaggccagtgcacataccacatcttcacattggttctgatctgagaccatcaggtggagttctgttgggggaaagacaaagcaacaataaaagcaaaagaaaacttttcggtgaactaatcaaaagccttaatcaattctccctgtttccttctctgcccccagagaggagggaaggctcacatgcacaatgagctcattttcctgagtgggttctaataaaggacagaacattaggtttttctctttaagggaacataacgctccttttagaattcattgggatattttggaacacaaataacaacagtggaaggcactcgtgtggtgataatttaatgtaattccgatgtcagtgacacgccacagtggcctagtcagcttccctgggggcggtttcttttgtgttttgcctgggagagtgagtgcgcggacattcatataccagcctggcagccccgtgcacatttcctcttttctcatctccattctcagaatggtttttttattataatccaaaggactcctagggagacaaaagaagttggagatttttccaaactcctaatcagaagagagtccacaagccaaaactagcccacatgcattttcgggtttggcctggaaatattttgtaacactttaaaggatttgttccaacatttaaaatagaagactttgcatggcaattccaatgtcaggcatccctagaaaaatcagaagagttggcaacctgggactcaccctcctgcactccaacaattggctggggtagagtagcagtagcctgccccttaatttggcctgccacgttctcttatatactatggacctatcagctccacttcactcatccgcattttttgccagcctttgtgggcatctgaccctgccaatcctgcccttaagctttggaagcctcaagccctggtcttctccacagactagcctaggtctctctatttcttgaagaagagagctctgggagccaaccgggtctgtactgttgtgatggaaatttccacccaatgaaaggaagaactagttcaagatttcccttttctctttcaaaaggttttgctgtagtacactttcagtcctgccgtttagttgatgcagtttgttggaatgacattgggctgctaatggtgttggccaaactctttgccatttcactgaagatcagtgtcatccagaagcaaggctatggagaagaagcaacccaaccacccacctcaggtcctaggcccagaatataagttctaaaggaaggtagatccagctctgcccacctgcccacactgctactccattttatatgcaactggagctgcaacaatagctctacagagcgttaggctcaaaagataccttacaaataattcagtccagtgtttttttccatcaggagccaatagaaatcaagaaagtgatggtcaggccagatggctttagagcctcccatcccattcaagcatcatcagatatttgttaatagcccattttgtagccaggtgtggtggctcacacctgtaatcccagctactcagcagggtgaggtgagaggatcacttgaggccaagagtttcagaccagcctgggcaacatagccagacctcgtctctaaaaaaaaaaaaaaaaaaaaaaaaatttaaattaaataaaaataaaaattaaaaaaattaaagagactgtttgtgacaagcagaatggtaagcaaaggtagacaaaattcatgcccacccaaaataaatcaaatataaatgaggagaggaatatgggggccattcatttgcataacagggatttcagctagacctgatggctgggaaagatttcccagtgaaataataaaatgtgacggacaagtggaagctaactaggtgaaggggagcaaggacagactattccaaagaggatggcagatttcagaggcctgggatgagagggaacacgcagagtttaaggaattagaagcgggtcaatgggcggagatgagacagggaaatggggaaatttcagaccacacatggcctttcagatcatggcacggggcctggtctttatcataaacagaatgtaaaggttttacagtcccatgaagtttcagccaggaaactccatttttatcttctttctatgttgagattcatgatatgttctcattggaataaaagattctatagctaaaatgagttggaaaccccattgctccaagcaatacttcaagacaaaggacttttttaaaaaaatttttttctgaggcaaggtctcactgtttcacccaggatagagggcagtggcgccatcatggctcactgctgcctcaacttcccaggctcaggtgattctcccacctcagcctcctgagtagctgggaccacaggcatgcgccaccatgcccgcccaatttttgtattttttgtagaaatagggtttcactgtgctgcccaggctggtctcaaactcctgggctccaaggattctcccacctcggcctcccaatgtggtgggattacaggtgtgagccaccacgcctggccaagataagggccttgaaagtagaccctgccccttgagaaagaaggatggcacagtggggagaaagagtgagaagctggagatgagaggaaaagccaaatgtggtccctggagaataagactgcaaatggtggccatgcatcaatcagagtgggattagagtgagaggatggacctcagccttggggtcagaactcccgtgcttgggatgggggttggcaaaaataaagtagaattaataagacatgggctgaaggtccagatgaagacagaagccctgttatcagaaccaaagcccagtgctagatatgtgtgcatccaggagggctgggttctaaatcctggaggatggggatgcttaggctccctacattcctcccactaataatggtcagtatgaatcatgtggctggctgaggtgaggtttaacttagccatatagtcttctccctgacccccaggttttcttttaaagcaaaatacctgcttcatcatggaaacagagtctttgacttaacaatggactattacaattccacatgagagcattagagacctaatacaaggaagcaaggaagtgaattcagcttctggctccagacaccggctgggtggtcctggacatgaacccttaccatgctgggcattcgctttccgacgtgcagagcggaaatactgatgtgttcagtttagcttgaattttgcctttactatggaagctgtcataacacatgcaatctttatctgtttagaggattgtaatccactcatagccatggacattgtcaccccaaaatgcagttcattcacagatcactaacccggggctatccctgcaagttaacaacccctggttacttttatttattttcttccttgacaagaaggattaaaccttcccttctcttcctaacacccagcacacagctggactaggcaaaattcttaaattagagtgtggattttaagaggctgaggcaggaagatggcttgagaccaggaatttgagacaagcctaagcaagaccctgtctttacagaaaatacaaaaattagctgggtgtagtgccgtgcacctgtagtctcacctacttgggaagctgatgtgttaggattgcttgaacttaggaagtctaggctgcagtgaaccgtgatcatgccactgctctccagtttgagcaataaaatgagatcctgtctcttaaaaaaaagaaaaagaaagaaagatcttgagcaaggatggattgggcccacaggacaagcccaacattgtgcaaggcacagggcagtacaaggacttcccaatgatggcctctgtccacacattgcttaataaccagtggcattcatagtagtatttcaagaattcaaagaggtctgccactgcaagagaaactaatgactttggagatcagtgaccttcttgagtaacttgggaaggaaaagctatacagtctaatggttaagaaaaaaaggcattgggataaattttgctttaaacctagctgtgtgtcctagagcagctcacttcacctctctgagcctggtttcttcatctgagaaacggaagcagtgatagttcctgcctcacagagctgtcctgaggattaaagaagtagatgcatgtgaagtatttcatgcagggcccggcacacggaaaagaaccaataaacgtcagctattcttagctacttgcatcctagacccgttttctcagatagaacatttgcaggaacatggattaaaggttatggattccctgatggggaagaagagggaagaaaaaactttaaagtcctgaaggagccagaactatacaaagcaggaatatcatgtggagtattatatataagaaatgctggtcggatctcctgcggaatttcaggaaggaagcagcttgcccagagaaaaggtgtgaacagacagacagcaacaccttgtttttttcagaagcttcaacaaaaggattttggcgccagttggcccagatttggaggggaggaagaaaagagtgggttgcctgcagtcagaaagagactgaaaggagaaggggaaaaaagtagaaaacacagaattatgacttggggaatagacagagtttgcggggatgtttctgggtgggtggtgggcatggcattgatcaaacttataacactgatgaatagaaacatataaatgactacataaaggaatacatttagagtgcctggcatatgacaaaaaaaaatgctcaatgtgatttagtacgtattcattgggcaggcactaagtaagtgtttattgaactaaagaaatgaaagtggtacatactttttaagggaggagaacagaatcgttcaagaaaaatgtttctcagccctgaactttcatcacatgggtggtgcttggttagaagcgaagaccgaattacatgtatcagtaactttgtaatttacttaaatttattgttttaatcatgatgttaactgagatcattgtagagtttatgtttgtcctaagatgtacttcttttttaaaaaattttaggttcactaggtatatgggcttgttacacaggtgttacatgcacaatggtggaggttagactctagtgcacccatcacccaaatattaaacattttacccaataggtaatttctcaaccctcaccccacctcccactcagacatacttctgcatgttcttggtgaggtcctggtcttctttttccttgcttggaaaacttgctggatagatgactcccaccatcttgaaatggcaaaccaaaatgggagaggcgattcgttttgtttccaaaagaaaacagatccctaatggagactcaggaagggatgaaagaaaaaaagaaaaggctcaatccatatcaatccctaagaacactggagagcctagctgtgagaggtaaagagaaaaaagggagcaaaaggaaaccccataaagaagtaaatgaatgaatgaaaagaattccccaggccttcatttcatagactgaaggttgtgcccccagcctgaggtgggtttggatcaagtgctcaatcccagtgacttgtcagggatcctttcagatgtgttcacctctgggaagaagggccattcgcctggggtgagcagggatctgaggaaacgtttagggcatcttgactgatgagctgagccttatctacagagcagtgtgaacagcctgatgtgatgagctcgctttgcaaggcactgaatcatcccagcttctcgctgacagaagcagagcagaggtcccggatgctccttattgcatgacgggagcactaggtgaagccacggaaattggatttgagtgattcccatcttcctctctccctgcccccaaactagagcattctgaccatccagcaagcttaaaggaacagaagcaaagcccagagaggaagaaacagaaaccctgtcagaagcaaagcccagagaggaagaaacagaaaaccagggagagctgggaccttgcgcagtcccacgtggtcagttagtggaggagctggaaatgatctagctctttctgctaaatcagtctttcctgtctcagaacttttcctgagaaatcactcaatccctaaggggacagctgacctgtccccaagtggtggatgtttagtttattgtcctaagaaatgatccagcaggggccgagtgtgatggctcacacctgtaatcccagcactttaggaggctgaggcgggaagatcacttgagatcaggagttcgagaccagcctggccaacatggtaaaactctgtctccactaaaagtacagtaattagctgggtgtagtggtgtgcaactgtaatcccagttaatcaggaggctgaagcaggagaatcatttgaacccgggaggcggaggttgcagtgagccgagattgcgccattgcactccagccttggtgacagagtgagactccatctcaaaaaagaaaaaggaaaagaaaaagaaaaagaaaaagaaatggtccagcaggtaaaagtagtgtccttatgtgaataaaaccaatttggcaatcatcattatcatcatcaaaatggccaaaatttatcagacatcatgctattaatttgtattaaatctgtacaaccacccactaggtcattctcattattgtccccagtttgcatatggaaaatctaaggctttgagaggtaaagtcacttgcttaaggccatataaccaggagggaagtggtagggtttagcctggaccccttgatgtctggtgtcaatgccagagctcttaaccactgggctctcctgcacccctgaggattaaatgggaataactgggatttgaacccaggacttctgactctttagtgctttgcttttttgactaatgatgataacagtaactcactaattatcatctcatttattccacacaatagctttaagtacctgcgtggcaacttgcactcctccaggattacagtgctagtaggtagcagagctgggaccccagaatgccccattcttcccttcccaccaccatagtgacatttccaaacccaacactgactataaccctccaacccttgaaaccaaacccagactcttctttggaacttacaagacatgcacaatcaggtcctggctatcttctgtatcagtgacatcctcccttttttctttcggccacactgatcttcttgtggcttctgccaacacagggcttttgcacctgctgttccctcttcctaaacatttctgtaaaccccttcctgacttttggcctgattaccttctacttctctttcagacctcagtgtaagtgtcacttctgaagacagctctgtctcttcctctggggtatccgtctattagtgggtccacattaatgtgattatttaattaggtaatgttaagtctctgcccatccaatttcaatttctatggccatgagcaagtcccccactctgggcctcactcttccaatctgtaaaatggatgacaaggccccacggttctttcaagatcagcttatatggccccaagtgggcctcgcaaatacaacatgttgtgtgggactcctcctcctcaaggaatttcccctttaggtcctgccatacggcattttctaaaattcccttgccacctgctgcgatggaaggcgaagtgcctggctttctttcatgagagttgaattgaattctgaacgtagaagacacttctgaggctgatgtcgacaagaaatgaacacagacacaggctccctctgcaaacagttcctggagacccttctctgtcctgtcaatctcctgggtgctggagagcagaggtaaattagacacacttcctgccgttgataaacacacagttgagtaggaaaacagatgcaggaatatacacagccatcaggtagagagaaagaaaaacaatgtctcccatttattgaggacatgctttgtgtcaggccagtgctgagcactttataaatacccattcattatccctttgcaaccctaaccaaagccatctgaaccactagttttgtttgtttgttttgtttttttacttttaagttttgggatacatgtgcagaacgtgcaggtttgttacataggtacaatacatgtgccatggtggtttgctgcagctatcaacccgtcatctaggttttaagccccacatgcattaggtacttgtcctaatgctctccctccccttgctccccacctcccaacaggtcctggtatgtaatgttcccctccctgtgtccatgtcttctcatttgaactgctagttttatatatattactgagacttaaagaggtgaagtaggctgggcgtggtggcttacgcctataatcttagcaatttgggaggctgaagtgggtggatcacttgaggtcaggagttcaagaccagcctggtcaacatggtgaaactctgtctctactaaaaatacaaaaattagctgggtgtagtggtgcatgcctgtaaacccagcactttgggaggccaaggcaggtggatcacctgaggtcaggagtttgagaccagcctggccaacatggtgaaactctgtctctactaaaaatacaaaaattagccaggtgtagtggtgcatgcttgtaatcccagctacttgggaggctgaggcaggagaaatcgcttgaacccaggaggtggaggttgcagtgagccaagattgtgccactgcactccagcctaggcaacggaatgagactctgtctcaaaaaaaaagaaaagaaaagaaacgaaaagaaaaaagaaaaaagtaaagtaagcaaagcacctggtccccctgaagagtcataggcttttcctttctatttctttgccttaaatcattccccagccatagccagaaagttctggattcgagtgctggttatgcctttaattggtacatcacttctttaagcctgagctccctccactagcaaagtagaaatagcatcaccttactcacagggcggctgtaatgtttaaataaaacaaatcttgtaaatattcccagttggtcatagaagatgttcgagaaatacaagttttttttttttttttcgctcctggcaaatatcagtaggaaagcaggtaggaagaaaacaaccccacaatgacaaaaatgaacaagattggacaagtctgagccctcttgcctttttattttttttgtttgtttttttacaaaatctgttttatatatagacagtttgaaagaatcaagaaattagaaagtttcactgagcaaattatagtgcttgcttctttattttccatacggactcttgtctcagacttcaagaacctatttgatgtgaatccatctcctgagcccaggaaacctacacaagccagtaaattaaccactttctaagggcatttttaaaaatctgaggccatgagaaaaagaaataataattaaaacaactaagaggagaagttcaaagaggatcattaaagttctgggtatgtgaatagggaagatgtaatctcagcaataaagaggatcatgcaatgcctggtgacagcgatgaaaataaaaagaacagtgtcacagggaagggaacaacacacaccaaggcctgttgagggaggtaggggagggagagtatcaggataaatagctaatgcatgcgggacttaataactaggtgatgggttgacaagcgcaacaaaccaccatgggacacgtttacctatgtaacaaacctgcacatccagcacatgtatcctggaacttaaaataaaataaaaatctgaaaaaagaacagtgtctttccaacagcacaccaggtaggtgaagaggcttctggggtggggatgccagtgagctttgatgggtgaagtaagcctcacaggaagtggagagacgcagatgtgggagtctgatagctccagttagaaccctaggtccaccacctactcacagtgagaccccaggcaagcggctccacctttctgggccacagatgccacagatgccatatctgcaaaatggacatcatcatacattgatcattgaacaaatatttactgatctccggccttgtaccaggcagggtcctggagctacatcaatgaacaagactggcaaaaccctgccagtgaagctgacatttgcatagaattgtaagtcagcatcagtaataacagcgaatctgccattgaccctctcctcctcaattctccccacatccctttgaggcaggcagagcagctgttgtgtccccattgtgcagatgaggagaccgaggcctagtcacacacctagcattgggttgcagggctcctgactctccacttagttgcctgtgtgttagttgcctgtctgtcagttgccttgggtgaagcaggtctcattgccaggtgagatgatgatgagacaggtgctacacaggcttcttcctctggctggaactcatccctatgatgtcactatatgtaaagcctacagaagctgtcacagtcactgtcatatggtcctgcaatcccctgcctgtccctcccccattagattgtgagctcatccatgacaggggccactgggtatccccagagcttagcatggggtttagcacccagtaagcactcaggtagcacatgatgaataaaagaatggatgaattgagagaaggagaaaggaagggggaatgtgcttacatcacacaataaatactgtatgaatggatggatggatggatggatggatggatggatgggtggatggatggatgatgagtggttgattggagggaaggaagaaaggaaggaaggtgggagggaaggaaggaaaggtgaatggataaaagaagaaagaaaagaaagaagagagggagaggaagaggaaaaagtagggatggagagagggagaaataggcaaatttcctttggaagagtcagtgaatgtcgaacaaataaagtattaaatacaacccagatcccttcttttgcctgcttagcttaccccctggccttattcacctgaccttcccttcatccttcaaactgcagttaaatcttacccctgtggtctgttccagcccacagagactggtcttttttcaagccttgtagtgttcctccaatctaatttccaattaacatcttggttgcacactcttacctcccctaattgaaaccaaccatagcagtttttagcattgggtagtggttaccatcacaggcctataggaggaaaactagctggcagaattttggctctgtcactttgctagaaagtgactgagaaagtcattccaactcccagagcctccattgccccaaatatgaaatagacacactgcctcacagaggtattaggaagacttacaccctgagaaagtgtgcaaggagcttcatgtgaatcccggcacatagcaagcactcgctcgtgtcaatggctatcattactattgttgcctaacctgtgattgtctcatctactcaacaatattttaaggttctaagagaaaagcaccatctctcgtacctggtgtgtgtgcacctgaattcatgcgcgtgcacacgcgtgcacacacacacacacacacacacacacacacactccctagcacaggactggatgaccagaatgcttattggttgatttctgcttggacccaagtcaagaaagtttcatttctaaagatttattgtaggtgagaatcaattcgccaatggttttatctaagccagtcttttagaaagggccttattgcaggaaaccagagacaaatgaaaaggcaatctgtgtgcatgttgtcaacaagcttgtgggagctcctaatactatttccctgtcaaggtatcaatagaagagaagacagtttcccagaacatgggcccggtactccctccacataatcgcctggggtggcagtgggtggctgtttagaaatgacgatttctgggatccattccagacttactaaatcagaaactctcgagttataacctgggaatctgcattttagcccactccttagatgattctggtgcatgctcagggaactgctgccatgcccagcctcacaggaacttagagtgcagcacttggagggcctttgagggtttctagtccaacttcctaactttacagatggagcaagtgaggcacagagaggttaagtggcttatgcaaggtcacactgcaaggcagtgacagggctgaaacacaaaccgaagacctcactggccagctgcctttactccattgcatcacccacctttttctctggaaggagttattgctgcctctgcaaggggaagaggtgaccagcattattgagcccttcttgtgttctagccacttgacataggaccttctagcaatcctaaaggctaggtattaccatgcctatcattctggagaaaaaaaactgaggattggagagaaagcatcatgtttgctgaacagcaaaatcctctggtgtataagacaaatctcaatatcatagggaaaaaccggggggaacgcccacatacatgtgaaatgatttgaaaatgggtttacataaaaaaatttttttcatttatgtaagcaggatatattatatgctagaacccagtaggaaatctctggcccatgacttgctgttgttagaattttatccatcacagtggttcttaaccaggggcaattttgcccaccaggagatatctgacaatgtctggagacatttctgggggtcacacctggggtgtttgctaccggcatctactgtgtagagtccagagaggctggttaacatacaatgatgcatgggacagcctcccacaaaaaaaaaaaaaattatctggccccaaatgtcaatagcgcctaggttgagaattcctgatctgtaagatgtgaactttttacttttgttgtgacatctttgtggccacctccaccgtaggagttgtagcagctcaccccaaacgtggtagtcacaggattctttccttagctgttctgtcttccacccacaaaatgggtatatcacggtggtgttagatgttgtgagtagaagacagaaaataggttctatgtgaaccaagtctcctgtcaaagataatgcagctaccaagaaataaaattagactccaagtccaggtaggtctcattccagaattaatgatatttcaagtgttgttcttgcctcatagatgaatcctccatatactccatatattttgcaacataagccactaaatttccttgcattgaacacagtctatttttaattatattgtagagtaaattggatttcacaagtttaatttcaagcacaaattgtggctcctcagcctccccttcagtggtaagaggtattgcttgggagctaagaatgtggatttatgatcagcctgagtttgaatcttggcccagctgatttttagctgtgtgtccctgagaaaaaaaaatcccttcatttctctggaactcagtttcctcctccaaaatgtggagataacaatagaacccacttaaaaggattattgtgcattttaaatcaaataatgcatataaaacactttgtatggtgcctggtacatgaaatgccctcaatgaatatcaacagtaataattattatcatcatggtcattgtcatcataattgttattataattaaggcccccggatagggagaaggtggtagattggagagtttggggaatactaggcatttgtaaaacaaagctggtacagtctggatctgataattcatcacttactaaatttgacccatcatttttgcttttaatgaaaatatattcaatattggaactaattactattaaattggcctcgttattaagcatcaagggatcaatggtggactcagtgggttatcgtcattgaataaaatgtctcaaggagaaaaaaaaagttgaattaatacacaatcctggagccaattgaaaaatccctaataacaccggctgttgctgacaattaattctaggagtctgtaaatcatgaaagagctttggaggcagaaaccaagttagaagaagaaatgaagaattcaactcatgctggctctctcagaggttctataaccaagagggagttagggagatttgaggaaacctattactccaacgaggggtatggggcagaaggagacctgaactaggagtcagcctggcagggcctggctcagcttctgttctctattactgggtgcaggagtaaagggggagagaaatatgagctatcagagaaggagacagacacagatcatctagtgcccttaagcccatggcaaggagtttgggcttactctatgtgtaatgggaagtctttgttgggattagagcagggagtggcttcataggattgtgtaaaactcactctggccactagacttcagaaagacaaagtgggaaactggtaggaagttattgcagttgtctagataagagtctacagaggtttgacataggattagggtggtggcagtggtgatggagaagagcatacagatacaggatatgttttagaagtcaagctggcaggaagtgctaatagactggctgtggagggtaaaggagaaggtaggcaatcaaggatgctgcctagattagagcttaaatagttaggtagatgttgataacctccatcagtcagctattgccacgataatgctgtgtaagaaactacccccaactcagggacttagaactgcaaccacatgactctgcagccatctgcagttcagctgggctataattagaaaatctgttttagatgtgccactagctattgttacaaaaaaaaagccctacaattaacatgtttcactttggggcctaaaacaaacaaataagctactcttaacaaatgaaaaaaatcaatgtttgaagaatctgtggtggtctgacactaaagtgacctgaaaagatttgtcccagccattctacaactcagggcatcaagagagaggagaacactccaatttctcccaggctcaagtaatttcagttttctgattagcttggtgcagctctcaggaactctgttaggcagatgacttgtcacaccaaacacaggacgagctcatcactggtcaggaagccaactcagtcagagagattggcttgcctccccctaatcaatgccatccacaaaacactaagagtcacaaccactgccaagccagctcttgctcctccatgactagttttgagcagcgggatcactcagtctgtcagaagctattagactcggattggctgattttgagaaagagggtggggggatttttttcaaggacaagctgaacacatagaagggaaaacacagtggccctagcccagcatccacggctgaggagaggaattagatgactcgaagaagaaagacaactgacaaaatgatgtttttagctgtgttagggtaatgcattgtgttccccactgagaaagagggattagggatgtgcttgaggaaaattgttgccatcccaagtggtaatttgcaatctggacaggaagtaaataagtgggactccacgagaaaccttaagcagctgcatttaggaacaagctgggctgactgactgtggctgtctggaaggtgaaggagtttgcaaataaagaatggcttctagttccacccagcagcaaatcttcccttggctttcacttctcaactcaagattccccccatgccctagacctggtcctgtctctgcattatttgctggcttagtgaacgatatcaccatatctatggttgagcaaaacaaaaacttggaagtcatccattactccttgctctctctcacttcccttatccatccatctccaagtcctgataattttgcctcataaatatttctcaaagtaactcgattttctccatccctgctgccaccaccctggtctaagccaccatcagctctcacctggccaactgcaaccatccctcactgggcctttggcttccagcttgttttgctttccatccatccttcacattgcttgccatagagatcttttcaaaacacacatctgccaattccaccttcctgttataaaacccttctgtgactccccattgctttcagaataaagaccaaaatgatgaatgtgatccactgttcccagcatggtctggttccttgcccacctctcaccactgctcaagctgttccatgggcttgcaacacacttccctccaactttcaccaagttcacttagtggcttctcaaattccagctcaagcatcagttctggatagcacctctctgttgctcccaaacacccttacatttgaaatcagaaccttaagcatatcagagaatcaagttcttttccttcagtgcccttatctcagctagtaaatacacctttgtgggttttttgtgtgtatatgtatgtgtgtgtgtgtgattattcagtggaaatcagactcctggtgagctctgtggcagaaactgtggataagtttactgaacacccaaccccctcccatcctctctagcctttctctaaaatggctgaatttccagccttccttgcacccaggaatggccatgtgacaccatctggccaatgggatgtaagcagaagctgccagctgagacatgcaggaaagattttgaagagagcagactcaacttggatgccctttttccttttgccccatccctttgttcctctctgaaatagagagacaaagaccccttctaccatgaagaatgaaaccacacaataaagatgagagagcagaaagaggagctggggtccttgttgtcactgttggtggtctggtcagctttggtccacgtaccacagaactcttactgccagtaggtcagggtttcctgttactagaagctcagttcaattctaactgatacaagctccatgaacatgtgcaccgtgtctatttttgttccccacgcatccccagcgcagtgtctggcacatagtagtctctgctcagcgaacatctgctgaatgagtggctggagagagcacggtctttggagtcctgcatattcaggctcagagtcttgctctgcagctgaaggctgtgtggccgcttaatttctctgagccccaatttcctcaagcataaaaactggatgataacatcccaaggttttattctgagggtctaatgagctgacgtgtagaaagtgccagaccttgactagaagctcagttaatagtatttgttactatttttagtaacataatagggctttgttttatttttagagttgaggtctcattctgttgcccaggctggagggcagtggtgtgatcatagctcactgtagccttgaactcctggattcaagcagtcttcccacctcagccttctgagtagctggggggctacaggcatacgccatcatgcccagctaatttttaattttttttttttttttgtagagactggttcttgctatgtttcccaggctggtcttgaactcctggcttgaagtgatcctctcacctcggcctctcaaagcactgggattagaggcagaagccaccacacccaccctttgttcgtagtacgattatgagtgattgggtctgtcacctccaaatgtcactttgggtgctgactgtgtacaaggcactatgataggcacttggggtgccagggaagcctgcagagtggcctctgccctccaggactgggctgctcacttagtgatggaagatttgcacacatgcatggagaactcacaatgcccatctgtaaaaacgtgccaatggccacagaagggacacaagccccgcgagagtggaggaaggggcaaaataatgtgcattgataaaattgtccctgggaacagtgcaggacagggagcctgcttcctctacattcacttacttaacaaacacttgtcaatcaccttccatgaagcagctaagtgctaggataacacaggcacccaccaacagaggtgcagaaatgattaaatgaatatgcttgcctgcctgaacaatggattaaatgagcaagtgcgtgaacaaatgaacttctgaagaaaaacaaacgagctagaaaatgaaaggagtattcccaggaaataaccatgctctaaaaaatgagagtctgggtcgatgaagggccaggctgcaggcttgtggcccaaatcagagtggggaaatgtggtcgggcgaggttaatgaaggtgaggggcggagttaggatgggaagataaggctacaatccacaccctgccccctgccccaatgtcctgtatgtgacactgtgccatttgtcactccacacgtttttactggaaaccatgtatacaccagcatggtgctgggcaatgggtacccagtggagaagaggacaaaaccgttcagccctctatgcctcctcatgcttgccaaccttccctccttcccagttctgcttcctcctctcagcccaccttgaagatagcagagatgatggtggatctaatctaatatgaatggtagttgccacttactgggggcttgcttagagcaaagtactctccaaacatctcctttaatgatcacaataacaccatgggttaggaagccattgcaatgaggaaattgaggctcagagaggaaaagaaacttccacgaggtcccacggctattcattggctgcaccagaagaggaacccatctggcctctttgttactgtgctcgcctcctcaagtttttactctaagcaagtgaggctcaaagtttaaggtgcatcagaggatgctcttgagggattacctatgaccaccgtgttgattgtagtggtggtttcatggatgtatgtatgtcaaattgtattaaactgtactttgtgtttttttgagacagagtcttgccctgtcactaggctggaccgtgtggcatgatcttggctcactgcaacctctgcttcccaggttcaagcgattctcctgcctcagcctcccgagtggctgggattataggcatgcgccaccacacctggataatttttgtatttctactagagtcggggtttcaccgtgttggccaggtttgtctggaactcctgacctcaggtgatccacccgccttggtctccccgggtgctgggattacaggtgtgagccaccactcccagccttcagaggtattttaatcaattatgttaacctttattgagtgtctcctatatgtcaggctctgccccgggcttgtaactgtactctttaaatgtgcaatttattatatgtcagtaatgtctccagctgttttaaaaaaaataatcaaaataattaatatgcataacaatctctcaggctgcgtattagaagactctcagaccccacccattgccaatagggattttgattcagcagctctggggtgaggcccagcaatctgtgacttaagaaacatcctctggaggattctgactctgctgccccaatttgtgtgtagcctgaggtccttaatacaactgcacctcagcatcccttagggaacgtttacaaaacaccaaggcataggactcactccagatccacttagacagggtccctggggatgggacctggaagcaggtattgttttgaaagttccccagatgattcaaatgtgcagccaggactggggaccaccactgagctaagaagcatttcaggacgtcaggctagggctgttcaaagccaggtgcaggtgttaacaaatgccccctgctctgccaggaaaggcaagtcaggtcctgcagctattccagaagaaatggaaggcccaaattctcttgctaaaataagccttctctctctgaaccctggaattgttcttaatgcatgtggcatcatgttcgtcaataatctcctgggcacagcatctgagaagccatgcacagtgcccgcagctgtgaagacgtctgctgtgtaggagctgaggctaagccgtggccctggcatcagcatccacaggaacaggcatccctccagctcagcttacaggctgtagagctaagggtgactgagacaagcagaatctgctgtttcatgaaacccagaggcagagctagcagggccatgagaaccatctcatcaagcccctcactttacaatttgggaaactgagggagaaaaaaagataaccatttgagagttactccttaaccataaaggtaaaaaaaaaaacaagaagaagtttctcctccatgcagcctgccttgactgcactgtctctctcgtgctttgggaccctggtcaggtcgctcagtcattcaacaaatacttattgagcactaactctgcgccaggcacagagctgagtgctaggataacagccatgagcaagactgacaaggttcctgcttttgtggtccttatattctaatttctaatggaatgaatcagataataaacattcagcacacagctagataaacagaaagtgctgctagaacaaggactgaggaaatccttcagggaaacagactggagactgcctgcagtcaccactggccagagtggccagatgaggcttcagtgaggaggggatatttaagcagaagcctgagaaaagggagggagagagccccgggaagaaccagggagaatgttctgggaagagccagagagaatgcattccaagctgtgaatgcaaagatccttaggaggggaagattttgatatgtctagggaaccaaaaggaggccagagcagctgaagtatagtgagccatggggaggctgattattgacgaggccagcacagtgacctagggacaagtcgcccaaggctttccaggccagcatggaagttagttttaatgaaagacgagcaagccccaaaactggggcttagcccaggagggttcttggctttgcctaggaaagaattcaagggccagccagtggtgttaagcagcaacttttattgaagtagcaatgcacagcagcaggcgcaagaggtattgctccctgtggagcccggctaccccataatagtgtgcccagagcagtagctcagaggcagttatgcacccatatttatacccacttttaattacatgcaaattaaggggtggtttatgcagaaatttctaggatgagggtggtaacttcagagttgtctggtcattgccatggaaagggacagtaacttctgggtgttgccatggcaatggtaaactgacatggaactctggtgagcgtgtcttatggggagatgctcccaccctggccctggtttagctagtcctcaatttggttcagtgtctgagccctgcctccagtgtctagtcctgcctcctacctcagcttgattctcaatatgctgggaagcctatgcagagttttctgtttggaagggatgcctctatctgtactgcaaggagaccagcagtcattgtccagtgagagtttgcagtaggggatgcagtttctaccacactgagtaatggccctagaagtagacttgctgtccacatttgttctattcttcctttggtgctgccttcaagctaatatctctgtgtcaaggcccaggagacagatcattcatcacccgccctgccttggcatctggctccgcaacttggcagaggcagaaagcattctgcgtttccttgcctgcccccacgatgcagaagcccccagccctctgtggctaagcaagtgaccactggtcaaaatcaattccaacctaagtttggcccttagctgtcacctgagtggaggccaactgcaagtgccatggctgtggaccctggtaagccagtttgtcatcctgtgacatgagggacatgcaagtggaggggaaggctacctgccctggggtccccacagcactccatggggcactgcaacagacctgggtttgaatgcaagctccaccacctacttggtccgtcactctgagcaatgacttagattctctaaggctcagtttcctcaggtatgaaatggggctcatggggtaggtgaggagaaaaaagtgaaggcgtaacacagttcctggcacctagtgagcactcattcaatcagaattcccattcttcttctggtttcagagcaactatagcaccaggaaaagtccttacccgaaaggagtctcagtttccccatctatgaaaggaagtagcaatatgagctgaactctgaggaccctcctgccctgaaagtcattaagtctctctctctctctgtctttcacacacacacacacacacacacacacacacacacacacacacacacactaagagcccaaactctggaaacagacagacgtgtattcaaatgtcaaccttacctgccctgactatgtgactttgtacaaaatacagccatgtgccgcataacaacatttcagtcaagacagcccacatatacaatggggatctcatcacattataataccatattttcaccgcacctttttcatgatccgatacacaaatgcttaccattgcattacaactgccaatagtattcaatgcaattacatgctgtacaggtttgcagccaggagcaataggctacaccatccagcgtaggtgtgtagtaggctgtcccatctagtgcacttgtgcaaatgcactctctcatggtcacacaaccacaaaaccatgtaattatacatttctcagaacatatccctgtcattaagtgacacatgactgtatttaacccctcgagcctcagtctcctcatctgtaaaacagggaggaacacggggacgatgtcagaaagtggtctggagcttcagaaggaccctgcaggtaagcacttagcccaggggttttagaatcaatgtacaaatgtcagctgttagactctgtcctcccccgacacacacacccttgtgtactcagcggcgctccgccatgggttaatctaagattgaagcagagacacaaattttccattcaaaacccgaagaccatttttgttcagtaatagatttaaacaaagttttctctcacagcaatcgtccctaatctccgattgttccctttttggagatgcagtgtctttttgcattgcttagagaatacaaattagatattgtctgaagcctttccctgtctccagcagtgctgcttcctcagggacattcactctctctcctcatgcggcgcctcttcctggagctgccttcatcctgtcatgggtggcgtgatcccccctggcacatctttgcaggtggaaggtggacatttgtccaggattgcgggctgaggaccctggaggagcctccccgaagtcctcactctccaccttcccacccagggaagaaataataaggaaagaggagggctgtgctgtattcatagaaccccatgcctcctggcaccatcatgaggaagggaagtctattacgctcattttacagatgaggaagctgaggctcgaagtcgagcatgcggaccaaggtcccacacctttgctccagtccctgattctccaagcttagggagaatgtgccagatcagaacttccattccctcattctacatgtatttattgagcacgtactacatgcaagcctctggtctgaacatggaacacagatgacaaacaagtaaacccacaaataagcaaggtaatttgaaattgtgacccctgctatgcagtgtcataatgagtgttggggtatgggggaagagggtaaatgtggttccctagaaaggtagtcccccatagaaggtgacatttgagctggggcctgggcagtgaagaggagccagccaggtgaagacctggaataagatggttccaggcaaaggcaagcaccagatggaggaccgggctcacccatcctggctgggcattgggaagaaaggcaggagtgcaggaagtgaggctgggaagccaggagtagtcagttcacatggggttctgatgccaatgtaggagtttgattgtattcttagtgcaattggaagccatggcatgggggacgtgaatcagccacttgacactttagaggacttcctgaccaccttgtggaaactggggtgtcaggatccaagagagggggcaggggagtcattctgaaacatcacgttagctccttgctgcatcttgggaagttcccaggaaagacagattggcccgaattggaacccaggtttgtgtgatcccaaagcccacgctctcttggctccagctaggctggaccttgggggaaggaaataatggggccagcagagagaggggaacttaagccaaagaaatgttccatctgaaagccagtgcattccctccctagcagctgcgagtaaaaaatagagtgggtcggaattagcagaccttttttttcctttctaatttatagctcattggttgacgtgctccttgggagaacgaacgtcttgctctctggcttggcagcaaagtcaatgacaaagtactgacagcccagaacagcattcttcctctgtatgaggtcatgaataaggctgggggctcatctctatgcctgggcatctcagcagaaggtggggaaacccaactgctggcttgatagccacaataggcctatttctgaagctcattttcccaaacatttagtaaactatatactgtgctctaggcaccagagaaataaaggcaaatagagcacagcccctgtcctcagtctagaagggacacagccacatatacaaataattacaggaaagtgtgatgaaaactgcagtagcagagagaaatgacctcgggtatcagggaaggctacctggaagaggtgatatttaagctaagtcttgacagattagtaggagttcaacagggtagagatacccccaacggctgatactgggaggaattcaataaatgttagtgtcttattctgtttcctagtgctttctcggatgttgcttttgtgtgtctcaccatattgcgtgttcactgggaatgggaaatatgcctttgccttctcttccatcccctacagtagtgaaaacaggacctagtcatagagctaagtctctcaaatttggcactattggcatttggggttggatattccctggtttgggacaggagggtggagaaggggaagcccattgtatgatgtttaatagcatccctggcctcttctcaatggatgccagtagcacctcctccatatccccaagcaaacatgtccctctgggaacaaaatcactcttggttgagaaccactgtcatagagtatccatgtatttattcatctacttaattttcattaatgaattcaacaaacatttactcaatattcaccatgggccagacacattgctaggtactaggaacacagtgttatataagatacagccactgctgctgccctcagagttgcctggctggaggggcaaagagacaaggctatgatggggaagcaccgaggctgtgggagcatgtagggtgagggcatttgagatatggacacattccaggaagggtccctggatgaggtgataaatagacattagccaggtgaaagagagggaaggcattctaggccaaggaagaaagagaaggcattctaagccaagaaaatgacaagcaaaaggcttaggggcttgaattaacttgcccttttggggaagtatagcagctcatacctggagcatggatctccaaggaggacagaggggtagaatagaggactctccagtcattgagaagagtctgcttcatccggagggccatggggaagccatcggagaattccaagcggaaaaagaaggaatatgatcagatcaagtaagaaaaactctggctgcaaagtgacagagaagtttcatgaagctgcatgagtcactgggcttgcggccttggaagatgctctcataacatcagaggcacctcctggccttggcctggccttggccctgcacttcaggttggatcttgcccccctgtctcgggcaacttgaaatctgcatctcaggctgctgtgcccacaaaagcctccttcccgtccaccagtttcccagccatgactgtccctccaggtggatgcaggaaagtgttttatctacccatgccattaaacctgccactgagcccaaattgcctttggagtttgagggcagatggcagtgcaacgtgtggctcagctctggagattcggcatggccaacccattagttctcctggagctgaacagagggggaccgaccctctaattgcttgagaacttgggtattattgaaactccctcatgcctgaatgatgtatgactctcacagtgtggctcagccattgccagcggctctccaaaacagaccctgtcttattttttattccatttatttatgcatttggtcgatctctctgggaaggtaagtttttaaaatactgggtatggaaacaggagatagtcaaactttccgagcctgtggacttgattgattgaggttgtgacatttatttccaaagcatccttcaaaaagttggttatagactaaaccaccagtttcaaatctggggtccccctgactctaatagtctttgaaaggagtgatgggcagggagaggagggggctgagagagaaacgaagtgttttgaaaactctaatggagattctacttagcaaaactaaggctgaatgtgctagctaaaaaggtcaggtttttctggcttaaaatcaatcagtaatacctgcaggatgacatcctgaccatggcctctgagcctcagcttggtgtggctaccattagcctctcctctgccttctgtccatgcagaagcccccatacacaacagtccccctaacacaccagccttattcatatccagaaccctcaaccagaacctgtctctgctccccctttcattctctgcctcgctctcagtcttcccactcccagaagctgccactgaccatccaggctgggctagctgccagggagtcctaggcagtgggatgttgagtcacacagggataggttcaaatccaggcttagctgctcaactcgaggtgtgacttccccacttcccctccctgagcctcagtttccctgtgtgtcaaacaaggataatcaagtttctacctaatatggttgtcatgagaactattacgtaaagcttcttagcactgactcgctgctgagtaagctctaattcacgttagccactgcttcattccttcaattacacgcctgtttcccacaatgagcagggaccaggtcttttgcctattctcaggttctggtgcaacgtctcacaaataggaaactcccaataaaatgtttgcatgtagaaatccaaagatgtcagagtggaagccagagccacttatacagtggataaacctggcaagttatttcacctctctgtgcctcagtttcttcatctataagatgggtatcctgatgatacctacctgttgggttgttaggaggatgaagtgagttcatatatgcaaagtgcttggaacaaagtaaacactacaccagtgttgctcttattgttttactaaaaccaaggaactgagtgatttatttgttcaccaatacagtgtggaagacaaagcacattttactgtggacaatgcatagtgggtgggtggatattaatgatgaaatggttagggctactgaggcagcctcatctgccacccaccccaccccacctgctcctaggcctccaagcctgtgaaggtggggaataatgatttggattttttttttaatcagcagagcacaagtgtgctatttcacatgccggctgtttaagtgtacacctagttacagctgactgccttggatgattggttgagagggctgagttcccgtttgtccccaatcaatctggaaactgaaaaggagccagaatattcattttccaccatcaagcctgcagcccaggattattgttgataaaggagctgtggaacccaagttccccgggggagatggaagagtaaacatcttactgatatcccagggcagtggatgaacagaggtcgggatttgagcaaatcatgtccctattattaattaaaggggcagggcattggtcagagcaggcagaagggcaaaggggctaaggaatagctgtgggccccatgcagttgatgaaaaggttgtgtcctagaagggtttagcctgaagggctgcgtaggcattcaggctggtattttgtacggacccactgtgagccactacggggcaaagcactcaggagggaaacacagaaggatgtgcaagaactaaaaatatgcattccatctggaagaagacaaaagttgaggaaccgtgtttatgaagatggcctcatgacaagatggcattcattcaaccactccttcatccacttcaaaactgttgattagcacctgtgttgagccaggcagttccgatcccttgcggatgtcaaataggagtaaaacgcaggcactgcttcccaggagacagcagcataagtggccagataaagaaagtacataaataataacagctgtagcaataatagcaaaaatagtaatacctgctgttttttgggcaccaacaataagccaggcttcgcataagttatttcattcaatattctccattgcttaatgagatgataggtcctatttttaccctgagtttgcagatggaaaagctgaggcatggaaatcgttagtcacttgactgaggttcatgcagttaggaaggaaccatgattcaaaccagttccttccaacttaaacccctgctggtcacactaggctgctctgcctctcgaataactagaacaacatgttgtaactgctgggttgaagctgcagaaagtccagtgtgactttagaagtgtaactgggcctctacatagtggctcaaccctgtaatctcaacactttgggaggccaaggtaagaggatcacctgaggccaggagttcaagactagcctaggcaacatagcaagaccccatctctacaaaaaatttaaaaaattagcagggcatgatgtcatgtgcttgtagtcccagctacttgggaggctgaggcgggaggattacatgaatccaggaatctgatgatgcagtgagccatgatcgggccactgctctccagcctgggcggcaatgtgaaaccctgtctcaaaaaaaggagggggagcatctggccagctggggggcagggtggagtggagagggctgtggctttaggtcccctatccccagcacacacctcagcatttgctcatagtagatggtcaagaagcacttgccagttagccagcaagttctttggaagccttctcaagcatcatcagacaggttctgcaccctcttgttcaatgctgttcacaaagcagcattttatccagtgagaccatgaaaagggattgtgggaatcttcattttgtatagaaggaactgcaactagcgagaaggagaatccacacctaaatccaagcctccagtactctgaaaccaaagttctttccctcagccttggagcctctgggaggactgattcaagatgagaccccagacccctgactccaaccccaaatccttctaactccacctgctacctcttcctcagatccaaggggcaacttatcttcccctggtttcttatcagcatggaacagctgtggttttctgactcacagagccgctgaggttgtaaaacattctcttttcactttccatgctggccaaatgcatcctgaacctgctggcgtgaccttctgttgctgcatgcaggcccaagcacaaagccattcattttgtattcattctctcccaaccccaatcccctctgccatccccccacaaccgcacacagccccctccacccgcaccttcacctcacccttggcttaactcagagaattcaacttccctcaacaaggctggggctggggcttcttgagctgcaaatatcaatttgcagctttctgtgtatcccctcaacacacacatacacacatacagacacacacacacacacacacacactcacacacacacacacacacacacacacaccattgcatcttgccttgggctgggcacatagaggatgcacaagaaatacatctggtagacccccacacctttgctcatgctgttccctctgtctcatataccctctctcctcttgtgtttgactttttttcaaaggctcaaaccaaacagcccctcctctttgatggaaggagagtcccattcatcaggtacgtcccacattcaggcacccaagtcctgaaaagaggacttgggactcaggcctaggtgtgatgctgaatcagccccctattccttgtcaactgtgtgaatgtgggcagtcattcctgagcctctgtcaaatgggcacgataatagtacctgccttatacttggttgttgggaggactgagtatgtagttaatggcatctggtcccatccagtcctgacagacagtggacacaaaattgcttgaggcaatttaataataattaaataataatgttatatgctatcattattgagctactactgtgttgtgggaaccagactcagccttccacatgcatcattcattcagcattagtggagcacctactgtgtgccaggtactgttctaggcgtttcagagtcatccatggaagaaaaaggccataaatccttgccctcgtggagcttaccttctaataaggagagacagagggtgagaaacaaacaaacaaaaatatgtgagttaacacagagtgttggagggtgtcaggtgctatgggagaaacgtggagcatgtcaaggagagagcaggcaagagggcattctggaaaggcctaggaagatggtgacatttgaccttcatatccaccaacccccagcacaaagcatttgccagaggcagacagaggagggcaatggacagtaggcgtccatgcacccaagtgagggagagagacatgcagacactctagagaagagtgtccaggcaggggaacggccctgttcgttcatcatttcatcctcatgagatatgttacgtgttatccccattcgaaagatggtgaagctgagactcaagagaggttaaagtcacatgagagggtcacagagctagcaagggacagcacttactggttgcaagtccatgctaaatataagaccttgtcatgacccagggcttggtgccccttatagtgaagatcagaagaggaatggatcgtcatcttcctctgcttgctaccctcgctggtttcaagacctaccctcagctctgcctccaggaatctagcaccgactgtgtctcacgtggccttgcctcatgccctccaagggatgcagcactggacagaggcaaaagaaagggaaatgtcaccttcttcttctgggcttggctcctccgtcttggaaagcgagtctcagaacatctgttaaaccaagccccagcatattaaacagccactgaaaatgtattgttgcttcgttcaatacatagcaattacacggcgagttttgctcattagcgggaaattgacacagaggcaatcctgctttttaaattaccactaatctcactgcacctgtttgggaagaaggcaggaggagaaaggaaaaaagttgataataaccatttcattacattttaaaaacaaacacttctaaaattcccttaaatatagcttttgggctctcagattcccatcttatcttaggaggagcctctttgcctcatgccacaggctggagtaactctccattaatgtcacaggcttaatggcacatgagtctgggcaccaaggacaccgggaggacaagctaggctcccttaaggtttatttaaagtgagattctgtgattaactatggttaagggacttggtgcacattgaggagagccaccatacctcagaggctcatggaaaactgacttattcagtgggtgggcaggtgttaggggaggtggatgcagatgccgctacaggtgtctccagagctcaaagacaaggtgtcacttgaccaaatcaaacagctgtcagtgaagctggcattcagacttgctgcccaggcaggttgctgaaatcatggagccccaattccccatttctgtctcagtgcacggggttgcatgccatgcccagcacagaggctgacttcacacagtaggcactcaataaatgcttcctaacacaacctcggggctgcttcctgagatgctccttcactgatatcctccagtccatggggccaggctcattctgtatgaggcacactgccctgggctcaagcccctccctggctgggtgatcttggacaaacctctctacctctctgagtcttggcttccttatttggaaaatcgggataatgatagtaagtccagctcaagctcgtggcttgctggcttgttggtgagggtcttgtgtgatcatagggctgaaagtgcttgagaaactggaaaagtggtttaagaaccacgactattgatacccgtggaaatggagagagaaaaaagaaaaataaaagcaatgtaaaaaagaacaattattattattctggagttggttgctccttggaagaggagatgctggggcctcggattaacatgaaacttaccagaacttaacatagcactgtacacatagtggttcttgatgaagacttgaaaaatgaattcttttatttacctaaaaaaatgttggtagagtgtcttctcttgccaggcagtggtcaagatggcagggattcagcgggaaacatgctcccagtcctcctggagttggttagtgccctagggccaccatgacaaagtgtcacaaaccaagtggcttaaaacaacagatatgtattttctcactcttctagaggccaagagtctgaaaccaaggtatcagcaaggttgattccttctggaggttctgagggcaaatctgttccgtatctttgtttctggtgtttgccttgcaacccttggtagtctctgctctacctctgtctcatatgaccttttctttgtctctgtggccaaatttccctcctcttataaggacaccagtcattggatcaaggcccactgtaattctgaatgatctcatcttaacttgattatatctgcaatgactcaatttccaaaaagttcacattcacaggtacagggggttaggatttgaacatatgtctttgagggagacaatttgacccaccacaaggatatcaaggataaacaaatatccattgaatttatcagagggtgccatggagaaagtgaagcagggttaaggaggatttcagataatgaataagcaggaaaagcctctgtgagaagacagcattgagcagagagagctgagtgaatgaggacatgagccatgcaaataactggtgcacagcattctgacagagcatgtgcaaaggccctgaggcaggaccacactggggatgtgcaggaaacagcaaaaagtccagggtgctggatcagaataagtgagggaagggtggagatggagcagaacaatcatcttagagactgagggtgtcttaaagagacaggaagccactggagggttttcagccatggagcgaccttattgtggtttacgttttataaggatcactctagctgatgcgttgagaagagattataaaaaggacaaggatgagagtagggcaactaaaagaagaggaggaggacagagctctaagttcatcaaagcacctggtctggtaattttatttaacccattaagcccccagagaagaaaaatgagcagggaggcctggcgtggtggctcacaagagaagaaagatgagcagggagacctggcgtggtggctcacaccggtaatcccagcactttgggaggccgaggtggatagatcacttgagctcaggagttcgagaccagcctgggcaacattgtgaaaccctgtgtctactaaaaatacaaaaattagccagacatggtggcacaaacctatagtcccagctacttagggggctgaagcagcaggatcacttgaacctgagaggttgaggctgcagtgagctgagatcacatcactgcacccaagcctgggtgacaaagtgagaccctatctcaaaagaaagaaagaaagaaagaaaagagtagaaaaatgagcagggtgacccatcacccaagttgcatgtgcattaaagaagctgtgaaccttgcaataaaatgagctcatttgagaagccctgaaatcatggaaaatcaccgtgccctgttatgtgaatgacttaaaaacttacctgcttccatttgtttcctgagcaccctttggtgttaagtcctagccactggggagagggagggcacaggaatgaggaatgcagagtttctacattcaaagggcttcccaaggagagagaaaggtgctctctgcacacacagctcagccacagggaactctagaacagagagatatttgttttaaatagtgtatctaggaagtcttactggaggaagtggcatctgcattgagcgctctaaggataggaagaatttggcaggagttgaggtgtgcacctacctggtcttggaggaggcatcttgaggagggatgtcaaactccaatttgtctcacaggaaactgaagcaaaggctatgttgagggtaggaaaagttggcactttttattcctcccttcttttatatttttcccccttcccaagtgcctactacgcaccaggagctatacgaggcaccagggaagcaacaatgaacaaggctgtagggatccctctgggaaaccacagactgatgggatttcagtgcagctgagttggagaagagagacagagagggagacttaaatagcagaacgaggggtttgtgtttgctccttcagcaatggggagccacggagggttttgagcagggaaatgacatgatctgaactggacaagtaataattatttgggcagcacgcaaggatgggtttgaaggggaccagaggcaaggaagccagctcgcatcaaaagataacccttaagtacatctgcctttgttggggcgctctggtttcccgtgcccctttgtggtggggaggtgagggatggagcatcaggggagggagaacaggctgcaggtctgagaagggatgaagggtttccatggcaaccttttgcttgcctgtagccaaggtagctatgcaaattccccaggcaccattcctgtggaccttgaagccagcatccccggctgctgagagcctgactttagaaaaactgggatgcagtaaaattgaacaagagagacgagagacaaagatgttcggctggaacaggggtgcaggctcccaggcagcccttgaattcccttgaacctgttctgcaggctccttctccctcctctagggagggactctcccaagcccacccttccccatttggcatgcattttacaccatggggacttgggccacctggaaaatgggctgacctgatggtggtgcctcctttaagtttttgtgatgacttgcaatattgtttgccaagcttcgtacacaatgcctgggtcagggtaagcaggtcaaaatgctagcagttattgttatttggcattgtgattaaagaatgctggctcttagaacaccaggtcctcctctgagagtggccgctgattgatgtgtgaccttgagaaagtcacttcccttctctttaatcttcctgttcttatgtgtcagatggggatgctggctctacagtctctttattagcattttattgttgttgttgttgctgctactgctgctattgtcaccattattattagtattgctgttttatcattgctattattataacacctatgttgctgctacctgctacaaagggcaatgatgatgattcctgtaaatactccacgtagttagaacgtgaaactctatgccaaagcagaccatgcaaaaatgagttttcgagaaattgttacatgaagagtttataaaaatgaaatgctgtattctacacatatcaagacaggattgcttgtgggtgttgaaacttattaggcgaggtagtccttagacattcacttgtcttagtcttaataattgaccaaatctcctctccttgagttctcacactgggtctgggttccatgtccgtttccattctaggtgatcctaaattcaattgagaatcctgagttcagacccttgtaagacacagcctctcctgttgtagaaagacaccttcctttacctaacacagatttagtccacatcgtattactaaccctaaccctaacccaacctgagtatttggcatgtaatagacactcacatttgttgaaaggaagaaaagaaagaattagaaggaagaaaatggggcacactgctttctaatcccaagaccctctagttattaatctagagaggaaggtagaagccaactctctcatattcgtctcagtggaaaagccatttttcccctctaactccagactttctgtcttctttttttactcaccaatgcccaaaggaaaaaaaaaaggtatttccaagtacgaaagtacaaagtttcaaacccactcgtgctcctccttacaatgcagtcgattaatcccacaacatttctcctgggtggttgccgttaattgaattaaatgagataatatttgttgagtacgtagcactgcgcctggaaatgtttattgcatagaattgaatctgtaatgggtagagatgattagcattgttgttgctgctcttaattagagctattaataacccccttcattagcacagtactttggaacttccaacccatcttctaatgcatttccttatggcaccgtctgggtctcaatgtttctgtcagataaatgggggtgacaatttgaactatgtgaaattcttgagaggtcattctcacagtgctgagtgcgaacgtgctttgcagactctagaaggctttgcaaatatcaagggtgtgctattttattgttgtctgaattgagaggtagagatagactctgatatatgaataggaaaaccccataccctcatctcatgatgtgaaatgactgcctggctgtgttctttttgcccacaccaggcacacttaagattcaagtaaacaaagggcatttgtagggcaggtaggtcccaatgatgttattaagaaaatcactaaaataggcatggacttgggcttcacggaatctgggttcaacactgagctctgctacttcttcaggcaagtcattcctcctttgtactgtgtcaaatagtgtccccaccctccccaaattcatgtctgccgaaaagctcaggatgtaaccttatttggaaataaggtctttgcagatgtaattcgtcagatggggtcatattggattggggtgggccttaagtccaatgactggtatcttcctaagaaggtcatgtggaagatgcagagagacacactcagagaagaatgccatgtgatgatgggggcaggtaggagagtgatgcaactgcaagccgaggaacaccaaggattgccaggggccaccatactgaaagacacaaggaaggattcttccccggagcctacagaaaagacatggccctcctgacactctgatcttggacttctagcctccaggactgtgagagaatatatttctgttattctaaaccagctagatggtggtaatttgttgtggcagctctcggaaactaatataccctctctaggctttgggattttataaaattgtgatgatatagcggaaatctcacatctcactagacagattctgcaggatgatccatgcaaaggttgtagaacagtgccagcacttaaacggtctccagatgatcacacattgacaccatcaccgttagaacccacaatgacctgggctgtctccttgatgtccctgcctgccctcagcctccagagagtgtccaggcagtcacctgactctaactgagagttctgtctgtgtctccatcacagagagccagactggacaaagagttcagggtgcatttggaggattgcagggcagggacaaggaaaagctgcaatacctggacaagtccctgatgacagctcagcatcaggacctactgtgtgccaggtagttcgtagaagtcacaccaaatattcagaatgcctccagtgtcaacatcattgtactacctccttaagccacaatgtcttcatctgtaaaatgtgaatggtgacattcctacctcatagcattggaatgagattaaggatacataatgacttgtacataagtgtttagtaagagggaactactattggtatcttttttgtttagagagagacagggtctcactcttttgctccagctggagtgcagaggcacaatcatacctcactgtaacctcgaactcctgcgctcaagcaatcctcccacttcagcctcccaagtacctgggaccaccatgcccagctagtttttctattttgattgttgtaatgacctctttttcacggttgagaaaatgaggttcagagaggtaaaataactggcacaaggttgcccagccgtgaatcacgggatccaggatttggacatacaattctgactctgacctcatgcatcgaagatcctctcttgccaacttgccttctgcttccagcaaggagacagaatggttaagttgtgagtggcattttcaactctggaagtttaggttgaccttgcataaaagaccaactccattttccttggaaaggactctggttttaaggaaagaaatttcatggggtggatcctgctgcaaagctggtacaaacaacccagtggctgaagcggctatgcaagactgccttcctaggggaacctgcccatgccccatgcatttcttttcttttttctcctgataagaactgtcttttaatattttggaatggtaaagctaaagtaataagattcaaaaagagccatcttctggttgcactaaaactttctcttttttaagtattttttaattgacatataataatcttatgtatttatgggctacagcgtgatatttcaatacgtgtacacaaatgatcaaatcaggataatcagcatatctatcacctcgaaaatgtattattgctttgtcttgagaacattcaaaattcactcttctagctatttgaatatatacaatcaattgttaattatagtcaccatctagtgctatagaacatgagatcttattcctccgatctagctgtaagtttgtatccactaaccaacctctccttctcctctccccttatccttcccagactctagtaaccactatttcactctctacttctgtaagatcagccttttcagtttcaacagatgagtgagaacgtgtggtatttatctttctgtgcctgacttatttcacttaacacaatggcctccaagcttatccttgttacctccaatgacagatttcttttttaaatggctgaatagtattcgtgtgtgtgtgtgtgtatgtgtgtccatttcttggattttctttatccattcatccattatggacttaggctgatttcttctcttggctattgtgaatagtgctgcaataaacatgggagtgcagatatctcttcaacatactgatgtcctttcctttggatatatacctgagagtgggattgctggatcgtaaggtagttctacttttaattttttgagaaaccttgatactgttttccataatggctatactaatttacattcccaccaactgtgtataagagttctttctatgcatcctcgccagcatgttattttttgtctttttgataataaccatcctgagatgagataatatctcattgtagttttgatttgtattttcctgatgtagtagggatgttgaacattttttcatatacctgttggccatttacatgtcttattttgggagatgtttattcagcacattgtcacatttttaatcagattatttgttttgttgctgttgagttgagttccttgtatattttgcatattaatcccttgttgaatgaatagtttgcaaatattttctcccattctgcaggttgtctcttcactctgttgattgttttctttgctgtgtagaagctttttagtttgatataattccatttgtctatttttgcttttgttgactgtgttttgaggtcttacccaaaaaatctttgcccagaccaatgaaccaagatgtttcccctatgttttcatctagtagattcatagtttcagatattacatttaagtctttatcattttgagttgatttttgtatatgataagagataggggtctactttcattcttctgcatgtggatatccagttttcccagcaccattaataagagaatgtccattcccccagtgaatgttcttggtgcctttatcaaaagtcagttagtgtaaatacatggattcatttctgggtttgcgattctgttccattggtctatgtatctgtttttatgctggcaccatgctgttttaggtactatagctttgcagtatattttgaagtcaggtagtatgatgcctccagctttgttctttttgctcaggattgctttggctattcgggatcttttgtgcttccataggaattttagaactttttctatctctgtgaagaatgtcattggtattttatagggattgcattgtatctgtagatcacttttggtaatatagtcattttcacaatattaattatttcaattcatgaatatgggatgtctttctatttttttgtgtcctcttcaatttcttttatcagtgttcatagctttccttatagaggtctttcacctccttagctaaacttattcctaagcattttatatatttttgaggtagctattgtaaatgggattgtttttcttgatttcttcttttcagctagtttgttgttgatgtatagaagttcctctgatttttgtatgttaatttcatactctgcaactttactgaatttgttgatcagttctaagagttttttggtggagtctttagtttttcctaaatataagatcatgtcatctgcaaacaactttccactttggatgttctttctttctttgcctagttgctctggctagggtctccagcactgtgtttaataggagtggtgagagtaggcagccttgtcttgttctagttcttaaaggaaaagcttttcacttttatccattcattatgatgtaagctgtggattttccatatatggcctttattgtgttgaggtattctccttttattcctaatttgttgaaagttttttttttttttttatcatgaatggatgttgaatttcattaaatgctttttctgcaagtcttgaaataatcatatggtttttgtctttgattcttttggggtagtgtatcacatttattgatttgcacatattaaagcatcagcaagtgctgcatgtcccagaagctacttcagggcctgtaaagactgaaggggagctggagaaagtcaggcatcttgggtttgtgtatttggggtggtgggaggaggcttggagtcagtttttcattctaatcccatcttggttagcttagggctgctagggggatccttgctaaggcagcaaagtgcctgcacagaatcagtgccccctggaaaggggatgtcattatggaaactgctcagtggtatttgtgaaatggaggtgtctcaccccaggccagggagactcacagcccctgagccaggatggacatctatatcccaacacacattcaagtcttgcctgatagagcaaaggagtggtcctgtgtgtggccactcatccccctggaagtaagtgggggtgtcctgcccactccctgctcctccccatgcatctccctggatacctttggaatcctgagatcacccccaccccacccctatttaaactcaatggggcaaaataactccaagtgttgtctgtgaatggcggcagcaggagcagcggcggcagcagcagcatcagcgacagcagcagcacaggcagcagcagcacctgggagctagttagaaatgcagacgcttggatcccatcccaggcctacccagtcagagtctacattttaacaaggtccccaggtgtctcatgtgcacattcaaatttaagaagctggactagagaatgaaaaaaggaaagggttgggctaagaaaagggtaacctaactctagaaaggaagtaatttagtttttcagtgatttatgcacttatttttggttatctatctgaagttcagactctaccaaagatccttgaaaaacccctttgcagaatcattccctacctcagatgaagttctcaaaattgacaaagaaacatgtgtgtatatatatagatatttcaacttttattttagattcatggggtacatgtacaggtttgttacatgggtatggtacatgatgctgaggtttggagtatgattgatctcatcacccaggtactgagcatattacccaatctttagtttttcagtcttgtccccctccctcactcctccctctagtagccccactgtctattgtgaccatctaaatgtacatatgcatccaatgtttagcttccacttataagtgagaacatgcagtatttggctttctgttcctgagttaactcacttaagataatggcacccagttgcatccatgttcctgctagggacgtgattttgttctttgtttatggctgcatagtatttcacagtgtatatgtaccacatttattttatccaatccatcattgatgggcacctaggtggattccatgtctttgctatggtgaatagtgctgtaattaacatgcaagtgcatgtgtcattttagtagaatgacttattttcttttggatatatgcccagtaagaggattgctaggtcgaattgtagttctgctttaagttcaacaaagagtaatattaatagtggtagcagacagtcttcggggcctacctctgggccaggcattgggctaagagtttagagtgaattatttcatttaatcctcacatctccctagaagggtgggtattattattctcctccattttataaatttgaaatccaaaatgatgtggctggcccagaatcacagtgtaagcaaattacacatctggctttgaacgaggtcttcctgctcctaggcctctctttgaccaccaggataccctttcttatgcatcagaagggcatcaccagcatagtcttggcttcagctctccactcctgcataaaatgtgtatgttcccctgcctctggaacctttattgttggtggtactgctgctgctgctgatgatgatgatatttagttggtttttttgactgtccctagacccttatttaggctgttccttttacccccctacttgcaatgtcctttctcaacgttttcacctatttgcattaaaagtcctagaagaaaagatatcagggctcttgacttcattttttaaacccacagtgccgagctcattgcttgtacaaaatagatgcccagaaaatgcttgttgaagttagtttattatttagttcaattattatttggttctttatcattagtgcgttattatttagttgaactatttagttaaatttagtttactgtatacattctcaatgagggcaatgttgcccccaaagggacaaaaattggtgcttaggttcctgtgtatgtataaaaaacagatctcctatggtatataaataagtatacagtatatctgcagtattaaattttcatggaaaaagtcatcttaaaaggctcctgggacaggtgataatgaggaaaaaagattttataaggatgagtttataatataattcattcaaagttttagtcttaaaaatctggacgacaaaacacaaatagacagaatacttaattaaataactcaccaaggatgaaacacaagtggaaaactcatgggaaatgttcatccttcgtagaggtcaagtgaatgcacctgcaactacccttgagggaccacattacaccaactaaattagcttagaatgtttaaaccaataacacttggtgttggcaaggttattagaacattggtaagctcaggggctttgtgatttgaaagaccccttaggaaagcaacacggcaattctgtccagctagagcggtaaaactgttcatgccctttgaccaaaggatttcattccagggaatttctgcttgaagatggattcaactgtagcaaaagttgtatacacaaagatgctcattaactacagctagcactgaaaaagaaaaaggaagaggagaagtgaggaaggaaagggacggaagagggagaaggggaagcagaaacggagagcaggaaggaggaaaggaaggaagatgggagggaaggaaaaatgtcaaacaaaatgaacacatgtaggccagctgcagtggctcatgcctgcaatcccagcactttgggaggccacggcgggaggattgcttgaacccaggaatttgaggctgcagtgagctatgattgtgacactgcactccagcctgggtgatgaaatgagatcctgtctttaaaaataaataaataacacatgtaaaacacccaacagagtgctgagcatttggtgagtgctctacagacagtactatcgccattaattcttcctctctactagcagtaagaccagagcaattgagcatctgtcctactggggggcttcagaaggagggtgagtgtcaggggtcttaatgaggagggtctagaatacagctccagcaagctaagatagtggacagctgccaagatcgtggatagagggatatcctacacagctctatttattaaggagtgggtgtctccaggcatgaatttgagggctgtttcctgtcctcagaattctatcacctggtcctagctcattgttgatgagcaagccactgtttccagtttccttggataaaggagcttccagcagagccaacctgggatacattgtgcagaccagttctaaagaatactttagaattctctctttttaaaaccactttattgaggtgtaacgggcataccaaaatgtgtaggtatttgttacatgcaatttgatggatttggagatgagcacacacccatgaaaacatcagtgcaaacctccagtgcccatttttcctatgacctaaggatgtgaaggcatcttaagacttatccgtctaaggcccaggcatctgcatttacaaacttgccttttgcttccctcgggagcctggttaatgcttgaaggaggcctagaataaatcaccaaagctttcctatctgggtggccttcatagagaagaagaatcccctctgctgtgtaaacattaaacaatttgagatttcaaagtggtgtctccaaacaaagaagatggctaacacaagcctcccttgcccactacatggaagagaaggactttctgtgaggtttgtgagcctgaatcaaaatgccagcacctgaggccaccctgagaaatccttcatgactcctgaggataatttttgccgagacagagggaattaggcctgttcctgtctctgctaggaaatctcagaactcatcccagctcacagttgctggggaaagagtcttggggctgtcacctccatgtctactttctccagcatagcaaaagcatccccagaggcaggagagggtaacgcgcagcagttgtctatctgacctcgcagtgttgagcacctgctcagggaaggcttggtgctagtcactgggaatccaataaaagtgaaataaatagggcctctgccttcgtggagcagacagccatgtagggcagacaagcagccatcatcccatttaaaatcattgtaaacttacagctgtgagatctttagtgttggaagagcacatgagtggggtttaggctggcctgggagatcaagggagtgatggttaagctgaagttcaaaggaagattaggaaggaagggaaggaagaggaagagagttctatgtacaaaaacctgttgccttattcatccttctcctgccctctcttctcacaaaaggagaaataaataagcaaagataaaaatgggaaggagcatgagcaagtagttggagaagtaaggaaatgcgtaagagactaggtaaacaatgaaaggcagataagctagaggggtattcggggatgccagggacgtgtgcatgaaagaataaataacaaaggaatatgggtacaaggagataagctaagaagtgaacaaaggaagtgaataagaggtcacctgagtgaggaggaaaccaacatatgaatgaaaagcaggattcctccattccagtatttccccatagccaaaatggccaaaaggctctttccaaatgcacacagaatgtagaaaacatagaagagacccatggcttgctctgtgccacagtacagaagttctcggccttgtctgaaacattggaatcacctggagagctttaaaagacacagatgcctcagtgccaccccaaagaggctgatgcagtgggctggggtgttgcccaggcataaggattgttgaaagctctctaggtgactctcgtggacttccacggctgggaaccactgccataaggcactggtttcatagcctggtccctggaccagcagcatcagcatcacctgggaccttgttaaaaatacaaaatctcagacccttccgcagacccactgggtcagaaactctgggggtagggcctggcatctgtgctttaagaagccctccctggggttctgatgctcactcaagcctgacatctactgccatggagggagtttgtcatcggctgagattccttcaagaggaaacatgctcctgttgcagcagagaaagttcaggttagattcaaagcaggaccaagtgtagactcctgagcatgatcatcagagccaccatggtctgggccagtggttttcaacaggggtggggagcaattttgctctccaagggacatacggaaatgtctggagatgtttttgatggtcacaacatccccacaacaggtggggtggggttactgctggcatctagagggtagagattagagatgctattaaacatcttaaaatgcacatgacagtctcctatcataaagaattatccagcccaaacttcaattgtattgaggttaaggaaccccaatctaggtaaatgcacctaagcaagctctagtccttgaagagaagcacccaatgcaaaatacttttatcttgatctcattcctataagcttatagatgatggatctggggaaaaaatcccctacaaaatcccatttaacttctcattttacaggagagaaaacaagccgcaaaaatgaaattattttctagcatctcacaacactcctaattcctgtctattaatttcctccataaatatttattgaaaacttgctaagtgcaaggtactgtgctgataagaagaatgtaatggcagaccagatggacaattcctgccctcagggagctcccaataatcaaaggcatcagtaaaattataaggacttcttaatttaaggtggcaggagaaggctcttctgaggaggtgacatttatgctgaggtctgaggactaaagagggaaaaccatgaagagagggaacaggtagtacagaggctgtcctatctccattactccagcctgcaaggagaacctagcttctccctgcagccaggtgtctgccgctcaccgatctggagggagttgctggagcttggagaagaacaggcatttaactccagacagcattcagagtcttatagaaaccccagggagtttatcacatctaagaccctgatagcatctgtattagaaatgagaatccgaacagactgctcatgaaagattagctttaattctttcagaagaataaatgcttataccaactctggcccgctttatctgcttgctcctgccagccagctgccctttccctctatcaagatggccacgagaggacttccggaatgagtctgtcatctccaattcattctaactaaacagtcttttgtgagcatccgctctgcccagatctgggtggagagctatggaggagagaccagaggagaaggtacagcctctacctttgaaatacacaaagacgcatagggagagtaagtttcttacatatccattcattcaacaggtgctccccgagtttaaaccccacatcaggcaccgcaccaggcactgaggatgaagaaaggaagctcatactcacatagcatgtgtcagacatgtgaatggttacaggacagtgtaagaagtgggcagggagtcatcaccccagctgcagaatccaaaagggcttcctggaggaggcaatgcctgaattgagagttgaagacaagctagcaattaaccagatgcaaaagagagggcaaaagcaccagcatgaaccaaggacagagaacacagcacatttgatgataattaaaatggcaccatgttgagacctcttgtgtgaattatctcattcacctactacatttttttctgtgtttaaatgaggaagttggggtacaatgatattacatacagctagcaaattgcagtatttattgcagtctgactgttgggcctgtatttctaatcactatgttgtatatcatatctatctagaaaatgatgcataattctctataactgaattataaaggatctgtggtaagaaggggagtgaaggagttgaggctgcaagtgcagacctgggtagacttgaagggccttatacacaatgtttgaaaaagtcagaccttgttctgagggaggaaatatgaaggattttaagctggggaacaatatggtcctattagaattttagaaaaatcatcatggaaggaggatcttttggagggagagattggagtcagggcaactagtgaagagacagctgtaatcatctaaggaagagaagatattagtttgggccagtgggcatggcccaatggaggtaaaggaaatgataaagtttaaaaacaaacaaaattttgtgattgactggatacagagggaacagaaatgggagattttcagatttctggcttgagctaggactaccacaatagctgaaaagagaagaaaaatatttttcatcccaaatgagagaaagaaaagagctttggggtaaggttggggtgagaaggtgaggatgaaatggtcagcaccaagagaggtaggataataattgttgatatctctctctatccttgacaatttttgaaagaattgaggcaaaaatagcccatatacctatagtaatgatttcaaaatagagtttagccttcaagggcaatctgaggaggagagaaaggtgaggaacccatgtaattgcagctggaaggctactctgctccaactagctttccttttcaactcagcctaccaagaaaaagcaaaagcacaaattcaacatgatcggtaagaggcaaaaactgagtacaaatattgaaacaacaggaaagatcatggtagaataaaggggtcaggagggcagagaggagactcaacttagagagataccctgaggcttcttaacacaggtgtcggagctcttaagggcatgatctgctgaggtcgccatccaccacgtgaatagctcaagtatttaaaggaggcacccatgcggggtgctgtccgctgtgctgaaatgccattgtgttctgggctgcttgcagggccaccttctaatcctggaatgccaatcatatctatcacatctcccacagctcataatttctcctaatttattgatgaaaagcttgtgatttatgtgctattaaagaaaaaaattgagccacgatttaggtgtgactatatagggatctaattttatgaacatttgattatgtttccaacaattacaaattgattttccctctgggaacttgagtggggaaatcattacaactacccacctcccatatcctgatttggcatgcttagggttattattaatctaatagaggaataaattatacacaatgcaaaggtaaacatcagtttgaggtatgcatttgatgaatatatccaacaaacatttactttttaaaattttttttttatttccataggttttgggagaacaggtggtatttggttacattagtaagttcttcagtggcgatttgtgagattttggtgcacccatcacctgagcagtattcactgaacacaatttgtactcttttatccctcaccccctcccactatttcccctgagtccctgaagtctatggtatcattcttatgccttttcatcctcatagcttagctcccacttatgagtaagaacataggatgttttgttttccattcttgagttactatgcttagaataatagtcttcagttccatccacgttgcttcaaatgccattaatttgttcctttttatgactgagtaatattccatcatatatacatatgacaattttggagagaattgaggcaattcttttggaaagaattgatatattacatataggcatagatatagacattatatatatatatacatatcacaatttctttatctgctcattgattgatgggcatttgaggtggttccatatttttgcaacagcgaattgtgctgctataatcatgtgtgtgcaagtatctttttcatataatgacctcttttcttctgggtagatacctagtagtgggattgctggatcaaatggtagttctagttttagttctttaaggaatctctacactgtcatccatagtggttgtactagtttacattcccaccagcagtgtagaagtgtccccttttcactgcatccgtgccaacgtctattgtattttgattttttttgttatggccattcttgcaggagtaagatggtattgcattgtggatttgattttcatttccctgatcattagtgatgttgagcattttttcatatgtttgttggccatttgtatatcttcttttgagaattatctattcatgtccttagcccactttttgatgggattatttgtttttttcttgctaatttatttaagttcattgtagattatggatattagtcctttgttggacgtatagagtgtgaagattttctctcactctgtgggttgtctgtttactctgctgactgttacttttactgagcagaagctctttagtttaattaagtctcacctatttatctttgtttttgttgcatttgcttttgggttcttggtcatgaagtctttgcctaagccaatgtctagaagggttattcgatgtatcttctagaagttttatagtttcaggtcttagatttaagtccttgatcaatgttgagttgatttttgtataaggtgactgatgaggatccagtttcattctcctacatgtgacttgccaatcatcccagcgccatttgttgtgtagggtgtcctttccccactttatgtctttgtttgcttcaacaaaccatttattgaccacttactgtactgcatggattcaggaaacagagggtatagagatgaatcatagtccctaaccttgtgaaatttacaatctaatgaggaagacagactctgaacaaggagttacaagagaaatacacagaggagacaagtagtgtgtgcctactaagcataaagtacagatgctgtaaaaagacaaaattggccaaggtgaggtctctcctttgaaagaatagagttgggagggtagataagcgtgaataaaatggggatgaaataataaaaagtgtggttcaggcaaaattgatacgagtattttggagaagtcagattggactgagattattggaggtagctttaaggaggaggtgggattggtcaaggaggagcaacagaggagaccagtggatttcagctgagtgatcatccagaagtgaggaagagttagcctccacgattgggaaacagagggaaataaggagtttgtttgacccagccctagtgggtcttgaaagcttagtcaaaccatttgggttttctcttgtttccagggtagcaagtgagttctatgagacaaaagaattctggaaataatctgttggccagaggtataatgggaatatatatatatatttaatatattgatatacaaacaaatatatatttatattgatatataaaagatatatatatgcaccttttatatattgatatattttatctatctatctatctatctatctatctatctatctatctcttttaaaaagaaatacatggcccttcttgtgagaagaagaacatatatggcaggtgtgagactcaactgcagcacatctcctcatgtaaatctgcagaaatctttgagggaaaaagggaaagatattaatccagatgtgattaggaaccaggatgtaacatacaaactcattcatttattcttgtattcaagtatttagtacatagccttttctatgtgcccatattgcagctgctggtgctagttttataaacgcaaataccattcccattctcaggcttctttcctagtgtgaaggacagacgtaagtgttaccagcacagggagctcagggagcttgtaatgggtgacaaaactagtctagaaagccagagaggtgatatttaagcagagaacctgaaatccaggtaagaaagactagccagacgggagaaggaggaccagcatgtgcatgggtcgatgggggagcttctgaaagcccaggacatgaagctcaaattctttatcaagagaaaccttggtccctaaagggagaccaccatgagttcactagactttcaaagcaaatcacaagggtgacgaaatggtttgagcacagggctgagaactttgatttcttttcaattcacaaaattactaagctcatattttgagcagctacatccattttcccttcttcccatagtcttgccctgctatattgactaccattcagtctcagaattaatgtcatttccacaaagaagcccccaggagcacctagccctggttcccctaaattcctatggaaaggactcttggtatcactcagcactttcatgcttcccatggtctaccgggtgccacatgccacattaactcctcccctggactcatttccacaaccacccaagagggggaagttattacctgcagagtttacagtcctgcatttcaaatccaacaccactgcctactgtgtaacctggaggcaagtatgtttacttctctgagccttcttgtcgtcatttgtaaaacaagccttgcagaagtagcccccacccgtcagggtgcatgtgacggctaatggagatatgcaagtgcgcttagcactgtgtctgctcatccatgtctcaatatctctggatgagacatcaagactcagataagtaaaataaagcatccaaggtcacctcatgtgtaagtggaagatgctggatttgaatgaaaagttctgtgactccaaaatccacattctttccatcctgccataatgcctttattgacatccttttatcttctcaaatcacacatttaaggaatacagaccctacgtccagctctgcacaaatgttgtcccaattcccaacgatcatctgagatagacagtttcccttttatgcagtggcctgtagggcaaatctgatcttcccaaagctggtccttactcagcatttacagtgcaggaaaatctccactccacctggttgctcaggcagaagcctgggcatcctccttgatctcttccttctctcagccttctcccgtctctatccaactcaatcccaagacttcttgactctaaacagatctgttttaaatcttgttcaccttttagtccccacagctagccatgcctcatcatctctcacctggactgatctttttgcttccacccttaatccctctcaaagctccagccagaaagtagagtgatctttgcaattctagtgatgtcccctctacctcacgtgtgaaaccccccattgcttttgacagagcatctaaatcctgcaacatggacagctaagattatcgttggccatctctcagatcaaggattccagtcacaaaacttggtgttagcaacacaaagagtaaactcagggtcattccaattctggaatcttggcagattctgaggctgcatttgctagggcaagcactgcctgggaggatgtgaatatttggtaactgtgagagttctgaggttgacaacagagcacaggctttgtcagggccctctctggtcagaggcacatggatcaggaaaagcttctgccccgatcttgtcactttgtagctgtgtgacctttggcaaatcacttaacctctctgagcttcagttctgtttattatgcaaatacaaatgaggaagatggatgaaacaagctgtatgacttccagaatttaatgccaaaatgggtcattagatagaacccatgaaattatcaaaatttgacctttttaaagtttacctattaaaatacatggtaatatcatatgtttatacttctctaaaggaacagacatttgccagggctggcaaactttttctctaaagggccaaatagtaaatattttatgctttgatggttatttagtctctggggcatctattcaactctgcatgaaagcatccttagacaatacataaaaagaaaaagcaggaccatgttccagtgaaacttaatttacaaaaacaggaggaaagccaaatttggccagtgggctgtagtttgccaatgcctgctttaaacccatggattttctgttatcacaggaaggggaaatgattgggatgtgaagtttggagttttaatggagcttctgcaagtgcttagcaagcagcaaatatgagtttatttcctcccttccttgtatcttcttccaagaaaagcaacttagagacaataatatggggatattctgcaggctacggtgcattcatattgcactagatgtgttttaggggtggaggaagtttacagacaggaccacctatcattgatctctccccctcttagcccccactcttaatgacattttgaacagtgtagcaggatcctatatgccccactctctggaagctcctccctgtggctgggcatcatgaaaacttatcctgggaggaggtagggatggcatagctggggcaagtttccttacaccaccctgtgcacctcccttgtcaacctgaattgccttagcttatgctctgtcctcttctggtaacccggaaaagtcctctgagcctgataggaattcagatctgccttgtgtgaacagaacctcccgcacgcaagttctgagctgagaaaaaaaatgaatgcttccatcaaattaggccaagtaatatccatctactctagggggaaattatttaaatagcatcaaaatcaatttccatgccattaaatattctggtctgtgttttaattgagacgattacatattccccaaaaagagaagagctatttgaagaatcgtgtcttttctctcttcctctcactggaactgacaaggaaagcacctcagagagctgcaaaccgcctgttagcctgccttcgttcctatccatcttctttagagctaacctggtttattatttttctttaagaaataaaaatggagctctaagaggcacccagggcactgggaactctgagttcttcaaatagaataaaccaggtcattctctcttcttcttcttaagggcttgggtttgtggtcggtggcaagaggcagacatgcctttgatgtcctaggagcagatagggaggtgaggatcattcccaacctctgctgctcccaggccttcttcctattcagtaaatattttgggtgcatcttccatggtccaagaactcactgtggctccctggaggagctcccagtctgatggggggatgttcctgaaaacaagtcattataatgcaacatacaaggctctccacctgatcactgcctcgctgccatcatggacatgagctgtgtgcatcctgtcaagctagtcaaggccaccaaggttctgggtaggaccagctcacaaggacagtgcacacgggtgtgtgtggaatttatggtgagtcagagcaagaggctgcggaggctgtgctgcactcgattgctgagtcctcaatggcagagttgactgcttggcccacagagatgatctgtgactattaaatgaagcatttatgttgtgtgttaaaaaaatcaaaataaaaagcagctgggcacggtggcttacgcctgtaatcccagcactttgggaggccaaggcgggtggatcacgaggtcaggagatcgagaccatcctggctaacacagtgaaaccccgtctctactaaaaaaaaaaaaaaaaaatacaaaaatttagccgggcgtggtggtgggcgcctgtagtcccagctactcgggaggctgaggcaggagaatggcgtgaacccgggagacggagcttgcaatgagccgagatcgcaccactgcactcccgcctgggcaaaagagcgagactccgtctcaaaaataaataaataaataaataaataaataaataaataaataaatagcaacatattaggagcaagaataaaaaccaaggccccagtaagtgtccccatagctctcatcctggttgcaggtcattatctttgccatgctttattcaagtctgactttctttctagacttagggcagagaccaggtcagttctgtttctattgtgttcccaatacctataaagtggcaagcagagtagaggctcaatcagaattaaatgcataaagcaacaaatgaatgaatgaatgcaaggtgaaagcaatgaatgaatgaatgcaaagtgctgctggaatatgggggaagaagcacctatttctatcaaagggatgtaaagaaggctttgcaaagaaatgatgttagagctgagatgaataaaggctcatcttcaccagatggccaattagagggaaggtattttgagcagaggaaatcgtgtgtacagagtcaaaataatataattaaaccaagagctaacatttattatttactatgttctaggctctttacttgcatctgctcatttaattctcacaactaccatatgaggtggtgctctcatacccatttcacagatgaggagattgaggtcacgatggctaactctctaagctcacacttctaggaaatgacaaaaatgtgcctcagtggctttactaatcctgtgataccaagcttggctgtcactgccaggttttcctgcctgcccttccaaaacgtgggttttcaaaacacaggaaagtatccaggggtttgatatggctgtaaaatgagtgctggaaagtaggacatgaggctggtaatataaccaaggacctttttgtagagagctttgaatgctaggctaaagatcttgtggtcaatatttcccaaactggaattctgcaaaacactattttacaagatgtaaataagtgagctctgggtaaagagggagtaggggggaaattcattaagcaaattatttgggaaacatagcttcaaccaagctaaacacattttctgtttgctgcaggatttgtcagagcctctaccatgaaagtaggcattttaattgtgcaagagacagaaaaggcacttcgaacttaatttttgaggcgtatttctcaataacccacagaatagtgaatttgggcattgctagcatagatgatggagatccatggagggaatttaaggatttaaggtcagatgagaggggtcaccaggactgcagggaaggtgactgaaattaagaggcaggagttagagggtttgctgaattcaagaccctcccagtcaggatgtgctgaagaccaacaggaagaggaagtctggctgcatctggaccattggcatcaaagacaggtttctactcacagtgggtccagtggggaagaaactgaattcatacacatggcactattcaaacaaagccatgctgcctctctatagaacaatgggctggcttttcagggcaatttaatgactgtggcaaatagcccaggccatcaattaaataccaatccaatttccttccaatgcattctctgcctcaggagtttcctttgtaacgtggaacaaatctggctgatgaggtgggaagatggattggccaacatgcacaatgactttgtcctctgcctgggccagcttctcagatcttgtctctctttctgaaggagatcacccggtatgaacagaaaagtagatagaattagatcacaggacatttttaaagtgataagaggcatcttgtttagcctagcccctccacccctgctttacctaaggggaaactgaggctcagcaaggaggggcaacatgaccaaggtcacacaactgttaaattagcttcctaaactggtctcccagtttgagtctttctccagtccagcacactccctcttcagtagccagggggatctagcaccttaatctgatcatatgaccccttaagccaagaattccccggaggcatcccaatgaattcagaataaaatctgataagatggagcagagggcacataggccagggtctctccatctccgcacaactgacattcgggatgtttaattatttgttatgggaaaggtgcctgtcccgtgcattgtaggatgtttagcaataccctcggcttccatccactatataccagtagtaccactgccctagctgtgacaactaaaatttctcccgacattgccaaatgtcctctggaggaccaaattaccgtcagttgagaaccagtggcctatggaaaatttcagaaagcaagatgtgtctgaagaagggttagggaataaatactgcctggtttatttacccaacgtgagggcttttgcccagccctttagtctctctgagcctcaattcttttatctataaggtgagaaggataatttctcccctgcaaggtttttgctctaggatcaaacaggacaatggatgtgactgtgcacttgacatgaaaaggtgcttaaaagtcacatgattaactgtgatgctgttcaatgctgtgctggtataatggcatggttgggggatattatgggatgtaattgtctccatgtccagaactcctgaaggcagtggttcttaaatgttaataggcttgtgactcacctggagtccttggtaagtgtgcgaacaccttgctcccacctacatcagtgggtcagaatgaggcctagaaatctgccttttaaaaatcatccctggagattctgctgcaagtggtcttttacgcgtgtaggagaaggcttcctcagagcttgaactagcagtacccactgctctctggcagggggtcaggaacttaaatggatgcataaacctagagcaggagtgggagaaggtattgctaacaccaccccaggtcaagattggaaccctaacctcgttgtttgctgatctgagcatttattgcattttctgtgtccctctggaaatttgaggttaatcccaatcttcgacgcaccagctcccgtccttgcctttatttttcatttgctaattatgcagcgtgactgcctcccaaacatattttgctgctaacgtctcccagtctctgatcaaaaattgtggtaaaacattgtcttgtcatgaggctaataaagcgtgttatcctgcctgtcacagaagctgccttacagatgctgtttgctatctgccagggcctggcattaatctcccttccactcggctacaaggaatagagtctactgtgggaagatcaatattgtattatctcggccaccagtgttgttccagctatggccaatgagttgtcattctcgtgttacaagtcaagtgcacaaaggaaaaggaccagaaaaaagagggaagagaagccagcccagaaggggacaagaaagacagtatcagggaaaagaccccggagaaagactcagagaagcaaggacatgaaaagtggttaaggacacttgccccagccttggacagacccagggacactgctaagcctgccttcagaagcttcatgttgacaatttcattcttctgaacctcagttttcatatctataaaatggaccccccaaaaatagaacctggcacagaaggattgaataagatgatgcgtggtagaatgtttagcccagttaacgcacacagggagggctcagtgattattatggagatattattgctgttgttcttgttgtcatctttgtttcttcctgggtaacactagacaagtcacctttcctccctgggcctcaatttccccaactctaaaataagaattcctttgcatctatgaaacaaaaacaaaacaccaaacaggaggcttaacttgaaatagaattatcagagatttggggaacagagatgttggtgctgacaattgtgaggggtgtgtgtgtgtgtgtgtgtgtgtgtgtgtgtgtttcagagagtgaagcactcctggaggaagaaacagcatagatatgatggacaaaaattaagaggcaaatgtatggaataggagctatagacaccttcagtgctctgcagggagaggacccttagagatttacattttggattattgaagatttgagcaattttatctttataccccttctttatctcttcctcatcaagaggggatcaggtggaacagtggaggaggcattgcctcaagcttaaagcctgattgcctaaggctggctgtcaaggaaaacccctcgctggtgtctgctaggacactcatctttcctcctcctgcctggacaacctgctccccagcctcgagcttccaaccctcataagtgggcagccaccttgaaacttcattaaaggcaagcccagcccctgcattcatttcatgcttagttaaagaggaagctgtgagaagcaatccccattcaagggcgtaatgagatgtccactaatgatccagatacaaaaataaggatgaagcgtggccagtcgaccctcagaagatgacaatttgtcttagaataataatgtctgattgtcctctttgggtgcacatgtgtctgggtttttattcaaaccattcattcggtgcttagcatatcccttcattcccaagtccttgaaggataggaactatagaacagcaataaaatcgtaattattcgtagtatgtatataaacaacattaggtttctgttgctctgctggttacagcatcataggaaagcagctgtctagattcttcatcaaaatcagaacatttgcactaagtctttgttagtatctattaaatacaaaagtaccatatcctgcaaccagcattctgttgggaatattcctaacagaaatgaatatacacatacaccaaaaacatggaatggagttgatattgtttggatatgtgtcccctccaaatctcatgttgaaatgtgatccccagtgttggaggtggagcctggtggcaggtgttggatcatgggagcggatcccccctcatgatcataaatggcttggcgtctttcccttggtgatgaatgagttctcactcagtcagttcctgtgagatctggttgtttacaagtatctgggacctcccccttctctctcttgtttctgttcttgccgtgtgatgtgattgctcccgcttcatcttctgccgtgattaaaagctccctgatgcctccccagaagcccagcagatgctggcaccatgctttctgtacagcctgtggaaccgtgagccaattaaacctctttttttctaaactacccagccttgggcatttcttcatggcagtgcaagagcagactaacagagaaatgtctacagttgtactattcgtaataataactgtgaagcaactcatattgcccatcagcactaaaatggataaactgtgatgtagacagaagatgaataaattgtggtgttgtcctaaaatgaaatactacatagtgagaaacaaggaatgaactaccactgcatgcagcaacatagataaatcttgcaaatataatgttgactgaaagaagccggatacaaaagagaacacgttgcataattagccaatgaattctcagtagtcagaattggtccttggccatagaaggcaaaatacaggttacccttgaagagagcaaacctaaaaattcagaatgtgatggaaatgttttgcatatttatctggtagctatttatctaggtcctatttgaggaatttcatcaagctgtgttcttacaattggggggagttttctatgtccgagttacattcaataaaagtttatgaaaaacatgaaaagatatgcttaggaccatgtgactctaaataggttctgcatgacatccctcactttggatgttggaccccaaacacttggtttgtgtttgggccacaaaaaaaccgaatttttacccacggttatcaccactgggccaggctgcagctggtcatcttatgcccaggggaaaactcagactgcataggcaggggtgaaggataaactttgggatgtcccttgctcctggttccacagcctcagaaaggtgggggtgccttagagaggaaaaagcagggactctggagtattttatattcccttccatgttccttagcaaagcacctggcagccactgggtttgtagtgagtgtttgttgaatgactatatgagggtatggatgaatgaatgaattcatgagtgaattcattttattttgtgaaagttaaataatgtatttagaatgctcttaacatcacctaaaataaaatagagctagtagttaatggggctcatatcagacagacctgggtttgaatcccagacccatcaacctctctcagtgtgtttgtgggtatgtgtacttccatctctgagcctcattttccccatctgcaaaatgtagaaagcaacagtccccacatgacagagtagttctgaggattaaatgagacaatgcatgtaaaacacttagcacattgtaaggctgaaaaagtggtagccatggttgtcattatgaaagagttgctatcatcatgtgaatgaagttgtagctattgttcatgggtggggggaattggcatctttccttctccatctctctgcctctctcttcctccctttctctgtgtcacaagccccacgtgtgcttagccaaccttggcagagttgctgctgagtgaataaaagggcatctttcccccaccccaggacaatggcctagtgccaccgcatgcaggcatcatgcctgtgaagggggccaggtgggtgccagggcactgaggcgctctgtgtagcccctgccgggtggggagctgacaatggccactctgaggaccattaaatttgcctcctcctatgcttccccaagccccaaacccagcacctgcccactgggcaagcctgcaagtgaagggaggctctgtgcgccgcctcggcctcaggcccacacacatccgaggcattgttcttgttggctgcgagagctcgttaggctctgggcagaggctggctggactccaggaggcagacatcaagccccacaactcaaagaatggaggagcctggggcttggcattagatgatgccagtccactcctccgcatgcactggggctctgatgcccagtgagaacgttgactctggaggaagagggtagagatgatgtgttatgcatccctgtgtccccctagctcaaagtggtgctccatacaggattacaggatgactgggagctgggctgccgtggggtgagatggtgcaggatgggatagattggggtggggtaggatgggatagaatagaatagaatagactctggacattttcttcttttgttggagatccaaattcttcctcaagtggactgagaagtcagcaggtgtagacctggcgtggacagagtcacctgagagagcaggggcgataagcagacactatttctccctccaagtcctgcaattctcagccatggccccaaaagagaaattgtaccttaggatcacccatccatagaacacgagatctggaagggttattagagaactttctgtccagtgcttttcagattatgttcaagtcccagaactgccatctataatctatattgctttgagcaagtgactaaagtgatctaagcttcagtttcctcttttgtaaaatgtgggtaataacattatctacctcccagagatgttgagaggagcaaatgaaatgatccataagtttaagaccatggatataggaccttgaatataggaccatggatataggaccttggatataggaccttgcatatagaaccttggatataggaccttgaatgtaggaccttggatataggaccatgaatataggacctgacatgtaacaagcacttatcaccattggccttcatcatcaccaccatcatcatcaaagatgattcgagtaagggaaaaacttagggagctgctctcagactcctgcccccacttctgattaaatccatgtgctcctattttttacttattattagggttcagtggtcccctggactacttcagcttcaataattcactagaaggactcagaacttagaaaagccatcatacccagccataaccataaggtttattacagggagaggacacagactgaaatcagcaaagggaagaggtacatgaggcagagtcctagaaaccaggcacagcttccagctttcctctccgtgtggggccccatggacagcacttctgccagcaatggtgttgtggcgacacccacagagtattgcaaactagggaaactcacccgaccttcagtgcccagggttttatctggggttggtcacacaggcatgattgaccactcatgtggctaccgttagtctccagcctctccagaggtcaagctaataccaaggccaaggcccccaccatcaatcacaatgttagcatggagtatcttgctaacactggcattgcccaaggaccccaggtacacgaagactctaatcaagcaggatattccaaggacttagcggttacctctctggagccaagctcaagggccaaaccttttttcagactgtgcagggtgtggacaacccagacctgctgagttaatcctttactgcacagcagtatacagatggtccccaacttacgatggtttgacttttttttattttgaatttacaacgttgcaaaagagatacgtattcagtacttctaactttgaattttgattcaaaattctttatagcaatttcattataaaataggatttgtgttagatgattttgcctaactgtaggcctatgtaagtgttctgagtatgtttaaggtaggctaggctaagctaggatgttcagtaggttaggtgtattaaatgcattttcaacttaagatgttttcaatttacagtgggttagtcaggatgtaaccccatcataagtcaaagagcacctatattgtcattcctcttaaggttttatttgaaggaatgattccattatacagagggtaagttgaggcccagaaatgacaagggacttcccaaaggctgcagagtgagttaataaggctttctgactgtcctagcccagagctttctctgtcataccacaggcctcagtttgcccatctgtaaaatgacggtgctaggccagcacccccacctcctaggtgccttttggttctgcctttacagaagttattctcccacctttttctgcagtctagtcctcagttggagcatctggctgtcagctacctttggggccacgaagtgtcctccttcatccccaggactcctaccctgaggagtcactggggaccttttagctggagcagatcccctgctgatttgtttgtaataggtggtgctcactctggacacagccaggccaggattcagaggctggctggaggagagacatggagcaaatacagccccttccctcacctcactggggcataagtgtgtggtcaaccagcccggcttcaaatcctggccttgccacttaccagctgtgacacctctctctcagagccccagtttgctcaccattaaaacgaagttaacaatcacaaagtcactgctgtccctgttgtgtctaaagagagtacagttcccgcctcttaaatgagaccaattaagccttgcatttgtaaaactgctttcaacatctaaaacccaacccttgctttaccccagtgtttctttaaggttaaccagtcaaagatcactgtccaaactttacaaagcaggaaacttgaggttttgagagatggaatttgctcaaggtcacatggcaacttgggggcaaagccagtgctagaacccaggtctcctgatttcctggatcttttctacctccaagcacatccttgtaagtacctgggaaggtcaagctactctttattcttgtctgggaatctgagcaaacaggtggagagaaattgttaacttactcatgatggcttttaaactcacttggcaaactggattcatttccaagtattataattctctacataggtaattgaagtatagcatataggtaattgaatgcagatcgatttcccaccctgagcttcctctctgtgctgactggtgtgtctgtctccctccctcaatgactcactgattttttgtgtgtgtacacacataaatcacactgcattcctctcccccttgctggctacctgcaagaattcacaaagccgtaccatgagatgcgaaagcagtgggggttcatggggtgtgaggggaggtggttatgaaggagggaaggaagaggagtgtttaaatgctaatcagttggcattgatgtcagccacagttaatcagattgctaaagatacaagggtaagatcgtgcgcctgtgccagactctctgggctcattcacgaggaagatggatgcagggcccagccaacgctctaatgagatgtaactggacataaaagaatgttcaaggctttctgaacccaacatgaattacaaaggaggcccattcgtgggggagaagccagctcacagaagacgattatccgataattactcttgtagccgaaacactgagtctttttttttttttttaatatagcctctctctcagccaggctggagtacagtggtgggatcatgtctcactgcagcctctatctcctgggctcaagcaatcctcccaccttggtctcccaaagcactaggattacaggtgtgagccactgcacccagactgaaagaatcttttcttgcctgcacaagctttcccacttaacacctgctacaagtcccccaaaggcccctaggtttctgcagcagactcaggaggtatccagggtgtgagttcacgtgtgcagtttggtgtgttgtttagggtggcaaaaatccctgctccatctgtacgaccgtggcatatgccagaaaatgaagagaacagcaagaaattaatcagttgggcttctgtttgacctcctaatgctaaagcaaaccatgcgagttatgtggatgagttgccttcatgttctttgcttgtaagtcaaagcacgtttatctaggattaattttaccaaggattaacctttgtgataaccagtagcatacaccatctacaaatctacaatccgtcacttaaagagattgactttgtcatacacaccaagtcttgttctcagcactgcaggcacacttgtgattcattaaatagatgctgactgggggcctactatgtgtcagaaccatggccacagaatgggctctggggagacagtgatgaatagggtacacatgatctctgtcctcgagaaacttcctcctagtagggaagacaggaaagaagccaggtaattatgagtgtgtgattaatgctttggcttatttctttggtggagttaagaattaaggaaaggagagtaaatccaagtaacgataatagcctatgaaaatgctgggtatcttagaagagagggaaagagagaggcattgattgattgaactcaggagaactgaaataatttagttgccatgaggcaggcagtgagaaatgaggatggggaaatttgctgggacagatcaccaggaaccttccagggaaaggtaaggagtttgaagtttaccaggcagggaaggggcggtttagaacgatctctctggctgctgcggaggccagcaaggaggttgtggagtgagggccacgcaagaagcagggctttcctaacagttgctctgggaataataggatatctaaaaagaaatatctttctttaaaaatttaattttagattcagggggtccaggtgcaatgtgttacatgaatatattgcataacgatgaagtttgggcttctagtgtacccattaccaaaatagtaaacatggtgcctgataggtaagttttcaaccctcacccgtcttccaccctccccacctttggagtctccagtgtctactatttccatctttatgtccatgtgtgcccattgtttagcttccacttctaagtgagaacatgcagtatttggttttgtgtttctgagttagttcacttaggatatgcctccagctccattcatgttgctgcaaaggacatgatttcattcctaaaaatgtctttttaagagacagtttgctctcctggcttctcttgtggtgggacccaggttctttggtgtattgtaacaatgaaatgtgttccatcattaaaaggaatgaattttttaaaaaagaaaagaaggggaaagaaagaaggaaagaaggaaggaaggaagggagggaggaaggaaggaatgaaggagagaaagaaacagaaaaagaaaaggaaagaaagaagaaaagaaaagaaagagaaagaaagaaaaggaagaaagaaagaaggagaggaaggaaggagagaggaagggaagaagaagaaagaaagaaagaaaaagaaagaaagaggagagaggaagggagggagggagggaggaaggaaggaaggaaggaagggaaggaaggaaagaaggaaaaaatgaaaagtggagctcatccaacttcccccccaaccacgttgaatgactccccagtgcctcgacttcccatggaaagttaggcattccccttgggcatttcccatgctctgtctgtgactgcacaacaccactgcaagtaatcaccttaggcaagttttttgagtgttgagcagaacctaagggatgaccattggatggcttcctggtttaggcagacccagtattgagattttctttgtctctcctcccacggagggtgaactgcctgtgggagaatgtgatgggtttgcttccagcctcgttttcccacccagccaccgactctgagaggaagaggagggctggggatcttgggattttcctgtgccgtgacattggaggtgttgaatcacagagagtcaatctgtgaccccatcctccttctcttctttcctgcctttcctgtctcactgccaataaattcatctccagttagaggaagaacatggaatagagatctgtccatgttcatcctgaggaaaaaattgggcgaaaagaaaggaagttagaacaactgatctttgagaaggccaaggaccaggccgtagcagtttccatcaggatggggccagggcacttggtcttgtgtgagtaatgtctacaccccgcttcctgtcacccttgcacagctacgttcagaattatagaacttctggaaacgtcatcagctcctcagcatttgctaaacgcccccaaacatccctcctccccctggagaggtagaatacaagtgtcttttcttggggactccctgcaggagagaagctgatttccctgctccccacggaaatgtgagagcagttagaaaacctgagaaggctggggtttgttctctgccctcctctgaaattgaggtgacaaagggagttaattatttcgtttttaattattgctataaaaatagcatgcatgtggcaaaacaacccaactgtatacaatgatatacaataaaaaaaataaaaagtgattctctctttgagcccaaacctcatttctactctgctgaggtaaagcccattacctggttcaaatgttacacatgtgagggctgggatgcacacccgcctaccttgattgttcttgcttcacactgagttgtgttgacatacagctgtgccattctttttattatttttcaatttgttacatagtttttgaataagtaagtctccctataaatacatacgtacatttatacacatatatatatacatatatatgcatgtaaaaaaaggtctataatgaaaattctcctttccatctttattcctcatcattctacttccaatgccccacctcccctgtaaccaacatagttcatttcttgtgtattctttcaaagttcctttatgcacaggtaaacaaatgcaaatatatgtagccttgttttatctccctgtttttgcacgaaaggtagcatactctgcacatcattctgcaccttggtttttgttttctttttagaaggaagaagacttctttattgctagtaggactaagcagccaatttgtctatacagtctgaaaacattcctaaaactgcaccctacacctccacctctccccaccccacccttatgagcaaagagctatcatagttcaattctgagctgctcacctcccctgaatctatattgacatagggttgaacccaagggaaacctggtgttcagagaactcatttttcaaaatttatctatttttaattgactaataaaattgtatgtatttatcacatacaacatgatgttttgaaatatgcaggcatcgtggaatggctaagtcaagctaattaacacatgccctacttcacacatttattaattttggggtaagaacacttataatctaatctcttagccatttttaaggatataatacattgttattcactgtagtcatcatgtcatacaatagatcccttgaacttatctctcctatgctttggcttaaattattgtcccttctaagactcatgttggaatttaatccccagggtgacagtattgagaggtggtgactcaaaaaggctgttggataaggagggctctgccctcacaaatggattaactactcctgaattaatggattaatggattaatgggttatcatgggagtacaattagtggctttataagaagcaggagagagatatgagcatattagtatgctccgccctgcagccacgtaatgcactgcgtcactatgagaccctgtagatagtccccaccaggaggaaggcctgaattctcagcctccagaattgtaagaaataagtttcttttcttttctttctttctttcttttttttttttttttttgagacggagtctcactctgccgcccaggctggagtgcagtggcgccatctcggctcactgcaagctccgcctcccgggttcacgccattctcctgcctcaacctcccgagtagctgggaatacaggcgcccgccaccatggccggctactttttttaaattttttttagtagagacggggtttcaccgtgttagccaggatggtcttgatctcctgacctcgtggtccgcccacctcggccttccaaagtgctgggattacaggcgtgagccaccgcacctggccttcttttctttagaaattacccagttccgatgttctgtgataagcagtggaaaacaaactaagaaatcctaatttaaattatgtatcctttgaccaacatctccttaatccttacctacccctgcccacccctctggtaaacaccattctaccctctgcttctgtgagttcaaccttttggattccaccacatcttactttttaacattacggaatccttggtcatctctcctcttccgtgcatagatagcttcatcattctcttctctcagctgcatggcattccacctggatattctgtaattgatttaaccttattgatgtattcttgatttatcttctagccttttgctgctacaaatggggccgcattgcttaactcgtctgcatagcattttgcacatgggcaaacatctctctgtaggataaattcccagaagcagactcatgagtcaaagggaagatgtacaaataattctgaaagctcttgccgtgttacactctatgttattcaccagtgacttcatctcattcctttaaaccctgcagatattttactgtgttctacaatcacgtaactagtcccctatggatgggtatgtatgttgtttccagatttttgctactataaacaatgctttgtattgtgaacactttgcaacaccctagtacgtgtcaatgaccacaaaggtctctcagctttgggacatgaccaggcagcctgtttacctaaaaatctattgctgtttcagtgaagcctcttttgttctcaggccattgaacccagactgtcttcctagccctcatttaccatggatctccagtctgacctgttacataaactctggttgatgtggagcatgtctgcaaagcaccctagaataggctccctggatgctcttgagaaaaaagtgtggtgaggcaggtgaaaggttgggaccaaccgtaggcacagcttcaggtagaaagcggcatctagagaaagctcgagagtacctcaaaaatcatcaagggggctttttagaagcctaccgtgccagtatccagctgccccagattccattttagatggtctagttaaaatcttcagaaaagaaatgctgacttcactgctgaagagcagcagcactctcaaatagagttggtggcagggtaaataggttcagattattctgaaggtgattttttttctatgtcaatcaaaatttaaaatgtgtaaatcttttggctgagcaatgagcaatgcaatttctttttttttgagttggagtctctccctgtcgcccaggctggagtacagtggcgcgattttggctcactgcaacctccacctcccgggttcaagcgattcttctgcctcagcctcctgagtagctgggactactacaggtgtgccgccacacctggctaatttttgtatttttagtagagatggggtttcaccatattggccaggctggtcttcaactcctgacctcatgatctacccacctcagcctcccaaagtgctgggattacaggcgtgagccactgcatccggctgcaatacgacttctagtatgccctccttaagaaattatgtgaatgtaatccccaaagatgcgtattaattgcagtactaattggaggaaggtaggggaatggcaataatttgaatattaatcaataggagactggttcagtgaggtatatgtttatattttaatgtaatcatttaaaaagagtaaagtgactatgtgtgttctagtcgaaagcccacggcttctaagtacaaagttggtggtagaatactaatgtaatggaatactatacagcagtgaaaaatgaatccatcacagctgcacttatcaacatggatgaattctataaagtgttgatcaacaacaacaataaaaacagagaaaaaagcagttttcaggataattcctatggtatgacagcatttatataatatttttaaatgtgccatacaatgccatacattgttcacagatatttatatctgtaacaaataagtgcatacaataaataatagcagtaaaataagaacaagtgcacataataaacgagaatgctaaatgccacattcagggcagtagttcattccagggggtggagaaggagatggagaatattatgggggaggaaaggcaggggtttcaactatactaggagtattctattctttaagatgaaggtgcacatatgtgggtatttactgcgttagcctttaactctttttgattgactgaaatatttcaaaatgtgttactcagtaagttacagaacaatatatgccatgtgataactttgtaaatgttcagacagatagaaaatgacaactgtgttcatgatggctggcaggctgctgtgtgagctctgcattttactggcatgatttcattttactctctaaaactccaaaagacaaggctgatgaaaccccaccatacagatgagaacagtgagccccagaggaggggaatggctgtccagtgtcttaccggcagtaacagtgagctaagtccagaacacaaacagttctgactcccaatctcacactcctaggtgctattttgccttttaaagtgaaaatatgtaagtgtttttatatcaatacattttatttagagatgaaacaagacttggccgggtgcggtggctcatgcctataatcccagcactttgggaggccaaggcacatggatcacttgagttcagaagttcaaggccagcctggccaacatggtacaaccctgtctctactaaaaatataaaaaatattagccgggcatgttggctcatgcctgtaaccctaactattctggagattgaaatgggaggatcgctttaacccaggaggcggaggttgcagtgagctgagattgcaccgctgcactccagccttgatgacagatcaggactccaaaaaaaaaaaaaaaaaaaaaaaaaaaaccctaatgacggtttaaacaagattacaattaacactgataccctgtagaaagcaggattggtgaacagaacgtaggagagaagtgcttgtacttttgatttcttacctctcaggtgttctttaattttttgaataaactatttcacaggaaataattatttgaagatgtgggaaagaggaaaagtgcacaggaaacaaagtcagaaagtgtctaactctaccccagttttctctctatgatcttgaacaagtcacttcccccataggagtctttattttttttttcacctataaaatgggaaaaacaaaatgtcaactttacagtattgtttggagatcggaatgagatcctaagagggaatgaactctatggagtataaatcgccacttgaatatcagtattgttagcatgggcatacaggcagagggttgcaactgactgatagggaagacccctgctgcccccaaggccaccaccacctctgccttttgttccagaaggtcttctcaaagtgcaaatgggatcaatactatgaatctatccttccaagtggaccacagggggccggcagctgttgcctgggccagtgacgagcatgtaataagtgcagaatgaatgaatgaatgaacgataaatggataaatgaagtgatgatcaaatgtgcccgagacggaaactcggctcttgctaaatccaacttctttatttataaaatagacattaaactaagaccttctccaaccctcaaattcaatgatacaagcaacacaaagctgatcagttccaggaattgggaaggaagtctttctcagtcctgagggcagtgccagatcacctctgtgttgtgttcactgtgattaatccagtggtcttcaaccagaggcaatcttgccacccaggaaacatctggcagtgtttggaatcatttttggttgtcacaactgggcaggtgatgggagggtagggcatgcaggttgggggaggtttgctgctggcatctagtgggtagaagctagggatgctgctccgtttcctacaacgcatagagcagcttctgtcacccagcaaaaatgatccagcctagatgtcaaaggcataaaagtaactggcagtacagttggttctatgccttcaactatccagatgttcctggctttgtttttaattttgtgtgatgtgctctgctgtggtttttcaagcctcaaacagccttgttctttcactgctgctgatatgctgtgttgactctggacaaccgcttcccctctttgaacctcacactcctttactgggcagtttgtaaccgtgatctccaggagccttttgatctttaagatgtgatatttattttcagttttgtccccagtggggccaaacaatcaaggcaggttgggcgagtctttatagtggagtctgaagtataagaaataaccactggaatgggtattaatgaggattagaatagtgactaacagttttgcagtaccttttaccaaaagtacatccattgattcacctgtcagtcctgcgtcctaaaggtagttactgtaaatagtgccatgagggaataatgatcatcatctctaccaggaaactgcattccaaagaggctcaatgattccatctgtgaagtgcttctgtgattacaaccttgtgtgtgcattcctagacctctcaatcaccaggggctagagacagcatcttaaaatcagctcgttctgtaaatatttatttcatttaagaaagtcttttacgtacttattatacgtattttggaaaatgccaaaaagtaggaaggagaaaatacacccagaggccaccagggcctccatcttagtgccattcttcaagtcaaaacatgattctctgcattgcaatttgttttacttcgttgcttctagccattttcatacataccatagaattttatgtctcattcttttcactgaacattatagcagtagcatctcccagctctcgtttcttcactcacatcaccttgtacctgcatgatgatatgttacgctactgcttggaattccgtgcctctcccaggcattctgctgcggctggggatttaagatacaaaccttcagcttcagagcttgtgctttttttttttttttttttgagatggaatttttgctctgttgcccaggctggtgtgcagtggcacaatctcggctcactgccacctccaccttctgggtttgagtgattctcccgcctcagcttcccaagtagctgggattacaggcccctgccaccatgcctgactaatttttgtatttttagtagagacaggatttcacaatattggccaagctggtttccaactcctgacctcaagtgatctgcccacctcagcctcccaaagtgctgggattacaggtgtgatccaccatgcccggtcgagcttgtgctttttttttttttttcactttaataggatgttcccagtctaatctcccatctccccatcaaagttagaaaaatgggagagaaagagagatacgctgctgccccaacttggatggcagaacaaatgttcaattgccttctacgtggcatggctctgtcctttgggggaagagcaacatcagcgtgcatttaaggaaagctccatctcttctgtttgatctctgtagttgattatcagtgtgtgtgtgttttcctaactccttgagggcaggggccaaatcttagaatgttcactctcttgtgtcgggtgtcaaccataggagaaagtgaacacccaacactttgattgattgaccgcttttgagtagagcaccgactgtacgtgataaaggaagaatcagataaatgtgactatcatgatagaaaattttaaatgttctgaaaaaaaatgagttaatttaactcagcggtcatcggacaccaagaaaaacaaggctattggggcaagttataaagttgctggataagcagttttgtccccatgatgtaagtcttctctatctggacatcatcatggggatattctgattgctccagtttcctgctgaggccctgaagtacaattttcgctaattcccagtgggacttggttttgcatggcactaatctggccaacatcctggctaagaatgaggcctgtgggctgcctatgttgcagaccacagatgcatatcatctgtgttggacttggccttaagtttggagccagctggcaagatccaagcttgtgtatgattaaggaaaaggggatagtagggactgagagatgaatttatctggtggatacaaaactctccttgatggtcaggttttcagtgggaaagggctgactctgaacccagctgggtttccttcttagagtggtttatagctgctgcggttagcacccttgtaccctgggggacccagagagtaagaacagcagctgtgaagaggaagccagttggggaatctgttttcttgcatttccttctgttcttttgactgtatttgggtcttggaggactgggattgctaggggagatcacaagccttggaaagagtcaaagagtcaccatctgctgcacaaacccacactttgttttctgccaactgcatccttaggcacttggaagacaaaacagatgaggaacacatagtaagtcaggtgggttcacgtgttcccaaacttccctggcaactctgataataaaagtcaccagaggagtttttcaatcatcagcttcccaagacccacccctggagattcagatgtgatgggtctgaattctgtggagttggggttggagattagaaaaacactctagcccacccagcagagacaaacaaaatgagagggaaagggaagaggctgattcaagctgaggaggaggatgccaagtgacatcaataccccatatttcttaaaagagctagtagcatgatctttggggtcataaaaaccaagatttgaaacccagctttgctgtgtgacctcaaaaagtgatttaacatcccaaaacttcactttgatcattcataaaataggaacaataatttctgcctgatacggttgagaaggaattaaaaaggaggcaatggatgcaaagccctcttcattactcaacaaagcaatcacaattaaaacattataaatatcactgttattttggccaaggtgaattgatgtgctttttgtcacctccttgtgtgcagatgacacaacttgtttttccaatcttgctctctctctcctctctctcatccccacttataattaaggggtaatgtttgcaaaggagctggctggccagataacccaaaaaaaaacccccaacatccgccagtgttgggatttagcagtcaccttttccaatttagcagggttaacaaatggctctaagaataattgtcaattccctggtcatttcaaaaacccaacaatgtctgagctagaaaggcccttctttcatatgcagtctggctgcccatttgacacatagagaagatgcagagaagaggagacccatgcaaagtcatgctagtgaatagtggccaagatgggacaccacccagatccctcagctcctggttgtatccaagtactttgtgttgtaccacagctgggtcttggaagctgggtgtcctgacccctcccccctgctctttttgtccctatgccctcttttcactccacagtctacaaagatggtcaacatcaatcattttagaaaagcgacagtgagcataaaagccattgttttgaggcagatccacgtctggtctaatccaacaaggtagatagaatacctccattatacaaaagaggctgctgaacctcagcaaggttcaaggacttgcccagactcactcagctcataactgtaacaggcaggatttgaaccctaactctgaagcttcactactccccaccttggactaggaaatctgcctgatgcctgaatgaccttgacctgccctcatgccatccactcacgctgctcccagatacccattcctggcccagcatcactggcggcctggaaggaacactggctggtaatcaatgttacacaacaggaacatttgttgatgccagttgcaaactgttgcagtctatatagattaagccaccgccgccaactccatgaaagtaaatgagcctctccaacgactgctgaaataaatttaaatgacagcactggagggcctggagactgtagctgagtgagtgtctccctgcagaaaatcgacaaggacagctatcagtccgagggcctttgtccccgtgatgtaattcctctctatctagacatcttcacggggatgttctgattgctccagtttcctgccgaggggctgtgattgcaatgacaagagtaaaaaccatgacggcagctggcatttgctaagcactcactacgggtgaggcgctgtcctaagtgctttgcatacatcaactcgctgaatgatggcaaccccaggaaataggaaataatagccccatttgacagctgagggaactgaggcttggagagtgaagtcattaaccagcaattggcagaactgggtctttaaaaagcaaacaaagctggtttccagcaccattctgccagacagctgcctgggccagcccttctttaaaatgactattgggccgggcgcggtggctcacgcctgtaatcccagcactttgggaggccgaggcgggtggatcacgaggtcaggagatcgagaccatcctggctaacatggtgaaaccctgtctctactaaaaaatacaaaaaattagctgggcatggtggcacgcacctgtggtcccagctgctcaggaggctgaggcaggagaatggcgtgaacccgggaggcggagcttgcagtgagccgagatcgcgccactgcactccagcctgggcgacagagtgagactccgtctcaaaaaaataaataaaataaaataaaataaaatgactaaatggttttaccttccagacaaaaataaatcgcaaggatggggaccaaggtgggaggatcacttgatcccaggagtttgcaaccagccatagtgagatccgtctcaagaaaaaacaaaatgaattacaagaagttagcaaggtatacaaggccctccagggcctggcccctgcctccctaccttaccagctttatcccccgtactctccacttgtgctccaaaaccccttgcaattcttttgtgcccacctctgcccagcctccaagcctccatgggtcttcacacagtcctctgttctgaatctgcctcgtgactctgaatcctaaaacatttctgtgtctcccacaaggtcactcttacattccttcagtttaaaatgtacctcccccaaccctgcttttacactgttggtgggaatgtaaattaattcaaccattgtggaagatggtgctgagattcctcaaagatctggaaccagaaatagcatttgactcagcaatcccattactgggtcccattacatatatacccaaaggaatataaatcattctgttacaaagatacatgcatgcacatgttcattgctgcactattcacaatagcaaagacgtggaatcaacctaatgcccatcaatgatagactggataaagaaaatgtggtacatgtacaccatggaatactatgcagccataaagacaaacaaaatcatgtcctttgcagggacatagatggagctggaagacattatccctagcaaactaaggcaggaacagaaaaccaaacaccacatgttctcacttataagtgggagttgaacaatgagaacacatggacacagggaggggagtaacacacactggggcctgttgcggggtggagttgggggaggggagagcattaggaaaaataggtaatgcatgctgggcttaatacctagcgtgggttgataggtgcagcaaaccaccatggcacatgtttacctacataacaaacctgcacatcctgcacataggccccagaacttaaaattaaaatttaaatttaaaaaaactctcctcccccatcccccaagcccagccagagcacacagcttagaaaagagagtgtggcctggtgtccatccccactcatcctcttagctgcatgtctttgtacagggaacaatctgcccaactgtacatggcatgcctgtcctgcagacggggttagggcccgtcctctctgctctcttagcacacaagcttttctctttccaagcattcatcatatcaaatatgattgtgtctactttcccatcccccttcccagtacatatacaaccaggcagtgaggcccctgtgctttttgtttctatactcctaatgcttagctcagtcctggcatgatcaagcccaagtcttcaggaaaaggaaggaaggaaggaaggaaggaaggaaggaaggaaggaaggaaggaaggaaggaaggatggatggaaggaaagaaggaaggaaatgaaggaagaaaatgaaggaggaaggaagaaagaaaaaaatggaaggggaaaggaaggagggagggaggaaagaaagaaagaaaggaaggaaggaaggaaggaggaaggaaagaaggaaggagggagggtgggaggaaaagaaggaagaaaagagaaagagggagagagggaaggaggagaaaaaagaaaggaagggagggagggagaaaggagaagttggtttagaggccagccggacgagctttgggcaccgcccttaggagggccaccctcagagtctgacagcaggtgaaggtcctaaatctccccaaactaactggtgtcttttctcctcttccaagatgctcttcccgagggagatgctagccctttgggtccttacctcctgccctcaggagccccggagagaggcagtcctggcaaagagcaccctgaagagagagtggtaacagcgccccccagttcctcacagtcggcggaagtgctgggcgagctggtgctggatgggaccgcaccctctgcacatcacgacatcccagccctgtcaccgctgcttccagaggaggcccgccccaagcacgccttgccccccaagaagaaactgccttcgctcaagcaggtgaactctgccaggaagcagctgaggcccaaggccacctccgcagccactgtccaaagggcagggtcccagccagcgtcccagggcctagatctcctctcctcctccacggagaagcctggcccaccgggggacccggaccccatcgtggcctccgaggaggcatcagaagtgcccctttggctggaccgaaaggagagtgcggtccctacaacacccgcacccctgcaaatctcccccttcacttcgcagccctatgtggcccacacactcccccagaggccagaacccggggagcctgggcctgacatggcccaggaggccccccaggaggacaccagccccatggccctgatggacaaaggtgagaatgagctgactgggtcagcctcagaggagagccaggagaccactacctccaccattatcaccaccacggtcatcaccaccgagcaggcaccaggtatgcagcccccaactcctgaagccatcctgaaacagccatgaggcactcactatgttcagggcatgtgggtagaggaatctcaagaagccccggccccaccatcagttaccgtccattgagcactgactatgagcttcgccctgtggctcagaattaatagcctcatttcatttgtttgttgttttggggggttgttttagcaaaggggtcttgatctttcgcccaggctggagtgccatggcacgatcatagctcactgcagcctcaaactcctgtgctcaagtgatcctcttgcctcagcctcttgagtagctgggactacaagcatgcactatgatgtccagctaatttttttgttttttgtagaaagggggtcttgcttattgtccaggctggggaactcctgggctcaagcaatcctcccacctcagcctcccaaagcactgggattacaggcatgagccaggacactcagccaacatccccattttaaagatgagacaactgaaaccctgagacccccaagcaacctgccaaaggtcacacagctaatgagcaagattcaaaaccttttcatcttggaacggaattcttcatttaacctgcttcaaagccactagccttttcaaagcacatttgcttttagcattacatgtattttctagacttgataaaatgctcttctgtgttccagtcttctctaccatctttaaaatgggagaaggacccccaattgtcaagcatacatggattttggacaagtgcaatgtggccacccttcaaagcacgtgagctctgggtccaaatcctgcttgctgtttgagctcggcccctctctgagcttttgtttacttccctctaaactggggatgaaatattatcagtccctatgagaataagtggggtcacccctgttgactagctaaaatggtgcctagcaggatatagtaagtgatcattctgtgtcaattattgctatttttattatcatgtcaattctggagctgaggaattaacagcagaaggacagatgggaacagcaaaatgcaggttcccctaaagcccccattccaccccacagcccatggttgagcttacatccaagttgtctttggtgtcctaattaaagtccttccttccagctctctgcagtgtgagcttctccaatcctgaggggtacattgactccagcgactacccactgctgcccctcaacaactttctggagtgcacatacaacgtgacagtctacactggctatggggtggagctccaggtaaccccaggagagtacctcacagaggctgcctcgtctagcaggaagtctcaggaggattgtctgagtcaggcttactgttatgctaactagtttggttctgtctttgcccaaccaggccaactttagctgggttttggcgaatgagtaggagttcttaactcaatgctttgctaaaatagcttgtggggatagagggaacatgctgacaaattctgaggtatttcccagaaggaaaatcccttgatactctgcttatctcacacacacatacacacacgcatgcacgtgcataaacacacacacacacacacacacacacacacacacacggaagctccacctgattcatttgattctttcttgcttgcttgcttccttatttctctttctctttctttcttgcttgcttgcttgcttcctgctttcttgcttctttctctttctctttctttctttctttcttgcttgcttgcttgcttcctgctttcttgcttctttctctttctctttctttctttctttctttctttcttgcttgcttgcttgctttccttcattttctggttattaggacattttattcttaaacttttgcccatacagtaagaaaggaaaagcagggtggcataatgctcaaacatctgggttttaagtcctacctcttccagttaaaactgcgtgactttgaacaaggaacttcacctctctgagcctcagtttcccgatcaataaaataggaataatgttactgctttgtaaagtttgggggagcagtaaatatgacaatgcagagatcatttggccacagcccagcagagagagagggaggagagagagagaaatcatttggtcagagcccagcagaaatcgcgaccatgcagtgcatgttatccattatcttcagtatgctaatcaccctgaatgtgttcctttttctcatgggaaataaagagccatcaaaagtttctgagctggggcaggtgtatgaccttaccttaggaaggttttttgtttttgtttttgttttacttgtataagagagacaaaaggtaagcccctcagcagtagaacctgtagtctttgcagtccccagagctttgcacaagtgtgtggcacattgtaggtccttaataattgttcatggaattaaaataaactggagaaaacctgcagtccagattattatagtgcttaagaaccctttcctccatgtcatgaagagtattggacccagtatgtgtccagtactgtgtggagccttttaccaggcacagtagagttcattcattgagcaattagaatgcaccaggcaaagctgttgacacaggagaatatgttgatgtaaaaaactgatgcaatgcctgccctaaaagagaaatacgtaggatgccatttagtagggactctaattggtgttttagaggttgttgtagaatcgcagcaaaggaacaggcaaactccttggcaatcagggaaggtctcatagaggagggcaattttaatggggctttggtgaatgagtaggagttcatcaaagagaaaagaggataagatatagggcctgaaggaagaagagcttgtgggtaaggcctgccctgtttagaggagaggcagagaaactaaagttccaagccctactcataaaagcgtaagtcttcaaattaggcattgagacctgactaaattctcccttacacacacacgcgcacataccatttgttcagcctccctgcgtacaactaaagtatctcgcttctttcttctcaaatcccacagagtgtaaatggcaaagcaagtgtctgattctttgagataggggttgattgtcctgcagttgtagccaccactggggagaataagagaatgggccagagagtgccctagaaatgaggcccccacccctcacttaccaatttatgcagaaaatggaagaatatattcaatcttttttaaatattttctgagcacttaatatgtgccaggtactattctaggcactggaaacattgaacagcatggagaaatccctaaccttgcagagtatacattctggtagaatgcttctcccggctccctggagattggatctcaagcacaagctgatccaactgctgcctccactcaccagctccaggataatctatcccacccactagcatccagggcctgtgccaaaggcccctcttacaggacacagcaatgggggcctcacattgcaagtcccttgcaatgcctctgccttgcagtttggtttcactctatccccttggcttttggggaaattagggggaccttgatattcccagggctcctgtgggctcggcatggggcccaggggtcccgttgaccaggggctagcagtacctgggccacttttcactgacttctttgcaaccttagaaggctctgtctcaaacacaactcagagttcctctctgtctgcttctgcctgttcccaggtgaagagtgtgaacctgtccgatggggaactgctctccatccgcggggtggacggccctaccctgaccgtcctggccaaccagacactcctggtggaggggcaggtaatccgaagccccaccaacaccatctccgtctacttccggaccttccaggacgacggccttgggaccttccagcttcactaccagggtagggtcaggccaaggctgatgaaacataggcgtttgcctcagtttccctctggagaaaaggattttaaaactttttgtgccagggacctctctgacagtttggtaaaacctacaaaccccttctcagaataatgtttttaaaagtataaaataaaatatatacaattttaaagaaaacggtattactgagctgcagttatcaaaatactgttataatctatgatgccttaatctatgtgctttttattaattcattaaacaatgtcttctagtagttcttataattgctgacatttcaaagtactaaggagcataagaaataggttgagatatccattatgatatgaaaaatatctgtggtttctcttggtgtcaaagtcacaggttctactacaatgtttcagtttgttgccaggaaaatagcacagctaaggtagaggttaatgaaaataagcaagcagctttccttcattcaagttcacaggccctgaattcaatatatagatccactgtgcgtccacagactcctgataaagagccttaacagggtacttctctcttttcttcttcctctactggttttcctttttgtctgttcctgtcttctctgttttgctctctgttcattcctctcttctcttacttcctttctccttccttctcttctcctccctctttgcttgcttgttttatttcttcatttcctcctctctttctcttcctttccaccctctattttccctcccttctctctctctctcctttcctagtcccccttttcttcccctctcctccaccccgatttcctcctatgcagctcccatgacctcaggtctcctttgcctcacccaggaactttcccttggatacttaccaactgctgaaacatctgaatggaaagtggattcgtgaaccatgcaaccagatattgagagccatcatgtgttatatcaaattgtccagacatttgaaaacaacaacaactcattttcaacttttctctcacctgtttctgaaacaggtggatgactgcaaaggggagtgtccacttcatcacaacttttcattgtgggatactgccctttgctgttgttgtgaatttaaaagcaacaacaaaaaagaatgtgaatcatgaacttgaatgtattcctcctcatcagtactgagaataaagatattctgtgctgcaggagaggtcagaccatggtctagggtgaagaagctaggatgaatttgacatcctcttatgaaaactgaggaattcagtatgtccccatgcacccttttactacccccatctactgactgcgaaggaggctctttctctgtattatctcatttaatccccaccaccacctgtaaggtggaggcactgagtccttgtctcaaggtgacatcgttttgtaaactcacattagttttctttctaaagcccaagctcctgtctcgcaggccagtagttctcgagctttcatatccttgggcaattcccaaagacctggttcaagcatctgcatttttaacaagcactcaagatgtgcacgcaggtgggactaaacttcctgggtggtcttgcccctcccagtcccagagagaaggccaatctgtctctacatagatagagataggctcaaaggaggtatggaaactcatttttcatcccaaacctgctgtctctgtttaggcagggtggcgatttttaagtcccaagaaagtgctaacctggcagtttcagcctgatatgatcaaagagagtcacaaaaataccattctccagagctctggagtccccaggggcctcatcttctctccccagcacaaactggctcccaggatgtgggtcaggttcttgatctgccactccaagtgatgactgagtctgcctctgcatttcttcccagccttcatgctgagctgcaactttccccgccggcctgactctggggatgtcacggtgatggacctgcactcaggtggggtggcccactttcactgccacctgggctatgagctccagggcgctaagatgctgacatgcatcaatgcctccaagccgcactggagcagccaggagcccatctgctcaggtatgctccagcctcagccggaccaaacctgatggtccaactaagaggggaaagaccaacctgtaggacaccgagagtgacctcagggaatggctttcagcccaggggaagaaactgctccaaatatggatgactattgttatttatgtttttattggagtaaaatacacataatatgaaatttaccattggagacattttagtatgttcacgctattgtgcaaccatcaccactacctagctccaaaacatctttaacaccccaaatggaaacactgtacagaaagcagtcactccccatccctccctcctccccacactcgctggcaaccatccggctgcattctgtctctgtggatttatctattgtggatattttatgtaaatggaatcatataatatgtgactttcatgtctgacttctttcacttagcgcttggcactgtgttttcaaagttcgtgtatgttgtagcatgtatcagtacttcatttctttttacagctgaataatattccattgtatggatgtcccacattttgttgacctgtttattcgttagtagacatttgagttgtttctacttttcagctattatgaacaatgctgctgtgaacatttgtatgccagttttttgtgtggatatggctttcatttctcttagatatatactcaagagtggaattgctgggtcatagggtcattgtatgtataactttttgaggaaccatcaaacgattttccacagcagctgcaccattttactttcccctcagcaatgtgacagtaccagtgtctccacatccttgcccacatatgttcttttccatgttgttgtttttattgtagccatccttatgggtatgaaggtatctcatggttttagtttccatttccctgatgattaatgatgtcaagcatcttttcatgtatgtgttggccatttgtagatcttctttggggagatgtctagtcaggtcctttgcccatttttttttaattatactttaagttttagggtacatgtgcacaacgtgcaggtttgttacatatgtatacatgtgccatgttggtgtgctgcacccattaactcatcatttaacattaggtatatctcctgatgctatccctcccccctctccccaccccacaacaggccccggtgtgtgatgttccccttcctgtgtccatgtgttctcattgttcaattcccacctatgagtgagaacatgcggtgtttggttttttgtccttgcgacagtttgctgagaatgatggtttccagcttcatccatatccctacaaaggacatgaactcatcattttttatggctgcatagtattccatggtgtatatgtgccacattttcttaaaccagtctatcattgttggacatttggcttggttccaagtctttgctattgtgaatagtgctgcagtaaacatacgtgtgcatgtgtctttatagcagcatgatttataatcctttgggtatatacccagtaatgggattgctgggtcaaatggtatttctagttctagatccctgaggaatcgccacactgacttccacaatggttgaactagtttacagtcccaccaacagtgtaaaagtgttcttatttccattttttaatcaggttgtttgtctttttgttattgagttgtaagcaatcattatatattctgatcactagacccttatcagataagtggtttgcaaatattttctcccatttcatgggttgtcttttcacttactgacagtgttatttgatgcacaaagcttttacatttggcaaaattaaatatttttttcttttctttcttgtgctctgagtgtaactactgccatttttcaagccaagccaatatgtgttgcacaccgtgccagaggctgcatttaatcctcacagcaatgccataggatgggagccattatccccattttgcagatgaggctcatgtaggtgaagtcacttactcaaagcctccatgtagaaattgttggaggtagcctgctgacacagtctggtgccctctagtaaaaagaagtgggctttctgagccagcagacagaatctgagacttcgaggacagaaggaattttaagcacctgttgggcgttgtttgtcattcagagcctttcctatctaggtactcattcgacaaacatccgccgagcgcccactgtgtggtaggcattgcacctgttgctagagctattgcagggaccctgacccagttcctgctctcacagagtttccagtcaaggtgaggctgtagtatgtaaatgagtaaacaaggatgcaaacatgctggtaacagattgtgttaaggaccaggaaagaaattcacatggtggaatgatgcagagtgaggatggagaggacatcagttattgtgagaggcgttgcaatgcagaaaaggtatacaggaagaagctgtgatagaggacctcacctgggaggaggacagtgatgagcgaagggtcagggaaggattacctgataacactccaagatttggaagttgagtaggaaatagactgagggtggaaaatgggggggagaagggggaaacattccaggcagatgcactagcacatgctaaggttcagaggtcagaaggaactcgatgagtttgagaaagcaaataaataaataagatcaatctgactaaactgcagagaaaatatcaggacaggaggctggggcagtggtcagaaactgtattgctcaaggtcatgagaagacaggtggactaggtaggagatatctggaaaaatttaagcataagggtgatcattctgacttctatttggcaaaaatgattgaggatggtcagagtggatccatggaaatcaaggtggacaatatctactatttcacttgaactcagggagataagattaccactttcataggcaaagagaatgaggcttagagagatgaagtaacatacttgaagtggcgaacttagtccagatcccttctctcctgagctcctccccttacagcttccttactcaaagtgtggtcctcggactagcaaaattattagaaatgcataatcctgagccccatgcaaaaccaaatgaatcaaaattttcactttaacatggcccttgggtgactcatatgcacattacacctggagaagcactggtttgtaacgcactgtccctgcaccagtgggcacagccttggccatcttcagctatcaagagagcaaaacccttttagaattctcaaaagtcctgatggtggttgagagagtataggttgccctgccacctactatgtgccaggctatgagccatgtgtgaagagaatattggaactaatgagacataattcctgccctccagttattcatagccaagtggagctcaaaaaggaaatgagagctaatgataaattctgagattcaattgttacagtattgttcccccaaggcccttcagaatttttctttcttttttttaaacaaagataaaattccaaaccatagggcagttggtcttcacgcctctctcacattaatttttatctatgtgtgaaatcagggaggaattaagcttccatttgtgctaagaaagatggatggggagccacggctggcaaattgaagccaaacagagccatcagttggcttaatcaggcaaagaagggaagcagagaagccgcaaacgatcagcagcttgggaggacagatggccagagccccccaccagggacagtgtcctccatttctcagctcctgagccacagggcaatagagctggctatgttttgagtgcccactctgtgccagggatggcatgaagctccccatgcccatcgtttcattgatttctcactactgtcctataaggagggtggacttatcaccattttacagtgggtaaacatgtgacttgtcttagatccacagcagatgactggcaaggtttcaacctagggctggcttatttcacagaacaatctctcctctaggacagaagggcagcctggagagagaaatgaacctagctttctgtctgtggtcctgaaagaagtatggagcttcttggcaatgtctttgctgtaggtcacaacacagtctggagcagagataagagttatccaccgttctctgctactgcaagccccattcagtcatactgtcattcaacaaacatttaatgggtacctgctatgtatcaagctttgagctgatattagagatacaaaaaggaaaaaatatttattctttcattcaacaaacattttataaagcaactactatatgccatatacctttctggattagcaggttatcataaataagacagacagtggagtagtgacttcgataagagatactggagtgaggcagcctgagcttgagtctcaactgctccacttattatgtgtatgtccttgaggaagtggcgtaatacctttgaacttcttttttcctcttttgcaaaattaatcgtggttattcagtaaatatttactgagcacattctacataccaggagctcttctggttgctggtagtgtgactgaaagcaaacaaacaaaaagtagtcctagcttttgtggaacctacaaaccccttagccatctgtgagatggttccaaataacctgtcccacttttgcttcctctcctatatctctgaaaatgaagggggaaccaagcgtcctgtgcttgggaaggaaatatttttcaagctcctttgatcctcataaaagatagaaatggctcccaagacttgaaaccctggtcatggtgtagggctttactcaatcgtggccctgggctattcttcacatcccttcctcctggactgactgccacgctctgtgagaagcatctgctacccaccatctctcctcagaaaattcaaaactggctgagtgctgtggctgatgcctctaatccttacattttgggaggccaaggcaggtggatcacgaggtcaggagttcgagaccagcctggccaagatggtgaaaccccatctctactaaaaatacaaaaattagctgggcgcggtggtgggcacctgtaatcccagctactcaggaggctgaggcaggagaatcacttgaacctgggaggcagaggttgcagtgagctgagatcgtgccattgcactctagcctgggtgacagagcaagagtttgtctcaaaaaaaaaaaaagaaagaagaaagaaagaaagaaagaaagaaagaaagaaagaaagaaagaaagaaagaaagaaagaaaaagaaaggaaagaaaattcaaaactgttctctcatatagtacgtgagaaaacaatttcctaagaaccaaatatctcctaagaattagagtaaaaataagaataccttctcgcttgagaactggaaagtgttctttccagtgcacaaatcactttttaatatttttcattagatttttatgataaaagtaatagatgattctggtaagaaatttttcaagaaatagtgaagtgtaagaaataggaacaaatcacttttatattcatggtctcaattgattcttgaaaatagcttattaaaataggtatggcacactattttctaacttgctttttttttcacttaaaaaatagtgagcatcttcctatatgctgaagtattctttgagaacatggtatttagtttctgaatgggtggagtgtatttacagttatgcatcacttaacaatggggatatgttctaggaaatgcatctttagatgatgtcatcattgcgtgaacatcatagagtgtatgtacacgagccttgatggtatagcctactacatacccaggctatatggtacagcctattgcttctccgctacaaacctgtacagcatgttactgtgctgaacacattgtaacacaaaggtatttgtttatctaaacatagaaaagatacaataaaaatataatattaaaatcttatgggaccactgccatatatacactctgttgtaaattgaaacactgttatgtggcacatgatgtatttcactaaacatctgtgagtggacattcatcttggtgttttttttatttttcattcctagaaacaagatagccatgaatatcctcattcctaactcttggtgcaaatctctaaatcttttcttattataattatccagaaccgcatttggcggatcaaagtgtttgagcacgttttctaggcttttcactaaattgccctcccgaaaggtcataacagtttgcattctaaccagtcatgatgaaagtgagcatttcccatcacccttaccatctccagattttattgctgctttttatcttggccgattaggtggatgaaagtagaatacagcttagatttgcatttcatttgttattagtgaggctgaatttttagtgcttactgagtactagaaatatatttcttcttttgtgaactgcctgtttatatccttcttgattgccattttgtaattaaaagtcagggcacagccagcaccacagaactgtcgttaaattgcagtcattccctaccatgaaatacacatgttgatggttccaattgtagggtgaaatctcctgtcaaacaggattccctcccaggagaagtcccttccaagctttctctccctgcccggtttcctcccgctccaggtctctgatgtttcatcctgggcaaggggcaggggtggggatcaggggagaatgaaacactcacttccttctctctctctctctctttctctctgtctctctcctctctctctccctctctgctctctcccattgcccacccacccctttctggatcagctccttgtggaggggcagtgcacaatgccaccatcggccgcgtcctctccccaagttaccctgaaaacacaaatgggagccaattctgcatctggacgattgaagctccagagggccagaagctgcacctgcactttgagaggctgttgctgcatgacaaggacaggtaaagctctgaaggtccacacccaaccccgtttcttcccagaatattagaacatggcttgaggacttggagtcttgaaatggctgaagctttgaccctcggaattcaagaaaagaagagctggggtggatggcaaagatcttagacaccatcagcttcaatctcttccttttacagataaggaaaccagggtatgcagaaggaaatggacctgccccagctcaatcagcaggctaggggaagaggcaaaaagggaactgccctattctttctcttgcacacccctttttgcagttgaacaaaaagagagtatgtattgatcatctgctcagtacccagccatatattaggctccatggagaacatgaaagaagtagaaaatattagtttctgacatgataggaaattgagatggaaaaactagacgtatgcacatgaaagaatgaaggagaagttaccaggcaatatctaagcaagagtgtgtctgtagactcttaataatatgcatagaatccagaatatgcatagaatccagaattataaaactttaatattctgcagtattattctagaatatttggggatcttattctagaaattatggaatcttattctagaatgttctgaaatattctggtatcttattctgggatattctggcgtcttattctagaatattatggggtcttgttctagaatattctggattattctgagatcttattctaagatagtctagaaaactaggactttagctgctttgacttgctgtcttgagttgggtttccttggaatcagacatggtgataaagatgtgagaggaagtagttcactggggagctgatcctagtaagcactaggaggcacatgggaaagtgagattgtgaataccagctgcgttaataagcgggtgactgctgggaaaaccgggattctgtccactggaaacctctgggcaatgtgttgagcatacctcagagtggtcctgttggaagggtgagggagctagggtacttatgcaccagctcccattcatcactggatgagagatgtgatgaggagcactaactatccccaacatcagctgccaccctttgagctggttgagttgactgattctcagagacttgtggtcagaagccagcagaaaatgtgggagcagttgactgctgaggggtaggagagggtagggcactggcagtgtttactgcacttccagaatgcccccaccttagaattttggagtccaagaaactttgatctaagaattctaatgttttggcttctttgatggatcaaacctagactatgaggtctttagtttggaaagacttaaaaaaaaaaaaaagacaactgaataattttcccatacctcttgagtccacttccctctaggcagttcagctttatccagaacaactctatatcgataaattgctgctgtaaagtgtaaggtatcaagcaggggctcccgaacgtggctttttagcagcaccagaataataacctggggaattctttaaaaatcagattccctatcctttcttctggagactctgaaaatctgggcatgggaacccttggtgaaggaccatttccaaatcttaaacctcagatctgcctcttctgaggggtgcttgagatgagccaggcttaagtttatactagacaacaagaattagcagagacaaaagaatgcatcaaaatgagtattttcttattttctgcaagttgtttaagtcctgacaaatgggccccccactggcactggtcactagtagtttctctggggtcctgcaaagatctgcatgagctgacacttaccaggaaaaaaccagctttcaagtgtatcagtaggaagagaagtttgtagagttcatcaaggttaaaggtcaacacacacacaaaaatgatgaagacactactctctgggccaagaagaaaagagaaatcaattatgtctgtcccatgtactttattgagggggaaatggctaaaataccacaatatgtcagttgcaagaactcagagctagataagactctacataagaaatgggactttgacctaaagtcaaaatggaaggagattggataatggatccaaaaatacagagggaggggtattccaagcatggagaattggaggatgagcacaaagatggaggggaaagaattagcaaatttgttggggggctgcagcagaagctctcatgagaacaggaggaaagagatctgggaagctagattggggttatatcctgaaggattttgaatgccaggctacttttataggcaatagagagcctataaaagtctttttagtcgaggagggacatgaataaagattttaagatgattttcctcaaaatgaaccctttctaaactccagtctcataatatgcccccaaaaaagtgagttctctggtcaaacatgtttgggagacactgcgcccaccctatccttgccttgaaaggtcgtaatatgtactagctaacaaaggcactgataagtcctgcagggaaaaaaaagtttaatttttatttaattcagcattttgcaaatccatttgaccatagactattaagaatttgagagaaaatgtattactattgcagacattctagaaaatatggttagaaaattgttggttttaaaagattaatagactacagagattttgagatcttgaagctttcctccagagcaaccctctttgccaaaggcttctgttctttgaaagaggtgtcccaacacacagcccctaagatataacagagtcatcaggaatcagaagactatgtagatgccccttcccactcctggaatgccccctggactctaccacagcccccatccttgcctcagccatactggacacatggcaaaataaacaaactgtggctgcaacatttatacatcttagtgacattagaaattcatctgggcagcataaaataaactatttttatgagtcagtaaaaacctcaaaggcttaaaaatgtgtgtttatgactccataaaagaagcttatctaatttgtatatggttttcttcaccatttttgcataatttctttaaaaaaccaaggctagcaagaagtcaacttcaaatagctttaataacaataaaaataaatacccaacattttgtttaacacattttatttttcagggcactttttattttgcaatattctcaaagcccacctgtaagatgggtcagaacgacgttatggttgggtctctcctttcacagttgaggacactgaggctgaaaggtgttttaagacttaatgtaaatccagatggggaattgagaaatgggaattatgactcttgacttcccacacagtgctcttagaaaatggggatcagagacagagcctggtgggagtcaaatgcttaataaacaaaacttacctaccgtgtcctgttaactattttttttttaagaccgagtcttgctctgtcacccaagctggagtgcagtggctcgatctcggctcactgcaatctctggcttccaggttcaagcaattctcctgcctcagcctccagagtagcagggactataggcacgcgccaccatatctgtctgatttttgtatttttagtagagacggggtttcaccatgttggccaggctactatctaactcctgacctcaggtgatccacccaccttggcctcccaaactgctgagattatagacttgagccaccatgccccacactctgatataggtgcaattgtacccattttacagatgagaaaacagaggctcagagaagtgaagtgttcttgtgcaaagtcacacagctgagaagtgacagagtcaggactcacacccaggtctgcctgactttacaaaagccaccatttaggcaatgagattagtccattatttccaacttctcagttaataataatagtcaacatcaattcattagttcgtcgtttggtttattacatcatatacattactctccctacaacctcagaataaatccataaggaagccaggacaggcatttagtcccattgtacagaagaggaaacaggttcgataaggtgatgcttgtctgagcacataagaggtaaagtcaggactgggcgtggtggctcacgcctgtaatcccagcactttgggaggccaaggcgggtggatcacctgaggtcaggagttcgagaccagcctggccaacatggtgaaaccccatctctactaaaagtacaaaaatgtgctgggcatggtgggacacacctgtaatctcagctactcgggaggctgaggcaggagaatcacttgaacctgggaggcggaggttgcagtgagccaagatcgcaccattgaactccaggctgggcaacaagagtgaaactctgtcaaaaaaaaagaggcagagttaggtttgggatccggtaatgaggctccagaggcagtcgtagcacatcccttcctctgccatgtcagtgacccaggaagatctgtcagtgtccctcctctctgctcccactgccaggatgacggttcacagcgggcagaccaacaagtcagctcttctctacgactcccttcaaaccgagagtgtcccttttgagggcctgctgagcgaaggcaacaccatccgcatcgagttcacgtccgaccaggcccgggcggcctccaccttcaacatccgatttgaaggtgagggtccctgggagcttccctttctcttgtggggctgggggtagcctgggagcagggaaagcatggggagatagaaatctgggctgcgaaggatgtgggaaatcccatggccatgtggatcctttggtttccaaagacaggctcttggtttcattaataataacaatgcctatcattaactgtgcacttactacgtgctcagtgccttctgtgcactgtctgattggatttcagcttctgcatcatgtttgatcctcatcacactgaaacattagaactgttattctatctgatttttggtgaggaaactgaggtttaagacacttgggtgaccggcccaagaccaccagtgaacaagggtggagttaagatttctgtccatcctgtgctggggagccctgaagctctgctccactccacctagtagacctcttagaatttagccacttcttcctccaagaagaatttagcaagagcctctcctgctgagaccctgactcttgaagaaggggttcgctgggcatttcatgtacgctgggggactttctgttctggctttgccaagaaaagctggcttttatcatagacagccctacagtttccagtggcaaaaagtcagggctctgaagttacgggccatgggaaggatccatataggatgtggaaaggcattaaaacacaacaactccacagggtggagaagacagagattcttactcctattttagatttttttaaatgaggtcccaaggagtcaactgggtggccccagggttctcaacacgtcagctggaaccaggacacgtaatttggtacctgttttctttggggcttttctaaacagcacaggggacccatcttctgaaatatagcaccgtggggtagtccctgcatcatctgaactgctgcctctctttcccttcctcagcgtttgagaaaggccactgctatgagccctacatccagaatgggaacttcactacatccgacccgacctataacattgggactatagtggagttcacctgcgaccccggccactccctggagcagggcccggccatcatcgaatgcatcaatgtgcgggacccatactggaatgacacagagcccctgtgcagaggtgagcggatccacaacgctcttcccacggcaccccagggatctccaccctttggatgagaagaccaaggccccagcttagaggcctgtccccagttttcataccaactttaggattagaaccctttccagggttcactgtcctttggttcagggttgctgctggtcttgagaaaattacaaaatgggtgaattttagaaggtgcaccttcttccaggcataggtcccacagtgcacagcttagtgagctgaatactgcatggatttcagctcctaaatactccctctgctacgcatgcttgtgcagtgcacaacccacgcaataacctcattaataagaacaataatagttcttaattggtgtgtaataattatgctaccagcactttgctaagagtgtgtgtgcattatctgatttcaacctcaccatagccttataaagtagattgtatcggccccatttgtaggtgagaaactaatgctgtgaagtgacctgcctaagaacacacaaggggaattggcagggacaggaatggaactcatgtctctttgttctcagagcactgtgctctgagccccactggacagtgttgtagaaccctcatctacacaggctgcagtggactgtcctgccagtttccccatattctttttgttgttgagacagagactcgctcggctcactgcagcctccgcttcccgggttcaagcgattctcctgtctcagcctcctgagtagctgggactacaggcgtgtgccaccacagccggctaattttgtatttttagtagaaacggggtttcaccatatcagccaggctggtctcgaactcctgacctcaagtgatccacccaccttggcctcccaaagtgctggcattacaggcatgagccatcgcacctggcccgtttccccatattcaaggctgctgagccaccctgagcctgggtctcctgctggcatgtggagtaatgaaaggtgccctcactcctggcagccaccgcctcaatggcagttggtgtgaaatcacagccttgccatggtgagggattgatccctatattaaatgtgccgatttaacagagcggaatttattggtgctttggcctctgccatgttgagacctttccaaagtggtaaacacagagtagaatttaaagggcacctgccgcagccacatctctgcttccagttcagggccgggacctgtcatagcaacattatctaaattatcgagcagctaccatgtgccagacactgtgcagcatgtttgacattcatgagcttaagcctcaaaataacccaatgaggttggcagtggtattgcccccattttgtagagaaagggagctgaggctctgggaaattacatacctcctcctacagcctgttagcagcagaggcaagattgggaccccgggaccacctaacttgagtgggcggtctcttagccactactcaccccgcaaaagagcagaggctgttgaggagtcattctgaccactgagctctgtccttggtcttgaaagagcaatagcacctcttagcccaacttttaccaaccctcaggtgcaaggtaggcagctggccagctctcatttaatcattacacacacacacacacacacacacacacacacgcacacacacacacgtgctggctgcccgaggtgaagacacctgtccacagtacacagagattcacggctgtctgacttcatagcccacatggttagccgctatgccacattgacttctttacaaataaagtccgtcttcttgcctgtctgtcttttacagccatgtgtggtggggagctctctgctgtggctggggtggtattgtccccaaactggcccgagccctacgtggaaggtgaagattgtatctggaagatccacgtgggagaagagaaacggatcttcttagatatccagttgtgagtgtttaaaatgggtggccctctaatttggcaaaatttgggagattgagaaagaaattgctcctgctttattctttcaaccaatattaactaagcatctactatgtgccgggactatgcagagaacaggcattcccatagtgagaccaagaacagcatcacaaatacacacacacacacacacacacacagagagagagagagaggagagagagagagagtccctatctttgggaaattcagcctaggaaacaaatatgaaatgaggacatacacaaataattgcatactctaacttcaatatgtgatgtaaggagaggttaatggtgctatgagattctttaactggaatttgatataaaaaggaaggtcagagaagtcttccccgaggatctgatactaaagctcagaactaaaagatgagttggagtgatgcatcccaaatgaacagaatgtgcaaaggccctgtggcaagcatctcattttcaaaggaccaaatggccagtgtggccagcaagaagggggcactgtaacacccatttactggactacagttgtttattttcctgtttgtctccctcaactagaccagaaggtcctctcctctggggctgggtctgactaccctctgtttccacagtctaacgcagagtctgatacacagtagatgctcaggaaatgattgctgaatgaaaaaaaatgtttttaatgaacggacttacttagctgtgcggctgggtttcctgtattcacagggggtaaccattagattctccatccagaatgttccccgctagctccccaagagggtgacacttgcagggaagcagctactctgggccagatgcaaaagtgactgctctaagcatttctatcttaggtaattctcacagagaaccccccctgggaggtcattaaccccactgtctgagaaggcagcagaggtgcagggaggccacccagaaagccagcgagcagcggggctgaaattcaggcttctgtggcttctcagtcatgctctttccactgccccatgtgagatgggggtgagaagtggacaaagacagacggtggtgcctggagaaagcagaatacagggttcctgacagacccaggtggcagacgggagggtggttgggggcggagagagtgctgaaacccagcagcctggggaagcagcactcacagttctctggctctacagaggaaccttgcaagagaaagagaaattattttcaaattattagtgaccggcttttgaggctgttccttagacacagcaagtgtccttagtctgggtgcggtggctcatgcctacaaccccaacacttcgggaggttgaggcaggaggattgcttgagaccaggagtttgagaccagtcccaacaacatagaggcatcctgtctcttcaaaaaaataaaaattagctggatgtggtggcacacgcctgtggtaccagctacttgggaggctgagatgggaggatctcttgagcctgggaaattgaggctgcagtgagccatgatcatgccactgcactccagcctgggtgacagagtaagaccttgtctcaaaaaaaaaagaagtgtccccagaggctgtcccagaacctccttctccagtggagtcagagacttacacagcttgaatagctgccccttgtggacttggggccaggccaatctaagaaagaattccacctccttcccatgtgactttgggctgggctcacctgttctcgcctctctctggacctcaatttttctctcctgtaatgggggtcttggaacatcagtgctttgtggctgctggaggcagattttacgcgttcctagcccattgcctcactcctcaataaagctcatcctcatctgggcacggtagctcacacctgtaatctcaacactttgggaggctgaggtaggagaatcacttggggccaggagttcgagaccagcctaggcaacatagtgagaccccatctttacaaacaattaaaaaaactagccaggcatggtggcacctgtagtcccagctacttgggaggctcaggtgggacaattacttgagccctggagttccaggctgcagtgagccatgattgcaccactacttcagcctgggcaacagagtaagactctgtctcaaaaaaaaataaaaattcaaattgaattaaatagacctcatcctcttccccccattcctttctctctgacttctagagtctggaataagatgcttattcattcattccaaccgaactgtttgagtgtctactatcaaccaagcacaattttatgtgctggaaaggttctaatggttgttccttcagtggtaaaattcatattggaaagaatggaatggattgtctctcttaactctagggaaaaaattattgtgtacctaccgtgtgccagcagtaggcttagcactgaagatacagttgtgagaaaaacagggcagtcctcaccctgcatgcctagcaggtgaggcaggtaagaaagtaaatgcagtgtgaaaggagcagtgacaggcaggtgagggcacctgagtgaaatcaggagggcttccaggaggaagtagcttctataatagcatgaaagagaaggtaggcaggtgacgaggggaaaagaagaatgtcctggccaggcatggtggctcaggcttgtaatcccagcactttgggaggctgaggtgggtggatcatttgaggtcaggagttcaagaccagcccagccaacatggtgaaacaccgcctctactaaaaatacaaaaattagccaggcgtggtggtgggtgcctgtaatctcagctatttgggaggctgaggcaagagaatcacctgaacccgggaggtggagattgcagtaagccaagatcatgcctctacacttaagcctgggtgacagagtgagactctgaaaaaagaaagaaagaaaagaaagagagagagagaaagaagaaggaaagaaagaaagaaagaaagagaaagaaagaagaaagaaagaaagaaagaaaaagaaagaaagaaaagaaagaaaggaagaaagaaggagggagggagggaggacaggacaggaaaggaagaagaatgtcctacctacatgatgagaacatctgcaaaacatctacaaagcctggaaatgaaagagtgtgacccacttaatgacataaagtttaatgtggctggagcaaagcatggcaggtgggtagagactacagagggaatggatcaaagggaagctctggggtcttcttagctgaagcttcacatagaaaactttattctaaggctgcatcctttaggaagccttctgtgtcgcccccttgtccttgtccataaaaataaatttatggttccagcttatgaattccttcccccagaagttaccaggaaaactacctgtcttcagccaagagaaggtacgacctactcctgagttcttggcttctctggcagaagatcccacccagccccaggccccatgaagtcatctataatcccctctcttctgcttggcttgcctcttctggcctcacagggagcctcccagatgggtggttttgcttaaataagacgggcccacatctccctttggtgccagaggtctagaggaggaaacaagaaaatgggaatctttactttcatcatctctaggcatcaaatattcaattaaccttcagcctgacaccagattgggttttatttctaccactaagcatgcatgcaatggagcagccgatccgggaacctcatgcaattaaagcttccccaaagccaagccactggcattagcatcaggaagggagcccttgcagcgggggcaggctttctctcttctgaacattttcacaatcgtagattgagcattgaccaggagagagggccctcagtttccttcctccctgccctgatactccatgccctcagcagccctggacccagcacctagcatctctgggcctcagattcctcctctgcaagatgatgggctaccttgaatcaagggtagttgcaaatccaaaatcatgaagggccaggcaacacaaataccggaattagagctgttgtgagattatatggaggggaggggtctgcgatgaattaggaagtacataccctatctaaaatcatttaaattcaatttccattttattttattttattttattttattttattttttgtgatagagtctcactgtcacccaggctggagtgcagtggtgccatctcagctcactgcaacctccgattcctgggttcaagcgattctcctgcctcagcctcatgagtagttgggattgcaggcgtgtgccaccacacccagctaatttttgtatttttaatagagatggggtttcaccatgttggccaggctagtctcaaactcttgacctcaagtgatctgcctgcctcagcctcccaaagtggtgggattacaggtgtgagccactgccccgggccataatttcaatttttaaaaatagcatcccctcctccaaaaaaaaaaaagtgcctactggctgaatccaaactgaggaccaccagtttgcaacccttgcaaatgattaaggtgattgagggtttaagctcccttctcattgcagcaatgaagaaattcatgtttttaagcacttactatttgtaaggtctttactaacattaatttttacttcatataagttaaaaataaattgtattatttgttctttggattaatcccatgaagtagttgcaactattacatttaattatatcctcttgcttcctcaccacttcacttggatgtctaagaggcatctcaaatgaaatgtattcaaagacaaactcctgattctccctccctatatctacttatagggagatatttatttatctatttatctattatacttattttacccccatctttctcatatgtgtaaggtatgatctattccatcagttgcttgggggaaagaatcaaacaacgacaaaacagaaaccttggcgttattctggcccagtggagtgctggctttcttaacaagttggcggcacagtgggccacaccctgatttgtagcatctgtcaatttccacggtgtaaatactcccaccatgacccattttaatataccaacataatgacaacaggctctccaaatgcctggaccattagctcttacaagcccgtatgagcctgcccccagcccagcacactcactgtgaactggacctttctctttctcccacaccctgtagccaaatcctcaggaaattccattgcttctactcaaaagtcaaagtcttcccagagtccaagcagttctgacacctccactgccacctgcagggtccacgccaccactgcgtcttcccagggttattgcaacggcctttgagatatccttgttcccacttctgccccctctttttaaccaacactcagtgatcctgttacaaccgaagtcatagcacccatgctctgctcaaagttctgcaatagctccctgttttatttggacttaaagccagtattcttacaaaaggccctatgggatctagctctggttacatctccagcatcgctttattcctctcttctcctttctgtatggtacatttgaccatattagccttcttgccattccacacgcatacctcagggcctttgcactgctgtctcccctgccattgggatgctctgccccaaatatctgcagagcttgctccccatctctccatcctctgactttgcttcacttccatagcccttgccaccacctaacacactacgcattgtggtgtatcttgaagtatttcaactcccacacctccacctggaatgtcacctccaggagaagagcaggagtttattttttgtcttattcactgccgtaaccctaatatatagaccagtgcatggcccatagtaggtgcttaataaataaaaggcaaggaagtaaatgtagcttgtcaggatcatacagacatgaggcttcaaagcgagaatttgaacccaaatttatgttcagctggctatgatgcacgtggagggaaaaaagagggtcagaaaaatatggaaagaccttctggggacatggcctccattttttagtaagtacaggtttattacatgacagggaacctggttgataagaaataacatttggctaaaaattatcaggtaaagtattaaataatagaagtaggaggtctccccaagagaatattttatagggttatagtttcaaaggatgtgtcatcatggaccttagaatcagaatatctagcgggagggggacttcaaggtcccccaatccagtgatgctgagatatgctggcagagttcagggccaagtgccgtggggcttggggagcctgtatcattctcccgggtgttctgagcactggacactaagccaagcagaaagtgatgacggaaccacagacaggctcagaatggggccaataagggggggcatcgccctccccaaggcagctgtcacgacttgcgttaggacaagcagccagtgtcatcccggggccttaggatttgcagtgacatcaaaatcaattcagtcccagttttaatcatcatggacatgtgaggactgtcatttttgtcactgagcaagtttaaatcgattccacatatatttattgagcatccactatgtagcaggcattgaggctgggccctggcagtgagcaagacagatgcagccccgcccccggggagccatgttgtaggctgatacagcaccagcaagaggaaatacagcactctgggggcccagagcgagggaaggtgagcctggctgagaatgtgagggagaagctttcctgagaacagtaaagtctaagtcagtttttctcaaccagggtctatcttgccccaggggacacttgccaatgtttggaggcatttctagttgggacaatgggagggtgcgggggagagcacccccagcatctagtggggacaggccagggatgctgctatgcatcctacaatgcacaggacagtccccaccacaaagaatgagctgacccaaaatatcaacggtgttgaagcagagaaaccctgatctatgctaagacctgaaagacagagagaagatgggcagagatggaggggaacagtgttccagccaaaaggaacagcatgtgctaaggtccagaggcaggaaagcacagctcccttcttaattgtccatgatatttaatatttgctgagcacttaggacatcccaagcagttacatcctagacatcttcacgacaagcacatgccttgggttctgttattatctccattttccagatgagtaaactgaggctcggggtggtgggagagtgcctgtgatcgcacagctagaagctggcggagcttggactttaaccccacttgccatgtctccaggaccctgtgtgtctggagttcaagggtgcgtccatgaagtaggacagcctggcggtgaatgcgactcagcagcgccttgaaggccacattagggagtctgggcttccccaaattgggcagcaggaaaagggtttaagcacttaaagagattaaagctttgcagaagggagctgagtcctctggtcaccagcccgaggctcacgccgacaagcttggcacacacttggcagagtggcatctggacttggcacctcctccctcccacagagggagtgaaaatagcatctcaacagccagggttacgtgaggcccaagagctgctgggtttaatttatcttgcttggttttccactgacagttttagtaaaccaatttgggtttgatagtaaaaataattccatcctccgggcccctcagccctcctaagtgtttgcaattgttatttttcacatcgacgatggggagggagtgtgcactgcagaccgagctgggtaggtggcccatagtaggcgcatgacttagctgtctgctgagtcatgaatgaggacgtaagccacatttcccaggcgagaggggatctctctccctcttcgtctactgggcagtctgttgataccgtggccatggcggttctaattagttaccatttattaaaaacctactatgtgctaggcaggccctgagctgcatcgtttaggtccgtgagcaataataaatgtgaacattattatgcagagataataattacataaatgagagctaatgtgggtagagataattacagaagggtaattacccaaattagagataatgtatgccaagcacattgcatggtatctggcacatagttggtgcttcataaatggagactactattatcaggaatcctcagataaggcagatattatcattaccactttatgggttgggtatgacagcacagagaggttacgtggtttcctcaggtcacacagctagtaaagacggagcacacaccgtagcctccacttccactgacttgaacagctttcggggcaccagctgtgtgtctcggcaatgtagcagcgacacgggaaggctcccaggcctgtagggactcaaagttcaggaagggacacatagccataaacagacagcctggcaaaatgtaagcaaagtcctgtggcttggagggtgagttgaggaggtagaggggaactagatttatctccgtgaattatggaaatatccctgagaaggtgacatccagaaggaatcttgaagagtgccagttgcccggagttaatgggagaaaagtgtcgtgagcaaaggattcaagcagtgatgacagtgaccattaggcatgaaatgaatgctctgaatcacagcatcaattacaaccatctgccccacattgttggtgttggaggaaagaaggaggttgcaccaacttgggatgagtcaggagccctcaggctaaaccttcttcacaccccaaatgcctccctaacccaccacgtatccctcccagctccatcagaaatctgcctcttcctctaaaaacacaactgaacagaaacttttaaaccctaagggccttttcatattgctctcctctcactctctctcattcattctctctccacaccccttccccaactctcaaaataaattacggaaaggagaataagggaactaacattggtgaaggcatcgtagaatagaagatccgagaggggccccaagtgggcaggtaacttagcaagtatcacacagcaagagaggaccagaaagacaacttgcttgtggccacaagagctcagcacgggggccacaaccttgaagatgccttgcagccaaggagacataaaagcgcctagagtcaaaaagaggtgcatgtaagtgcatcctgatgttcaccagctctgtggcctcaggcagattattgaaggtgctggtgcctgcacccacaatgggatattttgttcactttatccccagtgtctggcacaaagaaagtgcttgataaatatctgttgaatgaaagagacggtaaggctgggcacagtggctcatgcgtgtaatcccagcacttttggaagccaagatgggaggatcgcttgagcccaggagttcaagaccagcctgggcaacaaagcaagaccccgtctctacaaataatttaaaaattagccaggcatggtggcttgcagctgtggtcccagctacttgagaggctgaggtgggagaatcacctgagctcaggtgttgagaccagcttgggcaacatagtgagaccctgtttctaaaaagagagagacagagaaggtgggtgtgtaaattaattaaataatgtaaaaattaaaataacagataacataaggtttctgacacaagataggcagataaccatagctaacactacttttacccctactatatcccagactttatgctaaatactggcacacattatctcattgatgatgatgatgatgatgatgataaagaccaacagctgacattcattgagtacttacaatgtgccagtctttacatgctttttttacctatagtaactcatttcactctccaatgcaatatcagtaccctatgcaatatctacatcacgtcagtgtgactactcctttgtacagatgaagaaactgaggctgagagagatgaaactgcttgcccaaggtcacacaattaggatgtggccaagtcaggacttgaacccaggtctctaagaccaaagccagtttttaaccacacacacacacacacacacacacacacacacacacaaacacacacacacacacaaacggtagggaagtgctccacatgagagaaattccgagctccatcttacagaagaagaaactgaggctcaaagtgtttcctgctccccgtttcctggacatctactgcgaacatacatccatctctgcagggaaaaagtctcaatcaggctccagcgtgccttcctttgctcctctgcagagttcccaacattgctccctgtttatgagccccagcacagttctctaaccaggaaataaaagggcctaataacaaacccaggtaaccatatgattgatagctgcagaacagtcctcttcagctgctgccaacctgttctgtgctaagttaattccaagccctaaaaattaagtgccttgtccagaggcacttcagttcttcaaacagagatatagctgctttggactgtaagaattctacctgagagccaggaaaggaggagagagattcaggagttgaggacaacgttagccctgggagaatagatttccagatatcagcaaaaatcacaggagaaatggccacgacaaaaataaaactggctgaactcagatcttctggcccattagcaagaggagacaggatttccctggagccaaaagttcgaaggaattagagaaggagcagaaaatttcatagagcccaaattccattatgttgcaaatgaggaaactgaggcccagagatgggaagagattgccccaagaccactctatcagtcagctattgctgtataacaaaccaccccaaattcactggcataaaacagcaggcatgtatttctgttcacgagtctagagatcagcgttgtgcttctggtcttagctgggctcgcaggtgggtctatgggcagccactggccttcttcatgtatttggggatgggttggctgtcgtggtctaggtgggcatagactgggattgacatagacacgcatctctgctccatgtgcctctcatcctccaattgctagcttgggcttgttcccatggtgattggccagagtttcaagaaaggaagaagatgcattcaaggcctcttgagcccacactaggaagtggcacagccgcacgtctgccatatcctatggcaagctacaaagcaagggccaacccagaggtatggtgtggatacagagaggggccaagctttgggatcatttttgccctcaagctaccatgaccatagaagagtggagattagaactcaggtctcctggtcccagcccaaagctccaaatgatattactgtgtacaatgatcctatgagatctgagcatcattatccccattttacagacgaggaaaccgaggctcagagagctgaaggaacttgtgtaaaatctcacagctaggaagaataagagacaagatttgcacctagggcttggtgcctggcatatagaagactcagaaaatgtttctttccctacatgatgctttcagcatgtgggagacactctggaaagatcttgaattccttcagggacaggaaaaagccttcacctacagtaagaagtcttgggttctagtctcaattctttcactgagtggctgtgtgaccttggataaagtcaccccacttctctggacctcggtttctttcatctttcaaatgaaaataacaatggtacccatctcttcgagttctgagatgatgaaatcataccatgtgcagaagcacttggcaagggcttagtacattacacacactcaacaatttaattggcagctgtgatgacgattaatcccttccatggcccatggtcctgtgtacaaactgagctcctttgcacgatcacacacaccacacacacacacacacacacacacacattgatccctctgagcttgcagtttgagtgttacagtaggaatgaagagaatccatacacaggtcctacccaggtatcccacctgactgattagcttcctctcccccacgatttgcaggggattgtggtggtaacttggaaacacaagcaccagggttaggtcctccaccaacacatgcccatgttctgctccttggccacgccacgctcttctcgccttggtgactgcaagagcctacttgggaggggacctgctgtctgtctgagctggacattgccttgtcggtgcacccctacaagctcaaggcattcgaatgcaattagacctgacatcttagggagacacgactgcttgttttacgagtccctgacatgcgctgtcctcctgaacttactattcgacaagtgtttattgagcgcataccatgtggctagagttgcatccaattatcagaggtctggagatgacaatcatcactcacatggattactgtggtgccaaaatactcacgtgcccttacctttgtgccaagctctgttctgagcacgttacctcttagttaattctcaaagcaacctaggagagtcacacgatttgttctccatgtaatagatgaggacagtgatcctcctccgaggggtgaaatggcttgccacttagacccaggagtgccagcctcacacccctcatcacccctcaaccctgcttcacagagtagaatcgacttcatcctgaaggcagccagcctcccttgagagctgagcaggcaagcagtgtagtcagacctgctgtttagacagcacccctgggaggaaggcagaggtgggccgaggtggcaggaagccaggcaggaggcagaggggcagcagcattggcttggcatggtcctgtgatggccgaggcctggggaagcccctgcaaacccctctggggccttccggggagaagctgggacaagccctccaggtttcaaagttcgtttttcttggaggagttcccacgccaggcggggacggcccctgtgtggagtttcctgggggtgttctggccgctcggattggccacgccagggctttcgccaggggaggccttcgagaatatgtgcacgatgcggacgcagaatggcaggaagcggcgaccccagccactgccagcttctgctgggagaagctctgtcaactcttcctccagcaatgcagagccccggcccaccgccctctgcacacgtgcgtgtctgtgtgtgtgtggcagtatataccacacaccacacacacaccacacacgctatacacaccacacaccctcacacacaccacacacacacaccaccccacacataccacacacacatgacactacacacaccacacacacccccacacacacaccacacacatgccacacatgccacaccacatgacactacacacaccatacacacaccacatacacaccacacacacacacgcacaaaccacacatatgacactacacacaccacacaccatacacacacacccctcacacacaccacatgacactacacacaccacacacgccacacaccccacgacactacacacacacaccacacaccatacacacaccccacacacacaccacatgacacgacacatgccacacatgccacacacaccacatgacactaaacacacaccacacgcaccacatgacacaccacgcccacaccacatgacactacacacaccacacacacccacacacaccacacgcacatgcgccacacactacacaaacacacatactgccacatacacatccgacctcaccagctgatcaagcttccctcaaggtgagctctcgcaccctgacttagatgtcccggaatgtagaaggccctgggttccactccgtgttttataaacctggggaagcttacatccagaaaaaggaagcaatgtgggcagtgccacagaggaaattcatggaagggccacagatgccatctggggtcacccctaagtctggaaaactcaggcctcagcagcctatttctaaagccttgtattccccagatcaaccccttccttgctattgagtggggaaatggggaaagtgtgtgggtccaaccttctccacagagggaagcatgcagtggcttggtcatggccattgttaatggacttttttacaatttgtggattctgcgatttgcatctggggaaactgagacccgggttgggaagcctcttgtccagtcacaggtcagaaaggtggcagcataagtgccctttactgaggtctcgtcacaccaggatttgttgccacgccgcccttgcccctcagcagggtgcctagttccttataaatagtttttgtaatagaggaaaaatgctcttgtagtggaattcctggcattaattgttatttacagctgtcaacaatattatccccattttacaggtgggaacactgaggctcagagaggctaatctgcttcaaggtcctgcagctagaatttgaacctgttctcttaatgctgcctcttgtgctggaggtgaaacaccagggtagttaaggacagccgtctttgtaggcaaagcagccggggagctgttgggttttcctggtcatggtgctaggtgtaaaacgttatcggtgaccttgccagagcctcgcccactgccttcggaaatggctcagtccagagatgtggaaatgagaaactgcttgagctgcccgtggggcaggcccagggggacggcaggccgagagcaggaatctctttcctactctttttctctttgggaataagagggaaattgagaaaagggagaaaggaggaggagatggagaaaaggaagaaaagaagaaaggccatggaaactgggagcctctctgaagtcagggctgggtctcattcaggctgcaaactccaggtctgtggctctcagtcctggctgcccaggagaaccccctgggaatgggagttttaagtgacactaattcccagtctccacccccagggtttctgatggcctgatttgtctggagtacaacctgggatcaggagtttttaaacctccgcggggattctgaggtgcggccaggattgagaaccacggggcagtgggttcacagcctggagtggacaagcgttttggtgaatatttttggagagaaacagagaggaagagagggtggaaggaaaggaagagagaaggaacaaagaagagactaaggaaacaggctgggcacggtggctcaaacctgtaatcccagcactctgggaggccaaggcaggtggatcatctgaggtcaagagttcaagaccaacctggtcaacatggtgaaacccggtctctactaaaactgcaaaaattagctgggcttggtggtgggtgcctgtagttccagctactctggaggctaaggcaggagaatagcttgaacccaggaggcggaggttgcagtgagccaagatcatgccattgcactccagcctggatgacagagtgaaacaccatctttaaaaaaaaagaaaaagaaaactcatcatttttgtgtgttttaaggtgtcctattagggagccaaagatactggttttctgtgtcctccctggagctgacatggtttcttggcctgtctgccattttatcaaattaaattgaaagcaaatttaattgggtttcactgggccaaaggcccctcgacaattctgtgttgctgagaggtgcctggcaaggttgtgctgcatctgaaatgagcacagaggccttaggacctgggtctttggggctcagtttactcctctatgggattcataatgttttttctctgaccacctgactgtgtgggtgaggggatcagatgagaaaatagatacaaaacaactttaaacatgtcccttctaaggccttcaaaaaaaactataaatattttatcaaagttttattgcatacaacggaatttacaggttttgattcttgtttttcctttctttagatcctatgatttatttcatcactatctctactgttccataaagatcttgcctgaagggcaagatagtgttttcttaggaaagtcacttaattcctctgagcctcagtttcctcatctggaaaatggacataaatttgccgtcattccttcatttaagtgaactttatttcacctgtgccaagccctgggtgggctccagggattggggtgaagacatgtgccttcagggagccgacacaggcagatgaaggttgctggtctgttgctcaggctttgtcttccaacgacgtctgtttggattccggctctgctatataaccagctgcttgagcttaagcgtgtttcctcacctctgggcacctcagttggcttatctgtgaaatgggtgtgaagagtcgtacttacagggttagtccgaggataagatgaaatggtgcatgtaaagtgccttgaaaagccacttgaaaaccttagctagttattacatagctgtaaatgcagggtggacagagggatcctgaggaattagcaaggtgttttctagcagagaagagaggagagggctttccaggtagagagactagcatgagctaaggcatgaaagatggaggctttaagggtctaggagctgcaaggggcttggtgtactggatgtttgagacagcaagagatgggctgagacccagctgtggacttcctgggaggtcaggctgagaaactggactttagtctgtgggctaatttttgcggtttccacagtccaattctattaccagctacttctttttgtgttaccgtttttgttttcccgaaactgcgtgtaaattggcttgcctttttcacttggcttactccagccaaaataatgtccatgaaattagaagtttaatgtgcaaaccatatatttatatatttttctaatttgcatttaaagaaatgcataaacattagacatttcaaagtatgtttgcctacctaaaattgtcctgtgaatgaggctcgaaaaagccttttaaaggcaagatttctaagccaagggtcaaatgtttgtttagaaaggaataaggaaaagaaaggtggcttgctcatcatgtctttctatgccctctccggaatattgactctagctcaatagttaccaacctcacctaccacctgctccccacatccaggctcctgattggttggggtaaaaagggcacctgctggggaagtcagcccattccatgcttaggcatacactgccctctgcaggtgagcagcaggattacataaccagagatgggttcgctggtctgtgtcagattctaatttgcattctatcctcacctcttccactctctagaccccagtgaaagcaatgagggtcccttaggctgtttttatcctttttgaagaggtactacattcatacgattcaaaattcaaaagtacaaaaaggtctactgtgaaaattgagtttcccatccttccccagcaaacagccccctctctggctctcctccctagaggcaattactttcttatgtatcttacatatccttccccagatctttctaaatatttcaaaaaccataacagaaagcttttatctatcaaaattaagccacccagactaagtaactagattaacactgattttattgcaaactctgttatacctgatcgataataaccatgaacaaaacacaaagaacattcgttaccaagaaatgtaaaatgttagggagacaaaatctttttaaaacaagaagtctgggccaggcgtggtggctcaagcctgtatcccagaactttgggaggccaaggcaggtggatcacctgaggtcaggagtttgagaacagcccagccaacatggtgaaatgctgtctccactaaaaacacaaaaattagccaggcatggtggcacgtgcctgtaatcccagttacttgggaggctgaggcaggagaatggcttaaacccggggagggtggaggttgcaacgagctgagatcgtgccactgcactccagcccgggcaacagagcaagactgtgtctcaaaaaagaatttaatttaatttttaaaaaacgatgtctgtaatacaaaaatcacagctatataggaggaatagcttctagtgttctataacactgtagggtgacgatagttaacaataatttgttgttcattttcaaacagctggaagagaggattttcaatgttttttttttttttttttttgagacagggtctcgctctgttgcccaggctggagtgcagtggcgcgatctcggctcactgcaacctccttctctcaggttcaagcaattctcctacctcagcctcccgagtagctgggactacaagtgcatgccaccatgcccagcttatttttgtactttttgtagagatgggatttcaccatattggccaagctggtcttgaactcctgacctcaggttattcactcacctcggcctcccaaagtgctgggattaaaggtgtgagccactgcacccagtccagattttttttttttagacagcatctcactgtgtcacccatgctggagtacagtggtgcaatcaaagcttactgcagcctcaacctccagtgctcaagtgatcttcccacctcagcctcctgagtagctgggaccacaggcatgtgccaccgtgcccggctaatgtttttattttttatagagatgggggtttcactatattgcccaggcaggtcttgaactcctgaactcaagtgatcctccagccttggcctcccaaaatgctgggattacaagcatgaaccatcatgcccagctgttctgaatatttaatttgtgtttttttattcatgttttctgacacaagactcaatcggaacacacttcttgaaaacgtgtgtatgtggctttcatgggctgttgtataaaatggtggttcagatctcaagctttggcatcaaaagacgtaggtttgaatcttgaccttcctggttgagcctcagtttccttatctgtataatggagcaagtcttactttgtgaggttgtttgaatgcttgatacttggcggacagcactgttgttattcaaaagctaaatgtgggtcctgtgaaatgctttcccattcaaaagctatccaatgggaccagtgtttccactgccctgagaaagggaggatttaaagaagcagccagaagtggtaacactaaatggcatgtccacaaatggctgctcaggcccttgaaggggctgcagaatgtgcccagagcagggtcaaggtggggaaggagaggaggctagacaagctggacaagccagcgggttggctttggagtggcctctcaggcatgcagggtgtcaggtggcattggacttgactctagtgacctacatatccaagaaggatcaaggcatggccaacaagaagccctagaggcaggcggggcagaaatcccttgaggcagcctccctctgataccaaagttttcaacttaaccctggggagcatgctgaaagcagccagggcactggctgagaggagtccccttcccaaggttggagcagggaagagtccagtcggggttagggtcctaggtaggaattggggtcaaagccacagtctactctgtgcaagatctgagcccgaaacctggccctatgccctgagctggcactgattcacccgagacacacactcagcatggtgctgagcactagggatacagccagcagtgagtgagacatgggagggcctcagggagctcctgatctgcagcagatgagcatccccagaccaatggggccccaagtaatgactgagctccataaggagggtgagcacaagggctgcaggccagaccaggaggggatgctgggggctctgtgcaatagtgaatcatggaaggctgaaactaaggggtgggtaggagtttcccaggtggagaattcagagcacagggaagggaatgtgaaaagtcccagaggtcaccaagagcatcgtgctttggaaagactgatgagcaatgcagtctggttggaggtaaaacaatggcttggaagagagagagtcagaaatgaggcggcagggacggggcaggcggcaatgcaaaagatagacctatagagccttgagactagggttaaaagttggcactctatcctaagatgtttcttttttttaattgaggtgaaattcatacaacatacaattagtcattttaacatatacaatatatatatctacatatgtgatacatttacaatattgtgcaaccaacacttgtatctagtgccaaaacatttccatcaccccaaaaacaaattccataccgattaagcaattgttccgcattcttctcctcaccccctaacccttgataaccacccatctgccttctttctctgtggatttccctattctggatattccttataaatggagtgattcaacaggtggcttttcgtggctggcttctttcactgcatgtcatgtttccgaggttcacctgtgctgcggcgtgggccagtgctgcattcctttttatggctgaataataactccgctgcacaaatagaccgtattttgcttattcattgatctgttgagggagcagatctgatttaccttctggaaagattcatctggctgctaaggggaggagtatcagggccaggtgaggatgaagtcaggaaaccaccgaggtgctgtccaactgcccaagagaaaggtgatgatggtctgaggatagcctgcgacagtgaccaagaagaaagaggtggatgtagagggggagatgggagctgagatcttctgccaggagctcacactttgtgcctgtggaaagcctttcactctggcacctgagaagggccagagtgggcagggtctggtcttgggaagctttgtggtcctacaggatcctcccagaagggatcctgccactcccagtcacagtcagaccaagcctgcctgcctgccagcatctctccatctccccttcatcctggagtcaaactgccatcccgttttcctagcgcctccttggatcgtatctagctgacatctcaattcagacctcagcggaaaaccacactctgccctgtggctctccctgcagtgaactcaacacattttcatctcggttgcttacaaaggtccgattccagggatgctagatgcacttggtaaatacatggatgagcaagtgaaaatgtaagctcctctttgcattgaggggaaaaaactaaattgccaaactctgtgtacataattggaaccagtctgtcaaaaaagattcagaagaatgaggcagagagtaacttgattatttctcccagtgacccttcaggcacatcctatattatttttttcctctgggtgaaagctgcgttttcataggtcttctggtcacaataagtgcagtccagtctgaaaatcttataaccctaagtatcattcattttgaaacttcatccctccctcaactgtgctcctctggctgggaattttgcaaagggcatgggaggtaagggaataggagactctaacttggctacactgttatgttatagaatatatagaatgctgattttttttctgtctttaataggatattaaatgtgtgaaagtctcctgagcacagctgctcttaactttcccttttgctggggttctatcaccctttcagtaggaagccacttttaaggagacctatagttggcttctgcctgcaaggttcacaactagacccaggaaacatagatcatatccctactgtcatcagtgatgggatgctcactgtcaatatctgcttttattctccttgctctgaccagaggcaggcaggcatccccagtctgattttatcatttcttttggtgagcatcaaatccagctactgttatccaagccacaaaagaaagacacctgccaagtcaccaagagttcccttgaagccctcctcactaggcttaatgtgagggtgatacacattcgaccctccctcctatgatgccccacagtgaccactcccctcaaggcagtccttcctgccagcctcctcaatggccagtgccttcttttccttctcttatataagctagaggtgggaagaagggctcagactggaatagctgcatcgatgttagtagatgatgccattggtactctgtctaagccgtgcaatacttgccaccatgtgcccataatgacttcctactgcaaggcccttcccacttctccagcatttctctgatgccatgtggtcacatgggcaagccagaagttctagggactcaacacatccaggagcatccctcagtcaataaaggatggaaactggaggataaataccccagctccttctccctatggatgtgttctgcaccatctctaaaattcctgcaggactgaacccaaaatgcacagtgaaacctgctcatcaatcccctcttcgttgagtccttcccttcttcttgtctcatttccccaccagtgctgcctaggatggcctcccagacaagccagacttcaaaaggcatttgtatgtttgcttgatctctgcatctggagaatccaaatgcaatcaacagccaagtatctctctttggaaagtggaaatccactgcacctattgtcttgttcttagcttagggagacactgctaaaatttcagaacaacagaagaaattgcatttaatggtctgttgcacaccgtttacaatgtgcatttatataagtcatggtttctcgagtttagccctgttgacattttggactagatacttttttgggttgaggggctgtcttgtgcactgtagtatgtttaacagcatccctggcctccactcacccatggtacccacctagttaggaaaaatatgtttccagacattgccaaatgtcacctgtgaggaaaactgcccctagttgaaaaccactgacataaatcatctgatgtcatttggcataaacagaaatccaaagaaggatgatggtggtgatgatgatgatgacgatagtgatgatggtgatggtaacgatgatgatgccaaaaatgaaagtggaatataacaacataacattcaaatgacatcaccgagcttgcccaggtgctaatgctgaagctggaatttgaatccagaccttctgcctgcctcacctcatccccagagctcatgacatagacgaggaatattaaggctgattcacagacaagaaatttcagaaaaatcacatgccttccatgaaagtgacaaagctgagaatcaaaccaaagctttctgatttccaagccagtgtgctcttccctgcacattgctccatcctattttatggagaacaaagagttgccgtatggttttaaaatgaaagctattttcacccttgaagatgctgctactgcgttttggccatttaagtgaaagaataaagccaagatgtgcattgtctgtaaactactgttaccagcggatcagctgtgaagtcggcttaaggaatatatctgccatctaccatgtttcacactagtctaatccggcactttcatgaacaattgatgttttcatggtacgtagagctaaagaggccctcccctactacaggtccaaagctgacatcagtcccactatttttgctgtcaagtagactctctgggaggctctttcataccttagcatttattgagcacctactgtgtgcaagaacaagtggcaactccagaatttcaatacagcaggggtttaggggcttcaatctggttaaaaactgtcaggggggtaggaggagtctggggattttgtcttgaagacatgtgtgcaaagcaagcaggtagcttttatttgaagatgttttgggagtagcataggggaaactggtgaaaattatggcggcaatcaaaatcttcctaagccaccccttggagcaactttacatgaggaactacgagaggtatggtggaaggtattggggtgaataaaatacaatccctgccctcccagaagcaaactttcaatacctttctttgtgtttctgttgttttgttctgaccacctgaaacaccaacatgggtagttgccacctcacctcccaactcccggactagcagcaaacaccactgttggccattggatgaagctatcagcagggagggccactgtcagtctgcatcagtttcaggaactctgctcagggccatttcccagaacacctctcctctggcattgaattgctcagtcatacagttcccgtataaaacccttcagtgtctccccgtctcctgcaagatgatgtccaaaagttgaagcttggctctttaagcccttcatgatctaatccctgcagaactctgcaggcttctatgcctatccccataccccaggcacactgaccactggaaaaattctttcaggaaccatggtcttactcctttcttccctctgccttctccccatcattcattgttttcttttgttttgttttgttttgtgagatgagttcttgctctattgcccaggctggagtacagtggcacaatcatagctcactgtagcctcaaacttctgggctcaagcaatcctcctgcctcagcctcctgagaagctaggactacagaggtgcaccaccacaccaaaaaaaaaaaattttttttgagacagggtctcgcttctttgcccaggctggagtgcagtggcacaatctcagctcacttcaacctccacctcccaggttcaagcaattctcctgcctcagcctcccgagtagctggaactacaggcatctgccaccacgcccagctaatttctttttttagtagagacggggtttcaccatgttggccagaatggtttcgatttcttgacctcgtgatcctcctgcctcggcctcccaaagtgctgggattataggcgtgagccaccacgcccggactttttttttttctttttttttttttttttgtagagacagggtctctctttgttgcccagaatggtcttgaactcctggcctcaagcaatcctcccacctcagcctccaaaagtgctgggattacaggtgtaagccactgcacctggactccctactctgtgtttatctgcctcgaggtctcctactctttcttgaggtttcagagcaagaagcatcacctactgcaggaatgcttccatgatgcccctaatctgagtttgtccttactttctctgtccttactttggttataactcctgccacaatccctggcttacaaatctaaatagatcactactctgtgacccttctgagctcagcacagtgcctggctcatagtagatgctcaaaaaaacaaacaaaaaagaacattaaggagaaggagacaagaaaaggagaaagacatgagagagaaagaagacagagagagggaaagaagaaaggaaagaaagaaatgtgagtttgtatctgtccatgattgatgaagccaaaggtgaattatctggcattctttcaattagagatcaattttatctagcatgtctgagatggcacatgtttctgtggtatagtgaagtgatttctggattattaactatccactgtggtttaattatttagtgtcaaggtactttcttgcattggagtctttgaaaatgtgtcatcctttaacagtatgaatggtgacaggtttgagcatatctcataagtaaggtgcctccatcccacctctgccctaccccttaaacataatggatcattcagttgactctgaggaatttgccccgtgataaatggaaagatcatttcaccttatataaaaatgcaagttgtaattagcaagctgtcagcatgttctgcactgaagaagaatgaaagatgcaggtcatagccccagcctgtagcctggtgcctaacacagagatgtcacctaagaaatggttgccaataatgggagttttgaaggtgattcttcttacaatgcagcatttgactttgcaatgagtcccatgcagccaagaccattgcatcaatgtgtcttcaaaaacccaactgacggccgggcacagtgactcacgcctgtaatcctagcacattgggaggccgaggtgggcagattgcctgagctcaggatttggagaccagcctgggcaacacggtgaaaccccatctctactaaatacaaaaaaaattagccagacatagcagcatgcacctgtagtcccagctactcgggaggctgagacaggagaattgcttgaacctggaaggcagagattgcagcgagctgagagtgccactgcactctagcctgggtgacagagtgagactctgtctcaaaaaaaaaatgacttacaaatctttgtgtcacatttgcagtctatgtcaatcttaccctcagcttggggttaagacacatagcctggagcctgacacatacacacttaacaaattttgtattgcctgaaaaagttaatcaagggtttattgaatgcccattctctatttcacatgactctccctcttctctgccctccaagcctgaatctgagcaacagtgacatcttgaccatctacgatggcgacgaggtcatgccccacatcttggggcagtaccttgggaacagtggcccccagaaactgtactcctccacgccagacttaaccatccagttccattcggaccctgctggcctcatctttggaaagggccagggatttatcatgaactacataggtaggtgtctcatctggtcaatttattttttctttgtgtttagatacaggttaaggtggtttcctctaggttatttggcagttttgtactacagcgatttttcattgtattgtattgaaatgtactcatttcatttttaaaagcctgggctctctagtcatgaggaccagggtttgagccctagcacggtcatcgatgtctgtgtggctttgggaaagttactgaacctctctgagccttctttttgtcatctgtaagatgggcatagtgatacctattccacaaggttgatatcaggatgtagtagacaatgcctcataacttatgtttcatgtgtggtcagctgagaacctgttgtccccatgtttcatttgtggtcagctgagatcttacatcaacatacttcctaatttcttcccaatttgtgcaacttctcaaacatcgtcttcaccttcttgcccgaactgaagctcagctctcctctaaggcctcttcttttcctgtagcctcgttgaacaaggacagccttcctttcgcacttcttgtactttaggagctatagatgcaaaagatgtctttcctcatcctcaatgtggcctccaaaccatgtctctcctgctcctcctaaaacaaacaaaacaaaaaaaaaacctgctatcaaattcaagctaagctcacacactcctatgacccctcgtgtgctttcatccaatcacactcttcccttctcattccccaccctgtaactctccctcattcattactagctctacgacccaccccttttcaacctttaaaccctggagggtcccaggctccatcctggactgtatcctctcttccagctagactcacgccctccatgccttcattagttcccatggatttaaacagtaccaatatccgttgaccggttcatacttacaaccttgaccttaaactccaaatccatctatccaactccctgccaactcctcccttgcctccatccagtagacatctcagatttaacatggccaaacagaatgatttcttttcctacccaccaccaccactacccaacagcatcccctgctatctgccaatcctaggaaatgagacaacaactctcctggtttctcaggctgcttcctccttccttgcccccatatccaatccatcctctcaactccacttttcaatatgtctcaaatccaaacacatgtccccgtctttctacggccaccactctagtccgaactaccaacattcccagatgtcagaggactgggacaccatgaagtcccactgattccagtcccagaagagacttgcactaacagaggaactggtccagccctgtcgtgttccagcagaagaaaccctggacaagcaaggatgaagggttgctcatcggggcagagccgagctccaatccatgcttcctcatccctagctccaaagcttcctccacccccaatattttgggcagcagcggagaacctgggagacacagagggtaattaagacctaacatcctttgacatctagaagaatgggtgagtggttgcaccccaagaatttcaatgggcaggattcggccagtgattaggaaacgtgcttgcacttcccaggaattagactggcatcttgatttccaggatggagcagagaaaaggagaattcatcctacccagccctctgccaccaccactaccacaaaagaccctgtggttggagcaagattccatgtctttggttctttctccccgttcacttaaagaattgtccatctcggccgggcgcagtggctcatgcctgtaatcctagcactttgggaggctgaggcgggcagattacgaggtcaggagatcgagaccatcctggctaacacagtgaaaccccgtctctactaaaaatacaaaaaaaaaaacattagctgggtgtggtggcaggcacctgtagtcccagctactcgggaggctgaggcaggagaattgcttgagcccaggaagcagaggttgcagtgagccaagattgcgccactgactccagcctgggtgatagagcgagactccgtctcaaagaaaaaagaaaaaagaaaagaattgtccatctctaactaggttggtgcagaagtaattatgatttttggagttttaatttgcaaaaactgcaattacttctgcgccaacctaataatatgaattgtcctctctgtaccagcacttgcacctaaaaacaagctacccccttgaccatgggctgtttcaagaagcctcatgcgtgccaaagtacattcctggcatttttatttccagatggtgaacatttttcatccctgcctgctacatgtccacctctcagagaggctaacacgagtattgatcttcttttttatgtttcccaggggccttttacctttgattgtgctgctaaatattttcagagtgttattgctacaatttcttgtgggttccccgctcttttctgggcagtgccctgggcttcaggggataactcatgttggctgtccaggcaatgtaccctccagactcagctgcctttggaggaagtctctggtctcctggctcctgtctctctccttagacgtcctctccctctccactgaaagatgaggtcatggtttttgctcatttatctcccctagcgcccaagtcagtattccaaacctgcattcagcttgatggccaaaaaaaaaaaaaaaaaactgactgactctatccaaggctggtcaaggttaaccagaaagtctggccagtgttcagtttggcaatatcttgaagaagaagtgtttttgttcattgaagttgaaactttttgtgatttgtgtgacaacttacagttggcaagcactttaacatatattattttatttcacatcttcaaatgcattatctccatttccagaggatttggttcataaaaaatcccttgacacctcctatatgctaggctctgcacaccaggatatagagatgaatagaatattctccctacccttaagacattagtggaaatgcgaaaggcagtcccattaatagacaataccaggatcacaagctgatgctgtgggagaggcagaaaaaggattgcagagaatgtttttcagggatacacagcttggctagtttgggtaacaaaaaagagagaacagttcctgattgttattcctgttaaagaaacacacagttaatttcacaagaatggcaaatagaccgttctagctaattgcgataccactcagttgcttactacttatgttgaagaccatgttgaaaagaactccaaggaggtcatgcctaaagtctatggcaaagaatgccatgattgattagtgatgcctgccatgggcatgagaagggtatttgttattctggctctagattttaccatacatgggagttacacagatgtaactcccattcaatggatgcatcagatagtaggtcaggggttcctgtggtcactagggaattctgaagatcctatattgacctaaatgcctaagcccagctctggaaggtggccaaagtttatctgctatgattgcaattagagccttccacaggaagactctgggcctacgtggttctagaatgtgaattctactcccagaattcacctttgaacagagagatgcaaagacccattcactgtttcctgttctttgcccactgtctatggccaaaggcatgggatggaagggaataagaaacagagataagtaagcagtgctttttgagaagacgttggttatttgtcgtgtgtttattcctccaagtctaggataataactaagctccatattgtaagtcaactccaatcaaatgacagtggctccctggagtgctgttttgaggactgggaggtttcctcttgattcaaacaaatagatggctgtgcttgattagagatgtctgccatgagcatgaaatggtagatggtggtgtgcattcagtgcatttgtgcatttcttttgtgcaaaaattgaaccttggtgctaatcttgtccatgagaccgaaaccatgacttcagatccctacatttctagagtctaataagatgctcataatatctcagtcaaacaaacaaacgaatccatctaactcatcttagtgttcacacaacatcgtcatatcctgcatgttatttaactttcacattgccttttggaatagacaatgtaataattcttgactccactctgcaaatgagaacaatgaggcttagagcagttaattggcatgactggaatcacaccatttatttaaaaaagaaagaagagtagaaaagaagtcttccaactcctaggacagttttctaattcttagtaaagttaacaagggcccatgggaacagaccattccagagcctccacttagggtgcttggtaaaaaaatacatgttcctgagtcagggtttctggggtacaagccctggaatctgaagaacaggaaggttatagggtggttttctaattattagcaaagttaacaagggcccatggggacggaccattctagaaacctctacttagggtgcttggtaaaaatgcatgttcctgaatcagggtccctggggtacaggccctgggatctgaagaacaggaaggttaagtgacttagccaaggccacccagttagtaaacagtggggacaagatttaagccaagcttctacatcgtggcagcaactgagaaattacaaatgcagtgggtgccaccaaggagacaggaggtcccacgggagcgtgcagccatggtggcccatattgaagtcagacaagcaaacctttctccgtctcaaagcatttggctcaaggcagaccacatttctggtgtctgctcccatttctcccctttcatccatagtctgagcatctgcagctgtgtcccaaatccagggcttggctgatttttcagaggcctaaaaatagaggctcctgtccccccaccaagcaattctcgaagctatttttttacccttcttcttgcagacacccatgagatctcctttccccaaataaaatcatgatgaaatcccgggaaaagccattgcttagttctcagaatgactttcctgcagacagcggaggtgctctcctttccccagaagcacataagaactgcaaattaattatacaacataattagcttgctcctccaaatctgtgcagtgggcactttgaagcaagaatagtaatagtttgccatgcattgctaccttagtaacaagagtttgtaggagaaaaacagaacaattacagagaaagacacagtaataagctgtgggtagcattttctggagtatggttcattttcactaatgatatgcaattggatttgaagaatataccaacagtttatttttatttatttctgttcaaattgttttttttttcttttcttttgagacagggtctctctctgtcaccgagcctggagtgcagtgaagccttcatggctcgctgcagtctcgaactcccagactcaagcaatcctcccacctcagcctcctgagcagctgggactacaaacacgtgccatcatacctggctcatttttttggttttattattgtttttgtagagatggggaggtctccctacattgtccaagctgatctccaactcctgggctcaagcaatcctcctaccttggcttcccaaagtgctgagattataggcatgagccactgtgcccaccttctttttattttgatagctaattatttctcttaatgcatattaaaaatgcatatattacttattcaccaaactcatggatttacagatattcttaggatgaagctgagcatattagtcacctattgctgtgtcatagattataccccaaattagcagtaaacatttatcatcttgcagtttctctgggttaaaaattcaggagcagcatgagttggatggctttgtcttggggtctctcatgaggctctggtcaggatgccagccagagctgcagtcacctgaaggcttgataagcactggatgatgaacttccaaatggctcacacatgtggctggcaagtcaatgccaactgttgacaggaggcctcagtttctcttcccatgggtctctctggagggctgcttgagcatcctcacaatatggcagctgcttcctctgaagcaagtgattcaatagagagcaagaagagaaactcaatgttgttatgacctaacctcggaagccacccagggccacttttgcaacctcctattcagtgttggtagggactacacaagagtgtaaattctgctgggcacagtggctcatgcctgcaatctcaacactttgggaggcccaggcggtaggattgcttgagcctaagacttcaagactggcccaggcaacatacaagagctcatctctacagaaaaaaaaaaaaaattagccaggccatggtggtacatgactgtggtcccagctacttgagaggctgaagtgggaggatcacttgagcccaggagtttgaggctgtggagagctatgatcatactcttgcactccagcctgagcaacagagaccctgcctgtaaaaataatgatgatgatgatgatgatgatgatgataagaataataataataaatgaaaagcaaaagtaaaataaaaaacaaaaatacaaaaatttttaaaagagtgtaaaccctcggaggtgagagtcatccagtgacatctggtaagcagcggccacagtgagacaggtgccgttgtaattattccctcatgaaaggtcaaggaacctgagctgcagagtcaaaaagtgattgtccccccgtcacaccgttaataagtggcagagataggattctgtctgactcgaaatcctaaactggttttatcaaaccaagagaatgttcagtgagttcaggggcccacagagagaggtaaccataaagcttcactatagacgagctcttgccagttaagcgattttggaagcgtgttgctcatttctagaggcttttttttctcttcgctcatccctctagccgtcataaaaggaggccccgacaacaagactgcttcccccatctaagactgacgtttctcttttaaagaggtatcaaggaatgactcctgctcggatttacccgagatccagaatggctggaaaaccacttctcacacggagttggtgcggggagccagaatcacctaccagtgtgaccccggctatgacatcgtggggagtgacaccctcacctgccagtgggacctcagctggagcagcgaccccccattttgtgagaaaagtaagagtggtcttgtttccttcctctaggtccctgggtggcaaatcccttctagggatctttttttggtgggtgcagtggagctgtttaatgtagaatctggactccccctccaccaccaattcacgagcattgctcacaaatgtcattttatagctgtcagtggaattacagactcaggtgccttcagaaacctggaccataatgtaaacgagtgagataagctgggtgtgagacattagggagtggtgtgaactccagtgaatgggagcgtatgtagcctggtgaaaaagaacatttggctgggtgtagtggctcatgcctgtaatcctagtgctttgggaggctgaggtgggaggatcacttgagcccatgagtttgatagcagcctgggcaatacagtgagaccctatctctaaaaaataataataagcataaaaattagctgggtgtggtgggacacacctgtagtcctagctactcaggaggctgagacagaaggattgctggaacgcaggtgtttgagctatgattatgcctctgccctttagcctgggtgacagagcaaaaccctgttgagaggggtggctgggagagagagaaggaaggaaggaaggaaggaaggaaggaaggaaggaaggaaggaagggaggaaagaaagaaagaaagaaagagaaagaaagaaagaaagaaagagaaaaagaaagaaagaaagaaagaaagaaagaaagaaaaagaaagaaagaaagaaagaaagaaagaaagaaagaaagaaagaaagaaagaaagaaggcaagggagggaagggagggaagggagggaagggaagaagggaggaagggagggggagggaaggggagggaaggggagggaaggggagggaaggggagggaaggggagagaagagagggaaggggggagggaaggggagagaagggagggaggggagggtgagggaaggggagtgaaggggagggaggggagggaaggaatgaaagaggggagggagggaaggaaggaagggagggagggaaggaaaaagagagaagggagaggagaggagaggaagggagggaaaaatcattattatttaaccattttaagggattggaatgaacatgaactagttccctatagaagtcttcttacctgcctcattttttgccaagaaaaggcccaaagtgggcaaataaatttgaattgggccccttctatgtgggactgtttgcatttccatgctgggtctctcacttatcctccatccaagacagtggagacccaccaatcacctctgttgttctctcttctgatgaaatgaggtcagaaaaaccccttggcacaatggtctccccatagaagtcactggatttcattaacctttcattggttaatctcctgtcttgacattgaaagacatatatagccatatcttaaaattacattggtaacgatgcttacttatagtacccaggcagtagtaaaatgatagaatagaaagtgaaaatctttgatgatgttactctttggaaacaacgctgctgttaaacatttattctatattgcttcaattgtgtgtgtgtgtacatgcacatcatacatacattacatgtcacacatagacatctatatatgtgtcatctgtcatatgtcaatcatagctcactgcaacctcaaggttttgggctcaagcagtcctcccaccacagccccccaaaatgctggggttacagatgtgaacaaccacacccagctaatttttaaaaattttttgtagagacaggggtcttgctatgttgcccaggctggtctcaaactcctggcctcagcctcccagagagctgggattacaggcatgagccaccgcacccagcagatccattcttacaaacttcctgcatctgcttttttttcagctcagaaatgtggatatcttttcatatcatacatgttgtccagtttattctcttttaattggtttattgttttccttttatctatattgattttttaatgtgaaaagtaatgaaagtttattttactacattccagcactacagagaaagcagtgaaggctccccctcactttgttctctttagcagttgctcagaatttcatgggatggctattccatgatatttaactctttccctgttaaactatttgcaatgtttcctttttaaaaaaatcgcaaataataatgcaatatgcaaccttatacataggtctttggaccctgatgcaaattatttgggcaaattcatatatatgtgtgtgtgtgtgtatatatatatatacacatatatatatatatatatttatatgtatttttttgaggcaaggtctcactctgttgcccaggctggagtgcagtggtgccataatggctcactgcagccttgacctgccaggcttaagcgatcctctcacctcagcctcctgagtagctggaaaaacaggtgtaccccaccatgccccattaatttttgtattttttgtagggaccggatcttgctgtgttgcccaggctggtctcaaactcctgagctcaagcgattcatccacctctgtcttccctttcaagtcctaggattacaggcatgagctaccgtgccccacctctttgggcaaattcttaaaagaggaattaaattcaaggctattttctcctggcctattctccagccacctatcaacaaaagatacattatcttccaaaaaggaaaagaactgagttaggaaactttttttttttttttttttgagatggagtctcgctctgtcgcccaggctggagtgcagtggtgcgatctcggctcacttcaagctccgcttcccgggttcacgccattctcctgcttcagcctcccgagtagctgggagtacaggcgcccaccaccaggccaggctaattttttgtgtttttagtagagacggggtttcaccatgttagccaggatggtctcgatctcctgacctcgtgatccacccgcctcggcctcccaaattgctgggactacaggcgtgagccaccgcacccggccaagttaggaaactttctagatcattctgtaattctcagcaaacccatggtcatccagaggtctgacgtcctcttggtctggtttcatcccgtgtagttatgtactgcaccgaccccggagaggtggatcactcgacccgcttaatttcggatcctgtgctgctggtggggaccaccatccaatacacctgcaaccccggttttgtgcttgaagggagttctcttctgacctgctacagccgtgaaacagggactcccatctggacgtctcgcctgccccactgcgtttgtgagtcctgtttaatgaattgggcccccagtaggtagaagcagattcactttctcttgttcatgatggaaggctgggctgctaggaggccttctgcttttcgacaggggcttttattatcattactatgacaaaacagtacctaacactgattgggagcacacatactataacatttacagtaaatttatcacgcgttgctctaagtcttctaccaaatttcactctttcttcctcaagtagccctgggagcatagtatactttgtttttttgtttgtttgtttgtttgtttgtttgtttgttggttggttggttggttttagatggaattccactatgtcacccaggctggagtgcagtggcaccatcttggctcactgcaatctccgcctcctgggttcaagcgattctcatgcctcagcctcccgagtagctgggattacaggcgcgtgccaccatgcctggctaatttttatatttttagtaaagatggggtttcaccatgttggccaggctggtcttgaactcttgatctcaaatgatccacccgcctcggcctcccaaagtgctgggattacaggcatgagccaccaccctggcttcactgatttcattttaagaagaggatactgtgctaggtgtggtggctcacacctgtaatcccagcactgtgggaggtcaaggcaggcaaaccactcgagcccaagagtttgagaccagtctgggcaacatggcgaaaccctgtctctaccaaaaaaatacagaaattagccaggcatggtggtgtacacctattatcccagctgctcaggaggctgaggtgggaggattgcttgagcccaagaggtcaaggctgcagtgagctgtgattatgtcactgtaccctagcttgggtggcacagcgagaccctgcctcaaaaaaaaaaaaaaaagaatactacttcaaggctctctagggattctgatatacaaacaatgttcacagtcattgcataaggaaagcatgaagttacacggaaggagcagagccttacacagtattttgggggttagaaactctcagctgcactaatattttaaattagtgtgttatgaacaactccattaggaatacagccagttcaaactccagaagccacagtgaggtcttgatagtgttgaagaaccaagaatttaactctggggggaaaaaaagaaaagaaaaaatagaattcctgtgagttgattataaattcccctacatctgatgtgagtaacactgtgtacaatttatagacttggccacctcctatagtggctatgttttgtgacttctcacaagtacctaaaacaggcttcacaaattttgatgaccacactaacaagcaactctacgatttagacgagcaaactgcagaaaggcaaccagaaagcaggaaagtccttgtccgttttcattggataggctgatacttactgagcacttactgtaggccaggtgtcattctaagaatggcgcatgcattaactctttgattcctggcaggaaaacaaaaatggagatgtctgttgcctgtcgttgaagacagagtatggccaaattcacactcacaagagaccttcctctctgctctattcatgagccagccaaagccaagttcccgtgtgctagttcataaattcagcttccccagcccacagaagggctttactctacagatcccaaaagaatgaagagttttaggcccaaagcgcttgcttcatagatttcccttaacatctgatccttttcttgtgagagaaaaatttccatttctgtgttcttattttctcttctcaaaaagggacactttattattctgtttccacaagtaacagggattcttggaccacacagccctgtgtctccatctgtctttttagtcagagtcccagaatttcagagctgaagggaatctgagagataaaatacaactgcaggatgacttagagataaaatgcaactgcccccattgtacagataataacaatagttacttattgaatgtaaaagacacattgctaagcacactatacatatctgtaaacatgtgtttttgtgtatgtgtgtgtatatatagtgtgtgtacatatgtgcatatatatgcatatacacatatactaaggaaactgatattcagagggaagtacaaataacaagaatcattgctcattgaatgtgtaagacacatttctagacactatatatatgtgaatctatgcatatgtgtgtatttatacacacatactaaacctagccccttaaccacaaccacacttggtccccaagccccagaaccttgggccaaatccacattggttggttcctgttataggttgaatctatccccaaaagatatgttaaagtcctaacccacagtatctgtaactgcgaccttgattggacatagcgtcttcgccatcctaacccatggtatctgtaattgtgaccttgattagaacttcaaagttctaacccacagtatctgtaactgtgaccttgattggacctagcgtctttgacatcctaacccatggtatctgtaattgtgatcttgattagaacttcaaagttctaacccacagtatctgtaaccgtgaccttgattggacacagtgtcttcaacatcctaacccatggtatctgtaactgtgaccttgattagaacttcaaagttctaacccacagtatctgtaaccatgaccttgattggacacagtgtcttcgacatcctaacccacagtatctgtaactgtgaccttgattggacagagtgtcttcgacatcctaacccatggtatctgtaactgtgaccttgattggacgtagcgtctttgacatcctaacccatggtatctgtaactgtgaccttgattagaacttcaaagttctaacccacagtatctgtaactgtggatttgattggaaatagaatctttgcagatgtggtcaagttaagctgaggtcgcactggattaagatgggtgttgatccaatgactggtgtctttgtaagaagagggaaatctggacacagatggggacacagatacagagaaggccacagggtgacagagggagagattagagtgatgcagctgcaagccagggagcacgaaggaaggaccccccccaaccgcccacagcattcagagggagtgtggccctgctgacaccttgattttggacttccagcctcccagccaagaagtttctgctgtcctaagcctcccggtttgtggtcctttgtcaagggcagccctaggacgtcagtgtcattcccatttccttctagtgactgcaagagcgatcagaagcagccactttagtaactccagctgcagagacccagagatgaaaagcttaaaataaaagcttctattaaaatactgaaaggtggaggcatcatttttttaaaaaagaaaaagcacttcaccaatgagacccagtctctaaagaccctctgagctgcggcagctgctgctggatttccaagacgcaagcctccctccctcccttcgggaatgcttttccctgaaatctcagcattggatctgcagtgctgagtagagacggcttcccttacacccatgctaatgagttcacgagccacgcggggtgtcaggagacacgcggtactcccaaaagcctgaagaagagccctgcgtgtggtggcagcgacgtgacaagcgggtgaggctgatgggagataacgcaggaggcgagagatggtccgattctggcagcgcggctcctgagtaagagggaggatgcagtctaggttctgaaggcatttttaaggttgaggttgtcagacataaaacagctttgaaacgttttgtcgactgaacaaagggaacagcacccatttgatgggccccttcagtaggctgaccttttccccaacactaacactcttcaccctcacggaaatcgcacaggtgaatgcctgtccacttaaaagcaggcaaagaaggactggagagggtgagtagctttcctgaggtcacacaacagaaaggaagaacagaattctaactcaagcctgactaaacccaaaagcatcttcccaacctcatcactctgcagttcagcttttgggcaaacctctggtgcttaagagtggacaaagatccaccaagaagttaatgaagcagacagaaaactgcataagcccctgggcccagtggtgaggtggctcacgcctgtaatcccaacacttgtgggaggctgaggcaggaggatcacttgcggtcaggagttccagaccagtgtggccaacatggtgaaacccccgtctctactaaaaatacaaaaattagccagacttgatggtgagcacctgcaatctgagctactcaggaggccgaggcaggaaaatcacttgagctcaggtggcggaggttgcagtgagcagagatcacgccactgcactccagcctgggcaacagagggagaccctgtctcaacaacatagaaacagaaaagaaaagaaaagaaaactgtataagctctggttgtctacagcctcttgcccagtcacttgcccaaagccatagtttggtcccctgggactgaaagccatatctttttaatcctagtccatttaccccagggcactttaagaacagacaggtcaggcagagataaagggaagagtctgggtgtcaaagtcagacacaccctccagctctgctgagtgaccttgggcaagtaacttgccctctctgggcctcagagcccccatctgtgaaagaaaataataccctttaccaagaaggattgttgggagcaactcactcagtcattcagcttactcagttgttcaggcctcctatatgcaggcacacgctaggacagaggttcccaaactttctcaactcatgacacccttggtgtctcaggaattttttcacagatttcctaggccaaaataccatttccatttattaaataccagttccatttattaaacagttaggtacaaacaactgaatgagtagttatctcttcacagcatagtagccatttgaaaaagtaatgcacatacattaaaagaaaaacggttttttttattattaaataatgacaattgctggctgggcgtgatggcttacacctgtaatcctagcactttgggaggctgaggcgggcagattacctgaggtcaggggttcgagaccagcctggccaacatagtgaaaccccgtctctactaaaaatacaaaaattagctgggtgtggtggcacgtgcctgtaatcccagctacctgggaggctgaggcgggagaatcgctggaacccgggaggcggaggttgcagtgagctgagatcatgccactgcactccaggctgggagacagagcaagattctgtctcaaataataataataataataataataataataataataataataataataatgacaattgctgctacgaggatgtgtatacccgttgggctgtgcaaatcttcttaaacgttaggatcagatgggacttcgccaccctaatttcctgttccacattgattttgtcacagttagcacgagcaccacaaaaaaatccagctttgcaatgatgagtcatcaccaaaacaaaggtgacgtgatctaatgttgaaacggtgaactatcttgagctggtagttcacaagggtccaacacatcattgtgtttcctcagaacttttttttttttttgagacggagtctggctctgttgcccaggccgatgtgcagtggcgcaatcttagcccactgcaagctccacctcccgggttcacgccattctcctgcctcaggctccagagtagctgggactacaggtgcccgccaccacgcctggctaattttttgtatttttagtagagatggggtttcaccgtgttagccaggatggtctcctgaccttgtgatccacccgccttgacctctcaaagtgctgggattacagccatgcgccactgtgcccggccctcagaactttttttaaaaatcccacagcaccccctgtgagttcctggtggcatcctgggtcaccttggtgaaagtttgggaaccctggcactagcccctggaaaaacagtaaggtataaacagatatgacccacattctcatggagcctggggcctatttggaaaggagggtggagagacaggtctatgaaggaaatcacaatgaatcgtcagcaccacctcctccaggaagtcctccctgatttcctaggccgggttgtgtttctgtcctcagaattcccatggaacctacagtgacatctgtcaccacagctgctgcagtttattgaaatgatctgtttatatgtttgtagaatcacattccctagagtaagaaagagaaagaattttaaaatatatatatagaataaacacataactcacctgctaggattgtctccagttgatccttgaatcccccaagcccaggaggctcgacaaatgatgttactattactgtcgttgatattgttagcaaaatgaatgtggtctttatcacacctctgctttgttgcaacttcccctctttgataaggacgtggtggatgactcctgaggtaaccatcccaaagacataaaccacaccaccaaaactaaaaagaatctgacaaatccggcaagggttttatgagtggctctccaggagccacttagcttgcttaagagacagcgattccccgggaggccctggttctcacagccctgagcccagaacacctgggatacgagacacagggatttcccagcctggacagagcccacaggtgctgtggccagactgtggccaccgtaggagcttccactgttgagccgtctcctgtggccacatcttggccagcatgtccagtgttagctgagttcccgtcctcatttagaaatctctgtctctgggaaagcggtctctcacagaaatccatgataaccctaggggatttgggtaaaagaagggcctttgttatagcagaaccattaaatggacagcactaaaaaccagcacgtccaggtttgtaccccagccctgcctcttacaagcaccatgactttatacaagccagctttctcaccaaaaagattgaaaaacgaacatgccaatcataaatataaaggcttttaatgaatggtgtgcttggcacatagcaagtcgtcagttaacattggctgctaatcaccactctgtttcaaagctccactgcttgtagggcatattgcaaaccatttgtaactattactaggggacttgatttcgagctttttgttcaaatgtgctccagaaatgtacattttcttctattgttaaagagaggggaaaatagaaaaagaaaacagaaacgagagtgggttcgtgagtagatctataaggccatcggtccaattcatttgcattcctgggagagaacggctggagttacaccagttgcaacccgaattgtttaaaacattcgaccagtggttttcaaccagaggcgattttgctttccaggggacatgtgtaaatacaatttctagagaaattatgagttgtcacaacttgtcagggaagaggggtgctaccggcttctagcaggtcagggcccaggatgctgctcaatatcctccagtgcccaggacagcccccaccacaaagaattatccattccaaatgtaaaacctgtctaagttgagaaaacctgccttagatgatcttatttcaaagtgtgactacatgtcactgcctagccatgtctcggctaaggtccagactgtttatgggcagaaaaaaatggagtatggagacataagcaactcactcaaggtggtgcagcagacacaggcctccagtttcaaattcaagttcctattcctttgactcttctgccatcttctaggtgctgaagatacacacaaatgccttccaagagctggttcctgctggggaaaaattccatatgacattgttttcaaactcttactgaggactgggtcaaaattgaatcaggctgacttgaaagctagagaatcctcagctcaaattgcagctcagccacttcctgcttgaggggacttttcaccagtgagttccacctgagcctcagttttctcatctgtaaaatggctgcatggtgcagtggttaagaccggacttggaccacctggatttgaatcttatttataccactaactagcttgtgacctttaacacgttacccaaccgttctgcgctgcattctccttggatacaaaatggagatgatgaccaggcatgatggctcatgcctgtaatctcaacactttgaaagaacgagacaggaggatcacttgaggtcaggagttcaggaccagcctgggtaacctcagggtcctcaggaccctgtcttcataaaaaatttttaaattagccaggcatgatggtgcacgccagtggtcccagcgactcgggaggctaaggtgggaggatctcttgaaagggaggtcaaggctgaagtgagctgtgttcacgccactgcactccagcctgggtgacagaatgagaccctgtctcaaaaataaaaataaaataaagtaggaataaagatataatatctgtgtcttagggttgttgtgataactaaatgagttcatagatataaaacactcagaatggaatctggctcagagaatgccctcagtaaatattgtaaatgttggctgttttggtcatgattgttattaccttcaaggactttgcagaaggattagaaataatatatgcaaatcatctaatacagaatggttgtgcaaatactttggaaattaattaaatgatgagttaatatgttaaccatgccaggacaccaaaccagtggttctgagcccttgccaaactttaaaatctcctggagagttttaaaaagaatactctgggtgactaattaaattaaaataccataggggcggagccagggcacaggataacccaaggccattctagcacttagcctgggggtcctgctcctaggtcggctgtcaatatcctcctttacacccaggtctaacgatttatcctttatgcaccttccatctccccagggcgaggacagtgtttagcacaggtttggtatcaggaaatacttctggaatacatacaggactgaattagtgttcagttacatgaaggcagggaccatgttcgccttgctcatcattgtatgcccggcgcatacaatgcctggcacacagaaggtgtccagtgaatatttgttgtattaattcatctgttaatttatgaaagaaaatttccgaggaaaggttcatgggggaattcttttgtgtcgccactgccacctgctggtcatttttctgcactgcaggtaatacagtagggatttgtgttctctgaagggagccaccaacgtcatcaagaaaaagcctccccgaccagggggcgggaaagtgaggcttctcctgtgcgctttccccagcacagctgagaccacactgggctgtaatgacccggtaactgttctctgttccccattcgactgagttttgggagaacagaaaacgtgattctctaattcactgcttcatacccagctcctagcacagggatggaacattggaggaacagagtctacgggctgaaaaaaaaacaaaaaacaaaaacaaaaacaaaaaaaacacggagagtgtattctggactctgggagttcaaaagctataaagtgttgtgcaccgggctgcacttcccgaggagtaggagtattagatacactacggggatacccacgcggctttaaacagtgtccagatgaactttttgtgagtcgtttggcttaagaaaattagaaaaattaaaactgacatgtgaaacctctgattataagactattattatttagagtgaggctaaattatactgtgcaatctaaatagaaaaacaagtcaatagaaatttttaaaaatatattacataggccaggtgtggtggctcatgcctgtaatcccagcactttgggaggctgaggcggatggatcacttgaggtcaggagttcgagaccagcctggccaaaatggtggaaccccgtctctactaaaaatacaaaaacaaaaaaaatcagctaggcttggtggcgcatgcctgtggtcccagctactcgggaggctgaggcaggaaaatcgcttgaacccaggaggctgaggttgcagtgagctgagatcacaccactgcactccatcttgagtgacagagtgagactctgtctcaaaaaaaaaaaaaaatatatatatatatatatgtattaagtgaacaacagtacaattggtatgaaaatatgacaagagttttaaaagccataaaaataatcagtgtatattgggtgctcactatatgctgcccatctcatgtgcgtgagcttgttttattctcataacaacaccttgagacagcccattttaaagatgaggaaactgaggctcagagaggtcagttgtgctcacagacatacaactaggatgtgcatcctgagcccttggacacttgaacccaagcgctcctgctctgcaatttgcctttaaatgaaatgatgtgaggtctttcaagaaatatttactgggcacctaccctgtaccaggttgccaaggatgcagcagtgagctcagctgggttgaggaccaaagacttcctcaggatattttcagaggaatcattagaatatgattggcactgggttctgttcattataccatctatgcttattgtaaagtaatgcagacccaccctgcattaaaaaaaaatacatcaaagcacaggctttaaaaataaaaataaaattctcccttcctacagtccatccccaaggcacgctctgcagggtgaatgattccttgccagccctcttaggtctcatccataaacacataatagagtgctgccttggagggagccccatgattgacttaagcaaggctttgtgatttgattctgggctcaaacacagaagcgttggctgcatatccatcctgctctggaatgccagggggcaaacttcaagtatacagatgaccttcaattagtggaaggattagccttggccaagtgtcagctgaaccacttactgcctcatctctgggagtcttgtggaaagggagctacattcaaaatctctgcctctctcgctcaactattccaacagccccttcccttggctactttaggggtcttctgcagccacccagggtcttctgagtttctctcttctatggcacctgccatttttaattaaattgtccatttacacatttgcttggccccttagagcatgcagaccatgagctctagaggacaggaatgatgtctgattcacctcctcaccgcattgctggacgcattgctgggcatgaagtaagcactcaagatatattttctgaataaatgcatgggtgcccgccagagctatctatggtgtcatccaagatgcaactccagctgcacagtgacctgggaagtctcttcccacaggctgacttctgggctagatttcaagggtgggaaggaaacagttcataactcccagggaagactgctattgaagtataaaggaaaacccttcaacctcaagagtgaagccagattcctacccgtccacccactggaggagatcaaagtcccgattcttcatgtatggtgattactgtgactaaaacatactcatcaattgattcattcatcttttcattggaaaagtgatacatttaaatgcctacaaggccaggcaagtaccacgtgaaagacaatagggagtggcagagactggggctaaagtaaagaatattcctggtctaacagggaaagccattactcaactccagccagtcattgccatgtaacaatgtgaacccagtattgcccaatcttctaatgtttcagaagaatccagaaatctaaattattatttgaaatctcctaatctgtgaaagcttggtaactattgtttcagttgacattactcaagctgagtagagcccaaatgtaagtcatgttcacagagaaaagggttctagctgggacctatactgtactgtgtgccttgaaccacaagtgccgtaggaccagggattatatctgttttattcacctctgtgtcctcagtactatttatgttgttggcacataataattgctcaataaacattatctgagtaaataaaggaatgcttcctgtgaaccaggcattgtactgggtatgagcatatatgagtttaaagcctgggaaagaagtgccagaaaagattctgaagttatgatgatgataagacagagttccaaggacagaattcatgcctttggggagcaatctgggtcttgaaggcatgcttgagattcatcgtgcaaaatgagacgcttcaaacaacacgtttattatctgacagtttctgtgggtcagaaatctgggcatagcttaacatgtacacccatgttcatagcagtattgttcagagtagccaaaaggggaagcgacacaagtgtccatcgatggatgaacgaaaaacaaagtgtgacacctgcctacgatggaatattagccttgaaaaggaagaaaatttttgacacatcttgcaacctagatgaaccttgaggacattatgctaagagaaagaagccagtcacagaaggcaaatactatctgattccacttacatgcgataactagagctgtgaacttcatagagacagaaagtagaatggtggatcccaggggctagggtaagttgtttaacgcatatagagtttaagatttgcaagatgaaaagagttctggacataagttgcccaacaatgtaaaagtacactaacctactggactgtacacttaaaatggttaagatggttagttttatgttatgtagattttactacaatttaaaattttttaaataataaagtttagaatgttttaggatttgtagtcctgtgtgtgaagcaatttgctggctgtccattccatccaggtgctgaaaaaggactagatctcacatgcggcctggaatgggttaaacctgcaggttcaactctccagtaaatactgtgatcctaacaccttgggaggctgtggcaggagaattgcttgagcccaggagtttgagaccagcttgggatgcatggcaagaccctgtctctactttaaaaaaaaaaaaaaaaaaaaagccgagtgtggcgggacacgcctatagtcccagctactcagaaggcttaagcaggggaattgcttgaccctgggaggttaaggctgcagtgagccgtgctgcaccactgcactccagcctgggtgtcttaggctaccgggtactttgtgtctgcagctgaagagagcagtcaccagatggcagtatgggcttatttgtaatagttgaggccttttgttgccaggctcccaggccctgagcttcaggcttgctctgataggctcatctccaatgagggaaacagataactaattcagtacagtacagtgcatgcagtgctggagaaactaagaagactgacgactcaattcacggtaggaggcatcaaggaaggcttcctggagaaggagaaatgaagattgagtattgaaagacaagacgtagtcataatggatgcgcaggttaggtgtcaggtgaaaagcaagaagaagatttcataattaaacaccaccaccgtccatcatttactaagtacgtatgacatgccaaaaacaaaacatcttaagcatttccttacttacctattttagtcctccaaattcctaggagatagatattactttgatcgtcgttatgctaatgaggaaactaaggatcagaaaggttatgccacttgctggcgatcacacagctaacaagtaacagaactcatattttaaccttgattcctcagccaacttcattctaccttgcctgtatgtaatctgtgcccagaggtggaagacagaaagaacagtttgagaaatagaaaacagtctgatgcaaggtggggatgcagagagaggatgctggagaggctgaccaaagctagatcacacgggttctgagcaggactccccaaagatttgcatcatctcatcagagctccttctggcttgcatttcagcggaggagtccctggcatgtgacaacccagggctgcctgaaaatggataccaaatcctgtacaagcgactctacctgccaggagagtccctcaccttcatgtgctacgaaggctttgagctcatgggtgaagtgaccatccgctgcatcctgggacagccatcccactggaacgggcccctgcccgtgtgtaaaggtaaagaaacctactcaccacacagggtccacggggcctggagatgtcaggctcctggctcacaggagttctgaacttgctctaaaaaattggactaggagttcgagaccagccgaggcaacatagtgagacccccatctctaccaaaaaaaaaaaaattagtcaggcatggcggcacacacctgtagtcccagctactcgggaggctgagatgggaggatcacctgagcctaggaggtcaaggttgcagtgagccttgatcatgccactgcactccagcccggacagaacgagactctatctcaaaaaaattaaattaaattttaaaataatagagctgagctgctgtacttcattaaatctaagatgtcaccatgactttatgcaccactaaaaaagaaaaaaacatgctgccaattatactatgacacaatgtcttctcctggcttagcatttttatttttacttactaaaggagcttttgaccaggcacagtagctcacgcctgtaatcccaacactttgggaggctgatgcaggcatatcacttgaggtcaggagttcaagaccagcctgaccaacatggtgaaaccccatctctacttaaaatacaaaaaaattagctgggcgtagcggtgcatgcctgaagtcccagctactcgggaggctgaggcaagagaatcacttgaatccaggaggcagaggttgcagtgagccgaggtggctccactgcactccagcctgggtgacacagcgagattctatctaaaaaatgaaaacataaaggtctttaagctttttatcatatatcacaattatgaaaatgttcaaatgaaaatataagcagcccaggtgcagtggctcacacctgtaatcctagcattttgggaagctgaggtgggaggattgcttgagccggggagtttgagaccagcctgggtaacatggtgaaactgtctctacaaaaacaaaataatgataataatacaaaaattaacctgatgtggtgacgtgtgcctgtagtcccagctacttgggaggctaaggtgggaggatcacttgatcccaggagacagaggttgcaatgagctatgatcatgctactgcactccagcctgggtgacagagtgagactctgtctcaaacaaacaaacaaacaaacaaacaaaatacaagcaaaataaactggttccagtgtatttaaaacttccccaccttcaaagtctggcacttttgattttctaaattattactaaatttttttgtagagacagggtcttgctatgttggccaggctggcctagaactcctgacctcaagcgatcctccctcctctgcctctgagtagctgggattgcaggtatgagccaccacacccagctgtagaatcattttttactccaagtcttcaacatcctatttttccactcaatatcgctcctgttgaatgtcattgtgtactaaaatatatatacatttacatacatacatagctcctgtcccattaaagcatcagggatgcagaattctgtaggaacgtccataacgaactaaagtctttgatacaaggggcttgcagttacattgaggcagggctgggacgagtctgaggcaaaagaggtgcctgaggtgaaaaatgtaaggaggtgaccaagcgtcccgtagaacagccttaaaaaaagagtctccgtacacttctcgccctagacagctctcgccttgccctagtcccggccctgtgatccagcctggtttttgttgatttgtttgtttgtttttgtttgtttgtttgtttggagacagggtcttactctgttgcacaggctggaatgcagtggcgtgatcattactcactgcagcctcaaccacctgggctcaagctatcctcctacctcagcctcgcgagtggctgggaccacaagtgcacgccaccacgcccagctaaatttttttatttttgtagagatgggggtctcgctatgttgcccaggctggtctctactcctggcctcaaacgatcctcccacctcggcctcccaaagtgctgggattaccgcatctgacctctgcctgcttttgacccctgcttagagaaccctgcttaattatttcccacctcttgcactgcctcctcacaaccagttagttcccatgggttaggagtgttcctccactgcctacagggtgatctcccagggcgttacctggcgttctgcaaaccctaatactcttaacgcccccagtttgtgcacacggggaatcgtgagcgccacctggtggcagctattattacacattattgctttaagcctcgcccccacctcccagatggtgaagtgagaaaattgcatcttagaatccattgaacactcatcactaaaattaagttgtaacacactaagtaaaatttggattcgtttatctggacttttgaagtgcacaatcagtaatagtaacggaaatatgttcagtgttttaggccagtggatcttaacctttattgctttagtgcccctttgagaatcaggcaaaaggctcgaatttgccctccagaaggaacagaagcatgaagttttatgtctctacttgggaacccctaacttcagtggatccccaaatgccttattcatgaaccccagctctgaggcttaaaactactttcccagttagtttgtccactccgaggtatatttccaaaagaagtgaaacaggtatttaagcaaaccctgtctaagaatgtttataggagcactattcacaatagccacgagatggaaacaacccaaatgcccaccaactgatgaatggataaacaaaagtgtggcagaaaaaagggaatattattcagccattaaaaggaacgaaatactgacacataccacaacatggatgaacctcaaagccgttatgctgagtgaaggaagccagacacaaaaggtcacatgttttagggttctgtttctaggaaacatctagaataggtaaatccatagagacagaaagcagagtcgtggttgtctagggactgcttactgagtatggggcttgttttggagatgaagaacatgttttggaactaggcagaggtcatggttgcgcaccattgtgaatatgctgaatgccactgaattgtaacactttgaaatggttaattttatgttatgtgaattttatctacctaaaaaaaaaaacaattcccctgaatcacctctgttaagtcttatgaccactgtctaagataggtgagccatcttacctgttttacagatgtggaaggagaagctcagagaagttaagtgattttcccaaagccacacagctagtacaagacaaagctaggacttgaacccgcatctcatgactgtaaatttcccgccttcagggctactaagaaagacccccaaccagccagtcaccgcagcatggaaacctaggtgtgttcacacattcccgaatctaacccagatctcccaaagcaaaatcattgagaggcgggcctggaataagccttttaacaagctctcaaatgcactttgaatgtgagaaccatttaaggccgtgatttccaaacataaacggagtcctgagccctttccacggagattctgattcactgggtctaaagcaggacccagggaccagtttaactaaccacacaggtgaattgtatcatcagccaagtatgggaaacactagcatgagggttgcaatttaatcttaccaggtatcaagcaggggctcatcacgtgaatgacaatgacttatataagcagttcttttgtttttttttttgagacagattctcgctctgtcccccaggctggagtgcagtggctggatctcggctcactgcaagctccgcctcccgcattcacgccatttctcctgcctcggcctcccgagtagctgggactacaggcgcccgccaccacacccggctaattttttgtatttttagtagagacgggttttcaccgtgttagccaggatggtctcgatctcctgacctcgtgattcgcccacctctgcctcccaaagtgctgggattacaggcggagtcactgcgcccggccgtaagcagttcctaataagagaacaaggggtccttttgaagagcagcgaacagtaagaaatccacaattagcattcaagacagctgccttccctcattcccccataattttgactaagtccagcccagtgtttgaatttattttatttgtgtatttttaatagagacggagttttgtcattttgcccaagctggtcttgaactcctgggctcaagggatctgtccacctcagcctcccaaagtgctgggattacaggcgtgagccatcatacccgacctgaatttatttttgatagcacaggaaacctgctttgcagagcttaagtattgggaagttcctgagtaaagattgcctgtaaaccctctaactgtcacatggacattaatagaaattaatttgacattgttgatgagttttctgcagggaagaaaaattagcaggatttgttttttaagaaaccttggccggcgcggtggctcacgcctgtaatcccagcactttgggaggccaaggcaggtggatcacgaggtcaggagttcgagaccatcctggctaacacggtgaaacctcgtctctactaaaaatacaaaaaaaatttagccgggtgtggtggcgggcgcctgtagtcccagctactcaggaggctgaggcaggacaatggcgtgaacgtgggaggcggagcttgcggtgagctgagatcgagccactgcactccagcctgggtgacagaacgacactccatctcaaaaaaaagaaagaaaaaaaaccctaaataagaaaaccatgaaaagggccactttggcctggacaacgtgtttgtatctgccacggtagctttttaaattcttcttggattaattgcaaaggtatctcatggaacaagtagaagaaatcagagcttcaaatggaaggagcagttttcctctctcctccatccctttctttcttctccagaagccagtgctaatcacctgaatttccagtgtcacacctttccctagtcttatacacatagacatatttggaaagagagagggatgtttgtttttgttttacagaaaaaaaaaaagaaaagaaaaaaaggctgggtgtggtggcttacacctgtaatcccagcactttgagaggccgaggtgggaagatcacttgagcccaggagttcgagaccagcctaggcaaaatagtgggacctcatttctacaaaaaatcaaaaaattagcggggcatggtgacacactcctgtagtcccaactacttgggaagctgaggcaggagcactgcttgagcccaggaggttgaggctgcagtgagccatgattgcaccattgcactccagcctgggaaacagagcaagaccctgtatcacaaaaaaaaaaaaaaaaaaagggagggaggttcatatcatgctgtattctgtgttttacttattacaaaagtagtgccatgttattttttttatttgccacccgtcattccacactttgcttgttccccagtgcattcagcccttcctctgttgatggagacatcagttctcttccagttttttgtttgttttgttttgccaaaaaaaatcttgcccatgaatccttggatgctggcacttttcatcctgcaggacagattcctcaaagcaggattgatggtgtgggcaaagatctatggatatcgagttgtcctggatgtcaccaaatcgtttcccacaattggagcaatccacgctcaccaacaatgtgtaatatgtccatttctccacctcctcgccagcactgtatgttttcaatttttttttaatgctgccaaactgaaaagaaaataaaactaccatcagaatatacacaaatgtagctgggcatggtggtgtgcacctgtaatcccagctacttggaggctgaagtaggagaatcgcttgaaaccgggaggccgaggttgcagtgggctgagattgcaccactgcactccagtctaggtgacagagcaagactctgtcttaaaaaataataataatatacacaaatgacaaaaaaaggaaaaaaaaaacacgaaaagataaaaagaggctccattttgcaggtgatccctgaaacctctcttttctatgggctagtatctctagaagccccacaaggtcaatcagctcactgccttctcccacaactgtgatggaattgctagcaagaaaggctctcaggagacccctgcacctttcttccctctccatttccactcctgagatccgtcccaccaccaactctgtaaggaaatgagaaatcacttcctcctcagaaaaaaactgggatgcatgacattgtggtatgcaggaggggaagcaactcagtgccaatgtgaggccacctgactgggacttggggaccccgggctccagtccagttctgctgtggaccacctgtgtgaccttgagtgagcccccctccctctctgaccttggtttccctttttgtgaaataactgggggagtccagatcagagtttctgaagaggagccagtgagcccactggatgcatcagaactgctgaggcattggtgagacctgcagaggtccaccgctgagaataccgctctgacaagtcccaggaatggcccaggaatctgcatttaacatgccctgtggggttcatgagcacagggctccaaggaacacatgattcaatgcctcctcccagttctaagattccatggacattcacgcactctcactcaaccacggtgcaactcacatcttggggcaggaccatctgcttcaatctttccattttcttgatgccaaagctgcagagaagtgtgcacttagttagccagctagcttttcagctggttttgtcatcatggtgtgatgatggcgtaaaccagagagtgactttaaccaaggcatggattagggtgtcttgggattggggacatcagtatagctaagcctttggtggccactccctcctatcccctaatgctgcaattttttcatcaaagtccttcatgctggggttttgcattcctgtaataaacatccatccttgttggtatatttttgtgcttagctaccatgatgactgatgacaaagatggggtgccagtccccatgatgttgaacctccggagaagttttacaaaaaacataaatgattaaaaatagtttcacatgggatacaaagcctcatcaatataaaaggaataaaaatgaaattagagaggtttacatagatagtcttcaaaacaggaaaacagttccacctctggctggattttgtatgaaggtctggggcctcgcaattcattcgtgctttgccccacatgaaaatgatgaaaagaccctaaccacataattgagagcagaaaccagagagcttgagcagcccagactgaaatcctgcctccatcactgagaagctgtgtgatgtcagagaagtcacttcacttctctgaacctctgtttgctcatctgtaaaatggggatgataatagcattgacctaacaagattgttatgaggattaactgagcaaatgtatgtagagttcttggcacaattttggacacgcggtgagtgttcagtaattattcactatcactgttgttgatcttgggtcttatctatctcatcttctcttggtaacttaggaagtgaatagtccaggcacgttcactgattatagtggcccaagataagtaaaaacataccactaacttcaccaaagcatggcatgggcttttgcatcaaattttttggcctcatttcatgcaaacgaagtgaattcactttacattgaccaatgcttcctgatttctctttcagttaatcaagacagttttgaacatgctttagaaggtgagttccagaacgaaaaaaaaaaaagttcaataaatcaaactaatagcacaaaacaagggcaggtctttgaatatctttatttagacacttaaaaaataaataaattctaccttcagactgccaaagataatcttaaaataatattgtaggggaaaaaaaattatgggatttgcaagtcaggaccctaacaataacctgaaagggatttgacagctgttctgtacatggtaacagcaatgagataaggaaagctcagagcccataagcctgagaaaggcataaccctattgtaaaacttttcatgatgccattctagaaggggaactaaatctagtgacatgtcaccttccatgctgagagtcctcctggtttccagagggaagagtttgccctggaagcattcaatggtccatttttccctgagtcttttttcccctcagcatacccaccccttctcccatctctccttacttcagctctccttttattagaaattcccaaatgagacttattaatgaggagcagatgttaaaatctatccaggattttatttcagttttgttttcattttgtggttccttccctttccaacccctcccgtgtgtaaaatgtccagcgttctatgtcaccgctattgaatttggtacaaaaccactcaccgggactgtgatgtaaaatatatactgtaatatattactgcatgtatatatatgtaaatacaaatgcagtatattatagcatatatatttaaaaatatatactgtaatatattgtttcttttttttttttaatgtttttaccaaatcaagcagtttttattattcctggagccatctttagctttctgacaataatgagttcacttagaatctggggctatgtaaattacatttcactagtggctgttccttgtaacagacaacacttgaatccaagcaggtggaactagggctcatatataaatgaaggagcatgaattatacactccacttggaaaacagagggcacttcgtgttagtctccattcagagtatcctttttctgccttttgccaaccagtgaaccatgagaacgtctcaaagggctggggttgctcggagcttatgagagccattgtaacgttttgtgctcatgcatttattctgggtattaggattgatttttcagaccccataaagtggtggttaatgggttatagattggtgtacagccaagctctattagatgtgaccgtggagaatggcagaggaaacctggaggccaagtttctagaaggaatgtaggatccccctttaagctatgctgggaaagcagccctctgccccaggcgcctgcagcagctgttatagttcttgcaattgccacagtgggaggttgagagagcagccgggaaatgtgcaggagtagcctctgggaatcaaaacgggccttcatatttggggtgtcattggggtgtgcaggacagagagctgtcagtccccaatgctcagagcccactcgtggactggagagtagaactcaaaaggtctaggacgggcccgtcagtctgcatgcaacaagctcaccagtccacaggtgagcaccaggtctgagaatcccttagaaaccttgcggctgaccaccagcaccgttcaactcaacgacatacacaaacccagattcgcccaccactcctgcatctggggtccagacccattcctgtttctcttctccactccatggaatgtccagcaaatctgctttcccagttactgaatttgggattttctccaagtcttcctgtgaattggactttaatcagattttaactgtagctcccaaaaaatgggaatggtacgatcaggtttcaaacagtgtaattctctatagctcctatggccaacccaccaaaggatgagtctgggaccccttgcaaaggaccaccaccatttcctctagtctttggagatggctctgcaaggtctaaggccctcccagagccttagaccttggaaagccgtctccaaaggggtggagaactgggcagttgggcactcactgggagtcagctacctgggaaatgaggacctcactggctcctgtgttcagtagcagaagcggcagcagagacgtcgctggaaggggggaacatggccctggctatcttcatcccggtcctcatcatctccttactgctgggaggagcctacatttacatcacaaggtagggagctgatgggggagatgactgccaagcacccagccaccagtactcagagggactgggcggttcacctctctgagcctcagggtctccacctggagctcgggcatagtggcatttgtgttattgcagagatgcccagattcagcccaactctgtgggataaatatttacattgggcaattatgaagcctccaagcaagtaagacaaatactattcctgccctcaaggaggttatggtttagtggggcacacagacataacatattgccaggcatgttgatttgttccttccatcactcactcattcactcatttattcaacaaatatgtactgacaatctgttgtatatcagacattgtcccaggtgttgagggtctagaaacttgcatttgatgcagaaggaagatattaaaccatgcaccagaatagccactcattcattcacattcacagttgttgagcacttactaggtgccaggcagttttctcggttccagaaacatcatttgtggaaaaaaaaaaatagaaggaaatatttgccctcctggggttcaggttctaacaaggaaagatagacaataagcaaagtatgtaagaaaatatgtagtgttagaaactgataagtgcaggaagagaaggctgggagggggcaagaattctggaagagaagtggtggttgacttttaaatagtgtagctagaggaggccccactgagaaatgacatttgagcaaggacttgaaagtgatcatgagaaacctatgcagtccaggcgtggtggctcacacctgtaatcccaagactttgggaggccaacgcaggtgaatcacttgaggtcaggagttcgagactagcctggccaacgtggtggaaccccgtctctactaaaaaaataaaaaataaaattagcctgggcatggtggtgggtgcctgtaatcccagctacttgggaagctgaggcaggagaatcacttgaacctgggaggaggaggttgcagtgagccaagatcatgacactgcactccagcctgggcaacaaagcaagactccatttcaaaaacaaaagaaacctatgcaaatatgtgaaaaaggagggtttcatgcagggaaacagcatgtgcaaaggtcctgaggcaggaacgtgactaaaatagatcatccctgcccttatggagcccacagtctactgggggcagggtagagtaaatacacaaataaattataacacactaagataaacacaatgaaggaaataggtaggtgtggtgagtaacagagaaatcacctttaaatagatggtcaggggccaggcatggtggttcatccctataatcccagcactttgggaggccaaggctggaggatcgcgtgagcccaggagtttgagaccagcttgggcaatgggcaatatagtgagagctcgcctcttaaaaaataaaaaaaataaaacacttaaaaagttagccaagtgtggtggtgcacgcaggtaggagaatcacttgagcccaggaggcagaggttgcagtgagctgagatggcaccactgcactacaacccgggtgacagagcaagaccctgtctctaaataaataaataggtggtcaaggaaggctgatctaaggcaatatggcatacagtaggtgctcaataaatgctcatccttgttcttgtttccctttgcattcaagagggacttgaatgaccttccaggagaaaacaaattaagctccgccccctccctagtaaggagagatcacaaggctttggttctcgctgcctgggttgcaagttgagagcaattatgatttctgctttcacctcactaggattctcgcctgcaaaaggctgtttgcacacatcctcgtcgtcattcacagaggtgccgctgctcaggaagtggcaccaactgttcccgttcaatattgtaatgtttctcctagctggggagaagtaacttctctctcctttctttcccccagatgtcgctactattccaacctccgcctgcctctgatgtactcccacccctacagccagatcaccgtggaaaccgagtttgacaaccccatttacgagacaggggtgagttggtctctctcgtctcttcccaattccctccctctttgctctgaattcaccaacaataagacaaaacatttcatttcctattgctcacaagaggcacagccagtggtcctgtcttatccccaccaagagccctaaagagataaatgctgggagaacccagctctctttgcaggtgattggtgctgaggacgagcctaggaggctgattactgtcagcagaacacccacagaaaaaagaggctgcacccaagacccacagagagcagaccaacggtggcctggtggcaacgtgctgcattcccacacatcccactgggctccaccctttattcaatggcagtgtgaaacatccctacacatttgagtatcaggtcctattttaggtgctaggaacatagtcatgaaccccaatagacacagattccaccattaatgagcctaccgtcttgtgaattattattatcaataataatacatgccatctgctgggcactttaaatgcataatctccttgaatccttgcagctctctgcaataggttccacagttatctctaattgattgatgaggacattgaggtccagagagaggaaagaataatttggccaaagtggcacacagccaggatgcacagcctgaagccaggatgcaaattcaacctgacactcttaatcatgatgctatcttgcttccctcgaacctctgacaatccaatgtgcccatgaatattttgattacaacaaataatactttttaaggactatgaaaaaattgaacagggcactaggagaatgtataatggggacacttagagggagttggggaaggcatcattgagaaagtgagagtaaagctgagacatgggaagtgggtagagcttggacaatgggctgaagaagatgccagacagaagggagagcatgtgcaaaggtccagggcacatgcgaggaagcaaaaggctggttatgagtttgcaaaaccaccatccttcaagttcactgtgtaatgatgtgcagccatctcccaacgtttggggggaataaacctgacttgtttcttatcctgctaaccttccttcacctccacttctctgatctcctgtgttagttatccactgatgtgtaacaatattactgcaaacttaggggcctaaattaacaacatacatttattatctcatagtttctataagtcaggaagccaggcacagcttagcctgaccccctgctttatggctcacaggctacaaacaaggcagcaactgggctgcagtctcatctgaggctcaaccagggaaggatccacttccaaactcacatggttgttgacagcattcagttccttgcaggttgttagaatgagggcctcaatttcttgcgggctgtcttctaggggccacccgcagtttcttccatgtgggcctctctatagagcagctcatgacatggcagctggcttcttcagagccagcaacagagagagagtcatcttgcaagacagaagtcacaatcctgtgtcatgcaaacatggaagtgacatcctagcacctgtgtattctcctagttagaatcaagtcacaggctttacccacccttaaaaggaggggaccccacaaaggcatgagccccagaaggtggggatcatggggaccaccttggggcctgcccaccaaaatcccatgtaccatgaagcatagatgtgattgcatatctgtgttggctgaatgggagctggagactttcattaaagcatgtgacagtgtcaacttccagggctgagccttcttctatctccttgctccttgtccctggagcttggaatacattactcacactccataaatattgaagaaatcaaactaccccccatgttgtagtcgtttcacatggcaatggtagatcagggcatatgttattttgcattctatgtagcttgctttgaaatcatgggaaaaggtcagactgaaataaaggagaattttagagactagacatgaatgaatacttattagtagagtgtatcagtgacctagaactatagtaatgctgagtaacaaagatctctgaactcaatggcttaatgcaacaagcattcatttgctcatcagtctgtgggacagcgttttaggcttatttcagctggatggtaatcctggcattggctggttgatggatgggtgactcagctctgctctgtgtgtccttcattttcctgaagagactaaagcctaccagggcatgccctgttcttggtgatgacagatagacaggatgtgagcagaaacacacaagcatgtttcaagcagctgttgtacgccatttccttataacccattggcaaaagcaaatcagggtcagagtgggagggcactgaaaagtcacgaccaagggcatggacatacagaggtgcaaagaactgcatccccctatgtatatcactctaccacacaagcgtttgacaaatccgtgcttctctctcttgcaggaaaccagagagtatgaggtttctatctaaagagagctacacttgagaaggggacttgtgaactcaaccacaatctcctcgagacattcatccagagaccatgtggcacttgattgaaaccccagaatgtcgactgtcttttgtttagactctttatcaaaggtttactgttttcttccctgtatttattatatttaaaagtgaaa

SEQ ID NO: 122 - DNA, 248682 bp, Homo sapiens
gcctgggggtgggcgtcttctctcaaccgaagctgggagttggggagctggagggtccaggatgagaattcagtggcgctactaccccggagctgcttgtggttcagagatcagaaaggtgtcctgaggactggaggcagaaatccaggcgtggcgtactggaaggcgcactaggggagggcagcctggcccagaatttctttgcattttaaaggccacacattcagtctccccggggcgctacggaggtagtcaccgccacatccaggactccttccacagaggtcagttcctcagctgggtgggctttaatacgctctcttcgtagagacccggaggttcaactttaattctttgcgctgacatttgctcaacgacaccggagcagaaatccttgggataattgcgtaggtaacaaacagtgtctcaatcccactgaagataagtaagttaaaaataaagacagtgatgttggtggtgaacttgagtggcgattagtttccgcaattagttccctcctgcactgtccatttgttaagcaaatgtgctgacggctttttttaaatgattgggttgccataaaagaggttttctctagtctgaatgaacttctgtgcgatgctgactgagggtttcagcctcctctagatgcttacaagagcttggtctggaaggtacaagggtgcgaacccttaaggtaccaagcagcttctcagtgaaccgtgagacgttagaacacttgcttcaggacgcacagaattcagacaccacttattgaaggatttgtatggattataatttacattagcattcattttttgcttgagtcagtagcatttcaattcaacaaatatttattgtacacctgttaacgggcagacctctgagagccgggctggtgtgctgttgggtagcacaggtgttgatattaatacaaaggggaatcttaaggcacttattcctcacaggtgggtgtttagaacgagaccaatggtgctgcgctttgcctcagcagcacctgtgtaatcgctggttataagtatttaaatgcagggagaatgtaaatctttgaagagtctctgtcattagcctgatcagtcattccaaagcaataaaaattgtcaaaaccatgcttaaaataagattattaagaattagctctgtgccaagcaccatgctaggcactttgtcttgtctatgaaatctacaaagtagatactattcccctgtgcagataaggaactgaggcagagaggagtccagtaatttgtacaaggtcagtggtgaatttagaaattgcatgtggctatttctgagtgcagaactcgtactttttcactattccatgctgtctctaagatggagagtgtaaatccggcagatttaatataagaattcaaatttatattcatagatcctatctcctggggattaatggagttaaagtagtcctcaggaatgaagtgagcactgttttcattgcacttgtgtggtcaagctgtgacctatctgtgactagtagatgtagctttaaaagataaaatttattatgtgtcttaacatattttgaaaggcctttcaaaatatgttaaaagataaaatttattatgtctcttaacatattttgaaaggcctgatatatccaaacagggccaattaataaaattgcatatatattctctctgtgttatacatggaaggaacagctaatttcctattattggtgtgctttactatggtctcctcctgcagaggtgagtttctcagctgagtgggctttgaaatcaatttcagcttgatttcttacagctgcaagatgattagcggtctcttgtcacctggaaaggactttgtgtttgtgtaaacctgtgctcacacacgaatatatatttttccttaaacctatttccagaagtactacttctggaaattgtagagtactgcaatgtgatgatctggcgaggaatcaagttccttatttgacttttgcataaaggatttataacaactgacaatttctttaagtgcatgtaaaccaggaaagtaattttcaaattaaaattattatactgtggagaatggaaagtgagtgaaaaatagtactctgaattcaaataatatttcttgttgtggaaaacacttgctttcttaaaacttttcttgtaattgttggtaattacacacagaaatggaaggggttttatatttaaattaccttgaattgttgccagttaactgttgagaaaaggctttgcccgtgaagcgaggatcaggtagaatattttgcctgcgtcaatcttggcacagattttttttttccctctatcttcacgtggaggtgaaacagccagacaccttaaactcctctttaggagctgagctgttaagtccttcctagaaggtgtttataaaagtgtgcctgacctggtaaggtgttctcatggggaaccagggtgggtgatgaaggaggagagtatgtaggggatatgaagcaggggcagttccaagttttgtgaggcctaaaaggtaaacaatttggagactctctttaagaaaattaatacaaaattaggtgtgaaagtgaatatgtatttaaaatgagaaaaagagatgataatttactggagatttctgcctgtttctgtggagatcttgggcaatttaccagaaatgcttacaaaaacaggagtgctgattgcaatccggcttcccctctccctgagaacactcagcatttcccagcagcttgtcacacccacggggggccctgctagtgagaagcccaaagttgaagctctgttaccctcaaagagtgagagggaaagttgtggttaaaggcaaaggactcatgctccactgagcagagaagagactgctggatgggacagcagagacactctggacactcatgtccaacgaacaattctgagagctggtcttcaagactttccaggttggtttgtttctcagggatgcctttggccattggcttttccaactatcagtcaccatttattgggagttttctaatgtcccaagtcctgagtaaggcgaagtcctgattgtcaagaactcccagtctcatggagctgatttcattgatcacagtgctttgttataggcttgcatagagatgccacaggggccttggagggttcctgatggcttgagctgagtttggagttactctgatggagtccaggagggtcattctaagtgagcagagagccattaaaagccctggtggtggtcgggcacagtggctcacgcctgtaatcccagcactttgggaggccgagttgggtggatcacctgaggtcaggagttcgagaccggcctggccaatatggcgaaatcccatctctactaaaagtacaaaaattagtccggtgtggtggcagtgcctataatcctaggtaattgggaggctgaggtaggagaatggcttgaacttgggaggcggaggttgcagcagtgagccaagattgcaccattgcattccagcctgggagacaagagcgaaactccgtctcaaaaaaaaaaaaaaatccctggtggtttagactcattcattctcctccactgatgttcttcgagtccggcagcacctacgtacctgagattaacttgttagaaatgcacgttctcaggcaccccgcattaggagctctgcgtctagagcacagtaatctgtgctttaagaagccctccggatgattctggtgcatgctaaaatctgaaaaccactggtcttaatatttaagagaacagatagggcatggaatcccttatggagatcactgggagggaactgaaattaataataatagtaatatattagtgttgtaatatgataatttgtattactatcactaacatttattgagctctcaggttgtgccaggcattttgctaagaaatattaactcttaatcttcggtacaaaccctgggtaacgcagggctatgatcaactggatttaaatgtgagaaaactgaaagagaaataggaaattgtccgtagtcacacagctggaaagtggttcagccgggattcaagcacaggctgtctggttttagaaccttcctcttttatcttgcctgggagagttttcatcgatgccactgttatgtgttggcattggccaagaggcaggcctgggattgcttgggatgtgcctgtttaacaatcgtagtcatttgctgactactgtggttaagaaatttttcattagagacaaatttccaaactaggaaggaagaacttcattgtcatttactcctgatgcagacttttaaaatttcatgagtgaatagacatgattccatataaatgattacatcacatgcaaataccatttcccatagcgtcatgattaagggctcctatggattacccagcggggagtgatgttggtgattatggaaggtggccttgtttccttgtttaggaatgctgggatttgatctgattattagaggcctctcttctagaggccaagcacctccccaggccacagaggatttgaaggtgatgctgtgtttgttcattacattttggaagatattcagaagagctgtgccttgtcctattacattttttttttctggtaaaaaaataaaaagttgcctatgattcaatcctttcttttttttcttttttttttttttttttttttttttttacgaaatagccccatggtgtcaagcagcgtgagtaagaatgtacagatagtgacatggatatgtgtgcgagtgcgtagagtgatggtttgctctcgggtataaacctaaggttgctgtgcctttacttcccctctagaaaaaaatgtttacacaaacattaatttgagtttatggtaggcagcagaatctaattctgagaatgccagctgtgtcatctatgcatgcgttcattcattcatgtggtcactggttgcctgcctagttgtgctaaatattatgttaggcaccagaagagatacagtgtgaccaaaacagacatgatccccatggaccggaatagaagtccttgtagtgcaatgttatgggagaacagaatagatgccctccctctggcagtgagtcagcaggaaaggcgctcataagttattgtagatcaggagggaggtaggttattgggcttgattaaggccttagggaagtggaggtgcggcaggatttgagagataactaggaagattacacaggtgaccaggtggaggtgggtgatgagagagagggaggtgctgggcctgtggatcaggtttgagccttgggctgctggcttggtgccagtaacataagtcagtattggaggaggagaagcctcttttcagagaattatgaccttcatggacactgagtctgagatgtttggatgaccccaaggtagagatgttaggtggataattggataggataaaggtctgcactccaggaaagaggttggcaatgtagagatttgaaagaactggtctttggatggtaattgaataattgactaaatatcaactgattgaataatgcagttgctgtaacaactgaataattcaatcaactgaactcattcttcagcgagtggagatgaatcctccactctctttggcctttgagatatttgagagccatatttgagaggtggaggtggaaggacgtcctcaatgtggaaaagcaaacaagggccattgaaagcagttgaggacaggactaaactcggatttttttttttttttatgctgcccaaattcttatctaaggggtctggggactcatgccctacaaactataaattcttatcaaatgggtttcatttaaccctgtatatcatgacttactttccaatctgactctggcataacattacctgacaaagaagaaagtggaaatattttaccccaaaagtatgtttctttgccatattttgaaatggtcctgcaaagctgtcctttgtggggtcacatgtgcatctgtaaagaatctctattaaagctagatctttttcttccaggccctccctatcctgaagagattaagagtctagcaccttttaaggtctgaataggaaacatttgtcatctgtcatctctaagggcagccactgtaagacttcagagaaccttgctctccacaattttttatcttaacctgaacatttcctttctattgatcccaggtctttagacaaactcaaccaattgtcaatcagaaaatgtttacatttatctatagcctggaagccaccccccgccccgcgcactttgagttgtcacgcctttttgaaccaaaccaatgtatttcttgaacgtatttcattgatgtgtcatgcctctctaaaatgtataaaatcaagctgcaccctgaccaccttgggcacatgttctcaggacctcctgagggctgagtcacgggccatggtcactcatatttggctcggaataaatctcttaaaatattttacagagtttgactcttttttgttgacatagtagagtgaggagtgaacaaggaggttgttgaaagctagtgttcagaatttgagcccatataatttttatgaggtaaaacgtttatcatatatcctcttgttattttctgttataaaaacacacattttaaattaatgtatatcgtatgaatcataaatgaatcatatcattttgtatattgtgtagattggccagtgctgctttggagtagctgttagaatattaatttttatatagaatagataggttttcttaggtgctccaagtagaaggcttttttaaaactgctaaaaagtagctaggagaaaaaaaaaagttcttttatccaaaaactattcactgagcatgtgctatacatgttatgtgctgaaattttagttgtgaataaaacaaatagatcctcatcctctcagagcttacagttgagaggggaaaccagacagtttcacaagtgattacaatgaagcgtgctgttcgttaagggtgagggacagggtgctatgagagcaggtggtgagggccacatccaaagtgccacctaggcctggcaggaaggagatggagaagcacagagggagtgttttgagaaatcagtggatggatgcttttgaggaactgaaagcctaggctagtctgtttaagctttgttaatgacaagttattaataagtgggaatattcatgagaggtctgctaactgatggggaaaactaaaaaggaagcattaaacctatctgtgtgaccacgcccatgttctgtgaagggttttgaagaatccaagatacaatggagttgaccgtgaaaaaaaaaaaaaaagaaaagaaaaactaaaaacaaaaacacccaaattaaaaacaaaaataccaaaatcaaaaacaaaaatgattgggtaatgcttactttttttaaggtggtggttggggaactacttttagcattatgaagcatgtttggatttagcctgagaacttgggtaatatatcaaaaaataacattatatttcttggactacaataaccattattgctatgataatcttgcttaacgtaaaagatatgtatatagatatgcttagcttcttcggtttatagtctggaaatgacctttgggatcagctgttccacctccagttgccccttcatgaataatctggggctcaggagtgctgcaggctcaattattattttcactgggtcaattggtgacaacatctgttgggtagaatctgtcctgagttccttgtcctacagcgacaatgcttcacttgaagacttcttgtttgttgttggaacaggcccagtaaataattatctccatctcctttaagtctttacttacatgagctccctcccctgtcttccttatctcctactttttctgacactgtgctatgttttgaattctgtaggaatccttggcggaagttgccttcagcattttaggcctgtctaaacaggtagaatttatctgacatttctttcactcccttaagcctcatgtgagttggcacagagacatgtagctttggcaaagaatgagaaagaaggttctggggaagttttctctgttaatatttgaaccaaaagacacggtggggcttggaaagtatctgatgaattgtttttaaatgtcatgaactatttatgtgcccccaaattatgtttgatcagataggtgtggccctgatcagtaataacagactggtatttggtccttttattaactacttcctctccaatttcctttccaaagccacgtgtcagtttcaagcattgtcactatgagcccaagatccagaattattattttattgtttagttttggtgttcagttgtcaggctgtgccttttcattggtagttttttttttgtttgttttgttttttaagtagaagtttttgcttttcctagtttacaggacacacagatttagctgctgtatattttattttgtgtactagctacctgatatttcggagtctctactcagtggtagcattatcttagtcatgctaatcctcttaggaaccctattagataggaatcatctccattttattgaagggaacactgagactcagtgaaacctagaacttgcacaaggtcacccaactgggttggaaatctggcctatgtctttttttactttctacccctgttatttgatttcaagctagtgctgtttcaaccatttcaatcactgcactctgttttgcatcccagggaaattatttcaccccaagacttgaggggtttcaagacccattccaactaagatttcagaaattcctctacctcctgagtttggaagtagctgttctgtgcattctcaggctcaatgcaaaggtgaaatccttcatgacaggggaggccttaaaaccacatccatgtagacctggaatcttgctaaaccctgttgtgaagataaacgcagcatggtcttgataaatatgtcatttaagagcaatttcctgccagatgactgtgtatatatgaagctgggtaatctggaaaagtctctatcctttatctgatccaagtgatgctgtaaacaggattgttagatttgtgtaacgaagctagcaatcacatctaaatattactacacttaattcctaagtgttcatgtgagaacaacttcattgtgtttttatgtttttgaatgattgtaaccttttaaatatatacagatgttggcatttcaaaacccaggaaaattcttgtggtgctattgattagatcaaggtactttttttggtgtgtatctattattagcattaagacacacttatcaaataagatcttttcaagatccagagtatacagacacggtggatgttttggttatcgtggtcttcgagaagctggggttacttctctgaatactccacttatccccagcagagcttctgagatatctcctagggatcctttagtttcatgtagagtcggtggctttctaggatgtgagagcaaatgcagaggctggtgtaaatggcaggggaaagtagtggaagaatgtaactaatactcccttgaaccctacaatctgatgtgccgggcacagcctcatctgcttttgagaacactcatcggtgttgtttaatattcattccaataagaagccattttactataggttatgaatggtaattttgtatttttgtttaaactattttctaatgcaaattttgctgaccaattctggatgtcttgtttgtgcaattttggtcgtttccatggtttgtagtaatatcctaaatctggccagtcggaaaaccaggtcttgcctgtcgatatctttttgctggtggctgtgggtcagagctgactgacttagtacttacaaggcatttgtattattgttgctttttaaagtatgtgattaagcataggatagaatagtatagaacaatattatgtgctgatgtatgaatgcagatatatatattttttttctggaaatgagtgctagaaacttactagtggttcctttgtggagatggtctagtttgagctaagtcactttttatcctgtgcctctaggcacaattacagtttcctaaggcatacccactttaaaaaaaaaaagttaccaggtttaattcagtggtgagataatagggctttttatttttgtctttaaaatgtcatttaaattatccttggacctcagaatattaaagagactttgaatttgtttaatatttcatagttttttaaaagtctggcatttattattagattttattagtttctttgagatcaggagaattagcactactctgtatggttgttgaaatgattaaggagagaaaaggttccaaattattctctccattcagcaagagttcctgtaggccacttctgatgaggtaggtgcagaatggaaccacttaaaacgtttctactccagtgagcaagtaatgaaggcctatgctatggctccctcaaaccaccttgttactggggaaagactgggttttgaattcagacaaaccccagctcaactatcagttctgccatatattagctgtgggacgttgacatctctggaactcagttttctcatttgtaaaatggagatgaaaatactttgagatgcctgtggatattagtaagaatacatgtagactgccttgcacataacagatacttcataaatgtctattattcaaggaaaagagggagtctggattcttcgtaataagcaaacctacagaggtttgggtaagtgcctgcctacgctgttatgtcagctttctcagagatcaggcatctgtgcactgctgaggtttttttctacattgccttctaaccaggataaggatgagaaagcatggtaggatctgatactaaattacagtattaaaagaaacaagaggcacatttttgggccagtaacaattttaaaaatctagtctatttacccaacttgaggctgttatttttagagatgagacactagacactgaaagtttttttttaaactttagatttttattttcattttaaagatgtttttcccttttgcatttttaactaagttttgaggtcagaaagcgagtattgcacatgcacatatcctattggcagtattgggtttagtggtttcttggtagttaccgtatgatttgatgaaagcctggccacttctggggttagctgacagtgtttcctaaatatatgtatatatatgtatacacatatacacgtacacatatacacgtgtatatgtagatacacatatacacgtgtatatgtgtatctacacatacacgtgtatatgtgtatctacacatacacgtgtatatgtgtatctacacatacacgtgtatatgtgtatctacacatacacgtgtatatgtgtatctacacatatacgtgtatatgtgtatctacgggtgtgtatatatgtatctacgggtgtggatatatttatatacgtgtgtgtatatacatacgtacgtatgtacgtatgcgtatatacgtatgcgtatatacgtatatacatacgtatgcgtacatacacatgcgtatatgcgtatatacatacatacgtatgcgtacatacgtatgcgtatatgcatatatacatacatacgtatgcgtacatacgtatgcgtatatgcgtatgtacatacatacgtatgcgtatatgcgtatgtacatacatacgtatgcgtatatgcgtatgtacatacatacgtatgcgtatatgcgtatgtacatacatacgtatgcgtacatgcgtatgcgtatatgcgtatgtacacacatacgtatgcgtacatatgtatgcgtatatgcgtatgtacacacatacgtatgcgtgcatacgtatgcgtatatgcgtatgtacatacatacgtatgcgtatatttgtatatgtatgtatacacgcatatgtgtatatacgcatatgcgtatatacatatatatgtatacacatatgcgtatatatacacatatatgtatacacatacatatgcgtatatacacatatatgtatacacatacatatgtgtatacatatatgtatacacatgcatatgtgtatatatttatgaacatatatatgtatatacacatatgcgtatatacatatatgtatacacatatgtatatatttatgtacacatatatgtatacacatacatatgtgtatatatttatgtacacatatatgtatacacatacatatgtgtatatatttacacatatgtgtacacatacatatatgtgtatatatttacacacacatatgtatacacatacatatgtgtatatatttatgcacacatatgtatacacatacgtatgtgtatatattgcacacatatgtatacacatacatatgtgtatatatttatgcacacatatgtatacacatacatatgtgtatatgtttatatacacatgtatacacatgcatatgtgtatatgtttatatacacgtgtatacacatacgtatgtgtatatgtttatatacacgtgtatacacatacatatgtgtatatatttatatacacgtgtatacacatatgtgtatatatttatatacacacatatatacacatacatatgtgtatatatttatatacacatatgtatacacatgtatatatacacgtatacgtatacacatacatatgtatatatacgtatatgtatacacataaatatgtatatttatattcgtatatgtatacacatacatatgcacctatgtttatatacgtatatgtatacacatacatatgcacctatgtttatatacgtatatgtatacacatacatatgcacctatatttatattcgtatatgtatacacatacatatgcacctatgtttatatacgtatatgtatacacatacatatgcacctatgtttatatacgtatatgtatacacatacatatgcacctatgtttataaacgtatatgtatacacatacatatccacctatgtttatatacgtatatgtatacacatacatatgcacctatgtttatattcgtatatgtatacacatacatatgcacctatgtttatattcgtatatgtatacacatacatatgcacgtatgtttatatacgtatatgtatacacatatgcacctatgtttatatacgtatatgtatacacatacatatgcacctatgtttatatacgtatatgtatacacatacatatgcacctatgtttatatacgtatatgtatacacatacatatgcacctgtttatatacgtatatgtatacacatacatatgcacctgtttatatacgtatatgtatacacatacatatgcacctatgtttatatacgtatatgtatacacatacatatgtacctgtttacgtatatgtatacacatacatatgtacctatgtttatatatgtatatgtatacacatgtgtatatatttatacacacatgtttgtatatttatacacatgtatagatttatacacacatatgtatgtatatatttatacatatgtgtatatatacatatgtatgtatatatacacatatgtatatatacatatgtgtatatacgtatatacacatatgtatatatttatatacatatatgtacatatatttacatacatatgtgtagatatttacatacatatgtatatatatttacatacatatgtatatgtatttatatacatgtgtgtatatatttatatacatgtgtgtatatatttatatatacacatatatgtatatgtatttatatacatatatgtatatatacatacatgtatgtatttatatatgtatacatatatgtatatatttatatacatacatgtatatatttatatatgtatacatatatgtatatatacgtatatgtacatatacgtatatagacatatacatatgtacatgtatatatacatatacttatacatatacatatgtatatgtaaatgtgtatatacatatgtatgtgtatacatatataaatatatgtgtgtgtgtgtgtatatatatatatatatatctatatagacaaaagagtacctttgaaggctttggaaggtgaaacctagtcaatggcttcattggagcacatacctacatttctgattgctccccccccagccaaaaatattgatcagctatgatttcacgtttaaacagggcaatagagaaaatggaaatgttttctagtttcaaaaaacttgtctccctggagtgtcaagcttcatcttcatgaaaagattattagtggtaacctcttcggagcagagaggattttaaaggcagatgaggtctgtgtaggctgagagtggggaggaaaaatgtgacttgagtctggaagaatgggagggactggcaaaggcttggggagaggtcgtcacttttatctctgttcctctcacattgtgtagcctcttggaactttgctgaaggaccctttgcaatgctacacatattaggaatggacactgaaaccgtcacctacaggaaatgaggtgtcagagactgaaggacaggtggcttaaaggtcaagtatttggagctgagccaatggtcctgaatctcagctctactatgtagtaattgtgtgtcactgggaaagttacttaagctttctgtgcctcagtttattcgtcagtgaatgagtcgtctaatagtacctaccttatagagttatgaggattataggatagtatttctaaagtgcttagtacctgatacctgaagcaccatagcctccccttaaggagtagctgcagtggctgatgctcttgttgtttggaaatattgatggtggagagactcatttaactttaatgccatataatgtgtcatgtttacctcccttaatagaacctaataattgcttcatatttaaaaactcatttgcagtattttagctcagtgggaagattgatttggatgtttttaatcattctaagcctttgttctagccgaggctctatgaaatgggttgcaaaatccacagactgagaaatgatagaaaactagggaaagttcatttgggaattatcaatttaagctgtcacatgataatgtccacttcattgcgctgacactggcattgatggaatccaagtggtggagaaaaatcgatttaacctttttaaaagatgatggttttaatattgataagtgttctttaccttttcatttgagagatgctactgtaatggaatgccttataaatactaatgagtgctgactgccatctttgatagtaactcctttgagtattttaagacaaactcccatgatctgggcaaatgtcatgttaatgcatcccagacaggttgagaaatatattcattaaatcatgcttcacatgagtgtaggaagagtttattaatttatatttaaaaacctttgtagattcacaggccaaaaaagggcttaggaggtgtgtgcgtgtgtgtgcgcgtgagtgcatgtgattccttttaattcatctgtggcagctttttctcctttgattgagacatttggatcagttcagagggcattggatgcacatcagtcagctcctcatgagtgcttcctgggtgcctcacctgctgccctttcttagtccccaacatgctggggaattccagctgtctccaggatcctcaggattgtaaaggatttctgcctattaagatccaaatgttaatggaaagaggggacagagagctgggctttaggatccatgccagttctaggatccttcaattcttggttgatagtgtctgagatcacttatgtgggccttactctgttgtggagttcaggggcttcattgtcaacctgttgatggtgattttgtagagatgttaagaggagtgggtcatttcattacgaaatgattgggaaaaaccagatgggatgtccaagcagataaaacgggcgcatcctcaccatagtttactccctgaccttcaatcagtaagactgatgatcattactaatttaatgcctctgtaaaaagctgccctgtaccttatcatagagcaataaatatgtattacacaacatgtttttccaaaaagcttaacagttatgaagctctttaggttgatgaactccactagtctctaggcaggcttggatttctagtaaatattcagtcatgatgttaataaaacgaatcctcttctgaattcattcatttgtttgttccatcaaaacttatctgtaatgtgccaggtattgatgtggactgggaaaatccagtctcttcccctcagggcacttacagtattgcagggtggtattgaggagtagattaggagattaagtaaataaactaacaagataatgttggatccttagggccatcaagaatgtgaggtgtgatgagattatgacatggaggtactgcttcacactagaaggtcaggattagagttaggcttggggtagaacttgttaaggaggtgattcctgatgtgggacctgaaagagccaggtttttgatctgtgcaaaggtcacattatgtaactaataacagccttgaataaggaaacaaaatccctacacttgcaccccaagtgtttgatgcacccattttctccttatgcgaggtttctagtgttatacttcacacaggcattacccttccaccaagtagaactgaaccatctcgaaataatgggcctcttccaggcaaggacgtgactgtggctcagtagatcctacctttcttcacacaaaccaagttggctgaactttgctcccaatgagagctccttctgtgtttactttccaattacattggccagtcaggtaagcctagagctttggccaggcttgctttaactttcctttgacgcttaaaatatgttctttcgcttgttgcttttagctctctgtaaatgccacactgtcctgtcattctcaggctgtcaagattctgcccgcttgtgtcaagatacttattggaaattagagcttcctctactttaagtctaaatcttttcaacactggatttttatatgatttacgaaatttgaattgtttggtgaacaatgagccaaaacagacagtgaggctttgcaaaggtgcaagtgtcttaatcaagaacccttcctgctcagtccgtggaaacttacccagtggtgtaaaccctgccacggtggcttacacaggttctctgtgctttttgttgattaactcaatatggaacagtatgctttgggtcctgagagtcagaaggaatggtaatacagaattatacctttatagaaaagcagaaatttactaaattaaatgttaaactcgagcttaaatgctattgaagcgcttgtgttgtgcagatagatgcctgtactgattgttctctctctggagcttctgttctgtgcagagatgacaaacatgataatattttattacacataagtaggagttaagaatctgggatagatatctgtcttgattttccgtaatatgcctgtaccatgtgaagtggtttcatttattttacatagccctgtgttatttagaatattctaaaactatatgtggactttcctgtattggctgttgaataagaactaattagctgtgccatatctggagttagcatggcctcttgaattgtcttaaagaaagttgtaggatatttctggtccttctataggatctatggttctgatatttgtgctgagatggagatggtaataccagcctagagccattgctcccctttccaaagcccaaggcagatgttcaagtgaatgacatcatatttcccactgagtctcagaatctttttttttttttttgagacggagtctcactctgtcacccaggctggagtgcagtggcgcgatctcagctcactgcaacctccgcctcctgggttcacgccattctcctgcctcagcctcttgagtagctgggactacaggcacccgccaccacgcccagctaattttttgtatttttagtagagacggggtttcactgtgttagccagtatggtctcgatctcctgacctcgtgatccacccacctcagcctcccaaagtgctgggattacaggcatgagccaccgtgcctggccagaatcttttttttaataacagctcttcaggtagctgtcatgagttgatctgagctggtcaccagaaacctagttgtcatccaagactgtttttgattaaactttttctttctgttgtctgaaagcacacatacaaaatgtcactgcaaacattacttttatttttacattcgcttattacaaaacattatgtcaatagtaaaagaaaaaaaaagcacatattatctgcctttggaaaaaatcagccatcagtgattttttcattttttttttccccaacttaagccatacttgtacatcacttcacagagccataaacatagttttggtagaattttgtagtttgtgtttttcacttaaaattataccataaattattttccaggtgactacatagcattggagaattcatttttaatggctgcattagtgaaaatgagtggctcgtatttctgttcctggtgtatgtgtgtatctaaaaatatatcacttaatatgcattctgtgctacatttcctaggcttgtagaacatttatagtttgtagtaactcagttgtcaccttgtgcaaactgtgcaagagattctatccttcacttgtgctgatggagtaatttaaaatttcatgtcgtgagcacgtattgaggattactatagaagcctatgaacactggatttttgtatggattttctctaatatactctaaatctaaaaacacattaaggcaaagcacctggctcctcaaagagctaacaccatgaaattacctagaaaacaaaatttagctaaatgaatttataccttactacagggactgagagttatctatttttttctattagctgaacagcagtctttatctctgttatatgaaatgacatgagctgtgcaaggtgaagtcactcagagaacaatcataacattaagagaaatgtggcctgaaagaatacattttgatttttatgctacttatagagttcagtgtgatggagctaggaaaattgacagcagagcccaacaattttagtacagaatttatctgctctgggaaaaagctgtcttcattgtgttatgaaatgtgaattggtgttgggtatttatagagtgagaggcagcagaaaatgtcctcatagtcaagtttaagaaaatgtcttatctaaatgagaagcaatacattgatatctatactgacataagtagcatgactatggaagatgattagataagagtggcccttggttgacttcatgacttctgtttgattggcagtgtataaaatgtagtaatttcacataaacatttgggctgagagcatctcttgaaagatctgagtgtgaggcgagtcaggctgcattcctgcagagctgccgtagccacagtgaggacaggacccatggtcacctgggattttgaccctgacaaataaatatatctttttactttaccgaattcatctccttaaaatgtgtcagtttctagacctgtacattcattccaacttggcttaaaattaataaattttgtcatttttatgttttcttaatcatcctaaaatacacataacctaatacgcattttgttttttttttttgagacggagtttcgctcttgttgcccaggctggagtgcagtggcgcgatctcagctcactgcaacctccacctcccgggttcaagcaattctcctgcctcggcctcctgagtagctaggattacaggtgcccgccaccacgcctggctaatttttgtatttttagtagagacggggtttctccatgtcagtcaggctggtgtcgaactcccgacgtcgggtgatccacctgcctcggcctcccaaagtgctgggattataggcgtgagccaccacacctggctgcaatgatcatttttaagtatacagttcagtgacgttatgtttatattgttgcacaactgtcacctccatccgtctcctgaactcttcattttgtgtaactgaaactgtgtccattaaacactgtttcctcattgtcctctccctctgcccctgacagccatcattctactttctgtctccacgaatttgactactttaagtagctcccataagaggactcctatagtatttgtccatttgtgactggcttatttcccgtagcataatgtcctcaaggttcatccacgtcctagcaattgccagaatttccttcttcttaaaggctgaataataatatgttgtatgtatttatcgcattttgttcattcgtagacacttgaattgcttcttttgcctattgcaaatagtgctgctaggaacatcggtgtacaattatttaagtccctgctttcgtttcttttgggcagatacccagaagtggaattgctagattatgtgatgattctatggttattttcttgaagaactgctacatcatttttccatagcggctgtaccattttacatttccaccaacagcacactagggttccaatctctctagagtcttgccaacacttgccattttctgttttgttgttgttgatagccattctagtgagtttaaagtgtgtctcataatttccatgtacatttccctaagaattagtgatattgagtataacgtttttacagagcttactacagttgtaagacatgaccttttgaattgtcattgtaagaaaattacctggcagatcaaaagatctggattctagtaatgtctccatctttaattagccatttgaccttcaattctgtttgacaacagttaattaggctgtgctgtggtaagtgctgatcccctcatgaggtgacacagagtggagaaaaataaaccacaaattttttattcatgcctctggtttacagatttttttttttttggtctcaaagtaaaaacaaggtatcacagcttaaacttttctaattctaaagtttgtaatctgtcacctaaacttataagtgtaacttagattctcttcagacctaggtagggttaccagccatcaaaataagacatgaaaagtatgatataagggaaacaggtaattttgaaatttttggaggatctgtggttaatatctgaaccttatttacaatttctacttatttataaatttgattaaaaattagcatatcttaattaaatgttgtttattttatcttatctcttgtcataccttgcttttctggcttcccagctcattacagcctggcttctgtgtccccgaggtgtctgctgccctcccagtaaccaaacaagttgggggcacctctgcttccctcagctgacttttctgcaacatttgcaattgttgcttactccttgaaacttcctctctctttcctctgtgctgccactaaaagttaattattcctgtggttcagcacccagccttgtttgcttttcactttacacacttgtttgaggagagacggttcctgtcttccacatttccatctcagattttgctctgaactcccaccttgaatatccagttagactatatagtgtgtctcaactttgataacttatcagtcttccaccttaccttctgtaaatggctcttgctcctctttccctgtgttaattggtggttccaccatattacctctggcctatctaggcaacttaaacacctgctgctgcctgctccctattcctctccaacacatataatcagcaaattacaaaattcagcttctcagtcccttcattgtcattctagttacatttttttgtggtctagcctttatcacactggattaatgcatcaactaggtactgcattagcatctcattcttaacacctcctagatcacacaacactgttggaattgctttgctatctgcttctcctactgtactctgagtgcctcaggagaataaatggggtgtgtattttattccttgagctaatgcctaggggaactaaaggatactgtaatagtctctctcttaaagtctctctttttttttttaatgcacaaaatgtaagtttcacatcgttgcatgtgacagacctaattctactgcagtatcacacaagtgtaaccattaaactccagagactgaaacagttttctcatcagcttaaaaaaaaaaatctggtggtagtatagctcaatggtgggttgaaacacatctgctttttacatgatccttgatgctccagagcacactgtttactttcactttcaatgactctaatttcaaatggtatagatcaaggttgcacatatgtgtacatagaggatgagactgtggtgggtgacatgttagaaagctgtgaatacctcgatatttgattggcaacagcaaatgttttcgtcatagcattggaatattcttgattgcttctgtttattattgcttcttatttcctagcatatttgaattgcatcactttctgatcagcctttgtaattttctttaccatttcccattgtgatgcactaataattattatacagtgtctcttcaggtttttaaattcttattttagaatgatgactgctttgcccagagtagagatttggtgatcccagttacgtagggatggcaatctagcctaaggtataagcacagatgttgtggtcagagagaacctggttcgaatcctggcactaatacatactggctgacaagttgcttcatgtttataacccttgatttcttcttacataggattggtatttttactcagctctgttaacatttgtgaggaattagaaaactcatggacaagaagacagtgcctgcacttagtcactgccaaacaaagggccactatttatatccctaaattatccacttcatttggaaatatcacaaatgtggccactggtttgatttttttgcagcaattcatatgtggatgaaattgagctcagtgcaactcagctatctaacgcttaagaagacacacattttatattctgataaatactgagttggagacatacttgctgtgaatgaatgaataaatgaatttaaattttatacttgtccttatgagagtaagcattaatttgtcattgattacaaccttaaatgattgatgagtacttagaaactaatgacttcgcaaaagagaatttccaaactgtcaatttgcttagaatttaaacaatgtcattgtattattcctctaaagcttgaagttttcagatgtgtttctttttatctggcattttattaaaagatgtgttacgcatgggaaaggtcaatgaatgtgacacagggcttggcaaagctgggatttatggagacacaattttttagaagttttctattggaagatcagacctgttcttcttccttttcctaaagacaaactttaggagataacatcaattaataattttgagaaatagtccttaacactttgatcatataactataccccaattagtttatgagatgacccatctaattggggcataaatgatttcaaatacatctttagggaagatggctaagtttccaacttgatctaacaggtgctttagagacctaatatagaaagagtttagattgattatagaaggaatataatgtagaatggaagatctctttagttttcgtagtgtttctagtatcaaatctagagagagggttttattctgtgtaaatgagatctatgatattagcaaccatttagatatagatggctagattattaactttttagcagtttgactttcgtcatagcacttatgactgacataagtattttaataattaattttatgcatacttgcctttcttgagtagtgataaatcctatttacataaagacctctaaaaacatgcctgtaggccaaggaagggacgttgcatctcgtgaagaatcctgggatatttggtaggagagagtggaggagggctttgggcttatgctgagtggcattaagggtggaccagcagaagccgtggtcaactctgtactgagtgctattctgaagccgaggcagtttcacaattgagtatcctagtgatctttgctcaggaagcaggggaaatgaagtagagctaggaaagttggtaggaatgaaagaaatcattcaacagtagggagttattacattgtttagcaactatggaatgctcttaggaaaattttttttgttgactttacagttgtacttacttctgttaatgaagcacaatctgatttttagcagggatgacttttatttactcagatgtcgcataaaaacttttgtcttttcctcacagctccattttggtgctcagaattttcttgacatctgtaggctgaaaatcccaaatgcaaaaacctgaactacaaaatgttgcaaaatccaaaagcttttgagtgcagacataatgacacaggtggaaaattccacacctgaccctgtgtgatgggtcacagtcaaaatgcagccgaaactttgtttcatgtgcaaaattattgaaatattgtataaaattacctttaggctatgtatataaggtgtgtatgaaacattaatttagtgtttagacttgggtcctgtccccaagacatctcattatgtatatgcaaatgttccaaaatctacaaaaatctgaaatcagaaatactctggtcccaagcattttgaataagggatactcaacctgtagtaggaataaaatataccaccctcctccccatgtctgttggatgaataacaacttttattgatgatatactaaactttgtccttaagctgttctcctacaaaatatgggactcctttcagatagccagtctcagtacatagctgcaaaactttgcatgatgttgtttaaattgagaggctattttgatgtcatgagtgagtatcaggaaggcagaccatcacaagaattgggtcttttctgtgagcaagagacttagagaagtaagggacctttctgaaaagaagcacaacttgcccatgttcctctttcctgagtggacccaacaggcagtggttaatgtgagatacggtgtatagttttgtatttccagcaatgctgaaatctgaataaccaggaagctaaaaatgaagaaacaaatcataaatcaaagaacctttgatacttctccttccttccactggtcttcttccttggactcgtcctgcgtggaacatattccacacagcagacactatgatcctttgaaaatccatgacaaatcaaatcaatcaatcctctgaccaaccttcacctcctctcctccctgacttcccaattcacttaaaataaaacctcaagtctttgctggccctcatcccttctctgacatcatcttattctgtcactgatagatcaggcagatctggctctgttgacctctttgctgttagaagcaaggaacatgttctggctttggggctttgcatggatccattcctatttttggaatcctctttctcaaatagtgtttctcattcttgtcacttaagtctctgctcacatgctccctcatcctctgtgggatggcttcatccctcttcaaacatatatatcctcatgggaacactagcttcccaaaggcaggacccttgtctgatttgaccactgagttgatgaatttgtaagaagccaagtcaggctttgaaagcagattcctagcatccattgaaaggaggaattttgagggtagatgctagattagacaaaattcaaccttatctcccatatattttgcgtgtggtaacagtggtgtatgttccctacaatgccctggtagcattacaaagaaaaattgtttgggctttttcagaactatcacattttaaaaatatttgttgtcattttctttgttgtttttttttttttttttttttttttttttttttttgagacggagtcttgctctgtcacccaggctggagtgcagcggcatgatctcggcccaatgcagtctctgcctcctaggttcgagcgattctcctgcctcagcttcctgagtagctgggattacaggtgtgtgccaccatgcccagctaatttttgtatttttagtagagacggggttttaccatgttggccaggctggtcttgaactcttaaccttgtgatctgccctcctcggcctcccaaagtgtcaggattacaggcgtgagccaccgtgcctggcccattttcttttttaagatggaatcatgctctgccgcccaggctggggtgcagtggtgcgatcttctcagggctcactgcaacctccatctcctgagttcaagcaattctcttgtgtcagcctcctgagtacagcacctgccaccatgtcatttttttttttttttttttttagtagagatgaggttttaccatgtaggccaggctggtctcgaacccctgacctcaagtaacctgcctgtctcgtcctcccaaagtgctgggattacaggtgtgagccactgtgcctggccacatattgaacatttatgtgctcaaatcccaggagggtttctaattccttggttacttaataatgtcacaactaaatgaatgcttcagttatccagatttctctaagcccaggttatggtaaacagatttatttctatattgtgagtttgaatttcttttctaattatgagtgactcctctctcaaaggacatgcaaatctttttatcctgcctctgccccatcacctgggtccacaaaaaagcatctgtgtctacttctgaaaatgcaaattatttgaatgtgccagagtaagtaaaaaggaagtggtgcatgcatggtgtagtttgtaaatgtaagagtgacttgagacagatgagatcctttattgaaattaatagttaatgaattttcccaagagaaacaccatttagtagaggtgacaatggtagttaccgaaaaccctatttaaatcacgcttgccttaaaaaactaaaaaccaaaaaaccaaaaaaatcttgtctatttcatcttgtctggtttgcattatgttcattacctgattcttctttctaaaaggagagatacagttctgaaaatagttattgcctaaagggagaaaacaaattcttttcctggtattgcagttttgttatttgttttccaacaggttaaaggatttaattattcagatgctctagaactgttctctgcatattcttttgatcatacgccctatcaagcaggtactttttgagcagacacacccaatatataagtttacatatttacttataaattatgtacatgtactatggtgctgataatatatatacattattcagcatacactaaaatagagattaaaagaacacattaagtcagtgtgaatggaagttccaatattttcttcctacactctgtggctatgctggactctccctgggccatgctcactcagttcactctggggacccccttcaccccacccagcctagtccaggtcatgggattgcaggacctgaataaaaacacaccattagtactcatactctgcctagggaggctaagggaagaaaagtttgctaaaggtcctgaataaagctcatcgaactccaaattcttcacctttaaagagaacatgctacagtgcacagcctggcacctggggcagagtggtgatcaggaaggggaaattgatgttctcctcctatttctgctgctgttctgttactgcagctgttaactgctagttcataaatcttttatctaaaaattcacaattcagaaacttttgcaaatggaaaggattttgtttgtaagaatccttaccagggtttggtagcaaactctgacttggactcttgtgtaactatttctgttctatgtagtagttatatatcccattaagtttgaattgtgatatgtttgatgatgaaatactgtctccaaaccatttagggtattgtgtaatatatgatacactctctaaattcttaaatttctgaactccaaaaacaaacctggcccaaggttggtttaacctctgtgatgattatttctactttgaagcttgttgcccttttgttcaggttattgctgtatgatcatttggtgaaggatactgctttttgatggacatgatcgcttgtaaaggcttccccaggtctctactgtagggaagagtgcgcctgtcctgattcagtcatttgtaaactattgttattgtttggacaggaatagcagatggcttagtctcacccttgtgcactgaatgccctccacatcaccatgtaattgtcctttccagatcatacattgggtaaggaaccttctgatctctgccctgttcttaatctccttcaaccactttctcttcccctttggctgttcaccagtgaggtcatttgctttatctctggaatatatgaaaaggctccacctgtacctctcatgttgtcttctcacttctgttttctctacccaaggaaccttgagtgcctttcctggggattctggccacggaaacttctcctgttcctcaggggcaataagggtatgcgaaaattcctccccgactcaggatccagtgggcttgccatggtgcattcagaggctctgccatctctttagcattcctttccaggctgcagtctaccccctgagtccagcccactcaactttcttgttcagctttggcatcatctcatgattggagggtgcagccttcattgataggctggcattctttccagagtgacagtgccaactctcttcttctttctgccctctcgtcttctctcatgggccacagagtggttgggaatacaggttgtgggcagacagtaaatggggcttccaacaccatattaaggactttgaacttgtacaaagtttatctgcaggagccattaaaggtgattccatctctaccttgaaaagaccgttgctctggtggtgtaaatgagagattgtagaggagagaggtgagagaaggggagtagaggttcagagtacactctcagatatcctttatttcacttcagtttcaaaatgttaatttgactgtgtaaaccaaaaataaaattctaaggccctccaaccatctgaatgaacccctcttctcagccaacggcattccaacgttaacctgaaaaaatgagttcaggccatgatgggaggggacagccaggcatgcctcattataccctcctcccttttggaattactgaaagaacagtaatagaacagtgatagttctttaggtctggtaagaaacatttacaacctgttctctctgaagcctgctacctggaagcttcatcagcacgatgaaaccttggtgtccacaaccttttatcatgaccgagaccctcctttctattgatgattcttttaccaattgccagtcagaaaacttttaaatctacctgtgacctggaagctcccctgcctcctcaccacccacccctgcttcaagttgtcccacctttctggaccaaaccaatgtgtatctttcatgtattgattgatgtgtctcatgtctccctaaaatgtataaaaccaagttgtacccccaacccccttgggcacttgtcatcaggaccttctgaggctgtgtcataggtgcatctttaaccttggcaaaataaactttctaaattgattgagacctgtctgagacactttttgggttcacactaccacctgattggtaaaacagttggagtggatagcatgtggattctgtgttaggcagctgtgagtcttagtgacaactctaccatcaaaaaccaaccggtggccaggcaggctgtaatgtataaagtaggggcttttatgccttttagtaattcttgcaggatgcttctgagtattatataaattacgtctgtaacatgtgactgagtaccaggaatgtagtacctgttcagtaaaggttggtgtttagtttccctcacaccatgagatatttgcactgaggtctgaactttgaaaaccaggcatatgtagttgatgtttttgtattccagatagtgtcgcttttaattgacacaggtagtgttcattaggtcatgttaataaaagaaatagtttttttctaaccatgtattaagctatccaaaacccctgcttggctgatgtttatgctgattcagaatgaattcatgtcataatttaaaactcgtgaactgaagtgtttttcattgtacattggattgaagatctcacttaaaactgtgtggtctgtgtgaggttgtattactttattggttaggaaactatatttcaggactttgaaaaacattaatttcttgtatattgcaattaatctaattagacaaatatttaaatatttttggaaaactaatgttttatttccttcccttctaattattgtctttacacatcacagcagtataatctactgtagtcttttattcagggtaacttatctttaaataattaaaaaataaatttaaagagcttttagttggtcacctaaactattttattgttttaagtaccaataaatgaaactttataatagtcttattgcacagttattaaatataacatttcatgatgccttttaatatgtataatgtttgttaattgaacttcatttggaaagtgtttgaagattgtagttttaatttctgatgtgtgtgtttttcatagtccatcttttagcaatttataaagtgaactatttcttttggaagatgactaagacattgctgaaactatattggcctaggtccatttttcaaaatcatgatttgtaaatttactttgaaatttaactttaattgttaaagcaaatctaacagtgattgcaagatataggaaagtcatagctgcaatgtctatattttcgatttagtatacatttaaaatattgcttctcaaagcatattttagagggtatgtgttatattaatggtgaaataaatatatagggagttgggcatataactctctatggaaaaacctctatttctttctttttttttttgtgggggtgcgtggaggagacagagtcttgctctgttacctgggctggagtgcaatggagtgatctcggctcactgcaacctcagcctcctgggttcaagcaattcttgtgcctcagcctcctgagtagctgggattacagccacctaccacaatggccatgtaatttttatatttttagtagaggcagggttttgccatgttggccaggctggtctcgaactcctggcctcctgtgatccacccatctcagcttcccaaagtgccgggattacaggtgtgtgccactgcacctggccttatttcttctttgtagtagaaaatatactgcaggagtcattaaaggtgatttcatctctgctttgaacagatcactgctctggtggtataaatgagagattgtagaggagagaggttaaagaaggagagtcagactcatgactttatagtagaaaatagactcatgacttcatagtagaatatagactcgtgactttgtgtccataaacctgtttagtaagcagagaaggatgcattatccactttggttttcggctgaatagtgaatgggcattgtgtcttctgagagatacatacagctaagtctcattgttcacgatagttatgttctatcaagtcaaaacaaacactgaaatagcaaacactggaccattgcttgtaggggaaatacaaagttagcttcctttcagcctctggccacaatatttttgccaccctattaatagataatggtattgtgtatgtgtttctgtttaaggacatgtcatttaacacgtattgttgactcattaactctgaactcatagccaacagcattatgacttacgcccgaatgaagtttatctaaaacatgtgtcttctctgtaagacacatcacagccttctgtccttaggaacaccagacaacactacagctttatgctagggaaccattttaaacagtgaagtcaccaaccaaaagcacaaagagatgaaaaacacagcattaaatagaccacggaaagaagagttacagtttgagagctgaaacaagaaggcagacattgccttcttcagcctcctctgggaatatgcatgtagagtgattcacatttttttgcacgtgtctgtgaatgaccacaaaagtgctgtggggttataaagaaactttagcgagtataccagttcacaaatgagaatcatctgtagtcagactagagtaaatttttaaggctttcaaattgtcagctgaacagctaaaccctttcttccgaagagcttagtctggtagatatgagtagattcaaattctcctcctacctggaaggcctagtttctctctctggcactcctcttacttggtgctgacacttgaaacctcttagatgtccctcacttcttcttggtcacagtccctacttccacttgaacaagtgaatcacctttgcctcctccctaggaccctggttagcttacacattctgtcatatgtcctgaaatgggaagtgtcacagtgtagtgatgaagaaagtgggctctggtttcagatggcctaggattaaatcctgctctatcacttactgtttttgtgcccttgggcaggcggtcattgttttcccatctgtacaaggggtataataatattgtccacttgaggctgggcgcggtggctcatgtctgtaatcccagcactttgggaggccgaggcgggtggatcacgaggtcaggagatcgagaccatcctggctaacacagcgaaaccctgtctctactaaaaatacaaaaaaattagctgggcatggtggcgggcacctgtagtcccagctactcgggaggctgaggcaggagaatggcgtgaacccggaaggcagagcttgcagtgagccgagtttgcgccactgcactccagagcctgggcgacagagcgagactctgtctcaaaaaagaaaaaaaaattgtctacttgaaatgtcagtcattgataagataatatgtatttaaggtatttaatataggttggcacataagccctcaagtgtaaactattaactcactcagttacttatatgtaacttgtttttagccatcttaagaatttgattatgcacaccaacaaaaacaaaagaaggggaggaattagagtaaaggatactcatgtatgagaagatcaagctgaggtaatattagaacaaactaggaggtttggaagatataaactctcaatttggtcctgagttctgaccagtcccaataaggaaagcctgattctcactatcttttaaataaaggattttttttttcagggagcacacatctatttctggaactgaataattattttttccttgttatagggcactttgatgtgcgtatgcctgttgtgctgatttgtgatatgtttgtgtatacatgtgtgtctcattacactcagaatcttggagatttggcttcagtttacttaacttccatatccaggcctacctatgaggcaataactctgccaaggactcctgcttttgatgatgggattgccaggacacttgactctacaagaactctgcgtttgcccttcctctgattttatcatgagtcacttatactaactctaagtgcagaaaaaggcaacaggggttatatgaaaatggtaatggcagacagaggcagacgaagggactgagttcagtgtactttgtccaaggggtcacgtggacttggacattgtggctgggaccttaaagccaaggtctccatgcttttggttcatggcactctattattaaatatttcaaagtatatactccatgtgtatgcacttacttacttgtagattatatatacatagttcagagtttatataagatatacactactgtttgcattgagatattaaatagcttatataagatgtacaccactgtttgcgttgagatattaaaagaaggatgactgttctaaaagtagatcatagagatattgtgtaactcaataactttaataaatattattcagttgtacatttaaaatgggtaaattgtatattatataaattatcttaatgaagcctttttaaaaaggaagataaaatgaaggcaaaataaacagtatataaacatttgaaaacttagaaagtagaaggcttttgatctcacccaatttattaataattaaatccttattttttagcagaagcaatgtaattaaacatgtcatcaacatttttaatcatttcatttcagaaagctcacgctgggagtgtaattaccacaatttcagtattttcgtctgtgttttgactattgtcttcagtccatagttgctttgcaagattcttttttagtaagacaagatcacatctttaaatctctgtagctagctgtgctgtacacatacacgtgcatgcgtgtgcgcgcacacacacacacacgtgctctacagtctcaatatgcacacactggatgatcctgagagtgtgtggcctggggtctgtgttgctgcactgtgatcattacattcttgcatcagagcagctccaaatagcttgtgagtcactgatctatggattatgtgagggggccacagcctcttccatttcctggtgctgcattattcattagcacttttactatgtgaattgcatgcaaatatttttttgactcgtttgtatttttattattataattatttgtctgtctcctcctccaagatatatgcttcagaaggtcaggaactcagtctgttttgttcactgttgcattctcagcactttgactagctcttggcacaaattcttggctcaataaatattgccaaataagtaaatcaatttgtgtattaaattttagtaacaacacattttcctccattttaaaaatgaaaataaatacacgctgaagttcagatattttctccctgcccacactgaggtaccaacactcaattttggagaccattgctgtagttgggcggtaggtgaacagcagagaaggaaacgaagggtatcagaggcaaggcagagagcccatagagaatgtgtttcactgaaaggccagactcacttttctggcttttgacatttggatcagacccaccttacccgtcttgccatataaaaggaaagcaatgaagagttgagtcagaaaatgaagcagataaatgtaaaacttggttcagaacaatgtaaaacatttttgcaattttgtgcaacagggctgctggtgatgtttgagggacttggaagacatttaagagtggcactgtgacctgtgacctgtgacttgttcacattgactgggctggcgaagacaggaagtattcaagggaattgcacctattcagtttgttttgaagaactgctttgtaatgtaactgaaatccagttgattcagtttttgtgtttgctttttgaataatttacatacagtaaaatctatccttgttaggtagatggctgttggagtttgagagatacgtgcagtcttgtcaccactgccgcaatcataatgtaggtggtttctgtcacctcttcaaaagtttccctgtccctgttgcagtcaattccttccccttagcaagcattggtcttattgctatccatatagttttcccttttccagaatgtcattaagaatgatatcatacagtacgtttgctttttatgtacgaattctttcacttagaggaatttataagcgttatgctatgttgttttgtgtattagaagtacatttctttttgttggtgagtagtattccattatatggacacatcatatttaaaaaaaatccattcacgagttaatggaaagatggattttttaaagtttttgacaactttgaatagtttctttaaatgttcatgtgcaagtcttggtgtggagatctcttttaatttctcttaaactcctgtgagattgctggatcatataagaaactgtcacatttaattaaacaagaaatttatacttcaattatataagaaactttcaagctgttttccaaagtgtctgtgccagtttacattcttataatcaatgtatgagaattccgctttctcctcatcttcaccagcactttgcattgtcaggatttttggtttgtttggttttgtttgcctgcttgcttacttttagccattctaggaggcagttggtttagtttcaaatgtaatggcatgggtctggattactttccttttctttcttttttttttttttgagacagagtcttgctctgtcgcccaggctagagtgcagaggcgtgatcttggctcactgcaagctctgcctcctgggttcacgccattctcctgcctcagcctcccgagtagctgggactacaggtgcccgccaccacacctggctaattttttgcattttcagtagagatgaggttttcactgtgatagccaggatggtctcaatctcctgaccttgtgatgaacccgccttggcctcccaaagtgctgagattacaggtatgagccaccacgcccggcccaaattcattctttctttcttttttttttttttgagacagagtttcgctcttgtcacccaagctggagtgcattggcacaatctcggccactgcaacctccgcctcctgggttccagtgattctcctgcctcagcctcctgagtagttgggattacaggcgcctaccaccatacctggctaatttttttttttttttgtatttttagtagagacggggtttcaccacgttggccaggtttagtcttgaactcccgacctcaggtgatccacctgcctcggcctcccaaagtgctgggactacaggcatgagccaccgcgcctggccactttccttttcttctttttcaatctttattttgttgtccttctcgttttcttgggaaagtgtccccttcttgttttctcccttggctggcttcctttgtatagactatgtgattaacacctcattaaataccgtcagaacttctatttctgtatattcatagtatatgttccacactgccttgctatccatgaattcttaccagtagatcataaacttcttatggacaggttttgtgccactcttataagaactagtagatactcaggtaacatttctacattgacttttttttttttttttgaggagataagagtagagtcagctctgagatgactactttttaagtgattcttatttttaatctttttgtatattattggtagtttttaggacctaaggaaagcatgtttgccagatttccacttctgaatcagggatggattgatggaatactttaataacattatttttaaactattagcataagggttttttaattgctccaacaatgttagtgtcttcttcacttagcattatactattttaataatattgtttaaatgattagtataaggactttttaaattgctccaacaatgttcatttgtctttcacacttagcacttcgtgatatttataaagggcccattgaagtatctcgtgttgacacactgaggttggttagtttgggtttcaaattctgtcagttttcaagctctgttcaagttcacttttaagcatgaatcatgagttacacaaatcatatagatttattcttaaaatgttgattattttaagtcatctttttcagtaagtgccttataaagatttgggcagagtttcaaattcttctaatattcaggctttaggtgtaagaataattgatagaatttaggggtaagaataattgatagaataattgatgttttagacagataatagagtagatttgtctttacaactccagatatctggaatcatatgttttcaatgattgccttatgaagattattgaaaactgatatctcagtgttaattttcagtgtgtcttgtataagctctctcgtggacagagcagcttttataagggttaaatttatcaggctcccatatatgtgattagccattgctgtagacagttttctagtatttcatgttaggaaatactcaacaaatacattttaatataaccaaggttctgaagaagaccttacctctgaatattttccacagagcctattatattcccgagttcacagaaagttgttttattacttcaaggactctctgggctcaactctgtagctaaagaatgttatgttattctctgggcttggtaattgtgttccaactctgatatttagccgtgatactgttgtttcagagtttgaagtaagggaagatacctctaaaaaaaaggttcaactctaaagcgtttcacttatccatctatattgtaacattttttttccagttgtcccttttctccaagcagaataaaataacagaagcagggcacagtggtgagggtattcaggcaccatgcttgtggttccagctagtggacgttatgttcctgttggggacttttgaaatgtatatgatggtttttctggtcacactgacagggacattgctgacacataggagatggggactatgatagctgccatcttacagtgtacagaacagacccatatgtcaaagaatgtttccaccccaagtgccagaagtaccccctgttgagcaacactgagatagagaggcttcaatttcgggcactgtgagcttgaacagtttgcatttgcttcatctgtaaagttggaggtaaaattacctattgtataagatcattttaaggatttctgatgatgtatgtaaagcagtgaacacaggaccagatgcttagtaggaactagtagaggaattgtttgacgccatttttaacctttagtggtttcccagcccactcacagtaaaagctgatgtccacagactggcctacatggacctgtccaatgcgatctcctgctcccctttgaggtcatctcctggtggtccccctctctggctctcttccaaccacactggcctccttgctctttctccatctccccaggtgggctgcctaccccctatccccctctcctggccttctgcacttgctctttctgctatgtgagaggctctttggctacatgtatccccctggtgttctcccacactttcttccacattctgcttacctcatctaaggggtgttttcctgatgcatgatagaaaaatagatgcttggctgtccacagccaccctttgtttccactcggttgtttctcttccctttaccatcacagacagacagaaattattgtctgtctcttccaagtagtacataactttcatgtaagcaagtactctgccttgttcactgatatatccctagtggctggaatatcccatcgttacttaggtgtcaatatgtgtatcagatgactggattagtattttaaaacagcaatggcaaagaagttgtaattgactggtaacacttggttgtattaccagtcaatcacaacagtgttaccagtcagttacaacagtacttcatatgctatttgtgtgtatgtatgtgagacgagagtgtgtgtgcataaaaaagttatcctttctactagttacatagatttaaatccagatgatggaattaataatttacaggaaactccccatctaaacaattttgataagctttgcaagatataccacacattaggttgtccaaaaattggatttctctactcactgctcttccaattatattattctctcatctcttttaattgaaggaagcatgatacttgtattcttacatgagactaccttaagggcataatgatgtgattatatttgggtatatgttttgaaattggttgcaaatctctagaggttatcagtaaaactacttgtagcatgttagaattagtgagttttcctgtctgcttggaggaggtgtaattgctctttggatagacaataggtgtttgctgtttctgttaatatgggtaggagctggggacatgctttgaatgattatgttatgaaagaaactactggcttgatgttttagaagcaagagaaagataaatggtataatatacttatttgaaagataggtatttgaatttaaattttctttcttgctctttggtagatgtgatgatttctttaaaatattttgctttgtttctgaaaaatttgtctggattttatggcttaaaaatatgcaccatttgtgaaacatattctttttcacaccagaaatggctttggaacatatgcataaagtttctgttgttctaaattagtgtttcttttgggctaacctttcaattacatttaccatcctaaaataacttctttacctaagttggacaagattttgtactggaaattaatacctttgcctcctactatccttattccggtgatgttctaaagatagttcaggtgttctgtttctgcaggtaattattagacaaggaaacctttaaatgtggtgataatgttaggcaggacctttgaagtttaatggttgtgttctaatgtaggaactgtttaagagatccatctgtgtggtttaatctagggccaataaactcaattatgtgaagaagtgaattgccttctcttatatttgtatgtaatggctaagacaattttttttattggatggtgcttaatttcaaaacttgggtctatacctggatggcagataataactattcttctaaggtgatcaaggaagtgtgtgtgggtgtgcatgcattgggagatgaggggtagcagtccaatcaatgagtaattactgattgaacactgtagccagagaagcacgtgcgtttagcgtgagtgttgcgtctgtctacctctgtgatccagcctcttctgctcgaccttcagcccaattttttttttagttatctaatctgttactttcatttccttctttcccactctcttctgaacctactttaggcagattttcttctccattctcccatcaaaacaatgcatatcaagattgtcagtaatcttcatttcactaaatggatacattcaagattattgttactggatctccaaacagcacttgagactgttgaccacttcctctataaaacacccttcctttggcttttcggttttgggttctatttgtcataagataacaccatatttttttttcccctctctggctatgtctttctagtttcctttgcaagtttatgctgctctaagaaaccactaagtgttggagttctttaaggctaatcgtcatagtataaggcttttatattttcttggcaatgtcatccattaccatgcctccaattgtcatctgaattgccaatctcttcaacatctttctctagatgtgccctctctctttgcttcacaatcatgtgtccagctgccaatgtggcttttccagctggacttgtgaaacacaacaaagtcaagactgatctcaggctatcccttgaaaacctgtacttctcagcgaattaccctagaactctctagtagggctggactcaatagtgacataccgtctctcatcccctttagtgagtgccgttaatgcagcaacattgctttctcaatacctgttgtctttactgatagaacaagaagatgaacaaatcaaaagcacatagatctaaacaacacagccaaacacctttcactaaatggcatatatagaacccagcaactgcagaattaaccatgtgctgggccacaaagggagcctctaatttcagaggactgaaaacatactgatttgctttctgacttaatcctcagcaattaggctagaagtcagttacacaaacataactagacaatccccatatagaaattaagcactatatttctaaaatccaatatgtcatagaataagatagaaatcaggaaatatataggagccagagagtcaccatgaagttcaatcgcttggtgacctgggaccacagcaaaaactgcaaacgtcacttcaatgccccctcgcaggtatgcaggaaggtcatgtcgtccctgctctccaaagagctgagcagaaatacaatgtctgctccatgcccatctgcaaggaccacgaggtccaggtggtttgaggacactacagaggttaacaaattggcaagtagtcaagttgtacagaaagaaagtcaaggtgtatccatcatttcccaatgcatgcacacccacacacacttccttgtgtcccttattcagaaagaaatatgtcctctacattgagcaggtgcagtgtgagagggccaacggcaccaccatccctgtgggccttcacttgagcaaggtggctctcaccaggccaaaactggacaaggatcagaaaaaattcttgaatgcaaagccaagtcttgacaagttggaaaagagacaggcaaatataaggaagaacttattgagaaaatgcaggaatgaatataacttgttgtgcaaccatggtttaactggagatttttggcctagcatgtgtttctttggagcttatcaaaatgtctctggaatatttcatttcctattttgttaccactggttcagtgaatctacttttggaattttgattaataattttatgagtgaaaatgggaaatgctctaaaaaaaaagaaatcaggaaatatactgaactgaatggtaatgaaaatgtgacatattacaacttgtggaatgcaactaattcagtgcttagagggaaatttataacatcaaatgcataaacaagcaaaaggtatggtctgaaaatcaatatctaattttcaatgtcaatagtttagaaaaagaatagtaaatgaaacccaaagggtataggtgtagcaaaaaggaaatagtcaaaaaccaaaattaataaataaaatcaacagaggaaaaattaattttagaaggtattaataaacttgcaggattgttcagaaaaaaagcatattaccaatatgagcaataaaaagggttatttttaaactaaacatgatatagaaatgaaaagcataggatattatgaataactctagtccaataagctaaatactttaacatggacaaactcccccctccccacaacagcaaacataacaaaactgacaaaagaggaagtagaaattatgaatgaattgatgtctattaaataatttaaatttattattaaaaatcttcacatatatacacatgcatgccagagagctttactgatgcatccttttaaaaaatgccaccaattttacacaaactttctaagaaaatggtaaaggaagtcatgctttccaactctatggtttctaccaaaacatcacaggaatagaaaattatgactacactctttcatgaacataggtgtaaaaatcctaagacacttagcaagtagaacttagtctgatatataaaagtgttatcccagtggaatttatttcagcagtgaaaggatgagtaaatacttgcagatcagtatagtttctcacattaacagaaaaggaggaaatcatatgatcgctttgaaggttgcagaagaagcaattacagtgaatgctacttacaatagaaatttttatcaaactagaaatagaagagaattttcttaacttgatgagtatttatcttagaaagtctacagaaaacataattaaatgatgaaatttttaagattcttttgagagtgtttacaactgaagggtgccccttatcatttctattaaataacagaataaacaagtcataaggattaggaaaaaatataaaactagtattagtcacaggtgatcaggttgtacagatacaaaatctgaaaatagttaccaaaaatgtgttagaaggaataacagaaatcatcaagatcagtatttacaggtaaattttacttttatatgctagtaataaagaaaaattaaaaatgtctatactgaaaatttcaaaagataattgagataaattttaaagtgaattaaagattctgttttccatatctttacattttctccactgtctttttctattgcatcatctatttgtgcatctgtagaccacaaaatcaatttcgtatttattgcaactcactgataatcttgattatatcttgcctgttctggaccctttacatttcagaaacatggaacctttgttaaatcttaaatcaacttaaatcaatttaacctttcttaaatcaacttgtaagaaagataagagcaggtgataataaaatagaaaaaacatagatgaaaaagattgccaagatttagcaaacaagaaatgatattctgttttataagcatttttttttttttttttttgagagatggagtctcgctctgtttcccaggctggagtgtagtggcgcggatcttggctcactgcaacctctgcctccctggttcaagcaattctcctgcctcagcctcctgagtagctgggacaggcacttgccaccatgcccagctaatttttgtatttttagtagagatgggatttcaccgtgttagccaggatggtcttgatctcctgaccttgtgatccgcccgccttggcctcccaaagtgctgggattacaggtgtgagccaccgtgcctggcctttataagtgtttttaaagaaacaactttggcttcattaattctttgtattctatgccagaaaaaataatactaaaaataatagggacatattcataaacaggacagagattaaaacagcaatataatgaaattttatgttggtatgtttacagtcctagataaaaatctatacttttctaaaaaatatggaacttattaaactaatacaagatgtaaaaaacctaaatgagtttaaaaccaatgaaaaattcaattcaatcaccagttaaataactattttcaagaaaacctttatgcacaggcaattttataggtaagttctagcaattaagtaagaaattccactcttacactaagtctttctttgctgaaagtagtataacacatgactcaacctaaacaaagaacaaaggaaaaattacaggttgatattacatgtaaactagtatggacaaataataatatgttcgtaatctgaattcagcaatggtatttttaaaatattacaatgcaaataagaaatatttggttatatctcagaatgaaaaagatagtttaacattagaatatcaatgtaatttactacattaacagataaaaggagaaaagaaacatgattacttaaacagatgcaggaaaaaaatcttttggcaaaattcagcacttgtccatcttaagagctgttagtaaactaacccaaaaaaaaaaaaaaaagagatatgttcttagcctaaaatgtcttaaggaatattacgaggatggttaatatcacaactactgttacgtattgagttggaagcccaaaaaaaaaaaaaaaaaaattaagtgacttgaaaaagatgacacaaaactgtcctcatttgaaaataatttgcttgtctacatagaaaatcatagataattagagtttacagacacattattggagtgaaaaatgatttcaagaagatggttggaattagaatccacatataaaagtcaattgcttttctacatactatcagctcatgaggaaattataatacaatactaataactacaaaattatgagatacctaggaattaatttatcaaaatatgggcaagatgcctagtaggaaaatttaaaaatataactaactgctcattgaagactgaagttatatagataccattgatctagtgatcatgctttttaatatttacccaaatgagttgaaaacttaggtccacacgaaatcctgcacatggatgtttctagcagctttatttataattgtcagaaagtggaagcagcccagaggttcttcagtagtcaaatggataaactatggcacatctagacaatagaatattattcagagataaaaagaaatgttatcaagctatgaaaaggcatggaggaaccttaaatacatattcatgagtgaagtaagttagtctgaaaaggctatgtaatatgtgattccagctctttgacattctgggaaggacagaactatagagactataatgcaatcactggctaccagaggttcagggggaggtaagagagggatgaatggacaaagcaggggattttttatgacgtacagaaactactctgtataatactgtaagggtaaatacaggacattatatgtttgtcaaagcccatagaactgtacaacacaaaaagccaaccttaatttacactatagatttagttgttaatcatgtgtaaatattggttcaacaattgtattataacaaatgtatcacactaatacaagatgtaaataaaagcgaagaaatgtatgttaaaaaggatggacagaggtagtatatagcagaggaaatctctatactttctacacgatgtctttgtaaatctaaaactgctctaaacatagttcattacaaaaaaagatataaaaagtatattcatggcttgggagatgaaaatatcatgaagctgtcaaatgccctaatattaatttgtaaattaattgccaatcagaatgtcttctgcttttattcggaggtacagatacccagacaaatggattctaaaatttgaatagaagagcaaagaaaataggaaccaatttgaaggactacaaggtggactgcttgctcagctcagtatcaacacttatggtaaacctatagcaattaattattatacggtattgacacaggtatagataaccaggtatagtcctcacctatggaaactctgtacctgatagggatggcatagcaaatcattaagggctggggttggtctttgcagtaaagggtgctttacaattagattatccaaatggataaacaaagaaatatcacccccatctaaaaccattaacaattcaggatagagtaaatgactggttgtgaaactttagagctttcctagaaaaacatatgataatatatttatgaccttgaggatttgatttgatttgatttttatttttcaactgttattttagtttcagggaggtacatgtacagatttgttccatgagtaaattgcatgtcactggggtttgatgtactaatggtttcaggcagtgagcgtagtacctaacaggtagttttttttgaaaatccctctctccctctaccctcaagtaggccgtggtgtctgtcattcccttccttgtgtctatatgtactcagtgtttagctcctatttataagggagaacacgtagtatttggtttcctgttcctttattaattcacttaggataatggcctacagctccctccactattattgaatagggagtcctttctccattgcttgttattgtcgaagtttgttgaagatcagcagggttatataacctgttccattggtctgtgtgtctgtttttgtaccaataccatcctgttacagttgctatagccttgcagtatagtttgaagttgagtggtgtgatacctctggctttgttctttttgcttagaattgctttggttatttggtctcttttttggtttcataggaattttagaatagttttttttctaaatctgtgaaaaatgagtggtagttaataggaatagcattgaatctgtaaattgctttgggcagtgtgatcatttttaacaatagtgattcctccaattcaagagcatggaatgcttttccatttgtttgtgtcatctctgacttcttttagcagtgttttgtaattcttgttgtagacatctttcacctccctggttagttcattcctaggtattttcttctttttgtggttattgtgaatgggattgtgttcttgatttggcactcaacttatacattactgatttatagaaatgttactgattttttttttacttgattttgtatcctgaaaatttacttgtttatcaattctaggaggctttgagcagggactatggggttttctaggtaaagaattgtatagtctttgaagagagatagtttgacttcctctcttcctatttggatgccttttatttctttctcttgctttattgttatgactaggacttccagtactatgctgaataggagtggtgagagtgggcatctttgccttgttctggttctcaaggagaatgcttccaggttttgcctgttcactatgatgctggctgtgggtttgctgctctctttttatttattatgttcctttgatgcctagtttgttgagggtttttaacatgaaggattttggattttatcaaaagccttttctgcatctattcagataatcatgtggtttttgcttttagttctatttatgcgatgaatcacatttattgatttgcatactttgaaccaagcttgcatcccagaaatagtactatatcatggtggcttagctttttgatgtgctgctggattcagtttgcttgtattttgctgggaatttttacacccgtgttcttgacctgaagcttttgttgttgttgtgtctgtgccaggtattgatatcagaatgatgctagcctcacagaatgagttagggaggaatcactcctccttgattttttaaaaataatttcaataggattggtaccagcccttccttatgcatctggtagtatttggctgtaagtttttctattccagggcttttcctttttcgtaggtttttaaattttttttattttttattagtgattcaatttcagaactcactgttggtcagatcagaatttcaatttcttcttggttcaatcttgggaggctgtatgtttccatttatccatttcttatatgttttctagtttgtgtgcataaaggcatccattagtctcgagggttttttttttttttaatttctgtggggtcgtgggtaacgtctgctttgttgtttctgattgtgttgatttggatcttctcttttttttttcttcattagtctcactaccaatcttattctttcaaataacaacttttggtttcattgaccttttgtatgggtttttgtgtctcaatttgattcagttcaactccaacttttgttatttttcttctgctaacattgggtttgatttgctcatttttccagttcctctaagtgtgatgttagattgttaatttgagatctttctaacttcttgatgtaggcatttagcattacacactttcatcttaaactccaactgtgtcccagagattctgatatgttgtgtcttggttttcattagtttcaaagaatttcttgatttctgccttaatttcattatttacccaaaaatcatttaagagcaggttgtttaatttccatgttattgtgtggttttgagaggtcttttttgttttcgtttttgtttttattgagagtgtggttagtatatattttttaacttgttgagaattgctttatggccaaacatatgatggatcttagggtatgtgccacatgcagatgagaatgtatattctgttactgttggttggagtattctgtagaagtctgttaggtccatttggtcaagtgttgagtttaggtctcaaatatctttcttagtttggaatactaacaaagtttgacctaacagtgtcagtggtttgaagtctccccctagtattgtgtggatatctaattctaggcctttacaagcttgttttatgaatctggctgctccagtgttgggtacatataaatttaggatagttgattcttcttgttgaattgaactctttatcattatggaatgtccttctttgtccttcttgattattgttagtgcactctgttttgtctggaaaaaaataggaacccctgcttcttttgttttctatttgcttaatagatctttctcaatccctttactttgaagctatagatgttgtggcagttgagatgggtctcttgaagacaacatgcagttgggtctttcttctttatccaacttgccactctgggtcttttaagtggggtatttagcttatttacattcaaggttaatattgatatatacaggtttgatcttgttgttgtgatgttcactgtttgttatatagtcttgactgtgcagttgttttatagtgtcagtgtgctatgtacttcagtatatttttttgatggccagtaacagtctttcatttccatgtttagcattcccataaggacctcttataaggctggtctagtggtaacatattcccctagcatttcttgtctgaaaaggattttatatctccttcagttttgaagcttagtttggctggatatgacattcttggttggaattatttttttttcatatactgaatataggcccgcaattatttctactgaaaggcccatctttgcctgatgggattccctttgtatatgacctgccccttctctctagctgcctttaagaatttttcttttgcaatgatttcaaagaatctgaagactctataccttggtgaaagtcatcttgtatagtatcttgcaggggttctatgaatttcctgagtttgcaggttgacctctttagtgaggtctgggaattttcatggataatattcttatatcctcaaatatgttttcccagttgctttctaactctgtgtctttcaggaatgccagtgagtgataggtgtagtcttctacataatcccatatttctttgaggttttgtttattttttaaaattctcttttctttatctttgtctgcctgcgttgattcaaataagttgtttttgaattctgagattcttttctcagctttctctcttctgttagtaatgcttccaattgcaatccaatttctgtcatgagtgattcatttccagaagttcagttgattcttttgtaaaatgattatgacatctttcagctcctgggccgttttactgttttccttggattgaatttcagccttctcctatatcttgacgagtgagcttccttgctgtctggattctgaattctatgtctgtcatttcagccattttagtctggttaagcatcattgctggagagctagtgtggtcatttggaggtcagaagatactctggcttttagagttgccagagatcttgcactagttctttctcatctgtatgggctgatgttcctttaatcttttaagtcactgtctttttgatggggctttttgcttttatactctttgatccccttgagggtttgactgtagtgcaaattaggtttagccaactggcttcatttttggatgctttcagggaggcaaggctcagtttagcactcctggcctgcatgcccttatcattgggggctggaaacaggccagcagcttggttctctggcccctcaaggttaagcacctgctgtgctggaggagctgaagtgttcacagtcccctagcagcaacactctgatgggggctgccaataaaagtgatccagtggggcggtggtgtgtcgttatatgtgtgtgcactggtgaggcagtgggaggaggctgtgggtgggtgcaccaggcagaagaaggctgtgggtgggtgcacaccggcagaggtctttctgcaaaagtactctgacaggtaggtggggtctgctgttgaaaaacctatggcagtggctgcttgtaaatgctttggctgggcagctgaggctgcgctgtaagttgtgtggccaggcagggaccctgggagaggccagcagacaggtggaacactcagatcagattgttcctgtcccatagcaagacatccttgctctgtcggggtccagcagctaacaaaggctaatgctgcctagaggagtatgccaagccttggggggtgggctttcatggccatgctccatggcagatagtcccatgccaaccccccttggctttgcacaggctggagttctgtctctgctaactatctgggaagatctccctgccaccttaaatatctgggggggttgtgggatatcctgcagctgggatctcaaaggtctatggtgaaagtggaccactccatgcctatttcattcacccctttcctaggagctgtttggggccaggaatgagtcttactgcttggcaaccccatgtagagttcccagcttcttacctttcagcctggggtctacatcctccctctgtcccctctcaataccttctttctgaagatctgttcagaatatgccagtctaattgatagtcttgtctctcttagtggcagaagctattcctggctgcatttagttggccatcttggctggtccccaccttgagtattttaaaaccatatgcattgcacatattccaaccccaaaacacaatacattaaaaaattgatacattgaactcaccaaattttctttttaaatgactcttggcaccatataaagttttttaaaaagctacttattagatcccctttcgtcatttcagattggcaaatatatagcttgcaattataggtgcaggcaaggatgttgcacaatgggaactcattaactgcatcaggaatataaattaatatacctactttggagaatagtttggcaatacctagctagtcaagtttaaaatatatgcgacctacaaaccaataattctactctgaggtatggtgtttctcaatgggaccttattggtaatttggacaggataagtctctcttgtggaatattttgtatatccctaatttgcacacactatgagttatgttccctaccatggccattttaacaaccaaatattcttcacccattactaatcacttctaactggaagtttatacttggctgaaaaacagagagagaaactgacgtgtacatcagaagacaagtctaagtatcttctttaaatccttttgtagtggtataatagagttaagcatcttaagtaaccatctgtggaacattaatcaatatattatagatctttccataatgcaatcctatacaactcttaaaatggctttaatgaagctacatttatcattgtgggtaaaattcgtgaaggtaatgctgattgaaaagcatgtagtcatgtacgacttatgtaaagtttattaaaaatatgtttatatatccctaaataatatataatagaatatgtggatgaaataaattcagttttaggacagtggtttcgtctgctagggaatggtgggaaagtcttcacagagatgttcataggcagtgtgattgcacagaagtgcatatgagaatgcatagccagtgctaagaatctttggagcttattggcccagggatctgaaaatgattatgggctgaggtatatgaaaaatagcagggttagaacactaaaaggcctttacaactatttaggataaaaaagtttttaaaaagattaggtaagatctcagttaaggcaggtagtatagtgttgaagcccactttgtatttttgttgaaattttaaaattttgattaatatttcagggttcaggtctctaagaccactctcagctttggtaattctctaggaggactcaacctttcctcctacagctatgatttaccacaggaatagcagggaaaaaataatagtggcaaagagaaaagtggatgagaaaatctggaagaacccaggcataaacttccaagagttctctctctgtggagtcacacaggacatgtttaattcctgcatcagtgagtttgacaacatgtgtgaaatgttttccaccagggaagttccttagggagctttttattgggagctggtcacaaaggcacctctacctaacatgtgctcaaattctagactctcagaaggaaggcagataattagtataaaccaagttgtttgcatacagtttgtgcatagtgacccactcttatcacttagcgtggtggggaatctcccaaaatccaagttactgatgccaggtaagggccaaccttgcaggcagacctttaaaaacatagcaacctcagactagctaattatgctttgcttcacaatttatttttttttgttgaatggtacattaacttcgttagggttcacttaaaagtcacttacacattttattgaattcattctggtcatttcagggcaagatagtaactgtaaatatctcatcagagattggaattaaagtggatgtgtaagtgtctgaatgtttccgaaaccctagctccttcctccctttccttttctccaaacttctccaagcacactatatgaatttggaatgactgaaaaagaggtaagcagttctagggtcttttcaaatgactgagatttctaggggtcataccctgtcccacttctagtcattaaccagagaagataggatcttacttctctattaatgcattatgtttccttccaagaacatggatggtggggctgaaaatttcatccggttcttttagttgatcttaattttgaaggggtttctgtccacgtggtataattttaaatagtatgtctagtatatgaaatgattctccacctgtaattagattacacatttagtaaaaagttgaaatggtagatagggaatctgtgttttggaagaaaagagccaaatttatcttaaaagcagggaaatggtttgtttatcctctggaaatgatctagagagagctttttatgaaggataatctcctttagaaaagaggagagatttgtttttgccgcaagcataattaaatgcaccaaggtatataaattcttttcccagttctattaaagtgcagaataatctgtctatataattacatttgcctttatctttatcataaggtaggcatacaccatcagattttttactattattgaccctatttttgttattctttttccctcatgttaaaatgacgtgatatgaaatttcctttcgactggtaagaaaaacaaatcttgatggttaattaaaaaaatatccagtaatgacacattctgactagtgactgcttgctagtctgttatttggattgatactagattgtgaaagccagacctttttgtcccatttatattaaaaaagaagtttgagaaacaatccgagtcagtgttactgaatagctctaaaatgctctgtaaaattatgctgttccattctgagaacctctttcctaccttgcggttcttattcaggtaacattgcagtatgagctcaatcagagatttgggggctggtattaaaaaggtttgttttctttttctgcttggccagttgctagaggccagctggggaggatgtctggcttaaaaccataataaatgaagcttccattaggctcctcggcttggggccatttcctgtaaagaccttgctctgccgttagtggtttggagagggaaaatgcatatttttgttcaataaatgaaagctgaagattaccaggtagggtagcataggtatcatgttttgtgaagagatcctgctcttcaagggtcacattttagcttatagccttttgagtgtttatgacaataacctatgaacttgagtcatggtagaaaatggaacaaatatgtttatttttaaatatccttcgagaggaagcaaacaatataatattcagatagttgaatttgtctcagcagcctttccaaacctgactcttagatttattatttctttaagttttgctttgtctggaaaatacattgttcattggagaagtaacattttcaggcacaaaagagaccaagcgtacattacgtactttaagagcactttttttttttctggacacatctttttatgtttatatgtttgtaattctttatacatggttgtttattttgttgttttattctgtattttatgctgttgttgcttattctggaaaatatattgttctgggaaatacgctgtttattggagaagtgacattttcaggtacaaaagagtccaggggtgtattagctttatacaccttaaggatccttattttctctgggcatatctttttgtgtttatatgtttataattttctgcacgtggttgtgtactactcacatacttggagaaactatggtcagcgtgctttgcaaaacttaaatgagttccggttctgaataagttagaataaaaacacttcaacgtttctcttccactgaacacaaatatgaaatatatggtaaagctagttgaagtctcagaaaagtaaagctacagcttcgacaaacaggaaagccattctcctcattcatcagattggctcctgcagtttcccagtgccaactgctgactgtctctatccatagatcccctggagctgggtcatgacaaaactggaccaattatccagcgtgaatttaatgcagtcccagatccagatgttagcagtggatctcagaaggaaagagaaagagatgacctctagctgtggcccaaggagaaaagggaagtcctgaagctaagagggagggggaaatcccctaccttgtgtgcctcctttatctcacttttgtcatgccccggctccccaacagtcttgtggtggaggcagtggcagcaaaagcagctggtggtaggaaactgcagaagcaaaaataatgggttagggaggggcatatgctttctattcggtaaaatagagctatttggtagctcttagtggtgccaattgggttttttaatttgttttgttttttaaatctctctgtgtcttccccacaaccctggtatgatcatagatgtaggttgttcccgattgttgaatgaaaaagggtgagttctaggatgccagaaagtatcacaggagacagctgagaaggaagggcttgggaaatgatcaaatacattgtggactcatggactcatccatagcctgaacatacatggatctgatccttattagcgtaccaatgactttgagaatggagttaatgggtggaactccactcaagtcccagactgaccttacgtcctatacaagcagggcatatctaaatgaacctgcatagctattgaaaactaaactgataattggaaccatagccaacagaaggtgggctgcaatttatggctagaagctaaccagatcaagtgcttcctaaaacaatgatatcagcatctttgtagacttaaataaagcagagagttttataacattcaaaatgtccaaggtataatttatattggtttatgaagaaatgtaaaaatgttaactcacatgggaaaaggcaattaacagatgaaaatgaaaatatgactttaaaggagctattgtagaatgctcaaatgaataatcatgagtcttgaaataaaagatagaaactataagcgaggaaagatgtgaagtggcaccaatggaaaccagaactgaaaaatacaatagctgcctgccccacccattctccacccataaaaaacaaacctcactatatggattcaatagcagactggggatgacagaggaaagagtcagtaaaactgaagataaatcaataaaggttatccaatctgaagaaagaagaagattgaaaaataatagagtctccgggattatagaacaatcacaaaaggctaatatttgtatcactggagtgccagaaggaaaggagaaagtgagtaagcctcaacaagtattcaaagaaatgatggctgaaacattgatagattcaagaagctaagctaaccccaaataggatgaatccaaataaacacacacccaggcacatcataaactgctaaaaacttaaaaaaatattgaagtcagtcagagcaatgataactgatatatggaagaacaatgattcaaatggctgagatttctcatcagaaatcatggaggccaggagaaaatggcacatccgtttttcaagtgttgaaagaaaagtatagaattcaatatctagctaaaatatccttcagaaatgaaggtgaaaaatatattctcagattgggaaaaactaagagaatttggaggcagcagacctgacacaaaataacaagaaggccttcttaaacagatgagaaatggtacaagaaggaaatatggaatatcaaaatcaaggaaatgcaagtgaaaaatacaatagcctttctattttaattgaatagactatcttaaaatttaatagaccatttattttctcttgaaattaagtatggcttatggttgaaatcaaaagttaaacatggtctgatacaaattttcactgtatttagatgtaatatataagacaacttatgtattattatattatgggagaagagacctatacgctggtatggtagacaggataatctcccttccctaaccccagatacccacatccttatcccaggatcctgtgaatatgttacattatgtggcacaaaggacttgtagatgggatctaacagactttaagatagaataacctttgttttcctggtgggcccaatcaagtaacatgagcccttaaaagtggaagaggaaaacaaaatagtgggatgcatcaatgagagagacttaactcactgtttctggctttgaagatggagaaaggggtcagggaatgtgggcggcctctaaaagctaagatcagtccttagctgactgatcagctaaacatggctgttgatgaaaattttaaaaaatggaattttgctaaggctgagaaagataaagaaatggattctcaactagagcctccaaaaaaaaaaaatgcattcttgtcagcgctttgatttcagcctgacaagacccatctcagactttctcagaactgaaaagtaataaatttatctttttaagccactaattttttcattatttgttatgggagcaatacaaaacaaatgcaggtgatctggtttctctgttccaattgaagtggtaaaatattaattctaaataaaatgtggaaagttaactatacataccgtaacccctagaataatcactgaaagtttatacagagatatagtcaaaatcataactgataaattaaaatggaacactataacctcaacaaatgaagaagggcgggaacagaaaaaatgaaaaacagaacaagaaggaaatgataaaatggcagacctaaatccagacctatcaagtactatgttaaatataaatggtctaaacaaaccaactaaaagctagagattgtcagactggatttaaaaaaatgtcctagctatgggctttccataagaaactcacttcaaatatattgttattgtaagctgaaaagcagaaaggatggagggaaataaaacccacacaaacacaaaccaaaagtaaattagcatggctatgttaaaatcaaacaagataggcttcagagctagaaaatcatcagggttaaagacagacattacatattgattgaagggttagttcgggaagaagctataacaatcataaatgtgtgtgcaataacagagcttcaaaatacagaagcaaaaactgatgtaactgaaaggagaagtagagaaattcacaactatagttgaaaaattactcctgtctcagtaatagaagatcagcaaggacatagaagaactgaactatcaaccaactgaatctaatggacatttatacaatactccactcaaccatagtagcatatacagtcttttcaaatgcatatgggacatttaccaagacagtccacattgggggtcataagtcaaaccttaacaaatttaaaagaaagtcataaagagaatgacttctggtcataactgagttaaactggaaattaataaaaagatagatagaaaaatcttcagatacttagaaattaccaatatacttttgaataaaccatgacctaaagagaaagtttcaagaaaaataaaaaataatgaaagtgaggccgggtgtggtggctcacacctgtaatcccagtgctttgggaggccgaggtgggtggatcacttgaggtcaggagttcaagaccagcctgaccaacatgatgaaaccctgtctctgctaaaaatacaaaattgccgagagtggtggcatatgcctgtaatcccagctatctgggaggctgtggcaggagaattgcttgaaccggggaggtggaggttgcagtgagctgagatcgtgccactgcactccagcctgggctacaagagcgaaactctgtctcaaaaaagaaaaaaaaaaaagtgaaaataaaacataattttacataagacatgacccaaagaggaagtttcaagataaattagaaaatattttaaacaggaaaaaaatgaaaatgacatttcacatcttgtggcatgcagctaatatgtagccttaaaccttatttttaaaatgaagaaaatgctcaaagccataatctaggccagtggttggcaaactttctctctatgtttggacagtaaatattttaggctttctgggccatatggtatctgccacaactattaaactctaccattgggcaaaagcagtcatcgccaatatgtaaacacattagtgtggctacattcaatgaaactttatgtataaaaacaggtagttgtattgatttggcctgtagattaccaccctctgatttagccaccaccttaagaaaataaaaaaagtaagaccaaattaaacctaaatcaagaagagagaaataaatcataaagacaagagtagaaatgtatgatactgaaatagtaaaacaatgaaaattaaaaacccaaatctggttctttgaaaaataatccataaaattgataaacctctagcactatacttactggagaaagattggatgctttctaagactgagggggaaaaaaaagaatatgcattctcactaatactattcactatcttatttgaagtcttagtccaataaggcaagaaaaagaaaaggcatagcatatggagaggaagaaataaaaatacccaacgtgattttctatgaagaagacctaaaggaatataataaaagcaatacgtaaatgtaggaagttacaggatacaaagccaatataaaaaaattcaattgtatatgtttatgctgaaaatacacaattggaaacaaaaatgaaaagccatttacaatagcttcaacaaaaatgaaatacaaatcaacctaataaaacatgtactgggtatgtgagctaaaactggagaatgctgatgaaagaaatgaaggaagacctagataaatgaagagacctgccatgtgcttgtattggagactaaacatagtaaatatgtcagcactctccaaactgctctatttattgaaaacaataccaatcaaaatgttgcagtatctttttaatcgagagtaactcattctaaaatttatatagaaatacaaaaatctggaatagctaaacaaatttggagaggtcacactacccaattaaaagactatcatccttcagcaatcaaaatggtattggaatagttacatagatcaatggaaaggaataatgagtcaaggttatctactacacagatgtagcagagatttttgatgaaagtacaagagcaattcagtggagatattacagtcttttaaaacaatgacattggaaaaaattattcacatgtaaaaaatgaaccttaaactaaatataacactatacaaaagttaaataaattataaatctaaatataaaatgtaaaactatattactattagaaaacatgggagaaaacctttgttaattgggattagacaaggagttcttacacatgacaccaaaagtatataacataaaattttaaaaaatggcttgttagactatatcaaaattaaaaacttttactgtgcaaaaggcactactaagaatgagaagacaagctacaaagtaggggaaatatttgtgaactctgtgttcaacaaaggactaatacccaaaatatttaaagaactctcataactcaacaataagaaaacccaatttctaaaaattgtgtaaaagtcttgaatagacagcttatcaaagtagataaaaagacaggaaatgcatagaaaggttttcaacatcacacgttattaggaaaatgaaaattaaaaacccagatgttgataatactgggtttttcagtattatcaactgaaaggacttggccccagagggccggccttactccaggccacggtcttcctacacctcggtgcccagcagtctgtccactgcagggatctttcccaagagcagcagtagctcatacacatacctattagaatggctatgcacatacctattagaatggctaaaattaaaagtcctgatggtactaagtcctcagtaggatatagacaactggaattctcataattgttggcgggaatgcaaattggtctgttaaagtctggcaaagagttatcaggttctttataaagttaaacattcatttatcatatgacccagcaatctcactctttggcatttatcccagagaaatgagaacatatattcgtacacaaaaaacctgtacacaaatgattatagcaactttatttgtaagaattccaaattggaaacaacccaaatgtccttcaaggggtaaatagattaattgtggtacatccacacaatagactactactgtcagcaacaaaaagttcaactactgacatgtgcagcaactggatgaatctcaaaggtaacgtgctgagtgaaagaagcctgtctctaaaagttatatactgtgtgattccgtttagaaaacattccccgaaagacaaaatgatagtgatagagaatagaacggtggtttgcagaggaaggaagtgggggcctgggagcgcgtgatcctttggggatagacagacccctctgtgtcccgattgtgatggtgtaaacacaaatctgtaaatgtgttaacattatagaactgtgcaccaaaagtgagaaaaaagccaattttgttttagaatgatttcaaaaataaagttgaaaaagtcatttcttaacaaaacaaagatggtgaaactggtggttccagtgtccaggggttaggtatatccctgctttctacttgaatttctcttgaatatattataatgtaccagtaatacgtgcattcctaccagcttcaccccctcaaataaaggagactgactcctggcacaggacagtgtagtgcatggagaagataaacatttttccacttagacacattctttagagatgcaactttgtttacagcaactccttttctcattttcttggagatgtttttggtttgcttagatacacagattacaaacctcttcatttcataagaggctgattcccattcccagtctcccttccaaataggagatttccctcaaaggggaatgtaagcctctcccctaggattcctaagctttgatctgcacagtaacaccagggagattggttggaaggcagattcttgggactcacgttcatctcctgtggtggagcccaggactgtctacttttatttatatttatttattttgaaacttttttctctttatttttcttttcttttccttttttttttttttttttttttttttttgagacagtcttactccatcacccaggctggagtgcagtggcgcaatctcagctcactgcaacctccgcctcctcggttcaagcaattcttgtgcctcagcctctcagttcctggcattacaggtatgaaccaccatacctggctaattatttatatttttagtagagatgggattctgccatgttggccaggctggtctcgaactcctgacctcaagccatccacccgccttggcctcccaaagtgctgggattacaggtatgagccaccacacctggccgggactgggtatttttaaagacacaatcttgatgagtctctttggggtgctgtagggaacctctttgagaaattctatagagccaggaatttaaacttgtaatatatctgtctgtctgtctccatctcgatagctctcattacttgtgttgaaacacatatggctccacctaactgttttaagcattgtacagtatcccactgtgtgagcgcatctgaagctgctcccacagaaaccacagtgctgcttctctgggctatgttcaggtatactttatttcacacatgtgctgagtcttcagcagcagccgctgcatgacatatgggtcattcccaaacttcaatctcattatttttgctgagaaggtactggccaccttctccatttttatgttttccatatatattactttctttacaacggacttttcagttatttaaatattttttctttcagctttagatttttagttcatcaaaatgtttcttctgtcaaaaattctatctgtacaaaaaaatagctgggcatggtggcgtgtgtctgtagtcccagctatttgggaggctgaactgggagggtcgcttgagcccaggagttcgaggccgcagtgagctgtgatcgtgccattgcactccagcctgggcaactggagtgagaccctgactcaaaaaaaaaaaaaattctgtctggttgtaattagtgtggaatttgtataaattctttttctcagatgtctcaattgcattgttttaatttccacatacatgatacattttttcaagactctgctctgtgtcctgagtttctcatagtacctgtcacattgtgggtcctctggttgtattagctggtttgacacttcccatttcttacagattcctcccaggtctccatagagtgctaccctactctccttcattaaatgctaattgaaggaaaatattgctatatgaaaatagaagcaatgccttttatcgtatttgcaagtcaagttatgagatgtgaattgaatgtacttgcgtattgctaacgtgaaattcaagtttctgtttaggataacgtttttaaaagctgcaaaaaaagttgtaaactattttaaacatttaaagccaaaatgacccaatacaaagtaattgaaacaattttaaaagtcgctaacattgtattaaacatttactccatacctagcactgttctagataccaaagcactttctgtgtattagtccattcagtcctcaccgcagcctcccgaggtacttactgttaaactcatctgtaacatgggaataacagtgagacacagaactcttacataacttgattaagatatccaaacaagaaatgatgagaataatgatagagacacctttctgtgtctgagcactttaaagcatcagacactgtgctttctactttgtgtcatcgtatctgtaaactaggtaatctcgtccccactgggtgggtgaggcaatggaggcttagtgaagtgacttgcacctggtcctacctctaagtagaacagagtaaatcagaattgtaacccatggagtctgttttgagaggccaagctcttaatctttacattgtctgcagaagataccaagttcatcctgggagaagctcttgtcatgcgctggtcattaggcaagggctatagagacaaagtcctgacttttagcaggcaaatggctgcacacaccctgatctctggctctctggaccattcttcacaatgataaactgtcctctccttgaaggagctggggtggggcacaacagccagggtccttgattttagaaaatgtgatttgtggaagctcttggcctcttttggcctcagccaaatgtggcaaaatacaaacaggccaggtctcagtgtctgcccatcctgttctttttcatactgaaaggatttattatgaggcatgtgacacataaaataagggttatttctgcaaatttgattttgatttgatccgtgatgagttcaacctgttatatcccaaatcaccactttcctccacagcatttaccctactctgtaattacgtatttactgtatgtgtgaagcatccttatccctcataaccaactgctagtgagccacactttcattcacattctcaggctacatctcagaagcttgctttgtttaagggcttcattatgggaattttgtcatttcttctgaataagaacaaaactcacatttttataaatgtgttttgctctaatcacctgtatgtgaatataaatttgaaagatactagatggaatcctagtcgatagggccatgtttttgttcttgaaaacgtacacttaattctgggaaggaagttgacatggttaaagcagggatcagcaagccacagtctgctgggtttgcaaagttttattacaacacagccacattctttcatttaggtattctgtctgtctcctttgatgtcgcacagcagagttgagtagtagcgacagacaccatctggcccaccaagtctaaaatatttaataactggccctgcactgagactgtttgttgacctccggtttagagaagtagaaagtccccaccccttgatcatactgaagaacagctgctgttggtgttctcgtgaatgtctttagctccgcttcctctgggaaggaaataagacagttatctcttcatgaagcattttttttttttggtgccaaccttatcatctcattcttcgttttaatgtttctacagttgctctgataaaattcttttaaaaagttctttaaaaatgctttccccaatatttatacaagttaccaatcaaatgttgcagtcttaatcatttattggaaactgtaagatttttgagtcgtgtttctcactttgatgtgccttactgccaccaagaaggttcatgttttttttttttgtttgtttgttttttgttgtttttttctgttttataggagtcattgcagttttcagtagaggtgtacttctgagaagtggcttcttgggtcttcatgcagccatggatctggataaaccatctgtttggggctcattaaaacagcggaccaggccattgttgatcaacttgagcaagaagaaggtgaaaaagaacccaagtaagcccccagatctacgggcaaggcatcacttggaccgccgtctcagcctctctgtgcctgatctcctggaggctgaggccttggccccagagggccggccttactccgggccacagtcttcctacacctcggtgcccagcagtctgtccactgcagggatctttcccaagagcagcagtagctccttgaaacagtctgaagaagaattggattggagccaggaagaagccagtcacctccatgtggtggaaacagactcagaggaggcctatgcctctcctgctgagcggagacgggtgtccagcaacggcatctttgatcttcagaaaacttcccttggaggggatgcaccagaagagccagaggtgagaatagggctgggctctctttttttttgtctctctctctctctctctttccctctctttctccctctctccccatctccctctctcttcccccctccccctccctctctcttcccccctccccctccctctctctctccccctcccccctctttctctctctctccctccctctccctccctccctctccctctttccctctccctctctccctctctccctctctccctctctccctctccctctccctctccctctctccctctccctctctccctctctccctccctctctccctccccctcccccttccccttcccctccctttggaaaatttggttaggagttattttcgtggttagctcagatggggagaatgttgtttacaagaatttaaattaatgcagtattgattgcacccagtgttcccattagttttagggttgacctctgtgtgttttaaagctattacaaataactcttccagaatactttaggacattaaaagccatattggatgaattctcttttatctgtctcctggcaaagaaattaagtacctaacttttcctggaatttttttttaagtgtatgtttgtgtctctcactacaccattgcccagtcatacctgtagaaaaaccatgcatattattactcctaagaagcatatgaatgtatgtccccctttgactgccttaggatttgaacttccttctattttatacctgtgtgtgcactcgcctgtgaacaagcattcttttaaaaagttaacaaaactttagtatttcaatacaattaattaaccaaatataatgatgacacaaatattttatttcaagggtgaatataatttaaattcagtccccaggttaccaaatcatgatttaagtgactgatgtaattagttgtctttaaaaagtctttcgttactgacactgaagtaggtttccatgttgaagtaaggggttaatttttctgtgttccaggttagtgttacaattgcctagaaaactggttgtttaacttggatttttagtttcacttttagaaacaaaactcattgcttattccatgtatcagggtttcaccagggaagggatcatggatgtttggaggatatcatggccatattcgttagcaagcattactatattaagacaccattacccataaatgactttaactatttttttatttggcattacgttttataaaacccattttgtaaaccttttttgactttttagttatttatgaatttgaaatacatgtttcttttaaacaaaatgcaaatgaagtagattattaaatcaggtcagtataaggaaggtaacctgttgaattatataataaagttaatcttcgtctttttttttcctgaccagaaaataaaagtgggcttcttggctttgatatactaacattttcatactcagaaggaatttttttgaagcgactgctgttaaaccatttagaacttttattgtcatggccgggcacggtggctcattcctgtaatcccagtactttgggagaccgaggtgggtggagatcacgaggtcaggagattgagaccatcctagctaacacggtgaaaccccatctctactaaaaatacaaaaaaattagccgggcgtggtggcgggcacctgtagtcccagctacttgggaggctgaggcaggagaatggcatgaacgcgggaggtagaacctgcagtgagctaagatcgcgccactgcactccagcctgggtgacagagtgagactctgtctcaaaaaaaaaaaaaaagaacttttattgtctttgttgattaaacagaaatatttgaatgctactctaggccaggcagtgtgaaagttgctattggaaatagagatgggtaagaaagtgcctctgccctccaactgtgattttttgggagatcttacaagcagagcataagaggctactggatatcagagctgttgttgcaaaatgtttcagcctggtctcctggcagctcactggaaggaggggatcagtgtgtggaaaatgagggcatgttatctgtgaagcagtgtccaagttggcacagaggatagtgtgcttgccaggtgaggaaagctggtgatcacagcctgaagtgtggatgggtgctgttgggggtgatgagtgttttgctctacctggattggaggcactgggagctttgtggtgtgatgtgtgtctggaagggtgtgggctggtccatgatagtagatgtggggttgttgggttggctattttatcttctccaggctaaatgcagaaagcttagaataggcagattccttccagaataggttattctggatcatttggtttttcccttttaacgcaaccatttttttaacctttgttctcaaaaatgaatcctttgctcctctttttctgacctagaaagtacaaaacaaagaccaagactgattctaccgttcagggttgaggttctctctacttgagtgccgttgctttgctgggtggcatgcttgcagaggacggagggacgggagtgcggctgatcagacccctaggatcccttgcagtctagttctgcccacccagctccctcctcaccggctcctcccctcagtcctgcctgtttgagttgggcctgtcccactacccagtctgagttccaaaactgaagaacctggagtctgatgtttaaggccctgtcccactaccagtttatcacatggtacagaagaggggcttccttacttatcttctccactaggctgtgttgatttggaggattggcatggctggggagacacctttgtctttgttttctaagcgtctagcttcatgccttgcgcatagcacataacgtatgctcagctgatatttgtttaatacaaaaacgatgatagcaacgtgtgcattcaggttacttgggtatttgtgtttttcctgtgagttttctttagtttatgatttaattaaaatcatctgtggtttttgaaaaaatactcaattttattttatatgataattgaaattagaggtttaggcaggtgtaaactttttggctgaaatttgatattgattttaactctgaatttatcatttctgcttttttttttttttttaaacaaagggaattcctgcagaattcatgtcacctgagagtttgggaattggttcctctgtgttttagatatggcttatctgtttcttcctagttaatagctggtggctttctataccttgtgtggaatgaggaagaaatgaagaagaaggaaggagttggcatgtggcaagcctggtgtacagcaaggacaatcagatttttgtccagtgttctcagtttaacttactttgtttttagctttccagaggggtcaggcaaggagtgagcatctgtggcctgagggatccctaggggtttgcctcttctgttgtgtaccagcgcttctctggtgccagttgagataagtggggagattactctgagcagggtggtcaggaaaggcttgaagagaactccttttgagaattagtaagactcagataggcagagagtaagcctgtggcagtgggacaggaccccaaatatcagcaatgcctgaattctgcagtcacctccaggcccaccagcatcagcaaagaaagtgaaatgttagtctactgttatggggaattggaatgatggggcaaaagaggaaagtaagcatgaggggcaaggaagaaggaatgtgaaaaacaggacaggcagagcctaaaatattgcaaatgccaaatccagctgtaaaaccaaaaggtgagaacatacgcttagaagaaaggatacatccgtggaagaggatttagccagactctctcttgagctccagatccacaccctactggatgtctcataggaacctggtttcgacttgttttgacagaattcagtctccctgaagaaccacctcaaacatagaccatgatttcttggcagtatcaccattattcacctagttgttcaagccaaacatctgtgaataatggtagtctcttactttccctgcttttcatgtttgtggggtcttttgtcgtctcacatgtttcctcctctcttacctatcatattagtccattttcatgctactgatagacataacgagacggggcaaattacaaaagaaagacgtttaatatggacgacttacagttccacatggctggggaggcctcacaatcatggcagaaggcaaggaggagcaagtcatgtcttacatggatggcagccagcaaagggagagagcatggacaaggaaactccctgtattagggttctctagaggggcagaactaatggaatatatatatatagtttatatatatatagtttatatagtttatatatatatatagtttatatatatagtttatatatatatatatatagttctgtctagagggacagaactaatggaatatatatatatatgtttattaaatattatctcacatgatcacacggtcccacaataggccatctacaggctgaggagcaagcagtccaggttccaaaactgaagaatttggattcggatgtttgagggcaggaagcatccagcatgggagaaaggtgtaggctgggaggctaggccagtctgttttcacatttttctgcctgcttatattctagccacactggcagctgattagatgatgcccacccagattaagggtgggtctgcctttcccagcccactgactcaaatgttaatctcttttagcaacaccctcacagacacacccaggatcaatattttatatccttcggtctaatcaagttgacattcagtattaactatcacactcccagtcataaaaccatcagatctcatgagacccattcactgtcacgagaacagcatgggaaagagttgccccgtggttcagtcatctcccatgggtccctcctacaacatgtgggaattatgggagctacaagatgagatttgggtggggacacggagcaaacttacttcatattcattctgttctactgaaatccttcccatacttcaaggcctagtggaaaccttccttctctgtggtgctttttccaactctgtggtgagtataatcagcctgccttcattttcatagcatgtcacttttactctgactgagcactaacctcagtctgttctctggagaaatctgtagagagaagaagggattacaacaggaagaggaggtagaaaggggaagacaaattggtcctgggcaagggcatcactgagtaagttcttgagaaagtcggcatgctctaagacatgtactaactgtccagtggtcatctagctcagaggactgactcatgataaccagatggtcacaagtctgagctacaaatgacaatcacaactaatttgccatgagaattaaatactttgaagactctaggccagatgtggtggctcatgcctgtaatcccagcactttgggaggctaacatgggtggatcacttgaggtcagaaggtcaagaccagccttgccaacgtggtaaaatcctgtctctactaaaaatataaaaattagctaggcatggtggcacatgcctgtggtcccagctactgaggaggctgaggcgtgagaatcgcttgaacccaggaggcagaggttgcagtgggctgtgattgtgcccatgcactccagcaagggtgacagggcaagattccatctcaaaaaaaataataaaaattaaagactctaatgttcttttgatgtaaacagctcattcttcatttttgtcaaatcacacagaaagtcaaatcataatcaatgtctacttcattaacctgttaggagaaattattatctcagggcctggaaacacttgaaatgcatttcctccccacagtcagcctttaggagaagtcacatgagaatcaggaaaattggtgcagggattggcacactgcagggagaatgcatgggctccatgctgaatggcatttcatacaccatccatctcacaatgggtactgagccacaaattagaacttgacatactcacactttgtctactagggccacctttatccatctctgtgagcccacttagtccaggaagcctggattttaaagtccctccttctgaacaagtccaaacttttattgaggcttcctggcgtgacctctccctttttctgattgacacattatttcattaattgtatgttatcacttcattaattgtaaggctgatatcttatcatggtggcctggcatccatattgtgtcctttaggtgactttgtatgtctgggtgctgacggataaagagtcattgcttggattgaattgtgtcccccagaccaagttcttatgttgaatctctaacctttacatgactgtattgaagatatggcctttaggaggtgattaaggataagtgaggtcagaagcatggagccctgatccaatggaactggtgtccttatacaagagaaagagacaccagaggtctctcattccccaccatgtgaggacacagtgagaatggagtcatctgcaaggcaggaagtgggtttctgttgtttaagccacctagtaagtggtattttgttatagtcgcctgagctgactaactctgtgatcttaacagttttagcctcggaggacgatctcattgcttgtggccaagacttgtggctaaagaggaggtaagagcaccatagtctactgccacataccaatacctccacacacatacacacacatgcggatatatatatatatgtatgggagtgtatatatatacctttttataggtgtgtgtgtatacacacatagctgtttagaagtcagtctctcttgttagagtataagctcttgaagagtagaaatgtcatttttcttcttctcccggcctttctgcaaaccttgcttatatgatatgcatgtatattgattcatattatcactgcagttgactttccagccactgccaaaggcttggaaagccataagaaatttagttgtgttggggaagggtgatacatggaggcgctacgtgggtagggccctaaagaaaggagtttctaagcatcagatgaaatgtgaagaagctaaagttaagggaactcggagggagaggagcttatttttttatttttttcttcttatctagtttttttctcctcattttctcctctagtcagcactctcccagtacttactttacaagacgcttttaacatgcattgtaaaatcagctaagtatttagaaaatgcatacggtctattctggttcttgccgtaggtattgatggtgaaattgggattagacacagacactgaaaaaaatgaccagcaataccaaccagtctctactcagtgctagataaccagttgagatgaatggggaggttattctgagcagggtggtcaggaaaggcttgaagagaactccttttgagaattagtaagacttagataggcagagagtaatacagattagttaagtttgtctgtggggctagaaaaatatgaaggtcttagcccagtacctgccagccacaagcacctaacaagtgcttactgccatgattttggttgtattcattagtgtttataattatttttaacattgcttatttttcagaatgacatggaggtttggagaattttagtgacttgcttaatgtcatccagctagtaagtgtcagagacaggatctaactccaggattgtctgaatcctgggactgtgcgcagaactgtgggtataacatgagtttggaagtacaattctgcaaatgggagagctcagatctggagataaaaaaagttgatcacaaaaggaagacatttatttttctgtgtccactgtgtccttttaaacacaaggataattatcaagattgaatgggctcattgtcatggtcaataactaataattatgaaagaaaggatcattccccctttcccataatccatgaaattccacaatggggtatgtccttccctgacatttcatttggcagttggagttgtgaataactagctttggcatgcacttacgtgggtgagttgagtgatttagagaagttccccattgagatatttccagaaatggcttggcaactgcatagcttcaggttagtgatcacagagaagtagagtgagaaaccacagaggagaggaaacgacctccaggttgcaaaattaaacaagtgcgtcagtttctctacacttcaatgacgtcatttttactatttttgtgtgatctcgaaagtcgtacctcaatatgtgatggtgtgtcagagaggcaggtgtgtcagctacatcccagggtccatcatgggctcagtctcgctgttcttcttccttcccttcgcacctgttgaacgcctgctttgtgctgatgcagatccagacactagggacagagtagtcaacaaaatagaaaaaagtcaccttcctcatggagtttccactaggaaaggtggcaagctatagatataatcagaacataaagtgtcatggagagaaagaaagcagagtaggtgctgggggggaggtgttatcattttgtacagagtggtcaggaaggacctcttccgagaagataaccttcacacaaagatatggaggaggtgaggaagtgggttgtgtgcatagctagagaaaagccttccagaaaaagagaacagcaagcataaaggccccagggtagcaggagtgtccctgatgtttcaggaagagcaaggaagcagtgaggctggagaggaggcagtgaggcggcaatgggaggagatggcagagaagtgaacagaagccacatcatgtagggcgttcctatcttgtcaggcaactctagctgcttagtgcactgaatgagcgggatgcacaggagccccatgggctcaatgctgcatcactcatagggcagaaggaatcgttggcacacgggcagtgcttgctgtgtctgctgtagacactgggtatagcagtaagtccaagctttgccttggacaaaagatatggagaaatggcgcacaggctgatgggctgtgggcagagggaaaatggcactgtcccgaggcttcgtcagccagtctctgactttgtcctggtcactttcggtggggaatgttggagggagctaagaaagggactcagattgctcaccaccttcatcaagttcttttgatccactcttcccaaacacataggctgttttatgactattactaatataattcataataataataataaatagaatagcaacaccaatctaatgctacttactgagggtttatgtgtaaggaactctgctaatttctacataaatattatcagaccacatctatttggtttcctctgtatgcgaagagtcctcgcacagtgtctgtctgagaaaaggctttcagtaaataccctctgagtgatttaattattctaacaacctataagaatctgttttgatccattgagagatgttcccatgtcttgaattttaggtatatttttcaaggacagaaagctagaaagtagcagaggtgggactcaaatccaggtcttttggactccagagccttgttcactaccatgtacagctgcttcctggtcaggcgaggtgtgctgttttgggattctcctggcgcaggtgtggtacagtgaaaagagcagcgtacccaggtcactcaggggaagcccaacctagagtgctctccagggccgaactctccagctttcctgtgatggccatttagcctcctggctctgctttcctctttgccaattggggagactaatgacagcctgtggacttgttttaagaagttacaaggagcataaattttacattagaaagtgctcagcgatgtacaagcaaccattttttaaagtatctcctgttaataaacatgcaaaaaacttacggcaggtcagtggacaaatattactaaatatgcagagttttagagcatttcaacaggggttgataaactttttttttagaaagggccagagctttgtgggccacaggcctctgtcacaactactcaaggtgaggtcacatgacattggccatagacaacacaagaacaagtagacagcggtgtatttcaatcaaactttgtaaaagcaagcggcgggctggatttgtctcatgggatgtaatttactgactgttttataccatcatatgcttgagcaaggtatatggacacacacacacgattcagattttgctattagattagacagtcaatacagcagggaaatcacttttagagaccagtcttggagatgagagagaattaaatttatacaccttgattgtatgatccataacctcctgaaaagtggtacaaaaaaataagaacagacttggccgtttagtaggcttgattgtcttctgaatacaccttccagttttgacctctcattgccatgtagctcacttttcattctatcactgtgtccagttgctgcttcctggttagtggagccgtctgattccttttgcttattttgtaacttcctttgtcctctatgtatttgtgtttgtgactcctgtattcttaaatatacatattctagatagacaagatacgggttatagattaaatatgcagtatgtatacatttatatactttaatggggcagtttttaaagagaatactattgatttgttcagccaaatttttactcttatttagcttttctggatgtgggtttatgttttcttcctctgaaatgtaaacaaacagtgactgcttacctaatttttaatttggcttcctgtgtgtgcctcatagtaagacccttcagacagccacatgggagatggtattcgtacaggatcacatttagtgtatattgaaaggaaaatgtttattcacaacagtttcttgccctcaatctcaaagtccttggtgactagagaagattttctttttaaaataattgatctgccattccagtgtctccccatatcctgccgaattttaatatatttgcattcttatggtaggaaaatccacatctaaagggaatgcaaagtatgtattaccttcccataaatttcagtttagcaaggcagaatggaaatatcaatgcaaagttgcttttatttaaaaaaacacaaatgaaaaacacttacctgaaaggcagcagtgagagctatgcaagggaagactaatctcataatagtgctcattccaagatgttaatgctgtgtttctgaatgctagtatgtaattagacagttttgtcatattgagacttattagctttgacaatatttaaaattatttctcttcctgagtatgtacttgtacaaaatttgtttgaaatgttaaaatgatgcttattaggtaaacaatcaatagatagtacatccccaggatggaacactactcagcaataaaaaagaatgacgcagatgacaacctttacggatttcgaaggcattaagttgggtaaaagattccagtctcaaacatttaaatactgtatgattccaatgatatgatattctagaaaagataaaactatatgatgaaaatatacaattacttgccatggttctagagttggaagatttgaccacagatgggggtcaaagtggaatagcacagaggcatttttttgggtggtagaactgttctattattatgattgtggtgggggttatacaaatatatacaggtgtttaaaactatggcagtgtacacatggaaaatgtcaattttacagtgtgttaatttttttaagtaaattttttttaaaaaggccaagcacagtagctcatatctgtaattctagtgctttgtgggaggccaaggcgggaagatcgcttaaggctaggagatggagaccagcctgggctggtgtgcgacagttatggcagctgtgagaaggcatctctataaaaataaattttgtaagaaaatttataaaataaataaaactattttattataaaatatttcataacataaaataatatataatactacaacatatatctatttaaaaatttttatattctaaaatatttataaaataaaacaaaacttagccaagtgtgatggtgtgcacttgtaatctcagctactcaggaggccgaggcaggaggatggcttaaagttccaggaggtcgaggctgcagtgagctatgaatatgtcagtgcactccagcctgggtgacagagggagaccttgtctcaaaaacaaacaaacaaacataaacaaaaaactaagggaatccacagtgcttggttacatttattgggaactttccttttttttttttttttttttatttttgagatggagtctcactctgttgcccagcctggagtacagtgatatgatcttggctcactgcaacctccacaacctgggttcaggtgactctcctgcctcagcctcccgagaaactgggatgacaggtgcacgccaccacacccggctaatttttgtatttttattagagatgggggggtttgccatgttggccaggctggtctcgaactcctgacctcaggtgatccgcccaccttggcctcccaaagtgctgggattacaggcatgagccactacactcagcctaggaacattttttaaaaatctcgtaatattggtattctggggtattcctgatgaaataaatattaattcttctctttttaatgaaaaaagtaagttagtgatgtagtttctaggtttataaagcaggtgaaaataatgcaacttctactcaacgaataataccacaggcactatgcaagagtgtgggggaatatccaaagttatgtgtcccccagcggctgtaactccatcctcctgtgcatatggaacattttgctgttctttatggtaatcactttcctatcttggtgtttatatatggtgtgtgacagttacggtggctgtgggaaccataactttaagttctgtgacttttctgtgagtaaaaccagccataatgttgaattaatgtcattgctcacattgaatttccttgttgttataagtggaagacttatcacatatttgaataaaagctctgttttcatttttgataacatgtaaatgatggtggttaggtggattaattttgtcatttaattaacatcatcattcagtacagtgaggacaacttgggagaatatatatggtccagtctgaggggtgatacggtttaatcatacctctgtccactcctccatttgaaagtagaagatacaagaccatcattatccttggctaatgacataacactttaatcaaaagtgttattatccactttagtggatcccaatagttttgtggaattatcttcaaaatgggattggttaggtagagcattgattcaattaatagaactggagaccatagcatgtgatttttcaggcttcagagcatcagcaccgtttactcttggctctgcatgtgaaggcatggttattgatgctggaaatcaggcagaacgattgcatttgattgcattattgggaaatgatagtgtatggtataaaacacatacaaataaatctattgatattgggaaattcagtaagttgaataaggttctgattattggcataaagtggacttcagagagtactgcccaactcacctgggggtccttttatacataacacatgcaggagataccaagaactaagggagaggttgtttggcaaaggacctgtagcctcttttcttgtctgtcatcaagccacattgagagttagggctgtcttcctgcctaggcagtggtggtacttcctcagtcagaggcatatagtggctatagtgccagggccctagaaaaagcttgtgtctgaaatcactcttgatcctgtgcgaattaacctgaactgaacacagtgtattcacagtctagggacattaaacctgggactgatggggaaagaggcaagggtaagaaccgcagattacaagaaccttagggcctctttgtcctagccccatgaggctccattccttcttgtactcagggctcgtttctgcccagttgcagcctttctcgatgtcactgcatgcagaggcagtgggccagaaagcccgtccttgtttgcagctcctcaccatttctcgtgggtgctgaagatttgccccctggtctggatgttttgttgcttcttgaagctgcactggacagagcgaatgtgtgtctcggaaggtagcctgccatcaagctggatgtctgagtcatgtccaggtggtcactgtgcatggaaaggacaaatgtcatcagtgcccctacccgcagtggctcatggtttcctaagcattgtctccggggctgcctctcatctccaaattggcccatagcaatgaagttatccagtcgtctttggaggggaaattccgtggttttcattgacgcaatcagtcctggctaatgtgccaaacaggaatatcctcaaattgctgggaggccatttgcccatgtcccccctccactctgcctctcattgcaggcagctgtcctcacattcagcccagaaactctgttaaagttccagaaacagataaaatctcctttgtgcctataaaagctgacacaactgaggaatctgtgccccatactaactactgcatgatgcaggtgtcattgccctgtggactcatttcctgggtacgagaagcattttaaaattgggaaacataggggccgggcatggtggctcacgcctgtaatcccagcactttgggagggtgaggcaggcagatcacgaggtcaggagtccgagaccagcctggccaatatggtgaaaccctatctctactaaaaatacaaaaattatccaggcgttgttacaggtgcctgtaatcccagctactcgggaggctgaggcaggagaatcacttgaactcaggaggtggaggttgcagtgagccgagatcatgccattgcactccagcctgggcgacagagtgagactctgtctaaaaaaaaaaacaaacaaacaaatactgggaaacatagacacctctcattctgaggtcatctgttcagaatttgcatttcccagttttggtttggcgattgaccagttgctagccccatgaaggtatggcttgaggaatgtctctcagatcactctttgaaacgtttccttccgaacggacatgctcgattctctggatcctgagctgctcgtttcacatcggaggctgggggccgggctggcccacttgggagggatctggcacagtggctgtgctgccccgctgctttctctgggaacaaagctatttgcatgctaaacatgtgggtgaactagggatgccatgtggcccagcaggggcgtgcagttcctcttatccagtgacttaggcggcagaggacacagctaggatgacacctctgcatccacgtctccttgccacacaaacaggaaggcggccctcactgaagctgcatatgcaaatatcagatttccaaaggaaaagacctgatagagggtatcttcctgagttggtattaatttgcttttgtaaagcagatttttttttctttttctttgcagaagctatgtggaagcagtgacctgaatgcttctatgacatctcaacattttgaagaacaatctgtgagtggcattccttaaaaagaaacattaaatgttgtagatatttctcatcaaatgtttgggtttgtattttttttgcctcttttattgctaaaaaaaaaaaaaaaatgccaaaccgtatccacttacaaaaccaggccttgcaaattttcgctggaggagattaattcagtatctattgatttgtcagactgggatagattcttctaaaaatacagagtaactatgaaattgagtgagatagtaaggcagataaagccagtttgaagtgctttgaaactttcaaaagaaggctgtcaagggtggcttagccacaggatcgattaattgaatgtccaataagtgaatgataaatgattttatttgcccttttccctttaaggacagtcaaaagtttgaaatgactcaaaaatttaattgggctcatgtaatacatattcaaaaacagacttgaattctacaatatggccagcaggagttgatgcatttctggaggaggaagtgactgagttgcgggaaggtgagactgtgaggattagagtaagagacactaagagtgggtgccagagaatgaaagagaagggtggaaaagccgggagagcactggacagagacaatgtcctttggggacccagggaagagcatgtgtcagttggacatgtgggcttgtgggggcatcagctgagtgcccagaactgaaattttactacacatggaagtctacagaggtgatgggggttggtgggaagggtggagaacaggacggggcatcttacatctgaacttggaagcggggacacatgttcttgggagccaggcctgcagctgcacttcttcctcctgttgcctctcttggggctctaccctgagttttataacaagggatcctgcagtaatttaatgagggtatttcagaggttggttatctaattcttggaaggctaaccttgcaaagatgtaatcatatttgcttctgaatactgataaaatcccactggggagaaatgtaagggactttttaataaagcagggtaaccaagttgtcatagtgaggaggagttggggatgacagtcgatcatcatagtggcctttcttttttccctccaaaatcgagaagtatttctgaaattctcttgcttgggcccaagacatactgtcttaactgccttctccatctgtgcaggtaccgggggaagccagtgatggcttgagtaacctccccagcccttttgcgtacctcctcaccatacacctgaaggaaggccggaacctggttgtccgagatcgctgtggtaagacctgggtctgttatggtgggtgtagcctggaaacttctttctctctgtccttgtatcaatattgtcagtcaggctttgacatcacagcatggtttaggatagacagtggctcaaatctaagtctctccaggtataagacatttgcagtgaatcatttaaacacactaaaccttactatccttctttattattaggttaatgatacgaatcatcacgtgaagttgttttagaatggaatgagataactctgatagctttacgcctggcctatggcaactgttcaagaaaatgtttcctcaatcctactttaattattcatgagaaaaatgtgagcccatccttagtataaggtcatcagatgtacacattgacagaaatgcctttgaaactatctcccttctgctttgaaatctcactggactccctctaatagctagtgtctgcctgtgattgttttatttatcttttacaagtctctacctagccataaatacatacctgtatatttttaaatgtacaggtcttcaaaattgaccatgcttttccatgtacatatattgcctttcttttaaatactacgtattatttaatgtataactatgtgcattatgtataatgtataatgttttgtttatctatttctctactggtggtagctgtttttttccttctgtctttgcactataaatgatgctgtaatgaacatattgtatatgcttctgtgcacagataaggctaaaccttatattaaaatggcatgtggttaagagcagacagttgagctagactacctgggcccggatcttggcttctccattcatggctgttggatctgagaaatgttgcttgaccacttgatgccttgggttgtttatttgtaaaacaaggatagtaagattcacctaccttacaggctgttgggaagatggcaggcattaacttatataacgtccagtattcaattgagtgttttcttctaaatttttataattcttcataattttcagcattgacattagttatatattgcaaatatttttctcccagtctgttgcttatccttaattgtatggcctcttttgtcctttagaagtttttcatttcattgtaggcaaatatatctgtttttttctttatgatatttatttatttatttggttcagtagctgaggcctttttattctaaagagttctttttcttgcttcggttcttggacggtttctcctgttgcttcctctctattctgttttggaacatcttttcaataaaggaagggtctattgactctttgatctgtcttctatgtctcttaggttttctttttcatttttcccatgactttttcctctcgggaagaattcttcagcttgatcttcagcttgctcattttcttgtcagttgtttacattgtactgttctgtttaccaattgttatgtttttcatttttataacctattttgtttgacaatcccatccctttttgagaatattaagtattcatttaaaatatcctgcttgctgctctatttcttggatatcagtttaatgtattgactgtctcccatttaggacattattttcttttacatgtttgattctctggagcggtttgcttatcattttatttgtgtttttctcttcccccatctgtggatgttatttttgcttactatgtcctgcaatttggtgatgatgaggagagccggggcatgctgcaggacagggtgagccggtagttcaggctaggttcttcccattcctcctggttatcacctgccacttaaagcttttctctctgcatacgcctgtgctatctgcttctgcttattttcaggtgcctttgccgggcattgctcagcctcaaggcataggacagtgctggcccatccagctctctttttgtgctgaacccaccagtcacactgagctgcactggccatcttacctgctgcctccaagcctggagcattcgtggttcacctgccatacacccttccaccctcctaccctcccactccaccactacccagaaacatctttgctgtgactctctactgctcatgtctctggatatggattctttcatgaactgatctcatgtggctttcatctttcagaactgtatgaagtatgtccttttttttcttaaaatttctctctctcttgctcatgttttctcagatgtagcattttaaaatagtgaaaaaattattgcctacttgttggtaaatagttttttttaatcaaagtcataatttcttacctatcaagtgtatcccttctcatttctattattattataaatgtatctatttttacaactgcatctcttgtgttctttttaatggcttggggcagatagcattttatgcctgaaataatatctgaaagatgtaatcataaaccagtgtaggggtgcctcccacagatatcctgattcttaccctgatccggcacagtgtccagtggttacttttgtcaaaaatgattatcaaattcattttgtaaccatttctctggcgagtagaagagtgttctagagagtgtgtattttacattactaggaagaaaatgttctcaagctacatgtcctgttttacatttatggaatttcttcaaaaaaaaaatttttttttttttttttttttttttttttgagacggagtctagctctgtcgcccaggctggagtgcagtggcacaatcttagctcactgcaacctccgcctcctgggttcaagcgattctcctgcctcagcctcccaaatagctgggattacaggcacgcaccaccatgtccagctaatttttgtatttttagtagagacggagtttcgccaggctggtctcaaactcctgaccttgtgatctgcccaccttggcctcccaaagtgctaggattacaggtgtgagccaccacgcccggccaatagtttttaagtttagggatatatacaggccctggacctcttctgttggccaactactccttttctagctttctccatttttttctagttctttctccctcactgctgtcaggcaatactatacttctctatcaaactgatgcagttacagcagattccgagtagatggtcagtacactgattagatgatgaagccgttgcacacatcggaaaatgatacaatagggcttatgtgcacttgctccatatcttgctgtttcaagaccaaagtctgctctaaccccagccattgtcatctctctctgcagagtttcatcacagtcaaaacatcatgtgagaatttggcttttattttgtgcaaacctaatataatccaaatgtaaatacctaataaggagtctaggtcataaactgtgctgtttcagtccccatttcttttgaaaccagtagtaattgttcttggtttttttttttttctttcattttggggatgctttattgttatctgttaagaaaataccccactctttcaacattttttatttcatttttataccttggggatgccttcctatgctctgactatgtcaacttctgtttgattatcacaagtattaagatgaaggtatgatcttgagcctgctcagggcaagacggcatttgagtgtctactgtgggttcaagaaggggtcctcattactaatacatgtgctccctcactcctgcctcctttgcctaggtacagcgtcacttttcaatacagcattattttctacaaaacccaacccagactcagaagttttatctaacacaatcctttggaccaatagttctcaaaattgaatgagcctcagaagagtcttaggaactaatgaaaatgcacatctctgagccccgcacacagactctctgattcagtgtgtctggggtggggcctgggaatttgcgtttctaacaagttcccaggtaaggctgatgctgctggcccaggaaccacacttggagaacctttgctctaggcagtccctgtcacaggtgggtgtcggcacatgagaagaaacccatgcttctccttagaggtagagtttcaactcttgattatgttagccagacattgtattttcctggggctttttctcattacctgtttgctgtctgtcattggtctcagctttacttaatttgtattggaatataatttaatttagtattaacccaattaaaacaggtttaagaaactgtgtgatatgctaaagtactaactataacatgtttttggcttatctatgcatttacaatatttagtctttataacgtgttctccaattctgtagatactaaaccaatagcttattgttgcaataggaagtatctttcaatacagactcagatggcatttgtcctatgcagtcttttatgtttttcacaggcataagctctgtctcacctcaatcttataagattttacctttataaaacatatacctttatccttaattggggaaatgactgatctgctctattacaatcttagtgctgtattaggagggagaatagtttattaatctttttttttttttttttttgagatggagtctcgctctgtcgcccaggctggagtgcggtggcacagactcggctcactgcaagctccacctcctgggttcacgccattctcctgtctcagcctcccaagtagttgggactacaggcacccgccaccacgcccagctaatttttgtatttttagtagagacagggtttcaccgtgttagccaggatggtctcgatctcctgaccttgtgatccacccgcctcggcctcccaaagtgctgggattacagctgtgagccactgcgcctggccctagtttattaatctttgtatgccctcctgtgctataactgatggtttatacacagaatatttttaataaattttagttcttcgttgaagaaatccaacttcagtgctggacttaaggagcattgaggcctgttatacaagggaaagtaccttttcagaatgaacagtatttagtcacttactcccttattcaacaagcatgtcttgggtttcctcagtgaaatgggcactacactggtgttcttctggggcttggtgatgaaagtcagcaaaaaggatttatatgatttcagagatgaagatgactttcatataggtcacctggtccagctgctgatttaatggaagctttaattcaggaaatggaagcacaaaaattgaatgacttattgagggtcacgttgggaggcaagattcagagcagactgggtggctcagtgggacaagaagaggatttggatttggtctactacttggctttgtgacctccttgtacaacttacataacctctctaaaatgggtgtgatgtaccttgcctcataatgtgattgtaaggactgaaaaaagtaaaacaatatggatgaggctgggggacaaaatgttaagtaaaataagtcaggcacaaaaagacaaatatcccatattctgactcacgtgtgagctagaaagttgatccgtggagacagagaggagaatgcttactaccagaggctgggaagggtgggaatggggaaaatgaagaagggttggttaaggggtacaaaaatacagtagaaagaataagttacagtgttcaatggctcagtagggtgactatacttaataataatttattgtatatttcaaaatagaagagaagatttggaatattcccaacacaaatgatgtgtttgaggtgatgcatatttcaattaggctgatttgatcattacacattgtatgcatgtatcaaaatattacgtgtaccccataaatatgtactattattattaataaagatgtatagatgccatagtggcctacatttagaaaataggcaatagatatgttgttatagtaattaatgaataatcataatgcaagttggccatgttcttgactcccagtacagaactcattgctgtgttccatgtcagctcccccgtcattgaattagatgcttggtccctaacttgtgtcagtttgccaatttctctgtgctctctctatgatctgtctttagcatagggtttttaaaatacagctaatcaataaacaatgcaggaggttaggggtgccaacccctcatgcagtcagaaacccacatataacttttgaattccccaaaacacaactactagtggcctactgttgaccagaagccttactgataacataaacagcccgttggcatatattttgtatatgtattatatactgtattcttataataaggtaagctagagaagaagtgttaagaaaatcataaaagagagaaagtagatttattattcgttaggtgaaagtggatcatcataaaagcctgcaccctcattgtcttcacatccaattggctgaggaggaggtgaaagaccagggtttggtcttgctgtctcaggagatgcagaggaggacaaaaattctgtataagtgaacccttgcagttgttcaaatgcatgttttcaagagtcacctgtattttattttcctatgtggaatcatgtatttaattttaagtaaaaaacacggatctaattaatcacatattttttattatgacagaggctccttcagagttattcaaatgtgttgcaaccttgaccatggaggagcagcagctttagggcctttaattccaattgcacagcccctgtttttgaatttttttttttttagggagaaaagctattttgatgaatcactctctgctaaggaaggagttctgcattttcttcggattgttacataatcattactgtctgttactttctgtctagaacatggattagtagactttttatggctttatgggctataagtgaaaattaactcttgacatagtgagaaagcagccatagacaataaacaaatgaacatagctgttttccaatataaatttatttacaaaaacaggcagtggtctggatttaactgatgggccaaagtttgttgacctctgcctagaatatcatggtctgatttttggattcttgctttgaaaaactgctttaaaaacatctacaacaaagatggtataatctcattaggcagtcatcaagagttgaggctaatgctttcagcggaagcatcttggaaatacgacatgaaatcatgcagaaaaatccggagatgttgggtaataaaaagtcattttcttgctatttaactcagcagtggagtggaagaatatggtgtctcccttaggaaaagacagctcacaaaccccaagaaaggatgttagaaagtgcttagagggtatgtgattgagcataggaagtttttggtgactttgcccacgaggaaacacatgcagaaaaggtctcagataccagagttccctgtctctgctgtgatgccgtcagcgagaggctgggaaataggcttcactggcataaagagctgtgaggttttatctaaatcactcccttccctggttcaaacacagagctggtatgttaagcaggttatcaaggtgggatttggagatttttctgggagttttggtgaagattgctgaactacaccattgttaattgttctttagaaagactcacaaggaagtctggcttcagaacaatgggcaggtttagcaatggtgttgggaaaggggtaatgttgtatagttgccaccaggacacctcagggtctttagctgtggcctctcagtgtgtgtatgtgtgcagacttaaaaaaacaaaaacctatgggtaatgaaaaatgaagttggtgggagactaagaactccctgtcttaagcatgcttaatacccatgaataatcatgggcacagaagactatcatgggaggctgagaagtttggatcaggtagctctggaagtgtggccacatttagaagattgttccttgcaggtggttttccagttcttcaagaatttcctttgaatctttggcatgtgggccttcagccttgacaataggaggtctggtattggggagctcaggagtaaactaagcagccctgttattattactgttattatttattgttggatgactttggctgctgtagtggtctttctaagaacgagtcttactctgatgctgtcaatggtccaggcatggcattgagctcaccttcgttagcaatccgcataggaagaatggccgccatcttcctgcatgtctgctgtctcagccattgcctgtgtgttgtgttcatctgaccctccctgtcccctcttctatttctctcatctttctttgctctttctactctccttttcttcatcctaacgttttccttttatttccttatattccccatttcctttccattattttccgggatgttatacaagatgtattgttttcgaccaaataggacttacacttgttttaagttctcgatctgagtagctcttggctgtcttaaactttgagactggtaaagcagaagaaatatgtgagcaatcgcctttaattccaactgcttcatgatttggttgatgcatggaggaaactgaaccctgggtccatttcccatgggaaggaatgtggccgaggaggaggtgttctggcgtcttagagctggtcttatgctccaggcctggcttgaacttcagccttgcgatatgggcaggtctctcgtcctgtgcaaaatgctcagctcataccctgttggctcgtagagcgctaatacgtggaaaacaatagccctcgctttaaaaccctgtgctttgctgtaatgttaggccgctgtagtagtttaccactgtgggctgagggaatactgtgttgctggtgccctcttgtggccactctgtagcgttgcaaaaggaaaagaaaagttaatggaagttcgctgtcacattactagggccgtgaaaatcacttcagctgtaggttgaggtttgatggtcttttttgatgcgagttttagtggatgaaaataaatgaacactcattcagaaaactgctctctttctcaatttccagcacaggtagatatctgacgttcgtttctagagcaatggcagctttatatgcagataatggaaaaaaatgtgctacataagtcaagttcatatttaaaaggagtagttcagagaaaaaatttaaagatctctcgatactgtgagaattatgctatgtaatcgctgttacatagcataatttttactattattaaataattgttatcttattgtttattatattattattcaattattgttgtttaataaattactaaattgttaccaaaaagttaaaatgactgatttaagtcctggttttcttttgctatttagcaggctaatttttatgatgttgctagaactctgtattgtatactgagcagcggtgtagcttcccaacaggtgtgttctgaatgggatgtactgaagtattcattctggcagccctctgggcacctctgttaggcttgggccaccataaaccctgctgtgccctacagacatcattttgttttgtgtcatgatgtgacgtgctgaagagtgctggatggtgggtgagggttatgcgtgggctttggacatggaccaccggagtttggattctagctcagacacggtctagccatgagcctgctaggcttgcggtaggattaacctggtgtgtgtgcttgtggagacttggtggtggtcgtggggcggggccgtgaggtgggtggagctgaaacagtcatatgcaataaacattagctgttactattgccgtgtgaattgtcatagttattcttggtatagttattctagtttgggttttgtttttgcatttcgcctgtgggaacaggaatgactttgtgatttccccatcctttttatcgtgggcttatcttcccagtttcctcatcaatttttgtactttttgtgtatctttttgctcttttacttcttttgagataaaagttcctccccctgccgccaccaccacctctaacctgggtggtgtgagggttgtgaaaggtgttttcttgaggtcaggtcttattttctgtgaaacaggagaaatgagagactcttttaaaaggcaccttatttgaataaagactctgtcgtggattgaggtttaattttccccatcataaatttgacctagaaaatgccccttcatgagtaaaactggtgttgacgaaggcacaccactaggccttaccgaaattctgaacctactctactccatcgctccgattttttttttttttttttttttttttgagacggagtcttggtctgttgccaggctggagtacagtggcgcgatctcggctcactgcaacctctgcctctctggttcaagtgattctcctgcatcagcctcccgagtagctgggattacaggcatgcgccaccatgcccagctaatttttgtatttttagtagtgatgggggtttcaccatgttggccaggatggtctcgatctcctgaccttgtgatctgcctgcctcagcctcccaaagtgctgggattacaggcatgagccaccgtggctggcccgccccgatttttaaaatctatttttctttctaaaatgaaagagaatctggcttttaaatgtttggttacctggtgttttctctctacacatttttctctgtattataaaaactttattttggagaagaaattaaaagcttagggcaccatactttgttcagtcaacattctgaattaagtttgttcaaaatttgtaacattaggaataatgccacaacaaacgttcttatacctaaatctgtgtgtacaggttactttttcatatatttgcaagtgagttatttattcaggtggattgcattttttgtgttatatgatctgagcatttcaagattctcattaaaaaattgccaatttactcttgagaaagacctatttgttgacctactggtgtgtgaaagtgggccactttttgtttctcacctaccttgttatgtggaatattattgttactttttttttttttgagactgagtctcgctctgtcacccaggctggagtgcagtggcatgatctcagcttcctacaacttctgcctcctgggttcaagcaattctcctgcctcagcctcctgagtagctgggattacaggcatgggccaccacgcctggctaatttttgtgtttttagtagagatggcgtttcaccctgttggccaggctggtctcgaactcttgacctcaggtgatccccgccccacccccccccaacctcggcctcccaaagtgctgggattacaggcattagccaccgtgcctagccatatctttgttaatttgatagaaggaaagtgttgtcttgtttttttctttaaattgttttcatcaatttggacctttaaatatgtttggttaatgagatatttgcttctctgcatagtctgttccatgcatcacttgttcattctgtctcctgggcatgttcacatgcattttttaaatttgtcacttgcctttagattgtgtttataaagtttttgttgcaaaaatatttttaatcttacgattcttttctggaaagtgtcattttttatctagaaagcttcttgagagacacacacattcacctacatttcttctcttttctatctagttttacattttttcatttatttctttgatctctgtcaagtttacttagtttctggcccagagtaggaactgagttttacttgaaccaaatggctatctatctaactaggactaaatatttcttttcgtaatgatgtgacggtcactttttaagtatacattaaattgcagcacatattggagcctgcttcaacaatttctctttgattcctattgatgttgttctcttgttcggcatcagctccacaccagagttttattgtattgaaaattcagtcctttttattttgcaacatttgggatttgcttctcattggagtaccttctctgaacaccagatggcatgagatcattggccacatctgggccagtgtatcagaaaaattgttgttcaagagcaaatgtgaacctttcaaagatgcagacacccattctgtaacacaggagtggttttccttcactctttgagttttggtagcttgtggatgtcctgcagtaagtgattagagctgagttttaaaatggtttctgtttattcctttgccacttggtacatatcatcaccggacatgtttgtcccaacagtctttaatgtattcccacaactgaaccatttcctctgaagatttttgttgtatggttttgttttgggactctgtgcagtcttgtggattgatcagaatgtcttgatgctttgctgctttatagagtcagtttatctgtttctgtggaaccccatctcaattcctatgaaataccttggagcaaaattgggatgttttctattcctgctgcgtgtaagaaaattgccttacacccaaccaaacatcattggcttgaattaaatgtagcatgtcttctatttgcttgattggggcttctcttgagggggtggtttttatcaagtgtttatttcttttcttttttttttttttgagatgggagttttgctctgtcacccaggctggagtgcagtggcgtgatctcggctcactgcaggctctgcctcccgggttcataccattctcctgcctcagcctcatgagtagctgggactacaggtgcccgccaccacgcccggctaattttttgtatttttagtagagacggggtttcactgtgttagccaggatggtcttgatctcctgacctcgtgatccacccgccttggcctcccaaagtgctgggattccaggtgtgagccaccgcgcccggcctatcaagtgtttatttctataccacgatgatacttgctgtgtttcaagtcactcttttaatgtatttgtttcattgtctgtaaagttggtaagagatattctgcctgtgcgcacgttgatgtgtgttgtgtattcccacatgtccgtgatttactcatgtctgagttttgatttcagtgacagttagtcctatcacaccatcattccttgctgagtttgaggcagggagtgtggcctgtcatggtgaagggtgttattcttgagactctctctatgtaacaaattgccttgaatctcagtagcaaccatgtgttcgtgaattctgggagtgtaagtttggacaaagcccaatggagttggcctgtttttgctgcatgctgtctggggcttcacctgggaagagttgaaggttgggaggacttggctattggggtcctatctttggaagacttgaaggtttgttgattcccatattgtgtgtgtggaatcaggtgtctggaagatgaagatggttccacatgaggcctccccatgcagcatgtcttcctcatgacatggcagcatcagagtcactaagctttttatgtggaagctcagggctccaggcacaagggtcccagcacaaggcagaagctgcgtcatcttttatgatgcagccttggaaggaacactgcaccacagtggttgaagcagtcacccaattcaagaggaatggggacagataccctacttttttattaagtaccacagaatttgggggctattttgtaaaattactgtagttctgaagcctttagagtgaaaacaatctgggttcaaggctcagctctgaactttctaactttcctcatcctttaaaaaaaattttttattacatgtatttaaggcacaacatgatgttttgatatacatagtgtattagtagtccgttcttgcattgctataaatacctgagactggataatttataaagataaagagccgtcattgacgcatggttccacaggctgtacaggaagcatgatgctggcttctgaggagcttagaatcatggcttccagggagcaagcatgtcacatggtcagagcaggagcaagagagagagagcagggaggtgccacacacttttaaacaatcggatctcttgagaattcgctcactgtcatgaagacagtaccaacagggatgatgcagagccattcatgagaaatccaccaccatgaccggatgacctcccaccgggccccacctccaacattagggattacacctcaatatgaggtgtggatggggacacacatccaaaccatatcacatagtgaaatgcttcctacagtgaagccaattaacatatccatcatcacatagttacttatttgtgtgtggtaagagcacttaaaatctattctcttaatacatttttaatatacaatacccttccattaactagagtcctcatcgtatggtaggtctccagactcactcatcttacataactgcacctcagtgccattgacctacttcaccctatttctttgctccccttcacttggaaaaaagtcttctactttttgtttgtgtgtatttgatttctttttagatgccacatatgaaagaccacatggcatgttttttctatgcctggcttatttcacttagcataatgtcctccaggtttattcatgtcattgcaaatggcaggatctccttttataaggctgaaaagtattcctcatccttaaagaagcagtgtaaagcatgtctatctccttttgtaggattaaaggagatcattcccatgttaatgttattcttgaattttggtcctgttctatttttttctataaaggctggtgtctattttcttagacttagatttgtgcttaaatagtggcttgggtgggggattatttttagtaatttttaataaggagaatgcgagagtatcaataatcatgtatgctttggtaataatgggtttctggaacacagattactaatatgcatataggtcttgtagatttcaccctttatacagattctaagcaactgtattcattgattctctggcttactcctttcttatttttttttctcctctaaacctttctagtctctttttattgtagtattctagctgctgcctctcctctcccttttttctatgttgtcattgccttcttctaactttacatggggccctcgttttttggtgttacagggacaaccatgtatgaggtttctaagccgaagttcacacccttattggggtgaccaagaatagagatgcaggcatatgggagtgtttgtttgtttgtttgttttgaaacagggtctcactctgttgcccaggctggagtgcagtggtacaatcttggctcactgcaacctctgcctcccaggctcaagcagtcccccgactttagccccccaagtagctgggacaaaagctgcgcaccaccatgactggctaatttctgtattttttgtagaggttggattttgccatgttgcccaggcttgtcttgaattctgagctcaagcaatccacctgcctcggcctcccaaagtgctgggattacaggcatgagtcaccatgcccagcccaggcatatgtttttaatgaccactttgccaaaagccaattagttcaatcatctattcaaccaaatgaccaattcactgaaattactgaattcatcatgttaatatattgacagtgtttttcttcttctatttataaagttatagctattgatattcataaaaatattggatggggacttttaaaaatagcttttgaaggtctctggctcatcttagttgatgggttataaagacaaagccaaaagagcattttaaacaatatttaatttgtgtcaagccaaaacaataaatgatggaagagactgaatatgtcataatttaagctgcagatctacaaaggggaagtgtaaggacagaaaaagacaagatgttaggggaagaggttggggagggactgagagtaggagaaggcaggggaggcatgtggaggtctgggatggtatggggtggggctgaggaagttcaggggggctgtggtgcagggaagaatccgaagacccaggaagacctccttccccagttccctagacctgccttatgtctcattgtttatcctctatgagttgctataaactttataaatagttaaacaagttttagtaacattgaaaatttcaggtcactgatttcgctgtatattggtcattggaaattcttccagtaaattggactttggtaaattgcttggagctattacatctcagggtctgtccatgggcagaccttgcccgaggagccaatgaaatgttatacatggcaggtccatttagaggaaggaagtcaattgtatttgggagagaagttcaggaatagttcaatcagagtgtgctaaatggcaaaacatggacaggaaggccagtagaagactggggaagaaactgttctgtggttggtatcaaaaacagctgtgagaagcatgcggcccttatctgcaaaagaaagatgggccatgataagcctgggaatgtgcatgttctgtttattttggtggataaaaccactggcttggaattctgctgctttgaatctaccactatctgaagtaatatagatttttctctgcatgggagaagttccttctttctcagatggccgaggaaaaatgtcctgtaaatttccataatgtccattagggtttctgaagaggtcaattaaaagagccgcactagagctgagtagctcagctctactgtaagaggccagcagcacctgttcaaaacttagaaacaacgtttttatttttattttttctggtgtcaaagtcagaacttacagagtccatctaaaagaagctcagggctgattcttttcccaacaaaaagagaagatcctaaatatgtgtgtatattcagaagactataaatgtatgtgtgtaaatagaatagtcacttattactcttaccctattagataaaaaatttaaaatatatacgttttatatgtttccaaatactagttttgtcattggggttttatatatgtagctcagtgtccctaaagagctagtaaataattgttgacttgaatttgaaatcttaagctctcccaaagaaagttatcagatattcgaaaatgtgaacttagtgtaaaaatatggtgataatttcctttcaggagcaaacaactactttgggaaatacatttgattagaaaatttttcaagctaaagacaacatttcttttggataaattgcatggctaaattttataacttggcaaacctgctttgctgatagcaaataagtaagcttttcctacaaataatgcttttgtattcaacacagtggatttttagtccaaattaggaatgctagtttttagaaaatgttacatggtaagtttatatatatatatgcacagacatacacataaagtgaacattaaactgaatcatagaaatatatttatgggctgggtgtggttttatatttaaattacatgcctgtaatcccagcactttgggatgctgaggcaggcagattgcgaggtcaggaatccgagaccagcccggccaacgtggtgaaacctcggctctactaaaaatacaaaaattagccgggcctggtggcgggcatctgtaatcccagctacttgggagtctgaggcaggagaattgcttgaacccagaaggtggagtaggttgcagtgagccgatatcatgccactgtactccagcctgagccacagagcaagtctccgtcttggagcaaggcgtataagaattctgatgtcttattaattgaagaaagcaggtaaataatactgtataaagactgatccctttttgtgataagtgtacatttaagcatataaatttgaagtacatatcagcttattaagcttttctagatgggaatattttttcttttttaaaaacttttttttaaaaaccattgccatgagttatatcaaaaaaaaagcaaagagaagttgtttgtaattagagctgcattacaggttcattttatttgcatattaacaattgttcttgagctgttcaatgtgatattgactgtttctattcaccatttgtattggtaccagccatgttcttcaatagcactctcaaggtggtaagagttcctaaaaatgataagtaaaatgaaggggagaacaaaatcttcaaattctatagttcttggtgactctttcctgatgatagacttgagttgccatgggtccttactgagctgcctgttatttttattaattgtatctccaaagtggtctgaaatcctcaatgaatacaacagtaggtaaggaagcagccagtccttatgaggacttagtgatttttagtttttatacagctctttctttctaggacagctcagattattttatagaaatgttcccaaatcacacagaatccctgcgagaagtaagtaagataaggaattttctatcaaacctaagagacgatgatataaatttcacacctttagaggtggcaatagaagaaatactatagaaacaaattagtgtacattaacttggaaaatcaaagtaaaataaatgaatatttaattactgctgcatgcattgtcatacactcttcccctttataacttcagtagtgatactaaacatagcattcgtgaggcattctcagcaaatgaccgaagcctgctatcattgaagtatattggatcattcagttctcaaaatgatcccttgaagttgatagttttctatctcacaagtgaagatattacggcataaggaagctgagtaaatggcccaaagttatatagttagtaaaaggaacgtctgagactttaattcaccatgtacatctaacttcaaaatttattcattcattcatcacataagtataatccatctaccaggcatattaggcacctctgggcattaatcttaccttccaaaggagctttgatttggagaaatttaataatatactcataggtggtccaaataatgttttctatatttaaatacatttgtaaaatatggagtagaaaactttaaggtgttttttgattttgtttgtttagagagacagggtcttgccctgttagccaggttatagtgcagtggcataatcctagctcatggtaaactctaaatcttgggctctagcaattctcctgcttcagctttctgagtagctgggaccacaggcacatgcaaccacaaccagctaattttttgaaactttttttttttcggtggagatggggggtctcactgcgtcactcaggctggtctcaaactcctggcctcaagtgatcctcctgccttgacctctcaaagtgctgagattacaggcgtgagccactgtatccagcctgttatttgtctgtactgcatttcttaacatagtttaatattttactctatattatgaaagttctaagctgggaaatagtaagcagcttttctaaatggtttagatcacataccctttcccatccgtggagtgcccctcccatgaagttctatggaagtactttttaggggactttccgaaaccttgagtaggtccttcttgtggtctggtgccagctttctcctcagtcctcaactgtctgttgctatattttctcaactaccaggtttcctagctttaccctctttcttctttcttctaaattataagctgctgtcagatttatatttctaaaccttggctctgaacactttaccctgctgctcgtgagtgaacctgaatttccttccctcttcgtattaaagtaattccagatgagccaaaggcttaagtggtgtaaaaaaagaaaagaatataaaatcagtggaagaaaacatagctgaattaatttaaaattttgtacgacattgcttctaaacaggatgttaacctacaaagccgtaaatacaacttaggtaaatttgatgaaataaaaatgaaagtcacttattgtcagaaataacgtaagtctaaacaaattctgacaagacttatagtcaatggctgattgatttccataataaaggggctcatttaattccataagcaaaagacaaaaccatgggcccttcatattcatttctccagcagtttcattgttaaaattttcctctgcatataatcacttatggactccaaagataattatagaaggatgcctattgtagtattgtttgtactagttaataaaattggaaaagatattaatatccattatttagtaactagttacataaactaacacaatgcaatgaaaatatattcagttagttttttaaaaaacagttgatctacattgctggtatgagcagagctccaaggaatgttaattgtgaaagcgtgagtccactaaaaacaattctattttttttcctgtaaaatgcccaagaaactatttatggtgggtatattagacaaatgagaatccgcgaagagtactagaggagagattttacttttcatccctttcagagttgtgtgcatgtattacttttcttaaaaattaaaaaaaggagaagaggaaaatcacctgtctttattacagattataaactaaactccttattttgcttttataggctacttgggcctccgactcatctgttttttacaactttatttctcattatatgttcttcccttaatctctggatagattgaaatgcatgctcggcaccacaccgctctagtcattttgagtctccttccctccttcgctgttggagcacatgcctcctactggaatgaccttctctgcctgttctgatccacccatgtttcaactcccatcttctttattgcagcctccactggcactccagctggaactaatctttcccacctatgagccatcttcattcccaggttcacttctgttgggacacttccttcttggactttgtgttatatttctgggttgcctgctgccccttaggtgaagaagagcaggatctgggatggatgcaccatgtaacctcctggagtgctcagcatggagccacactcggaaatggccggaagctgtttgtggcacattagcatgcctgacagatgcaacatcgaggcagacatgatgacccgtagtgtcagtgggcaggagtagaaacaagggctgtcacatggtcgttaggaagggaagtgggtgcaacatttttagaggactgatgactggctgttagttttgcttagcatatatatatatatatatgtatgtatgtgcatatatatgtatgtgtatatttatgtgcatatatgtgtgtgtatatatatacacatatatatgtatatatgtactgctgtgtgtttggaatggagcaggacactcaggccatgaatgcttaacatgttgatagtctacgtctgaggctgagggactccttcaggtccccatggcagaattggtgacggccccagaatggaggcaccgtctctggactcctggcttcattctcctcgccgagtaccacactactacaagagcctcattgtttctgaagctcccagtgaacaaggttaaagtccacccattcaggtgtcatctcatcatttgtataatctgggagttgcattcctgagtggccgaccccttttcagaagctgcctagttgagatgtcacttccctgacagtgaggcacttaggctcagagagaaaatcacaatgtgctcccccttctctcaaattttccctaacaattaacgcggcactaacttgacaccctctttccttgtttggctttgtaaaccccggtccctttttctattaattccagacattaatattttctttcacgcaactgccgccattcacccgtgaaacagtttgaacattatgtagctgtcaagatgcctggggattacccagtatgccttgcctgtgagaaactgacaccactgaggcctagttttgagatgtttattttgagagtacgctgacaagcatgaaggcctgatcccagagtggcaatttcatttaattaaaggcctctttttattatagttttcccccacttttttatatatatatatcagaatgattgttaaagtctgcctcgccagaggtgttctcttctgctgtaggagggagggggtgggcgactgtactctcactagtgagcatttcactgaatggctgtgaatgcattcatttttactgttcttctcagaactggcccgaacacggtgtgtgtgtgtgtgtgtgcgcgcgcatgcacgcgcgtgtgcatgcccaagtttaaaataaagactgatgggcttctactcctatgttctcaaacttaaaatgtgagatttgactatgtatatgtatctatttgcagcttatttaatttttgtttaaagttagtacgcttgcagtactggaaggctgacttctcaaaatcatgccttacttaatctagtaaggcttttaaaccatggctgctattttagttcgtagtgatgttaatgtcatttcaaatagctgggaaatgtagtgcattccattttcagtaatttttagtactggagctaaatagaaatattaaaaggagctgaaaaagtaaaagattgaagtaatgcatgatggatattaatgatttgataaatgttatgatacagtagcctaattaatttttgatataatagtcctagactatattggcttgacgttgctatcagcaattcatttcaataaatattctgggggcctatcttgggtactgtccaaggcacaggggagataccagtgaacagaccgggctgttggtctttgtatgcttattcactgtgccgtgtttcaaaattaactatagtattgtaactccccaaattagattttctttctttgtagcgttatcagctggccttcgtttatctcctcattgattgctcattcatttgtgcctcctccttccaccgttcactaggtagtaatgaacaagtgtattccaagcattgtatcatgcgacgcacatgcatgtaacacacgcacaatacataattcatgtattatgtttgcaggcattttttttttttttttttttacttccattgatctgaaaaatgtggaggagggtctgccatcagcccttctttttgctttgggcggagtgactggagggacattattcatttcttttggcgtctgtttcaaagctcccagggaggagccgggcgggtcagcggtgtcagcactgaggccagctgagggcctggctgatgtggagttcagctgccctggctgagacaatgttggctgctttagtgcaggtgcggggacgcagcaaagaatggcaactttgtcaatttaatctctacgcctccagtttcacttgtagccccatcgtgccatcttttgagccagtgattccagagattttatttattatgattatattttcaagtataggattctgttgaatcagccatctggctaaatgtttgaaactgatttctttcacttttcactgacttgctgcagttcctaggagagggtgggcttctccctaagactactgaccctgttagcttgtgctggtagattttacttcttgaatttttgcgagtagtataggagtgacctacccacaatgaaagaaaataaaaattactcaaagagcccatttatattctaccactaaagggaaaaaatcgttcatttaccccaaattctttcatatctccctgtcttccatctccgagccctttaatctctgtgcagggagacattagcctggggagtggggaaaggatctttatttaatgaaagtcccaggcttttacatgtattttaaaattctgtcttgttttcttttccttttaaaggcacaagtgatccttatgtgaaatttaagctgaatgggaagacgctgtacaaaagtaaagtcatatataagaacttgaacccagtatgggatgagatagttgtattgccaatccaaagccttgatcaaaagctacgtgtgaaggtaatcacagatagctttcaaatctgctcctttattaaaaacatttctcagcagtttctcatgtcctcttagacgtgaacttgccaaaattaattcttttattaggacagattaaaaataataatatagaaaaaattccttatactgtttgttgaaactgtatgtttctcttcaatcaatgagatacactccagtgaaaataatatctacattgattgcatttcagtctaccaaatgtggaagaattattactggtactgcagtggtgacaagtactaaagcctttctcattaggaatatctttatacttaatagagcttcaagctaccccttgtaagcatcaattgctacaacatctgggttaaaactgcatgagttgagtgcaggatgagattgctatagaaaatttagcaaatttctatttaattggcagatctgctcactgtggaaaatactaaattttaatgacagactatttaaactacagagaatggtccattgtgcataacatttcaatggatataaatactgccttaaaagaaattgttgctgttattttggtcatagtaggcaaaatgggcaagattgaataattttgttctctgcattggcttgactaaatttctctttaactatactatgcaaagtatttcaagatctgaaagactgatttcagaatttccaacctattgcatttgttaataatttgaaaaactcagttggtttaccataataatgtgttaattgacctctgtcctctttgtaggtatatgatcgagatttaaccacatctgatttcatgggttctgcatttgtcattctcagtgatcttgagcttaacaggtaccgtatttttacattttaattgttattgatgagttttagagggaacttacgataatgttaaatggtgcttgttgaggtcaaatgacaaaaataacatatctgaacaaatgaaagagagctttaaagtgttataactgtcagtgtatttttaaggatttttgctttccaggtgccaaatatattagtcagatgttaagtattttataatgcattctaaagtgtgtattggatttcatactttgatttgttaatattcagtttcattaacataacttaaaattaaaacaagtgtttacattttatttgagtggtaggggagggggatcagttaaccaactgttgaattaaacaatgccaaacagtttctctactctgaatataactgttttattttcactaaattttgtgctttcttaacatcatgtctaatccttattcagaggtaggagacttttaccataagctcctgatgcgtgtaggtcaatacagtcctgtcaataagtggtagcattatttgttgctttttgcttgtagaacaactgaacatattttaaaactggaagatccaaacagtttagaagatgacatgggagtgatcgtgttaaatttgaacctagtggtaaaacagggtgatttcaagagacacgtaagtgggaccttctattcttttgaaacctctcattttgtcgttttgaaatggctcattgcaattgtcccttgatagctagcagatgactgatgtttttgcaattattttagggggggtgcaacattttatggagtcttaaaatatctgttttttaatacaatgctcttctttgaggaaccggaaaggaaatttgttaaggaattatttcttttgtgttattaagatgatcaggcatacatttgcagcattttggtttcttctttcttcttttacttttagctaccaagttttccattgggagttcttttgggaagatacaaattttaatgttctctagtctagtacatgcaaatttctagttgatacagtacctatcaaagatgtctgtaacatcagtgaagcattagactttgtcacaatatgattgggactcttcttttgagcaaaaatgtggatacaaatcataatcttattttatttgggattatattttataattctaaggctatattagaacaaaagcatctttgatgatgacttatttgaaaagtatttttaaagccaattgaagtacctgctttttaagatgtgttataatttagcatgtttataatccaatataaaaatataaagcctatttataattaggtctccagtaatgcttcttgaattgaggcagtggggtgggtgaggagaatatttttcttttgacatcacttatgcttctagttgtagctttttatgatgaaaaccgtgattgatttactagtaaactcagagaagatagcttaaagcagtaggaaaactgtagtgtgacttttcagttaccttttcaaagattcaactaaatatctgctatttttaacttgagttccttttattacttctttttaaaaagtggccctgttgacacttgtgacctcaataaaagagatattttaatgttaaaatgtcttaaattaatgttgaaaataaaagtattttttctcatcccacctaaagaaggagggattttctttagcttcttcttgatcttgacagcattgctgctgcatccgtgactctggattcagtgtcagtgatacagtaggtgaccggtgacttgagctgggggctaggttatagcatgcaatgtaaatagttatttgtcacgtggttgacaacttgccagctgatatcgtcaaaaaatttcttatatattcaagtggggcttgtaaaggtagttgatttctccatgaaaatagctgcatattcaaatgactgcctttgtgaagttttctatagcatattagattatgtttagcagtaatattggcacttaaaagatatttaatattgtcaaaatttagagttttaacataatgccattttagtttcaatttatttcaaattgcagaacagttaatactagactcagcttggagctgtttttgtaaaagatctcaaagagactatgttttcagggctcaagaatagccatatttcctcttagtgtaggcctggtttcctctgactccccacctcccatgttgaagactttgtcagaatgtctgtccgctcactcatgtgcttccttattttcttttgtctttgtctggcagaagcctagtgtacactatattgattatatatacacacacaaatatatttttatccccatatatacacacacacacacatatatatttatatatacacaaatatatatttgtctccatatatacgcatatttatctccatatatacacatatatttatctccatatatatacacacatacatatatatctctatatatgcacatatatatttatatatacacacacatatatatctccatatatatacacacacatacatatatatttatctccatatccatatttattcaagttgggtttgtaaaggtagttgatttctccatgaaaatagctgcatattcaaatagctatctttgtgaatttttatatccatatttatgtatatggagatatatatgtatgtgtgtgtatatatatatggatacatgtatatatacacatatatatggatccatatacatatatacacatatacacatatatgaatacctatatatatatacatatggagataaacatgtatatatataacatatatatatataatggaaatatagacaactgcctactcttatctcttctgattggtagtttttttccatttatatatttgatcaaagaaaattaattgaggaataatttattctgggccatgtgtggttattcagctaacagtgcatattgggagccttggggtaaaatagattatcagaatctttgttcttttcattgagtttgagttaatatttaaagagatttttatattgggattttaagtgggaataactagcacttgggactggaaatcagtagattatttgggtgagataatttgtttataaatttccattttaatttaaactctgatggagagatttcagtttaaattctcagttttttacccctttttcttccagtcatctttgaggtagcctttgttgctttagaaccaagctgacaaaaatctcagtatgtacaaaatgtttatgaatttactcttgtgtccagggacttaaatgtatatgagaatggtgcaggcagaagggaagacactggctgcaaggctgacaaacatactctgtgttctttttttgtggcaaaaaacaggaaaaaaatagtagctaaaattaggagctctgttctcagactgcctgggtctgaatcctagatccaccagtggtctggttaactcaaagaattatttaacctctctaagctataatttcctcatatgtgaaacaaggataaaaagagtgtctgttttatagggttgtgaagattgaaattatcaaatatggtgcttggaattgggtagagacactcaatatatggtagttggtagcattgtaggaagtgaatagtaatagtcattttccattaatttatttacatgctttatcttgtgtaattgttaaaaaatatcaaatgcgttcctatgtgtcaaaaggcctaaatagccctgtgtacctaaaagatggtaattaattttggtggttggtttgggtgaaaatatctgtcactatttcaggaaaatacaaaaaaaaaaaacaaaaccctgatattaatatccaggttatagtacctataactctgtcataggctgaatgttgaactcccaatatcactgggggacatgtaattaatgaagaatatttttcagtcatttctgtaccaacatttctagttgctggtcaatgcaatgtaagtggatttcccctgaagattattaattttctggtttctaatgtattgggaagacatattggcaaagtggatcggtcatttacctaaaggtatttttttcttaagaaaaatagtaaatgtggtctgctcaattaggtttataattgagttgtaacctcccaaatttatccaagttgtaacaaccagttagcttgttaaccagccacagtagagctttgcagtactgaatggtgacaggagtgatgagagggttttgcttggagagaatttgtagaccaaattcagcagccttagcatgacagaggagagatcagaagagaacagtggtgaagtttcttgctatttagaaatttttttccttttccttagatactgcattagcacattttcttaattatgcaataattattcatattttgtctagtgttttgaatactgagatttacttgaagtaaatggaattatttttttctagcatctaaaactatggaaacctaaacatcaactatcagtggtcatgaatttcttaaacatttttataatatctgagtatttcaagcagaagaaacctttctgcttttttagagagaataatatggtgttttaagataatttttaaaaatgtacttctaaagattgaacagtatttttatgtcatggctttttcatactgaatacttagagaaaatgatgtaacacaaccacatacatgtgactctttgttgttgtttctattttcttgctcaaatatgctttctctataacctcagaacttggatattaattatctgaatgtaacctggaccatctaacataatataattacattgataatgattctatcttcctctgttttattttgccattttcaccattccgcggacacaaatctttagcgttggtcaaatcggaagcgattaagtgccagcaaggtaaatatacttttttttcctttagatcatttggttaaaaactttgtctttgtagcaaacaaaaatgactgcatgatagatattacccaatctttacatcaaacagaattcttttcctcttactgctgttacgaataagaaaacaaccttcctttaaaaattttatttaataagggtattgccagatgtttgagctgactcttgttttagtggtggcattttatatgtaccggccatgttagagtgttacacttcattaagcttggattatttagagtttagcatggttagatttagtccctttaggaagttatttgccatgagatggaaactagcattggtgttgtaggggcaatgtaagggttgaaagaaacatgtggtacactttttaagtctctttaatatcttttgaaaaagccatttataaatttttggtaaaatttcctttaaagctttctcatgaattgctggttatttagtttttacattgatagtatctttttaagcaattatacatttctgtctgatttataaaaggcgcaagaatgcattattaatttatgaagttattaaagtagccagttgtaacataaatgactaaatgtgaaaattagtgtaaaaataaacacagcaaaaaagtatttgtaacttaatttataaattaaggagaaattatactttgtaaggagaaataacaacaaaataattcctacgaaatgatgcagtatttgagactgttccttcagtttctgaattgtggtggtggtggtgtgtgtgatcggaagatgtacagatgatctcggtgaatgcctgtatttgcacacccacatatatgtgcacataaatacgccagctctgatttctaatgtcactgtacctcagttacttatttctctacataataaggagcttgaaactggggccactgccagctcaaagactggagtttggatgcggatgagagaccgagagagcgaaagagagaaacagagaattttaaactgacttttactagtcacttaagaagaaagcaaactttcaaatcttgcttttgaaaatacgaaggaaacagagttctgactcatacttactaaaagatataccctttgcattatgaacactttaaaataattctcataaggtgtcttgttaccgtatgagttcacttggttcccaagactctgattctttttagtaataaaattaatattcaagaaataataacacggagccatctcaaaaattccttcaacatttgccttattcctttatagtcactagagggtagaagaacatcatttctcaccacaggactaagcccagctctcactctcccatattaagagtttctgtaaccacccaaagcagtaaagtttcccagaatgctttggggaagcctgacaaagcagtattttctcgtttattgattctgctgctgcactaaaacacgggtactgtacatcaataaccatctttagttagggagctttggtctgtggaagagcactggcagtttgtggaagaacataaaggctagaaagaaagattgtgagcctggggaatattggagtctagggaggacaggagaggttgtggaagaatggccaaacgaatgatggggagtagaaaaaatgttgacggcctgggtgaagttatcaaaaatatgaaggaaacagaagatcccggagagcagtatttatatgtatacttcagagttgtgtcttagaactgagctgtttgtcttttttttgcttttttcccatcatggtagtttctcgaatttgacttcagtgcactgggctcagggatataatacgcgcccatcccgagtatacatgtttaataaaatcctagataaataaagtttactttattaatttttgaaagctacttatgctcttattcaaggcacacaagttatattttgctgggaaatttcaattatgttgactttttgcttctgagaatgtacagttttaaagagaaaagtcaggtagtgtctaatttggcttatggaaattagtcacatggagactatagacgcttgatcaacaacctgtaaaagtagttaaaataccctggtcggcctattttttggtatttttaaattatcaggttctattttaggatttccacattgtatttaatattatgtaataatttaacataaagaagattacttagctctgagtattaaaattttcactagtcctaaggaatgtattacctaaaaatatcattagctttttcacctgaatctttttcttataataactttattcagataattgcttcttaatgccataaatctataattttgcatcatccaaaaggttcctgaatggcctttgtagattctttttttcaactgttttcttactgttcggccctggatttcaatatagtaaatacaatgagattgcctttaaaaatgggccttcaaataagaattgggaatttcatttaatagggttgaattcgacacctagttctctttatgtatttactatatacaatctttggtgtgaccagatttgtttccaagccttatttcccgcttttctaatttgtataacaattcgagagctaaaaaatattaacagtggttatttaccttacatcaaatagtctaatataaagacaaaaaagcaatgataaaaaatggctttgacaaattactgattgtgttcagaaactgcacatattctgtctctctctctcacacacacacagacatacacacacacacacacatacactccccacaccccctgctattatttgggtgtgtataggtgttatgtctgactacaatggctatttagttatggattatctttactttagatgaatttttaccaagataagtacatactcttacgtagcctctcttttgaccctctgttatatgtattaatatgtctgctgtctaaagtaagaaacatgacttatactagtgtaatttttttttctgtacgaaattaattgacttctagtgccaattgttggcctgtttggttttatattcttttattttggttcctctctgttattgcaaaggctgacctctgcaggatacattctctaggcactcctatcagctggcctccacctggctacatacactgagaagacagtcatagcatttggagggaatcaatctcccttcccctctccctctcctctctcactctccatcccccttctctctctccctctccgttcccccttccctctccatcccctctccctctccccctccccatcttcctccccctcccccccttcatttctctcctctcctttctctctcctctctctctgtcttcctctctctctcaaatgaactgctccgtgaccagagcccaggtgagaaccaggagacgttttttgattgtttgtagtcatatatctttgggttgaaaaggagctactcaaagatgccacttctgtcatcttctaggtgaatgccctctctcactgtaccgctttctctaattgaactcacatgtcttatttctgtgttggcccaggaagtagtacaagtaaaaccctcttgcaggaggaaatatggtccatttgaggacttaaaggaagtgtgttgtacctggaattattcccaaattaatacagttttttttgtttgttgtactgtttttttgttttcatgcattcttcactgaattcaaatgcccactcctagtaacacctgttacctttttattttcttggttaaactcaaaggattggagaactgaatactcaaaacagccacatttatctatgtgcttattgtacacctacctctatctgcttgtctgttttccatctatgatctaatttagctcatctatctaatttatctacccgtctctatctgtcttctatctctatttcatctgtcaatcaatcaatctaaatgtcacactgcactgacccactgctgaatgtcgtaaccctgatgcttctgatgccttattatgaagtctaggtcagtattaacctggacagaatgacttctagaggctttcctcctccctggaagctgtagccttgtttaggtgaagctatcaatttatcagaactttcaaagcttgtatgtactccacaccagagggacagagggactgtcttccttaacatctcatcaaatctctcctctcagtgatgtttgactcagtttgccccaaaacctctcactgagcacatacacttgcggtagaacctgtccttggatacagggtgaattagactcagtcatcagaattgatgagcaggtaagagaaatgagaattagtgacggaggtattcaaagggtgcagtgagaccattatcctggcctttcaggtgggtggagtgggttggacgctggtctctgtgttgggctcaggaaagccctcagataaaaaaagactggaggctgaggcgggcggatcacgaggtcaggagatcgagaccatcctggttaacatggtgaaaccccgtctctactaaaaatacaaaaaattagccgggcgtggtggcatgcgcctgtagtcccagctactctggaggctgaggcaggagaatggtgtgaacctgggaggtggagcttgcagtgagccgagatcgcagcactgcactccagcctgggcaacacagcgggactctgtctgaaaaaaaaaaaaaaaaagactggaatgaatctcatcagttgagaaagaggatgaaatgaatggaaacatttcaggataaaataatgtggcatatggtaagatctccaaactatttattgtaggactctaaacagcttgcttttcggtgtgtcccctggaccagccgcagctggtaatggttagaaatccaacttcctggctcccatcttagacttcttcaatcagcaactctggaaatgaggtgcagccatctttgaacaagtcctccaggtgactgtcaagcaccttcaagtttgagaagccctgggaaggactagagtataaagaaagatgctgggaactgtaggagaaaaagcaggagatgtaaggaagggcaggccttggaggccatggctctggctcctaaccataaggtgatggaggtaggctgggattaaggtgaggcaagagaggtgctctgggtgcaaaacataaaatggcatccggggctgggcacggtggctcatgcctgtaatcccagcactttgggaggccgagtcaggtggatcacttgaggtcaggagttcaagaccagcctcgccaacatggtgaaaccctgtctctactaaaaatacaaaaaatactcctgtagtccaagctacttgggaggctgaggcaggagaattgcttgaacctgggaggcagatgtcgcagtgagctgagatcacatcactgcaccccagcctgagtgacagagcgagactccgtctcaaaataaaataagacatccaggctgatgcaccagccctgcacttgcagaacctggagcatgagctgtgtacctcactgcttcacactactcccagccctcggtagggttgcttataaagtattttaagtaagaaatatagaacaatagagaagtgaagggtagcaggattatacaagtaaatcaagaaatacaagacgattaatactattgcacatgagcccaacatataacttgagcttcctacaggtcagggcaaaaagaaaatcttgttgaatcacatggcccttgttgttgtgttgttttatctcttcatttttttttttaaatagtaggaaatgcattagaagcatttcgctggtcctaaaatctgagagtcactgggtatgtgcagtctttaactatttttttaaatcttctcttaatctatttttatttttaagtacaaaaattgagtgacaattttatcttataatttaaaaatattaaatttaatgcaaagcttttatagctaatgtatttgtacacagattattcatatctctggaactgataccatttttatctacaagtataaattgcaacttctgtggacttttacatgtgggaaatttaaaaggttttctttttattctcatgcaaggatttctgtgtagttctaggagaatttatgggtccagtatcctcttcagatgatagagaggagctgcagagaagaattttccctgggagcctgttccatggatgtatggatcttctcatgtcatgcaataaaagctgttgacaaggaacagtagttttacatgttgaaaaagcttgaaaggaatatttcagtgaaacattttataggctcaatgttttctctttagttttcaaagcagtggtcaacatagttggaatctgactttactactcatttttcttacgaagttgatttttttaatgcatttgtttccattgactacttactttcccataatgacttaggaaaaacaattaatgacagtcaaaatgggatttattggcaccacgagaacactgatatgtttatccttctgtctctgagactatgtatggagtaccagtacattatttggcacctggcaggtatgctctggtcagtgccttttcttacttctctctttgttggttggctgattggtattgtgttatatgcaagagagtattttggagaattatcccgtgggtattgcttggcatcgtcagttctggagtgccacctagttgaatgtaatcttgctttagatggccgtaggctgtggctccagctcctgacttcatgccctccttttaggatttctttcctcctgacctctctgccactcttcctggcctgggacagataagaggcaccacctggcctcggacagataagaggcaccaagctgacctgtccatccttcctcagtttcctctgcagccatgccaaggaaaagggatactggaattcacatcactatctccccagcttgtccccaggcccaaaacatcaaataatgtatgccaccaaactgtagtccatttcatgtattccagcaatgacagtacattccctgttttagagtctagtcctagatcagaaacttatgaggattccctacctgtttgaatctgctgggtataattttagtcccaccgcaaagtttctccccttcctgcctcgggatggtcttgaacgagaagtaaattagtgttttcaaagctcttttacagaagttaatatgtttctaactggcacagcacaccttgttttcactattaataactagccagtgtgccttaagtggaagtcaccttttctgttttagaaaaatgggtggggatttggtgaggtgggggctgagaaagacagagcagatgaatgaatcaacataggaatagcgaaaggtctgatcctttgggaggaaggagaaaaataacaaaaccctgatgtactgtattgtatccattatgtctgctgagaaattagggtcaggggcccgaaacttttcactatctcttggcgtctgtttcagttcaggtggggtggctttcccctgtgatgggtcatttccttctctcctttcacattccaggctgcattaagatgacaaatttcacgtataggttcgggcacaggcatgaaaacctaagctattcagctgagtgagtgcagatgagttgatttattgtgagggaaaaaaggggtgtttgaagagcacaaaagacttttgcgagcccagctctgcaagaaagcacacaatagatggcccaggccctaccctgaaccccagactccctggtctgaggcctcatcaaacctatcaagtatggaagagaaatgttaaagtaattaagagacgtctttaaagtacacctcctccagcatgtgtggatcacagatgaaactttatttgaaaaataaccttatagtggtttgcagaaatatttggggtataataagtagaataaaggtcttgtgttcttttctatctgtgaactctgcaataaatacttctcctgccctccctttaggaggggtagaaaaaatcctggacagcagagagcaagtccatcagatcaaacatgactgcgttaaatactaaaatgttcaaagtccgactgagatagataaaagctttgatggaaagtggatatttcccagggacattacaagcaataatccagatgttatggtgtaatgcagcgagtgtccatggatagatcaggagctccagccaagtcgcgcctgctacagtcctcagccttgccctcccatgctgttccgccatatggaaccgatctctaggcccccttaataaccagctttggattccattttcacagagctcatagagctaagtggagctgttttatggacaagttagatagaagcctttccaagataaacatccaatttgaaattaggacataccaagccgcaaaattattttagggcatatttcatggaagtgctgccatttttcttaagcaattgccagactgtaggatgccctttgatcctttgtggacattactcccttttttataaaaaggattttgaaatagatgcagtgtttagggaggaatatatctgtcggaactttgaagcatggccgtgggacaggtcatgctttagcttgttggttggcaagtcaaactttaagaagaaaaaaagcaaaaggaggaattgcagcaggatatatgaatcaaaatctcatttttgttttaaaggtagaagtttttagcccatgtacttaataagctagaaaatgtattcagtatatcgatatctatataaacatctatagatatatgtgcatatatgcagatacatctatttatatattgtgatggtgtctgtttatgaccaatacaaaaatcacttaatattaactgtttcataaacctttattgagtatatctggaatatgttatttttatatataataataacaataataataatcatatattattccggatggaacatattcaataataaaggtttatgaaatagttaaaatattcctatacatatattcccatatatatatatgaagtaagaaggaattacttatgttcaccagagaagaggatagttctttctttttaaaattctttcctcatttgccccttctgttctgtctcagcacctgcagaacctatgtgtgtgtgtgtgtctgtgtgttttaagagaaaagtcacatggatattgatatggttagactttgtgtccccacccaaatctcatcttgaattgtaatccccataatccccacttgtcaagggaaagaccaggtggaagtaactgaattatgggggtggtttcccccatgctgttctcatgatagattctcatgagttctcttgagatctgatggctttataaggggatctttccacttcactcggcacttctccttcctgccgccttgtgaagaaggtgccttgcttccccttcaccttccatggtgattaagtttcctgaggcctccccagccacgctgcactgagtcaattaaacctctttcctttgtaaattacccgccaggcagttctttatagcagtgtgataacggagtaatacagataggaagtttgggaatatgtgttttcttgaatgtattttgtttaagattgtcataaatgatcaaaatacctagtgtggcattgttgcgtcacttattaagagtggtggagtggcctgggttcgatgaggtaagctgggctataatgactatggtactgacataccatttgttgtgataaattgtgactaactgctgtccgagcaaattggtgtctaaatgatctggaagatatagcgagcgatgacaggaatgaatatatagtgttagaaattcattgctcgacgatgatgctcagcaccatttacattcttcagcccatttatttctccttcaataaagaagcctatgcttgtgttatttcacttactgaacggacaacgtaaatgaactctgctaactaaatgcagcgtgtggatcatgtggggatcccgactcagacaaactagccataaaaaggcatggttgagaccatcagggaaatgtgaatatgcactgtgtatttaatatgctagacaacttatggttaacgccattgagtgtgatcatagcaggatttttatgtaaaaacaaatgtggattttgctttaagatatttcaaccagaaaggaatgaaagcataggtaaaataagatttgccagacagtgaatctggtaattaagtacatggagatttattatactcttctctttacctttgtgtatgtttgaaaatttacatagtggaaattaaaaaatgaagtgtgactactctatttacaacttataacaggacatttgcctttttcctccaaggtatgtatgagtgtgagtaatataatttagcaaaggaaataagagttaagttattgaacccctcctgggtcccaggtgcagtgagatgtgctttatacgcccccttccctcccacccccactccaggtctgcaaagctcatttggccagctaggccactggaggctctatttggactagtgaatcttacatggtatagggcttttggtagtatcccaaggaataaagagaagtggagacagattcaaatgtgaaggataaattcaaagtcattatttctgaatgcccagagatattttgcttccttgcaaggcaatgccttgttctggtataatatctctgttgcccagaatgtctttcttcctctcacactattaaaatagctaaaggcccagttgaaggagtcccaccaaagagcgcatctgggtgggagtaccggccagtgccaagtcaaagtgttgcatatactcatccttcactatattattaccactccaaagcttgagaaggaagtcacataactgtgacagcaggtttgcaaaaccaatgaaaaaaacagttttccccaggcagggaggaattttttttataattaaatactgaaagttggaattcctatgatcatcaaagtcactctcaggaattagaagcaagtttacatgtcatctttattttttgctttagtcctctttgatacgcaacctacggctctctgagtccttgaaaaagaaccaactctggaacgggattataagtataactttgttggaagggaagaatgtctcaggaggaagcatgacagagatgtttgtccagttaaaactgggagatcagaggtataaaagtaaggtaagttccatcttttccataaggagaacagtatctttaaaataaaaaaaaattaaaaattgtttcccactttaaattttacaaaagtagaagtaatttatgttcagcccgcctaactatattaaagagcagaaaacaaaataattgtatagatgcagtcaattaatgtgggtattgttttaattgcttagtacagtttaatttagtaactcagagctagagaaaccttattaaatcatagatttgaatgtctgacttattttcaatttgaaaataagcaaactatgtttcatagaatgtgggaaaaggataagtaaaagttttcaaaatgctacaaaaatagaatagcataatacgtgatatttgggttaaaatatgtgagataattaaaaatatttgctttctcttgcttgctagtcttcacgccaaaaatagtatctagtgctgctgttttttgctgggattaaaaataataaactatccaaagtatgaaaagtgatttattttaaacaaacataatggcattttaactgtctttgaaaataattcatcttattctgctgatccaaattccgtttaatttttaatcttagtaatttggtgtggattttatttcaaaaactatagtccctaaagcgtgataattaattagttttacataactgtcagacaggaatatttcctatgttttatggattgaaggagctctggggtacttgaaacttaaatcacttgccaaaagccacacaggaaaaaaaaaatcagtggacgattttgaaaatataaccgaggatatttctagcatcaaggatgcagcagatacagacaagttggaaaatgatttagggaggcaagaggttgtgcgcactgcacaattttcagtacagaatcaaatattacatgtcatctactctagcacaaagtagagaattgaagctcatgttgaagaatagtttataaaaaatgtgaaaattgagggtgtattaagacagaagtatgcagataattattttaaccaggtaatttcaggctttgcctcacagtgagggtatccaggataaccatatctctctactaagattcctttagcttgccagggtcaggctaaggatttaggaaaaattattcatcactaagcacacttagccatttggactaaggtgaagtgtagaattagttcagtatctgctacattcacccttggggaatactgcatttaatttgtggtctaacagggcttttcttgtttttttttttgtttttgtttttttcccaacctggtttctaaattctgtgatccaatatattaagcctgatgtgaaaaacagctgaaatgattttacatgacattggctacagccgaggtctgagttctctatgtttttctgatgcaagaatagttagtacggggatttaatacctcacactgcacccctagagcctaatactctgggaccaacattcttgctcactttgtattcacatatttaatctctatataaaggaaacaaaaatgaaaatcctgccaataaaccaaacgtagaagcagtttgaatcacttttgaagaacacagaaacacttgtggagttttcaagtcactctcgttaatttttaggtttggctgcagtggaatttcctagtctttctccaatcctagtaactggattcactaactttggatttaaaaataggtagcaatatacaagtcgtgggtttctcatttaatgcagctgacagatgttaattaagaccctaaactgttaatttatatagttagtaagctagcattgaatggatatgccaacaaaactgttacttgcattcaattaagcaattagtgtgatgtcctataagacagacaattgtaagatgtctgctgatatatgtccactgtgtatgtgtgtgtatatataatttatggtttcctgtgaggtaacagtactctttgtaacttggtggataaattattggatctggggggcagctaagatagtagtaatgttttgccagttcttgaacccaccaagtccctttcattctaaaaaaagaagtttacctttataaggggtgaggtccatcatcttgaccctctgcagtttaatgatgaaattaatgtgtagcttctgtagcaatgaatgacattttaagaaaataaatattataactgcatgttttctagacactgtgtaagagtgcaaatccgcagtggcaggaacagtttgactttcactacttctctgacaggatgggcattttggacattgaagtgtggggaaaggacaacaaaaagcatgaggaacgtctgggcacgtgagtcccctctgctttccagtggcgggagcatgtttctgcatggggctggttctgagaggtgatctttatctgttagggctgagggcactaccttgcatccctcaccccagagtgccatcagtgagctggatggccagtcctaactgggggaaagtttgcttttcatttttgtttgtttaattgggaaatgtcattcagtattgattaaaatagtgtgtgtaaggaattatctaaataaagttaagctgccatctcagactattcaaaacattttatataaatttccaatatacgctataattttggttttgctacctagcgaaatgttatataatttagtaaaggtctaaggctaggtgttcccatgatggaagcatttcgctgtccttgatgtactttatagcacaccaaggaatggagtttgaggccaaatctattttattttatttctttacttttggaccctctcaactgagacactcacatgtgtaatgaacaataatatcaatattattgcttcttcctagggttgtagtgaaaaatacaatgaaatgaggcagcataggtgctgtaacccgcgtacagtaagcaaaaaggagatgctggcagaagcacagatcatctctgagcttcagaaaagccctttgagttactggtatcatgctcattctatagatgatgaaatggaacttcagaagtttacacattacttagtcatgagctccagagtcaggattttgtgttttcaaacaccaagtagttttctccatcaaatcacttgccttgtgttcattctgtatacatattatttgtacacagatcttaaatttaaacacagatgttgaaagggatcccaaccactacggggtgtcttttccgaagctggatcttgggttcagggagatgccttaaggtcaccccttgaggaatgggagggcctccttgcacctctcctctgtggccagagcatctcagcttttgcctgtgctctgtattgggattccatttgcagaaagggttttgttgctgaaaactaaagattgaaaaccacttttctagtaaaaaccccttcattttacagacaaggaaatgcagaggcccaaggaagtgaaattttttttcatcagtaaggtgtttagaggcataaacagattgagacccagctaacccaatacctgtgcagggctttttctcagtaaaatgcttagcacagtgtttgactgcttcttgtcattgcctcatcccacctcagaatcctgagatagatgcgtgaggagttcagtacctgtggaatgttgctccggtgtctctcaatatgggtaccctgttgcatgggactgtctggcatgttgcaggatgtttagcaaacctggctctcacctgcctgataccagtaactttccttgattattgtgtggaaaacacacaagcatatgtgtgcacacacatgcacacacagcatccctttttttcatcacacgtgtccaaacacccctaggggaccagcactgcccccacttgagacctctcacctcaccctccacatctctggttgcattactttgcaccatctgcacatccccaattctatgcttgtctgttagattgcaatcgtttcttccctggccgtctcccagccaggtttgcatttaggagaaaacccacttcctgtggtcctgtggtccagtcttctacagacatggcctgtcggatgacttctgtgaccttgtctctcacttctccacacatacagggtgactgagatagctcaggctcaggtacttctcagtgtgtctgacgttgtcactgctgtgatataccaggaccctgccaatacggatggtagtaggatttgaaattttgtgctagccgaaagagcaaagatcaattacgcaaattcagagaactctgtgtcccaaagtgttatctgaacagtgggaacaggggcctcctgtgatgaatggccagcgtgttgttttagtaggtgcaaagaataatgcccctgcatttcacaagtcattgtgctgtcatgcttccttcacataataggaaacgcttttccaaatgagtgttgggttgcttcacagagacaaaaaaagtaatttaagatgtctcttgtaatccatgttttgtcatttgggtgttcatttattattttagctatttcctgtttataaccgagacatatacctgtcttggtggtcattctgttcttcctctttatgaattttaaagaattttttttttttggtatccttttcctttttcctctcctgtagtacaaaagataacaaaagtatctcttgggagctggtgctactgctttaccctgcctcgagcttgcaggtgggggaaatctacggtaaaatatcgactgcttctcagactgaaagattgtgctagcatatgtacatcactgacatgctacttatggttccttcttcctggctattgtttaaatatttcaagtttttttttttttttttttttttttttttttttaacacatttgcttttctttgtgatcttcattctaaggcccagctattttccaactgttgggaaaaacctttttgcatcaggaggctctctgctggtgcaaatgtatcgtaactctcctctccaaagcctgtctcatgctttgtttttggataaaaccttgatattcataattgaacattacagttaaaaatctagatggactctctggggaaattctcttcagggaagctgtgtaggcagttcagtgggagggaaggaacatcagctctggggtcacacatcctgagcttgctgataatcacactgtctgctaattgtgggacttggacagtgattccctgtggagtctggctctgtatctgtataatgggctcactcgccaactggcagggtcatcatggctaacagtaacaacatctacttgacactgtttattcccttgcgcactctgatggtaggtattacttattattaattttgagatttttctgcacgtaaactgtaggtcctcacaacttggcaactcaaattatgcaatttaagaaaataagatatgactagtaaaattcaatgtatttttttcctccaaaacagcatagaattttttgatattttttggtaaaagtgggcagtgaccatcgtcaaggacatggtaggaggggcatccattgatggaaggattgggcagtgtaggtcagcctgaacaatactgaagttttataaccaggtatgataaggctggggtagtggttgcttatgtgtagagaaatcacattggcatgggtaggttgttagcttggtgatggttaaaacatggacctgccccgtaggcccctcctccaggctctcctgagtcatgtggaacttgctgacttcccctttttccatagtccaccgacctgcagattccccctgagccacaagtaactcctaaaaacactggggttggtgagatgaaggtgcttgggtaagatcaaccatcgcctgaaactgtgttgcctaccgactccagtgtttgttcatgggcaaaacaagcaaaaaagcatctgatcttagatagaaacagtgagcttttagggaagagtaagacataaagctaagtttaaccggctccaacttttaaacataatgtcaagagtatgaatatagagtaatatagattattccattttgagccatttcaaagtaatcataccaatttcttaaagtatattttatatttcaaggggattctacagattaactcattatagaattttctagacttaatttagtttggaaaggttgagaatgggaacccacaaggccatttggactagcctgcctcagagtccctcctcagtcccagatggtgctgtataaagcagctctgacattctaccagtttattagcggctctgaggcagcgaaaaatctgggctggagtatttctctggacaaattgcaccccatgtcgttgatctgcttttacagccaggcttgacacattcaccattttcctcctgttccctggcttccttagcctctgagatttacagcttttaaaactctagcactcttttctgccccttgcctttgagttaaaagctgaccagtctgtaatataaaacatagaattatggtaatgaataagaggttaaaagctatcatggcaagtaaaacttgagcaggtttgtctgactgatatggtaaaattatgtgttgaattaaaacattaaaacgctgtgggattaatggagaaagacaagaatgggaggtcagaaacaatgctaaatcagcacattaactgcctgtgggctagagaggctggctttaatatatgccttttgcaggaaagggaaaaaaaagtaatttagtctgttttcttcaggtgagtagaacaatggcattttaaatctaagaggcacctagtaaatacatttatttcaattcctttcctacataggggaagaaacagaggctgcaaaagatttagttagttcaagaaaaaacagtataatttggagtttttgactttgtgagttttgttacggcgctgacattcattcttttgtgcgttcagtgtattcaaatcttcaaatctagagcacattgtatgctgggcagaaggcacagtacttgaggattcagtggacagtgatacagaaaaggctgctgtccttgggcactgatgagcctcgggctactacaagtaagcaggcagtggcagtaggtggaatgagggctgcaggtcctggcatcatggataccaatttgggcttagaatggaagcggaggcttccttgaagaacagcggtctaagctgagacttgtaggaatagtggtaattaacaagcagacaggaagaagagctttccaggaagacagcaaaacataggcaaaggtctggagaggagagagagcacattctctccgaaaaccttgatggagtggaaaaatcagtggtgtcacatgataaggctagagatgagggcaggggtgaaggcacaaagccactggattccatgtcttgcagatgagctatgggagttccttcctagacactaacacagcagtgacttggctattttgatttccatcgtgtaaatcttgttgttgcagtggagctcctattgattacatttttaaaaagctgatgttggaataaaaatttcctggtcacctaagggctcggtgtgttgcaccttctgaacgactgtccaaagacatttagtctccttgtgtgtgaagtcatatgtgatgccaccggaacagacctaattggttcatgctcattaattgaattccttatatagatgccctgcgtgtgtgttttccatattgtttctatcagacagaagagagcaatttttataggttttattgctttatccatttttattaactaacagatcattggatattttgaccagcgtttcttgagctgtcgtgagttaaaaaaatttacattaaaaaaaaaaagacgtgtaattcaccaccactaaattacaagtatttctgtagttcaggggtcagcaaaccagggcttgtaggtgaaatccatatggctgcccgtttttgtaaataaaggttttttttgggaaaaaaccttcatttgtttacattgtctgttactgcttttatggtacaagggctgattttagtagttgctacagaaaacttatggcccacaaaccaaaaatatttaattattagcccctcacacctgcccataacagggaaaggctaatcctgtaccctacccataagacatagccaaagagaggacagaaaagagcaagattttactggtcttcagcagtgactagaaagacataagagcccaaccagattatttagtattttttgcaagaagaatccattacactaatgaaaaagaagaagtctagattcttcttttgagatttttcgtgttaaaggtgtctttgattaatgtattatagaatgtttacgtcttaaagactttaaattttagtccatttgtctttgaacctaagaaaaaaacacaaaaagccattttggtcatttgatatttctcttttgggaggttggatgaatattttggttaacattatttgcaatttgagggaaaaaagcctttcttgttaaaaaaaattctgttgcttttctgataatgcagtaacctcttactaggttggggttaatgaaaataattctcccagtctctggctaatgtccagagcttctggttctccttcaaactttatgacaaaactggagcagtgtgagctggagttgaaataggttaaatatgaggcctgaagaaggttttgtatgaaatacattttttctgtctcccgtctttcctccttcttccagaatgtggaaataaatggggacaccaggtgggtagaagagttacagaatgtttataaaaagtcatcattaaagggggcctactatggtagctttaaattaattctgaacatactggttcatgtggtgggtcaggacctctaagaggctgggtcataacccatgtccagaaagactaagttttaattttgattgatatgatgctaatatcatgatgctaatatatcagtttaacttgttccttctagtcactgagaaagtacaagtaaatatttggctggattcactcgttagttatcaaagactgtaaaatccattaagctgctgcctaaatcttcaacctgttgctcaaaggactctaatatctaaactacaaatggctatttttcatgaaagtgttcattctagtgaagggactgatttttttgtaataacgtaagtgtaaaacattcacagtagacagaaatgagtgaaaagcttgtgaaaatgtgtaattttgagaagaaacccaatatttactttgcatttcatctggtatgtggttcagcttttacttaaaattgacaaactgctctgttccaataagttgagcacttaaacagtcgctaggaaaattttcacagttattccaattatggtaatactgctcacagcgttactagagtactctagaattaatatcaggttcattttgaattatccaagaaaaattttagtagcacttacttatatattatttttaaccttcaaacattattagctgtcagagcacttgtatctaaataaattttggctgctcaaagaaccaacaaaaccaccatcccaaaggcagatgtttaaaggacaaaaataaattgccattattaatggtattaaaaagaatgtgccatcaataggctattgttaatttgtaacattgtgattagcagagaaaacttctacaaatttggattatttacctttccataagaaagagctttactaaatgaaagtgtatataacagtgtaaaataatgcttagcaaagtattccgaagtagaaatattactgcaatattgctcaagaatttgtggggacctacttttctagaaataaatggtttaaggcaatagacatttctttctttccaagcaaatttgatttcccacttacatcatgcttatgaaataaaaatatttattaacctatattttcatagatagtaatgcaatttaactttaaaagcttccctattgatacagaaaaattgttttgattcaaatcagaggattatttaaaaatactttttttgtaatttgtctcccatagaaatatttgatgaatttattacatgcaaaagctctaatggccactcccacctgtaattggggtcacttttgataaataggaaataaatgcccagttaagttaattatatggacacatattggtatgtaaaatattttaaaatcttgtaataaagtctagtagagtcttttaatgtcatatttatttggaaaagtgattgctagctttctcttaaatttcttaaagtggaagttttcatccacatagccatgtggctcaaaattgccattgctttatatagtatgtaagttaacctatttgtaattaactgcaaatgtacaaagtccattgacagcttagggtaagaatctatccttattgttctctctggggagcagtgcttccatccttttctgaagtcttgaatattcatcttattctataattatggagggtaaaggagaatgtaaaaaaaaatgacgtctgggaataccatgccccactttactcaaccccacctacttcacccacctgcatacataaacagagcaggtgtggtccaggcaaacccagagttgtcagtgttaaggcaaataaatggcttagcacctcagtccccctttttggtgtttgcttctgtatttaaatgtgtttgaggttttcaacatccccagaacattggctgttaagaggcggaaaacatgcaatttatagcagatgggtacagcctttcctggcagagctgctgaaatgggatcaatcaacagcacttcatgctccatttgtccaaaagaaacccacctggggaaaccctgtggcactgtgcctattaggaaaacaccttaacgtgttttttaaaataaaaattcgccagttggcattaatcaggaagaaaacgatttctccattaaccctctcccacttgcctttctcttatctttttttttccttcatgttttgagccatgatcctttattctctttactcataaaaggcacagcccacggaagccatacagcatgcttactcataaggcttaaactttcaaactttttctttctaatttttgatcttatctttctgcagaccttatttggcaaggatccactcctctcttttcattttccatctgccgatgctgccttctttttgattttctggacctcttcctctccttaattttagagtgtgttaggctgggggtgagcattatgaattagggcaacctttgctgctcaataaacctaagaccagacagagtgagttttgggggatgatgaaatcaaagccaggtgctttggaggtactgcagtggccttgaattaatcacttttctctctcttgattcctgaaacttttctaggtgtaaagtggatatctcggcactccctctgaagcaagccaactgcctggagctgccactggacagctgtctgggggctctccttatgttggtcacacttacaccctgtgcgggggtctccgtctctgatctgtgtgtctgccccttagcagacctcagcgaaagaaagcagattacccagcgatatgtgagtgtttttccttattgtacactccccctcctcccaccttctcttttaaaacaaagtctttattgaaacaaagtctctgaattgaaaaactacatcaaaagagatctttgtcccaagtttccttgtacgtcataaaacaagacatcagacttaggggttaatgcattagtgaaaaggtgacagtagaattaagagttggttttgctattttgaaaggcaaaaagagattctgaatttttagcgtttagcaagtctttggggaatgttgaaatccccagggaagcagactcctgcttaggctgtgtgtgtgtgtaaataggacttttaatatgagttcacaaataactttaccagccattaatggttgcaatgttatggatacctttgcagaacttcttaggatcaagtgagaacctgctcatgccttgtaaagcaataacactagctggacatgaagaaccgctgttctgaactagtctggatgataagagcagtgtgtgatttctccctaagtagttgcaatgagcttaacagtccactcagcatttttaaatgaaatggctgtgtcctcttcatttattttttgtactctggctttctaggtgcctttatttgcattctgcttttatcctatcttctgtataaatcaatatgtttattttagtgccacacagggaaagcacgttttagggaagtggcatgaaaatgaagcaaagatgaatccctattcaatggcactatcattctcagcataaactttagtgtctccaggatccttcactgtgtagatgtattgattaattgaataattctgtatcttcgggagtacaagacctagccacatagctcattgtcaatgcagagtgcgcatgtgaggctggcatactgtgaagaaggtttgacacaactattaacattctctctgattaggtaagcaaatgaaaattaatggtgaagaataaaacctttccccaagctttccaatggataagttgacaaatttaccaaattcatgaggagttttgtgtgtttataaaggaacattagataccatcataatgcctgctttgaataatactttaggatttgaggagtagtaatcgaaaagaggtttgaagaggctatggtcaaagtagaaatagtgagtgcttcttcagctagcaagctagccagcacattagagggaacgaatgctgtttcaaagcacaagttacagccccctggatttgttttttaagttatgaggacagatcctctttaaaggcatttccacttctaaattgtaaaagcatttcatttcaaatgcgttctcttagtttaaaaactaattgttttgtttgtttaggttgaaaatatagaggagaaacaactttcaaatgtttttaggaatgatgcatattaagttaggcaaactgttattaagcttgtgttattctacctgaaatgcctaaatagcaagtattttaatagcctttcgtaaatccttgaggtctgtttatcacaggtttttagctatctaatgatgacagaaatagcatgtccagaggttttgaggcagtatctttttcagtaggtgtgttctggaggcaggagaagagagtttatctgccggcctctttcatgcacaatttcttaaggatgccatgtatataaacacccaaatattgctatatgtgcttaagaatgagcagtagatacattcagactttggctggtacaaactcaaggctaaagtaaatatgaatctagggtggtactagatacttaatctctaattcaatgagctagctaaaacagaccagaaaattcactgtttctgccccaactctctttagagtggtgataagtatctctgatgggtccaagtttagtcctctggaatccataaagtttgtactaactaggtcagaataatgttgtgtttcagagtgatttaacagttgcattaatgagaaagaagggggaaaaagagcatcaatgtaattctacccacacgttttcctggtgggatatctatgccatcaccaggggcgatgttaaaagtagattcgatgtgcttctaattggtttattttaaagctgtcgttaactaattctcagtcacttttcttttaatctggctgctataagtgcctaaccgtcctgttatataatatatttttggggatttttttttaaagatttcatgagaaaaaggaagataaatctaggatgcacttcctataggactttatgacattaagtagtatattaaaaagctgttttcacttgtatcaccttttcaaccctcagtgcttacagaactccctgaaagatgtgaaagacgtcggcattctacaagtgaaggttttaaaggcagcagatctcttagcggcagatttctcaggtacaggacattttcattttctaatttatctttatttatttcctgctttgaaacaatctcctggcaaagcaaaatgcttaataagcagaagtatgactataacagtcatgctccttcaaatagagtcatagcaaaaaagaggcagacttgagcaatttctttcacataaagcacctatttacacaattatttctttcaaatgattttatgctgattcagtaatattcaaatctattgagcttcaaaaacatttgtggagtatgagtcacgacttctttatttgttaaattaagttgttggtcaagcttttctatgtaacctcaaatgacagcgattcgacttctcgccttttgctgctctctgtgctgaatggttcacatggttcataaatctgagcttgaagtcagatctggctggcacctcatcgtaataatgaccagagcctaggccctgggatcactttgcagttgacattgtcttataggaagtttctcttggtgcttctgtaacttgaacttttagaaagaggccaaagcagacatgctttgtgctggattatgctctgctgcacgtagagtaatccagacacgccagtgtctgacagcgactccgcactcattgccaaattacccccttctgctgactaacaatttagccgcctacatgacagatgctatttaccaagtaaattgatgaatacaaagagtattctacagcatggttctatctattgattcaggattgcatggtttttaaaaatatatatctcatatttttagaatgtgggctactctttttcttcctttcagacaggaacaatttcactatattcgtacagcctctaaatttctgagactgagtttgaggaagttcaaccattggaaaagagaactttagttttcagcgcattatattacagaaattttaggaaatataaacttagttgaaaaaaaaaaaagttctcctcaccctgctcaaaaatgaagcaatagaaatgactaccctataagatgatcctgactagtgagaagatccaaaaatggtttttgggccaaatagaagatacaatttttgaggcttgtaggtgaagtactcagatgattgctcttaatattcactagtattattgcaaatgtttgtaatctcatgttaattaagacatttttctttttacttatattttatgaaaacagtcaacatttcacatgtgcctttgacattagtggttctgtcatccctaaagcacatttagaattgcctatgaattttccagagaaaattatttttaattccatgtaattgtttacatgcagcgcttttcgaatgcactgttgtttttctctcaggaaatgtctccagccccaagaactcatttatgccttccagcatttaaaaaaattctttctgtaagttgcatatatatatattttaatctccagtgactgattataatgcagtaagagtattttttgaaggcttgtttacaacaacatccatatgtggaaaccctttgttttttttaacccgcgatggagtcctgctctgtcgcccaggctggagtacaatggcgccatcttggctcactgcaacctccgcctactggcttcaagcaattctcctgcctcagtctccccagtagctgagattacagatgcctgccaccacacctggctaagggaaacgcttttgaaaaacttaatttatttagcctgttctatcaagtaacctccataaagcccccaaaactagtttttataaagattgtttcaggccagtgtatcatctccaaagagtattttgactattaaaatagagtgaataggagaggatacctgaagaaagagtctttgtaaagaccctctctatggaagaataattttgggagaaatgttttcatcttgttgttttatgttcaaggtattcagtagatagttttggagtgcatgaaggtaagtaccaacaaattccaataacgatagcagtagttagaaatgaaataatgctgtgtggttcgactaaatgccctggtgtttcactatttctgtatttatgagaaaattcttgctatagtgaattgaggaaaagtgatttgtcattagctaaacatgtgtttagaccataatggtcttcgtttttagaactaagtctcacagtctatgtttatacgttgtcaggctcctgtatgaatcctccagagtgttgttcccaccaaggcactgctttagggctacaaagtggacttattccagatagttgtaatttaacttttctatgtgaaaaaagaaatggattcacattaccgtgaggtagcaatgaatacctctaagaggtcagcgatcgtggcctacggtggggatcaggcattactgctgttatcattattgttaccaattcaaagtatgtagtaaaaaaataaaacagacctcaacagtgtcattggatcaggatcagaaaagccaaccatttttgtcagtgccaggaacatttaagaaataagtatttctactctatgccttccattttccagtcatcttactttataaatgagcgttcatttattgcagttgctaggggagtaaagcattcacccacaaattaaaaaaaaaagcatttactccggataaccagggacattctctaaagaatgatggtcattttagacatggtgcaaaagggaacctttcgttctttctgcttttcttttatcatatgtttttattttgtggtaattgcatgtttctaagaacaacatgaagtaaccacaataaatgatgcttcagtttagtttcacctaaagttcaggaatcctgataaagcaaaagtccatagggattagtcttggcagtagtccatacggaggttatagttaccgttttgggggcaaagggaccacacatcctggaggaggagtgaatgcatatggtaaactctgtggtcagtagtttcctaattttaaagacgtccacctcttttcgaataaccattagaaaaagaaaatataggtcattcaagccacgggaatcaaattagaaggatattccctgtgagttgttattgatgttatgattatgtagtcataagaaattaaactttggaaaaattgaatactcattactatgttagtattttagaacattagaataaaatatactaaggtgaatttatttctcataaagttgttttatctataaaggaaaatagtgtatacattttcaaatgtgttgaaagacatgaataagcctaaatctgtgtatattaccaggattatatttacaaatggtaaagtctttaattctgtaatgtataaaaaggtatatttactgtttttaaattatgccttttttaataaatatgctatttgattgtggttgaagctacctgttaatacatttaaatgtatatttatcttggcattttttagagtttctgacatttgtgtacaagagagaagactttattcaaagaatcttaagtaatctatcttctttggagcctgtctctctaaaattggtaaaagctattttttctcaggtctatgccaacgttagacgtggatagccataagcagttattctagtagaaaagcctgtcaaatgttttttaaagaatttgcttcacaaattccttaggcccagtgtaacctaacatttttaagtaataggtgatgcagcctgatgtcattacttttgtagtaaaccaggccacagccttgattcatgaaacaaatgataaattgtacttggaggctcaaggtgaatagctgtgtgtagtgtttgacaagaccaacatacttcactcagctactgctagtcttaaaatgcaggtattttaagaagaaaacaactcgcgttctaatgattaactgaaaaagagaaacattttattctggacaatgctgagaaatggacagtatagcaggtttcatacctacagtagaggcccagacagaaaattgtggtatatgctgcccaggggcacatctgatcataaattaatactgtcgaaagaaaatacaaagttaatctcataaactgtaaaaagagaatatagtaaacaatgggttaatgggaaaattgttagagaattgaaatgtttttcagtccagattatgttacctttcagtacacatgacaacacctatgttacccattgagagagatcagccaatgaagagtaggaaactatattggtttgctcagcacatgtgtgcagattattcaggatagccttattatagttgacagtatgctgctgagaagctgccaggattgtaatgtgttggggttaattcagcactaggaattgaaaccatcatggccaccactggcatgatgcatatgccaagattccacaccaaatcagtgattcttccttagcattcttagaatcaaaaagtgggttcatatagctaccttcctgttacttaagctttctctttattagttttattctctaaaataattattgtaagagacttccttccccataaaggatgttccaaaggcaagaggccattcttcagtctccctctgtttcacactcatggcccttaccctgttcctcccaggatgccccttacccactcagaatcctacataataggggaactggaaacttaggggagtttactttaactcaccatgccaagagtagcaacaaagcaatcagagcagccctccacgcctagctcggtgggggaggatatgaagtgacataacagcacaacagaaaatgcagtataggcttcaatatcctctctttttatagcacaatcccattgttcaatccgttttcacattgccataaagaaattcctgtgactggattatttataaaacaagaggtttaattggctcatggttctgcaggccgtacaagaagcatgacagcttctgcttcttgggaagtctcagggagcttttactcttgatggaaggcaaagcaagagcagtggagcaggagtcttacatggcaggagcaggaccaatggataggggatgctacacacttttaaataaccagatctcttgagaactctatcaggagatagcaccaagaggatagcgctaaaccattcatgaaggatccacacctgtgatctaatcacctcctgctgggccccacctccaccattggggattacacctggacctgagatttgggtagggacatagatccaaaccatatcactcatcttcatttttcatgtttccattattctaatagtctatatgttatgaagagaagctagggaattatcaggaggcaatggagggacaaaactggaaatatcatcttgactcacaatttggagttgcttgccttccagaattctcctggggatttttatttcacccttgagactttttggcaccctttgccattaaaaacaaacaaacaaacaaataaaacccagccatcaatcatgaaaagtttccaaaatatatctggatcctcttgatatcttggtaataaaggtgtcacttggacccttttctctttccgttgttaataaaggaaataactcccaaattagcataatctcaaaatatctatcagaggaaaaataaatatgtttccagacgagaaatctaggttattataaagtatccttatttgataaataggcatgttaggggaccataacaattgcctgatccaggagaataaagatacatttaattacagaaccactgtttctttccagagaacccaatatagcttcctcgaccactttttaagtatttctcaacttcaggaaagtcagcttgggggcagttctggtaatcgaccacagatattcattgagcaccacacttggttaacagacacacccttagggagcttgtgatccctaagagaaggctcaatcttcactctgccttcactcctctactgcaggacatgaggtgtaggaggtggtgtgtacctttgaaacagatggagaccttcttcaaaatcagggggttgcatttccagttcactggttccttggctatgccattaggaggagctcttggtctgtcccccacacagatttgagccgtaactgcagtaaaatattccattccttgggtaagtgcatgagccttttccatgggccctggattcagccttaactaaaccagtgtccagttcaatgatttattcactgaagataaaaattagtgcccatgtttttgccttttgtttgtatgatagctgtctctcattttaatccctatgtctaatgacatgggagatatacagaagcagagacccatgtgttaatctcagttctcccacatactggccttaggctccctctaagcctccatgtcctcatgggtattttaagggttaaatcaaatcctaaatgaacgtgcctgatatatattttgtgcttaataaatgtatttcccattccttattaaatgcattttattagagtatatttgatacgtgaagaactgtataggttgttttgttcacatattgtttataatttccctaattttagatcatgttagacatataagctgataaccacttttatctcttcagccacttttagaaatctagttaccactctaagatgtttctttttgtttctatttctattgagtgcttaaaaagaaggcaaaaaaatatgcttcatggtagagaaattctcatactgaactacttttgtgcttgaattttacattttgataatgtggataatagttttattagtataaaatagcttggcgtgttcatctttttgttgttgttgttatacaaaaaagtgctattgtcaaactgttgaccaaaatagggcacttagaccccacattatagagtaaaaatgtttctgccttgtactatgatactgacttttgagttgtttctggaaattataatagtgactacaagtttttttatattgctgtttttgttttgaaacgttaagactgcttgtgtcagaagaggaatagtctcatggttattgttcactgagttttcaaccacatgcccatattatggtttcatttaattgtctgtctcttgaagctgtatccatagcaatacttcgtctcttaaagatgccctattttcaaagggatggctataattgcagtttctagaaagctcagtagtcgtgattgaacgtttttaattttcaagagatcttcatggatagctaagcccaaatcaagaccaacttttgaaaaacacattaaaaactacataaatctgcctctggcaggccgtctgcttcaactgccttccagagaacatggactgtagccattgcaaagtttgggagtatatggatgacttagtggtttataacttagaggcaccgtgagggtgaatgaattcagctcatttgtgacattccatgaattaacagaggaatcgcttccatattaatgggtgggttcttagtaacgtttaaatttatttagcaaatataccttttctattctctgtgatgccttatgatttttcctggtgatatggtagaaaggaggaattggtccctgacctcatgtgaagtgactgatttaaccagtgactgtctaatttcaattactgctaaggtcaagaacgtggtgttaattcttatggaagggatgcctgactgcagataccgcaggaagtgatgttctagcagcgatgtcaaatagagacatgagagagagttggcaccgcagagaagaaggaaaggcacttgaaaatgaggaaacagcaatgttccagggcccgcccagctttttcagaggtctggaagaaagcaagcaggacgagaagacagaaagcaaaagaaacctctcaggggagaggatgttcatgtcttaggtgggactggatgacataggagcttctgggccaggtgaagaaatttggaaaactattaagggaatgatatgatccgatataaactaacaaaagtttattctggcagctgtgaggagcaaggattttgagaggagaatgaaaatgggaagatgttagacaagatcagtgaatgatgatattgttgaggggcttgagaagtagcagggaagtggaggtagaagaagaaaatatttagggccaagcgcagtgactcgcacccataatttcaacactttaagaggacaaggagggaggattgcttgagcccaggggttccagaccagactggtcaacatgatgaaacctgatgtctaccaaaaaaaaaaaaattaaccaggtatggtggcatgtccttgtagtcctagctagtcatagaggctgaggcaggaggattgcttgagcccaggaattcaaagttacagtaccatgagctatgattgcaccattgcactccaacctgggtgacagagtgagaccttgtctgtatttaaaaaatacaaataaaaaggaaactttcttatgtcactcatcttgtttgctctaggtgttagaatataggattatcagaaattaagataaataacattttagcaaggtgaagtcctatttttcctttactgttcttgcagtcctagtatggacctgtctgccccttgttctagacatctgtcacagcaaggtgagcaggtctttgcctgtgtgatgctgaggaagtcattatttgtcctagagaaggccaggacccatctggaaaggctggacgtacatgaaaagttaggcctagaagaacagagatcaacatttcattttcttttaaaggccccctcagctcctagcacagtgctttgcacattctgaggatcattaagcagttgttgaatatatgaacaggtacatcatacagcaggcattataatgtccaaactcattatcataggagtctggggtctccctggaggttgcagagaaagtgccacaaagaaggcaaggttaaactaggcctgagaagttagttttttgttttttgtttttttttttaatgttttccttttttggagagcaaggagattggaagggcacagagggacaacctattccccgtgcaaagtaggaagcagaaatgagccctgttactctgtgtgcaggaccggatagggcagcctagtgaagttaggagtggaggaaagagacaccaaccttgctgaagagttggtgaacagtgggtagataaggatgggttatgtggggtaaacagagagaaaatatagatttccagaactgatcaattaaaatgtgctccaatatctgatagtaaggtttgtaaacaaatggttggaaataagacatgaaaatagagttttagaaattttcatctggaatggctctgctgtcctcccacgtcccccaagcctctctgagctaaaatgctccatatttagtttcaggaattgtgttggtccagaagtgctttcttccaactctaccccttgtattgtattgacagtctagggtggttcctggctcctggatgagtagaatgaaatgaaaactactggtcatggtcttcaagccaatcttagtacctatccacctgtatcttacattacctgattatcgctatttgcctctctctctcatatatatacaaaatgtaaatatcatatatatgatatataatatataatgtgtaatataatatatgatatataatatatataatatatgatatgtaatatataattatatatgatatgtaatatataattatatgacataattatatatgacatataattatatatgatatatatataatatatgacatataatctatacttatatataatatatatgatatataatgtataatataatatatataatatatatatcctcctaataaatttgatgctttgacctgtcccgtctccacaagaaggacttatccatttctgctcatcaaacacttcccttgtaaacctcaattaagaatcgcctccactaagaaatctttctgaacttttctgaactgaattacatttctctgaactttcatgctctcgtctgcatttcactgctgccctctgtccctaggccgtagcactgttcttgggggatggtaagagcatacatatattgggtgtgcctgcatcaggacccttaagtgaatatgcatgctgactgtggagtggaaatttacaaatgtgggatataagagtagtaacagcaatatacaattggagatctgaaatggaaacaactcagtttgctgtgggatgagaatgaggaatcttttcttggaaggggcagcattttcagaatagcagagaccattatgagagtcccttgcagataattgcttaggtggtcattgtatttcagggtcagtttagtgctaggaacatttattaagctatatgcttaataaacggttatcaaatgggctgggcatggtggctcatgcctgtaatcccagcactttgggaggctgaggtgggtggatcacatgaggtcaggaatttgagaccagcctggccaacatggtgaaaccctgtctccactaaaaatacaaaaattagctgggcgtggtggcacgtgcctataatcccagctacctgagaggctgaggagggagaattgctggaacccaggaggcagaggctgcagtgaaccaaaatcacaccacttcactctagcctaggcaacagagtgagactccgtctcaaaaaaaaaaaagggggggttatcaaatgaatgatatgacaattgtaacacatttattatttgtcattcagcttctataattgatacaaaggtaaaactgtttaagtgaaccccccccttacttgccattcaagaaatacaaataaattttaaagcaatgttggaaaatagcaaaggctattgagtgcaaagtgctaaacctcaatgtgaaactgaattgtcagtggcataaatgtgtcaaggtgatgtggcttctggacacagaggaggtcttctagatgttattcctgtgaaatgggtggtacaaagaggaaaagcacggcctcaaatgtatgtatgtcagtctcccttgtccttttctctcagtaccattggtgagcatttggacatttcatttattatgagagatacttgttatctcaaataagaatatttgttattgaaattttactcaaagtccccatatatctgaaactttttaagagaaatcaatccataaaatgtgcataaattattctataaatattttaatgtctttgtttcttcttgcttctctctgtttatactgtaaaattaataaatgcagcattttaatgagctttgactgaattatcttcagagagttggtacaatgtgttccttggagacacataactgaagttcctggtttctggaggaaagtctgttcctcattagctgggacagctaagagcgtgcttgcttgagagagcgggagccacagaacgagcccacctgtgcctcaacaggaccaggcagcatctctgccctgctgtggagtaaccccagggttttcattaaaagtgtcagacggtttccctggagcaactgctgatggcgtgtcatgctggcgtctctggaggagcagcgctgacacctactaatagtctgacaaacggttaagtagctgtttcagcctgggtggagaaatcaagcatggtatacctgagcattaagccaaaagtatgtggtctcttcttgttcacagttgctgaagaggaaatggtgttgttctatgttggtaggcttttccccagctaactccagcctcttcccctgcaaaccacatggccagcgtaaactgtctttaaataaataagactttttgtgggtgcagatggatttttatgttagtttgattttgactccccagcatctaaaatcccttccgtgtttgaatcatttcccattgtatattttgaagaagaggtcagagcccactttcattcacagaagctacaaagtcagtattccctttatgagttctggcctttcaggcctgggtacttggctgtgtaagacaggccccggaggcccttgcatcggtcttgagtgaggcaaagaagcaggagtagagaattcatattggaagtgaattgtgagggcaatattctggggaagcagaggccacaacagacttttcctggtatgagatatgggctgagtttcttgtgcttaagtattctttggtttatagtgatattttttagcccgattctccagcctttgtaggaattctgaatgctgtttgatattattttaataaatttcttttccgctatatgtagacagggaccatttccattgtttgcaattgaaaaccctcactccttcctttatgtctgtggcttgatcattgtctactggcaactgaaatagtagcattgacttaaaagctttggcgaggaatctaagtgtccaggccactagtcagttgagtggaatctcctgtttaatactattcatcgcccatgcgtctgctcttctcctcctccctttttaaacaataatcttcatacaggctcctgcaagtatcagtatctctattgatgtgctgtacctcagagcgcctggttattaagcgaattagatggaggttcagtgacccgaatggtaggccagcaggtcaagaggcctgagcactctctggcttaggccctggcctgggactccttggccatttgttggaacagcgtctgtccttgtgcccccaattaatttagcaagcgctgctttgtaaagtgccagtgtgctgcagacgccggcaatgcgttaatgtcctacggacattacggagccattcgttctttccctgacagttccaaatccagatccttccgccaaacacagcaaaagggaagtgagttttttgcttggtaacactgtaggtctaactttggatctggaaatttcttaggttttttggtgtgcaaatatgggagatagcgtagaaagaggagaggtgagaagtgaaagatgagcttaatttttttttgttaagttaaaaactctgacctttattgagttatactttttttgtttgttttatgacaccagaaatgtagctcgtgtattctcataacgtactgagtatacaggatcatgagtgtttgtgaccatttgctcaggagcagagcttaactcctaaagagccatttttacactttttctcacttcctcttacagccatgtagaagcctgtaagttacaggtttccagttatagaatagtaattatgcagattgacttagaatttaggaaggaaacagagatgaacttcattttaaaaacaaagaaatgggctctcatgccaaatggattcccactcctgtgaaatgtgtatgtgtggccgctggctttcaaggcctggtcttgggtggtgtgttagtctcttttcacgttgctgataaatacatacctgaggctgggtaatttataaaagagggttaatggactcacagttccacgtggctggggaggcctcacaatcgtagcagaaggcgagtcacgtcttacacggcatcaggcaaaagagaatgagagccaagtgaaagaaaaaccacttataaaaccatcagatctcatgagacttattctctaccatgagaacagtatgggggaaaccgcccccatgattcaattatctcccaccaggtccttcccacgacacatgggaattatgggagctacaattcaagatgatatttgggtggggacacaaccagaccgtatcaggcggtgtgtttgttctaacccgttgagtattgctaaaggtacaacacttgtagcctctgcctgtctcctggattcccacacagggcctccatgactcattggaaaagcagtcttgccttccctctttcagcaagcacaactttatctgactcttgttcacattgcccttgtccctttcgagattcacttgtctttgaccgatgtgtatgttatctttccagggaagagtgacccattttgcttgttggagttaggcaatgaccgacttcagacgcataccgtctacaaaaacctcaaccctgaatggaacaaagtttttacattgtaagtgctttagcctctggaattatttctgctgtgcttggaaggtagtctggggctcttgagtggaattttctgtccatttttatgggcaaagagtaaattttattgtttttttcttttgaaaaccttgtatcctttcatttttatagagtgtggtgttaataatagaagagaccatttggaactgcaagggacttttataggaggcatttgtaaagtagatcttttagtgactaaattaatctatgaataaatggaagcttccatatttctaggttaattcattcgtgggttaaggaaatggagacctgccttaaattcagtgatcttatgtgttctaagatctgccaaaatctttaggaaaatacagattatctgtgactccttagagacccccaaaggctccttatattccagtttatctgagcgacccatcccatagtgattctctgcccacactatcaaacctgggcatttaggaggctggatagatttaagatcttagtttgcttcagatttcaaggcacctgaacattgaggggaggccctgttgaatttgggtaaaatggtgacatactgtccctacgaagctaaatcaatgctctgtctgtgcttataagtgaaaaaataaagttcattttgagtagagttaatgctattagcagaaagttcccaaggatctatgaaaagtggattaactctgctaaacacttttgccaatggccagatataagagtctcttgtttccctaacacgttgccaatggccatggctccatttttcattgtccctggtatctggcttctggtcaatattaaaatatgtatatttttagtattttgtgtttcaacaacagagggtttctaagcatttcaggaaatagtgatttttcaccaccattttattttaaaggtaattcttaattttaaaaaatgttaactcctttcatttggaagctttttaaaaattactttggttggacactctgctaatgctttctccctatctccttctttattttgtttctttgaaagtcctacccttgagtgcaggtatactgtttgaaaaatgtcatagtaaaaaagttgacttctttttttcatatggatgtctgaatcttctatgatggaaggtttgggaatacagtcagtttgatttaatttttggaatttaattaaatggtaggtttatactctaaggacatacagacttaattagtgaaacagtgtttccagatcttcatggaacagacttcacttgtgtgtttttgtgtataatacatggtatttttgttacagtcccattaaagatatccatgatgttttggaagtgacagtgtttgatgaagatggagataaacccccagattttcttggaaaagttgccattcccttgctgtccgtaagtttcctttattaataaacaatttgtgagtcattttatagttgatgagtttctatggtctagagttgctttatctttgtcaacctgggggaaaaaaatcctcctaactatagcaggaaacgactgttttattcctcattcttttccggtattttcagtagtttcagatataaagggatgtaatttttttctgtttcagtccaatattgacgtaaccaaccaaaacattttgaccagtttttcaattcattttcagtcttcccaacttaagataggaatttgtctttggttacaaggaatatagatgaatgactgattttctatttattaatgaaaaacacacatgtatttctttatagctccttactgtacatttcttcaaagattaattgttggtaactgcacatttgttctcaattcttttaaagaccattttcccaaaagttctatttgtctttttagcagtcatgtttgcttttggtctcaaaatttaaaaatgctttgtggaagaaagcagagggcctttcttggagaaggaaaagagttttcgcagtccagctataagataatgcaccagggtccgtgaaggaaaaaatacttacaaaattcagaagagaaagcaccaaagaatgcctttacatgggtcggggggaagctggggagtgaattcatctcttaattagacagtgatatatgtaccaaacatactctttgagaagagagaattccagtttttcatccaaccattaacacagtttgttttaggcttattatggctttatcagccaatgagactttattcttcccaaagacttattttttccaagctatctgtggatttttgtggatggagcactccgtaatttaaccatgagattagcctaactcacttgatgtttacagagggaggaatgccgtacttcttactatcttttcttctgtgtttgtgcacttggataatttctccccgagttctcatatccctgatgttactcggagagcctgtctgcagcatctgctccctggtacggctggctcctgccacatgctctgagccatcggcaccagccgagcagctctcagagaggagatggcaatttgggatttccccccctttttttttcattacaactttgtcagttattcccatgagaatacatgtaaccagaatgtgggggacactttagagaggtctgggggactcaaagcaaagactctccttgacagttttctcatttcactttttttattccttgcttggtgaacatgacttaaaaacaaaacaaaacaaaacaaaacaactcccctctgttttgtacctaaaagttttgtgtgtttggtctttctgtactaccaacaactgacttagctcgcctgcctgccttcctttccccaaacccttacccgattctgtctttctcttcttccctccttgtagccaacctaaaaaaaagtcaaagtgtgtggtggctggcatttaaagtaggctttcccaaaacattctacctcgtattttgaaggatctggtttgtgaaaagcattagcataggttactggttcttcctttttctctccttcctctcctcccttcctccttcctccttcctccttccccccttcctcctttccttcctccctctctccttccttccctagaagatctaagaagttacctccagcttaatcagggtttctcagtcttggcactattgatatttggggccaggacattctttgtcatatggagctgccctgtgcatcgtagcatgtccagccgtctccctgacctctacacactagataacagtaacgcctgcccacatccctgctgtgacagccaaatatgtatgtggatgttgccagatattctgagggggtagagatcacttccagtcaagaaccgctgacctaaactaatgcatttttcaaaacatatctttcaaaatacaaggtagaatgtctcaggaatgacctggcttaaatgcaaggagtcctcgattgggacttttttcagattggtcataagctgccttatgatctgttgttcattcgtttgttccacaaatattcatcaagtgtccacttggtgccaggcagtgctttaggtgatagagctctaacaatgaccagagggaggctccctcctctcttggagcttttgttatagtagcaggaaacaatgcataaacaaaacaaaagcaatatacagaatgttagatggtgaaaagtaaagagggagagggttgctgggaatatgtgtggggaagggcacttttttccagctgctagccagggagggcctcatggaaaaaggggcatttgagtgggaacgtaaggaggtgagggagagagccatgtggatatctgagaaatccctcccaggcaggaaattctcaagttcaagggctgtgaggcaggaccttgactgtcaaattccagcaatggccgggcagccagtatagattgatcaagtgtgcctgtggcgaacaggaaaggacacagaggtagggtggagctggagaggaccctggaggatgtgaaagtgaaaaaggttgaagtactttggcattttcatcgtgggggatgggaaaccacgaagagtttcaggccaggaagtgcttgatttgttccacattatgtgtttgtttctaatataaaagtgctgtgtacatccaggaataacccctgatctgcaaggtctctaccttgtaaaatagcacagcctgggccattcctttcagggacttcgggggaccctggcatggtgcactcagtaagatgcttcggctgctgctgttcactctgtttcaatccagattcatttccaattcctgactgataaattggggaagtgatcatatcttctagtgcatctgtgtgggctctccctgaaattcagtggtccacctgcaacattccctctccaaatgaattgattctctatctaatattagatataaatatgatcttaaaattgctgtaaccctcaatttaactggcaaagtataagctgtaagttgtttcatggatcattctattttcaaataattctaacttgtgatttagaggatgtgttttaacctacttatttagatctagtttttttttctttaatctctcttgagtgatgcttacaatagaatagtgaactagcaagttctgtgccttacacttggcatgtgctgaaccatcagttctctaaggactggatgaggcagcctttattattatgcccatttacaaataaggatactgaagcaccgaaaggatcctgtagctagtaagtaatagagacaggatttgaatttaggtggtctcatactaaagcctgagctcctaagagtttgttatattgccacagtgagtaattattaagtatatatcatctccaaagcaagaatcaagaggctattttgtgtaaccactgtgctatgtgccgtcagggtcggggttggggggtggcaggagggacacagacttgaagagttgggtaacttgcaggaaggcacctgtgcaataaacacgtaagacccaaataaacatataagtctcacaggaacgagaaagggcagtgggaagtaggacggatgggtttaagtttaggaagacttaggaagtgtagggagtttgagctgggtcaggggtgagtggcgtgttgatagtgtgtggcaggtgaagtgaagaatgaaggacattccaaacagagggtccaggaatgaggggagcagaggtgtaggggaaaggccgtgtctgggaatgaggaggggcctggcttctgggagctcagggtgggcatggaggggaagtgggacacactgagggcagcccaggaaaggttgagggaggtctcggttactgttttagcagggagccactgaagatttttgacctggaggtagagatattggagcagttgactaggaagaaagtttcggctctagtatgaagcaaattagtgagagagaagactcttcccagaagacttggttcaaattctgagaattaagcatcaaaggacacccttagatttcatattgtgtgcttctttaggagaaggacttgtttctctgtttttttgttttgttttgttttttaacgtgagcaagaatcataaaaattgatttgttggtgtttctctctgatctttataggcagtggagccataataataccttattttaggtttaaaaacagaaaaaacagaaattgtatttcttgaagaggaatgtgaataatttttttgagaattcattttctctaatcaagttataaaccgtaacttgatttacacttttagagaaaatgcaaactatatttttaaatgtctaagtataaagtatggaatatacttcaacttttaatctcactcaaaatggtaatgtgctaagtgcatttaagcctgttaaatgaagagcctgttccaaattcactatatctttttaatcaaggtgaatgtgctgactactgactcatttaaaatccatataaatatattcattattgatggtgaatgttcaaggcatatatatatatatatatatatatatatatatatatatatgtatatatatatatatatatatatgtatatatatatatatatacttagatgtttatcataattgaaagaatacaggccaatgggctatccttccatatatttcatttgtcttcaatctttttcagaaaaatagttctttatatagatatagaatactttttaataaaatattcatggttaaaaacagtagaaaattgagattggaatgcgttataatctgaagacttctaatatttgctcattttcacattgctcctttaatcttctaatcagtaacacaataagtgtgcattggaaaactctaagcacacttcagagtcttaaaacatgtcaggcagtagacacgatcttctgataattcactgactcaatagacttatttaatatttttatccttaattaagtgatcttaattctgtcctgaaaatcaggctggattcttctccaggccattcctttttattgaatcacacatttaccctttcaaaattacccaatggacccatttcagaagactgaaaatcagctttcatggtaatctgtaaaacaggaaaagcatgcatatattggtatttcctaataacaaataagaagtcatctgcagtttgatgaagacctgcaatttcttttcttttcttttttttttttttttttttttgggatggagtcttgctctgttgcctgggctggagtgcagtggcttgatcttggctcactgcaacctccacctcccaggctcaagcaattctcctgcctcagtctcctgaataactgggattacaggcacccaccaccatgcctggctaatttttgtatttttagtagagacaaggtttcaccatgttggccaggctggtctcaaactactgacctcaggtgttctgcccacctcagcctcccaaagtgctgggattacaggcgtgagccaccatgccctgccaaagacctgcattttgaatcagatgtgagtccttctgtgtgagccaggccaatgtcacaaatgactgtataatcagaagcatgggtctttatactgtccttctaaattcccagtgttctcggtgaatccatgtacacccgatagctggctgcaccaataacagcttcacttaattgatttactgggacaaattttctataatggcttgtaccaaataaatgccatgtgtatctccatttgcattttcaattaactctattgcccaagtttcacctgtgatgggtttgtgctttgaaatggacttgaacagtcataggttgttttaggttaatacagaaatttttgcccattaaagtaaataatattgatttataattaagctttaaaaaaagtaaatctgttgccaaggtttggttttccagggcatagatttggttggcaaattccatgtaagtcaagttggtgccgtagggtagaggggcagtgtgcataggtgaaaaggagagagggatgtatcacctgggaaattatttgataaacacaaaacttgagtcccaagtggggcgaaaatggtcactttgaacggaaatttcacctcttctcattgtctactcctggtccaatgtaaccattgaaataaataaatgaagacaaaataacgcaaatttcctattggttctagaaactaggaaagaatacctttaacatgctggagagatcctgaaccccatgtagtagacagtctaggtgtttgattagaacagacaggctaagagagaaagaatgactgtaggagtctcctgatggcaagtagaaagctgggtgaatcacacgtggtagatgttaaatcagttcaacttttctattaagtggaaaaacctcttacatggattcaaagagtaaaatctaattgctgcttctttgagacacctaaaacacagtaatacacaaacggatgaacaaaagtatcctacacaaatgtaagtaaaaggtaggtcagaaactcgatacaggttttaggggtaaaaaaaagattgaattaacaataaggttattataaggccaggcgcggtggctcatgcctgtaatcccagcactttgggaggctgaggtgggcggatcacgaggttaggagatcgagactatactggctaacccggtgaaaccctgtctccactaaaaaatacaaaaaattagccgggtgtggaggcaggtgcctgtagtcccagctactcaggaggctgaagcaggagaatggcgtgaacccgggtggcggaggttgcagtgagcagagataatgccactgcactccagcctgtgtgaccaagcgagactccatctcaaaaaaaaaaatagtaatagtaaggttattataaatatgaacctttaaggggataacttttcatacaaatatatgtgcatattaaaacagggaaaaataataaaactagaattgtcaaatgatatatattatgtattcagcattttaaaaaatcagaaacaggctgggtgtggtggctcacacctgtaatcccagcactttgggaggccgagccaggtggatcacaaggtcaggagttcgagaccagcctgaccaacatggtgaaaccctgttttctactaagaatgcaaaaaaattagctgggcatggtggcatgcgcctgtaatcccagctactcaggaggctggggcaggagaatcgcctgaacctgggagacggaggttgcagtgagccaagatcacgccactgcactccagcctgggtgacagagcgagacttcatctcaaaaaacaaacaaacaaacaaacaaaaaaaaacaaaaaacttggagaaaaaatagagctattccctctattttctcatctttaaattgataatagttcctattgcataggattgtttggaaaatctaatgagcttctatgtttatgaattaacaattaaaaattaagccttttatgtccgttttgagcaatacaaaattgtaacaaatatgaaattatgcacattttaataaaggaaatatttgcaaatactatctgataatatattatctttgaataataatatgtattatctatgaacataaagaaaattcatagaaaacattttggagtgactaaaatgtcagtaagatcaacattatgaaaataagattcgtgactatacacaacaggaaaacatttttaaaaagtgaaaaagaatccaagactgtaacacaaaacaaaacaaaaaatgataatgtctaagatttatgtgaagaaattctaggactgtactgaagggcttgagagaggactaattggaaatcacttaatttataataaacttgaaggatgaagtcattgaggaaatgataaactacttaagtaattctggtaatttggttgcttaccatcggggaaaatgtgtcggtgtattacagcaaacacaacaatttcaagataagttaaagatcaaacacttgtaacaaacttcattaaaaatgtcaaaatagtggggaaatcctatgtaagtaaactgagaagcaggaataataagagaaaaaaaatcttaagatatcagtatggccaaaacaaaaatcgccatcagatattgaagacaaaggatagactggtaaaaaatactggcagtatctaaacaaatggataatatcactagtacagtatatacattttctttaatcaataaggaaaatacaagtcaacctagcagaaaacttaaagaagtcaaaatcagccagtcacggtggctcacacctgtaatcctagcactttgggaggccaaggtgggtggatcacctgaggtcaggagtttgaggccagcctgggcaacatggtgaaaccttgtctctactaaaaatacaaaaattagctgggcgtggtggcgtgcttctgtaatcccagctactcaggaggctgaggcaggacaatcacttgaactcaggaggcggaggttgtggtgagccaagactgcaccatggcactccagcctgggcaatagagcagaactccatctcaaaaaaaaaaaaaaaaaaaaaaatgtaaaaaacgtggtagctgaacacgtatgaatggctcatgatttattcaattatgatcatgatggtcgagaatgtaaatgctatagccagaccacctaggttgacaccctgactccccctttaaactggctgtgtgatttttaacattacttaacttatcttatctgtctgcatttctttgttgctgaagtgaagataagtatccttctgcttgtattggaggtgtatggtgaagatcagagttgttaagtatgaggtgggcacaacattccccggcacacagtgagcacttatagtgtaagctggcattattttcatctgcattgttttagcaattgaaatgatcaaatacgaatatgccttaaaaacttcatatgagtgtttgtttaaaaatgttacattaacattgtgactgggtgcagtggctcacacctgtaatcacagcactttgggaggctgaggcgggtggatcacgaggtcaggagatcgagaccatcctggctaacatggtgaaaccctgtttctactaaaaatacaaaaaattagctaggtgtggtggcatgtgcctgtagtcctagctactcaggaggctgaggcagcagaatcacttgaacctgggaggcagaggttgcagtgaaccaagatcacgccactgcactccagcctgggcgacagggtgagactccatctcaaagaaagaaaaaaaaaagttatattaacattgtgttttttctattaaacactttttataaattgtacacaacttttggaatgaatatatattgcttttgtaggagcagcttatattttagggatagttggtttgggtttcaggcagtggatgaatggattgtctcaaaaaggaagaagtgaggtagaaatggaggcggtctagggtgatgaattccatgctgcctctactggctggtagctgagcttctgtgcagcaaacagtgacctagtagatctctctctaggtgctgtttgtataactcacatcatgggaataaggcctgattccaagtggtgacaagaatgtgaatggataccgagtaaagtgtattgattttcctcttgcccagccacatgtctgtcctcgtcacattttattggagagccactttccatgtgcatcagctggaaccaactaatatgtcatggtattgtcacgttattttcccttttatgcagagtgaataagagtgaataacggctgaaagagcaatgctatttatacgcaacatcctcagtttctaactggaaggtcaaacaatggggaatcagtatgaccctttagtttggattttgatcttaagtgtgtatctttcctctctaaagccattgatggttttattccttcatattgattctgatgaactttgctattgaatgagttggcaattcattgcatcaaagatctttataggaaagcataataatgataatttttttaaaaagagttcaagatgagaagtttttttcctctgttctcacatgctcacctctgttatatgctgattataaaatagtttagttttttaatataatgagtgtaccatttatttgactcaaaaattagttttaccaaccaacttctaaaaactggttatatttactgtgcttactgcttggtaaatatatttaatattcttttatatagaaaaaagttaaatagcttaagcatgactctgggtcaaattaaaaattttcagcaagactgtcttcagtgacttggctctggttccaaagtcctgaatcattactcagaaacagacttcttgtacttttatttactgaccgattgaaccagggatcagctgttagcatgctctataaaagctttgtgatatatttctgaaaataatataagggacatgaaagtgtcaattttcctgatgaggggtgtttgcattctcaagttaaatctgttattactgtcctgcatagatggtttcttcagcttattgcctaatattatgcactatttggccatgaaaaggcaagtatacaaaaatgtgtagtaagtcaatttgaagagtttatcctggaaaactgaagttaaagacatcattattttatccaagactcatatttgagtgaagtgaagtcctcccaaatgtcagctcaggaaatctctccaaatgaattgccttgtctttttgtcataaattgaaagctgtatttttcctttttgcctttgctgacggagatctcaaaattaatgaaaagtatatatagattctctcctctaaattttctttttaattatgtctgtttaattatttaatagaagctttaaggttataaatgtagaaataattttcagacttttaaatataaataataaattttgtttagacgtggaattgtgtgtgtgtgtatatatatatgtttggttttcatctattatataaatgctctcatgtaggagtttggcaagttggatgatacagaactttttatctgatattcttgttttagaagttcaattatataatcagggaggaaaatatttttaaaagtagtctcttctgttactatctcaatgttaattataacactattcaaatgtgttcacctgttcttaacccaaacatattccaaatactaactagcatttcttctttcctttagcttttatcttttctctaaagatattccttgtagcagacaaactagaaaagtggaagcaactaaatgttcatcaataggagaatgaataaattatagtttattcactttttaaagattatatagcagtataaaaaatgaaccagacctagatactaatataaacagattaccaagtcatattgatagatacaaaacaaaattgcaaaatacacacaatttgtcacttaggcaaagaattttaaatacatttgtctgtcaagactatttttatgaatataaaatctcaataaaatttagaaaggatgcctgccaaattcctgtctaatttatgtttaggggaaggaatttggtgtttgtggaagttcaaagggacttcagttttttctgcaatttttaaactttttacagtttttaaacttatattctattttttaagatagttaagtcccaaacatgcatgggtttaattctatctcaggctttgatgcctgctttcatgtccttaggtgggttctgattttgctgacacaatgtgagggacattaggaaacaggaaatggtcatttaccaaattaaaaaatccctttgctataaaatatttctctttattctgatacctcttgttcttctgttattctttgccaacccttaagaaatcatggaaattttaagataacagtacaatgactgtgcgttgaagcaaagctaaactggacccaagtcagcttggcaaattgtcaggctgtttttgtatttatttctttcaactttaacatccacaatttattaagtgagactgtgtatcaaggcggaagctcagaatcctgtttggacaccgtttaggaaggaaaccaggtctttatggggcacccccttcctcttagctgctggccaggaagaccatccttctgtatcaagcctattcaatcagagagaggtggggtgactttgggaaggaagatgacctctcccttgtaaagtggaattgctgtttccccccatgacttatacaactcatttctaccactgtttataagaacacttgtgtgaatgcttgtagtgacagcaatagtcatttaaaatatggctcaaatttcatgctgttagatttcctatgctattgaaatttttgatcattacaatctcaaatagagcttttgattaactggagttttgctgaggcccttttagagttaataggtatgcttcttaaaagcccaaagtttaatcagttacatatactactactatgtaaaatcatgactgctatcaaatctgaaaagagaatgatgaaatcaagctaattaacttgtctttcatgggagccaatcagtttccaaaatcatactgaaaatgttttacttagataacttatatgtggggtccacaggtagactactgtatggaactgatgcaacatgccagccaagagaggacagcagagaaacttgtttattttgaagatttgttggcactttgtgcattttgagtgtttttggattttgacctcaaccttaagctgatttatttacttaatttgcattgtttcctggcttgtaaagcaccattaaaaccagctcctttattcatttctgttaaaaataacattttggggggaatacttttagatttacagagaagttcaaagagaatacagggttccccatacataccttatccagtttattctaatgttgacgttatatactaccataatacatttgttaaaactgaaaagaactaacattgttaccttgtgattaaactctgatccctatttggatttcaccggtttttgcaccaatatcttttttctgttcaaggacccaatccagaataccacattgcatttaatcatcttatctccttagactcttctaatctgtgacagtttcctagtctttcctttttcccgtgacctttacagtcttgaagagtattggccaggaattttgtagaatattcatcatttttgagtaaatggaaatatgtaacttatgatttgcaccaatatttttcatccacacaccagtttcagcctagtgatcatcactttatcttcctatctagagcttgttataacagcactctaaaagtaaaaggcgatttatggtggatttaatatttctttaatgtttgcttcacctgtgatcattgtgcatccccaattttgccaaagttagttttggttatttactttaaaccacatagtaattttgcaccaatgtgtattttgtcttttgtttgtgacagattagagatggacaaccgaattgttatgtactaaagaataaagatttagaacaagcttttaaaggagttatttacttagagatggaccttatatataatccggtaagtctagctgggtcatacttcccggctttcccgtacctaaaatagaaggtgaccagcctttggaggctcaaatcaatgtaagatgtttcagaatttttgcagctacagagaggaaagaatagtgttttaaagctgtgcattttataagcaggttaccctcatctcctgctttcttctggaaaacgtttgtgtatagagtatgtatactggtaaaacctgagtttaatggaaaagtggaatacaggcttgaagagaaaatatttcggttaaggaattttacagttcgtgtgatgtggagaaggacttgaatctgattctttggggtcttactcagtctggtggtttgaacaagtgctaagtccctctgaccctcagtttattccctgtaaaatggggctaaaatggctcattgacttatttttccgggtcattgaaaggaaataaaattctctgtgaaaagtgtcttttcataaactggaaattgttattcacatgcagacatttttggtagaagcttaactcaaaaggatttcagaaggaagttttatcttttacggacgttagtttgaaaaattcatgaacctcaatctctgcagtggttgaaaatacccccaaggaatgagcaaagtggagacagtacccttctagactcaatctgacccatgccagggactcttatcaaatgagacctccagaaacatgtacagggcacaggggtgtccaccatttctttgctccctgctaaggtcagagtcagaagctattggtctgcacgattttcccagtcattaagaaaactaggtggatgaagtccctatacatgctgcccttttttaacaaggatgtcttttctaggtgaaagcaagtattaggacttttactccccgggaaaagcgctttgttgaagacagccgcaagctgtccaaaaaggtgggtcgctacagtaggtggcttgttgattggtacactcagcacccagcagctgaagtattaacacttgcctgtaatttcttccttgaaacttttcctccctcttactcctcctctctccctcttgccccatctctccacttatttctccttgtccccttctctcctaaaataaggaggtcagtcagctcccataagaagggcaagacttaaaacataattcttgggtgaaacagaaggtctcaggcccccattattctcctgattcattgtataaacaaaaattcctagcatcaagactgtcagtgtcttgtcctgcctatccgtcctttaatcacagccattttgtcctctgccctttgaagtttcagggaggtgcagtgtgtggagtcaatcacagaattaacccagcagatcttcagagacttctagcctgggtttcgctcatgactgctcctaccacttcggcgtggtctaaatttgggatgtgttggcatttcaccccatactgaatgcaagttctctccctctgcctattgcccttaactcctttctcattcagttcaacaaaaggtgaagttcagggtctggtaggggaagtttcacttttttttttttttttttccgtgacctttacattcctttttcagagtccctccctgttgtactctccgcagctcaggatttcactttgtacctatcgtccctcttcaattgtataacaaagaacaaagtgtcccctttttcaagagtttattacttccaccacttcctttggggtgagcagctgtggattacataaagcagttaaatataaagacgtcttatcatccttttgtttcccatgaacttctgggcatacttgggaaaggccttaaacgtcttctgaggggaagcctccaaatatttcattttggtctgccgtaacattgagtgtaatatttattttgtgtaatctgagtaaatgtcttattttattattgttattattgccttttgctctgtttacttgaaagttaaaacctgggttgaggtgggtggggtagctgctttgcaagcacattgaaatgaatctgcctgcaactgggagagagacatttcctttgcaaaacaagacctccacgtggggtggctttgggctctcagagcactggggaacttggggctgaaatcctagggtatgctaggaccctccgcacgtgcctcttgctacttagtccccccaaattttgataaactggaaacgtttccttaggatataaatgcttgaaagcacttactatgtgacaggcacttttctaagctttttcattctctcaacaccttgtaagattagcactaatatcaaccctattttgtaaaagagaagttaagtaacttgcccaaggtgaactccaatcccttcccagaactctgtagacctctggactagataagctataatacttgcatgttttaattgtaaatctattcatttgcttccaaactaaacaacatagacactcattctgtgtctgtatctctctttatctctctctctctgtctttctctttctagttctctctctctctctgcctctgcatgtgtctttctcacacaaattcaccaacattaaatacctggcttctgcagtttcaccagttccatttttgtgctgaacattgttgaaacaggctattctttttcagatgagcgctaaaatgcatttgattctcatttcctctatggatgatcatattttaaaaagacttttagaagtgtcaggtcttctcctttctattattatcatattttaaaattgggatctatacaaaatataatttaaatgatcagggtacctgatctagatggaatatttgtagtatttaaatctagtttcctgtttgtcattttttaaaatcagatcttatcaagagatgtggaccgtgtgaaaagaatcactatggcaatatggaatacaatgcagttccttaaaagctgcttccagtgggaatccacattaagaagtacaatagcattcgcggtaagcttcctttcttatgttcaaactatttgcttcttatttgcatctattcatctttctgaaatatattacagcgtaggtgattacgtgggggttgtctttctaagacagtacttaggtcaaatttacctgggaaaccccttaaattacccaaatcttagtcatatatggtctcttggtaaatttaagagcactactgttgtatatatatgtttaaatgtttctccagttgttgttacagctacatttgtatagccctgcattgtgtgtattttttttctttctgtgccagtgaccgcccataatttctgaaaaatggcatctgaaaaatcacaggactaaataataactgaattgttcaatttacattttaagtaaattattcccaaactttgatattaaagatgtttattcatttcaagccagttgggacatactgatcattacacattgcaatttcattcagcaccgcaaagaggaaccacccctgtctatgaaatgtacccttttctctggtgacattggcccatccttatgagcataataaaatcgcagaatcaaagcgctgcaagagatcttaaaaccacctaagtctaccactgagagcccaagaatcttggaaggacttcacagctggcctcatgccttcactttatatctcagggcattttctctcatttgtaaagggacttgtccttgatcaaattggtaatgtcagccatgggaggagaaatcaagtctcccgactgcaaatctttgtatatttggtatcatgccattcatttctgtcctgtgcaaagatcactataaaaactaatacgaggtatgagtggtctaagagtgtgaatatcagtcatgatcattggtgaatctgatttctgaatgttatgtggttctgcttctgttttctactgccaatatatgctgaatgttctctcttagccaacaggcatagcctcatataaaaaatgggggaaaaaaaacatttattagcccaagaagccaatgggttcaaggtcactcccaacatttttatgccatcaagtatatcagctccaaaagaggcttttcctttgccattggggggtattttgtttgctgtcgtttattttagttctccactgcttcggtgtagaggacctatgctgcctgtaggcttgacctttcctatactttttctgctgtctgaagttgctaaaacatttggccttaataaaaacactaataaaggttttattaatctgtatccgtcattgtctcagcatttgtttatccacttccctttctcacgttctcctcagctggtggcttcatgcgttgagttccccttcaacctccccagctccacttcccacccgaattccctttcaaaactttccatggaatgttctatgcaattctgggcaaaagaggaaagtgaacacaattggtggcttcttccagtcagcacccagacagccactgtgaggaggagaggatttcctctttctcgagtttagtttctggcactgtgattttagaaaaacagagatctgttgccctggattctgtagggagatgacagaaatgattaatgggctgctggcttgatctgaagaaagattagaacagatgaatagaaataggttgtctaatagaggggacttctaaacaggaagggaggcttagaaatggagccacttctccacggccttttctctgagggattcctcactgctgagcttcatgcctcggagcagagcccgcccccacgctggagaatgcaggctgccatgttgtactctcagatctctgaggcccacagcaaggaagatcaaggtggtgttctccttgctggttttccaaagtatgattttgcaaggatccatgggtatatgcgactgtgtgtatagggacatttctcattggacaccattgaaaaaaatgcagagccagttagatacgctatatacctacagcctatcatttggttgtcctgaaagtactggaataaaagtgctcacttaaactcgttttcagttttaatttaaaactctacttccaaaaatttagaccatgtgtatgttgactggccttggtgattctcagaaataccgcagccataacgtggtggataattcccctccctaagttgatgaagtgtaattttattaaaagttgtttttttattcctattatgattattccaaaaccatttctgctattaaaatgagaggctatacagaaaatgctttcttgagacagaataataaatgtatttcagtttcatctcttattttttattgtttttttttttttttgtgacagagtctgactctgtcacccaggctggagtgcagaggcacgatcttggctcactgcaacccctgcctcccgggttcaagcgattcttctccctcagcctcccaagtaactgagactacaggcacgcaccaccatgcccggctaatttttgtatttttagtagagacggggtttcgtcatattggccaggctggtcttgaacctcgaccttgtgatccacccatctcggcctcccaaagtgctaggattacaggcttgagccaccgcacctggcctccgtttcatcttctttcattcttcttttggtaagattatgggtagccaagctttcatgtccttttctttgaaaacgccttcatttatgtaccttgcctgtagacctgttagctgtctgtaggggactggattggcggggcgggttgcacacctagggggctgccctggctgtagtgctgtgtccccgagtctgtggggcttcatgatgggttgtctttctgcaaaatgttggatcctcaagcccaggctctcctctgcctttcttcactatgcaactgccatatctgtcaggggtgacacacactgacggatgttctcctgtgatctgttgacagaatgctgcttggtgtctttattcgtcattgtgacactttgttcatgttccaactgctcgccttggcatgacagggcagaacagaggcgctgtctgaagcaaggttttaagccaaggatttattaaatgacccgtagtcaggtcctctaattgaaattagcgaatgtgatagttgagggtttgctacacaggtgtgaaaggagctattttagttgaaccagtccctggtggggcttttcttcttgtgacagtacaggaagtgatgctaacacaacaaactaagggcagaactgaagggatgtgtttttcttctgttttttgagaaaacataaaatattaactttatgttctagactctagctccaggtgatacaaacatgaacattgcagaatcatgtttaatctattctcaatgtcaattttaagactttatgaaagcaaaccatacgttttccatggatgcctatgtacatgtgcatgaacataatcgtatcttgttgaaagcagcagttaaagaaaagcaggctcttaagatctaggtccgcatggtgtctcgtcagaagtggatggacaaacgtgagagaactcaccttgctagatgacccaagcatcaccttcctctaccatgcgatttatcactgctacacttacaggagtggttgtattcccaacatgagagaagaaagttatcagtaatgcacctgctatgttaatgttgctgcatagtgttgaatttattgttatcataagaaattaaacatgggcatttgtagggtggtcagaccattccaagtcaagtttctatagactcagttcttcttgttaggatgaacattgaaaatctttctcattttgtcttctgggtctttctctttcccctatgtttttcagatattttggtatcttgccttttctaaggtttacttagttatattaaattaaggatatattttttcttttttcttccttcagaaagtaacattcttgactttcccatttgaaaaacaaattaatatgagatgttgacttagtgaatgaggccaaatagaactgaaatattttgccttgaagtaagtgcacctgtatatttccctatgaatagatttgtaaatatatgtggtattttatacacatgtatatacatttatatacatacacaagacgtgtacatggccattcccacacagattttgactatttgaactattattcatagttcatgttatttcagtgcttagacactgtcccaaggattttataaatttagttctcacaacaacctgctgatgtaggtggtgattactatcttctttttacagatgagaaaaataagcctatagaggtcaagtacagtgacagagctcatgtgtgtgtatgaggtagaggtggaattgaaacccaggccatcttgctttagtctgtgcaggcttaacccttcagctattctgcctctcactgatgcccaggatgcaatgtttgttgtccttgtatttacatagtgacaccgggaccaaccatactgattgtttcagatctgtatttagatattatgtgtggggattaagcctgttccaagctgtgatgctatacaggaaagaaaccctcattacatgggcgagaataattctttagctcagttattttattcacaagtgatgatgagaccaaaattaaagaagccaaacatggaaatgcccagcccctgggcatcacatgcatttggcatccttggaatccagctggataatttgaaaaaccctagagccttggttctagactgagtcccaaattacagtctgacttgtttttccccacctttgaggaatgcttttagatgatgtagagggattttcaaggggagaagaaagtaaaaacagaaaacaactagtggaagggatcatggaaggcattggacttttcagttgttttttttttttttttttaagtattccaagttgttcagaaaagggatggggtagaagagaataaccaccccttatgttcctttaaaatatcttgaaataatagctataaaagagataggcccatatgtctagtggggatctctattttatatacccagtgtctcagtgcaaatacattatttgatcataataaagataaatttgttctcaaaagataactttgcattgtgatatttatattggtagatccaatcatgtatgggtgttttgttatgacatacttatattttataaaccccaatgttgtctattaaaagtcctaaagttatattattatataaatgcatttttcatatgttaaaatattatttacttgacagatggcatcatcagaaggtgattttaaacagcaaagttctgatgcttttaacatagaattgcatttatgcagtttcatttttccaccgatatttcaggcacacacctattgtatcaagggaggcaagtttgtggggcattgatggattctttgctttattaaatttttacttggatgtttgatctaaaaagtaatctaaatctaccatatatcaacgagtatcttcataaagctatgattttaacatctgtgacttttttccgattttttgagtatagggaaataaagaatttacttttcagagttgacaaggactgaaatatgatacacaaattaaagcatcaatcaacctctccctcaataaagttaaaaaatacaactgtccactcgcttggtaatatcccatatttaacatatatagaatttttagcttttagagatcctagaatattgagaaaatgtgaagtaatttcacatagaacttaaaaacaacagtagcagtaatagagccaacccttccaacacacatgtacttgtgcacacacacacacacacacacacacacacacacacacacacatgcatgaacacgaagaagcagaggacatttgggaaattaaaagttgctctgttgaatgttttgtgaaagcagtttagtaaaaaccaaaggcaaggccttgaggactgctgttttccatgatttctctgtggaccgaaaaacattcagattcattttgctttggtacaaatgacaaatgcaacactgttttgagattcgactcattaaataatgctggtcaaatgtctttttgatgctttcgatatttatgtgttaactgtgtctaaaagatttactttaagttctgtcaccagtttactcacaacgaaatgcacctgcatttcattaagctctttcattggctatgacatccaccagaagtcacaactggatgtgcagagcagacatcgctgcccatttgctaggtgtgtgtgcagttgatgctcaaaaattaaaagtatttgtgtaaagctggaaaaaagaaatttcagttacaataaccagaagaagaggggttttagacatcttaaaagtgtgtatatataagtgcacacacagaaccatatacacatatatgcaaaatatataggtatattcaatgcttaaaatatttggcatcttatggttttaacatatataagatagtttccctagtcttccttttcatgaaggactacataatatactttcaaaatgttttaaagtttttttcagcacttttttaaaataggaacaatccatcattgcatattgtgagcataatttttacaacataattgcaccttctattggcaggttctcaggcattaactaattatgcaatttaataaaattacagtaatcgcattaaaaagattatctgttaaaaatttaaaaggacactattaactattttagcatattttcatgtttatattttcaattttgtgagttgtgattccagacagaatcatagctagatcgactgaaatcacttattcttttggagcattccaattttgactagtaaacattagatctcaattattgtaatcatagcacagccatattcacatagcctggtagatgtaaatggttagctcccccttttgtgtgtaggtccaggctctgcgtgggaccctgtgtcactaccactgccttttctgagctttctgttggtgtgcacttgcaagcacatattttctgccttctctgaattttcttttcaggattctgtgatggtgaatactgaatgtcagcttgattggattgaaggatacaaagtattgatcctgggtgtgtctgtgagagtgttgccaaaggagatttgagtcagtgggctgggaaaggcagacccacccttaatctgggtgggcaccatctaatcagctgccagtgcaactagaatataagcaggcagaaaaatgtgaaaacagagactggcctggcctcccagcctacatctttctcccatgctggttgcctcctgcccttgaacatcggactccgagttcttcagttgaggaactcggactggctctccttgctcctcagcctgcagatggcctattgtgggaccttgtgattgtgtgagataatacttaataaactcatatatattaaccaccagatgccaagcagagctctacctcaaggctatgataatactcaaatatgaatatatatatattcctattccattagttccatctctctagataaccctgactaatacggattccttgtcttttacagatcccaagtagtgcagtctaattcactctgctttccagagataccctactgagcttgatccagattttaggatcttcaatcttaaagaaaagactccagaggtcgtgtagcaacttaatgcagctgatgtttgactaccaccttcttcaggcttgctccttctcccgatcctccctctttcctcctctctcttccctcttctccatccccttcccacaagcagtgatggtttcgagtatctagtacactgctagatattgaaatgcaggaatgaattttcatactgagcactcgtaagtctatcaaccctcctcccctattttccactcacccttcctttccccctccctttccccctccctccctctctctctctctccttcctcctcaccccatttatcccctctactctgcctctctccagaagccctcctcacctccttagtttccctactttattcccccaagtttcttctatcatcctcccttatatttgaaaacaagcatatcataagaaaaaatgtgctctttgggaattaaattaggtcataagcatggaaatattttaaaaacatggaatgggttacaagtatgggtaggaattactgctatctgatataactattggtgggtgatggtattcttcaaattcagagaaaggcctcgctaaaacacacacacacactcatgtgctatttcattgcaaactgtttttgtggacctggacttgttgagaacctgttcaatgacagggtggaaatgcaaagcttggtattgtgtgctgtggttggtgttcaggagtcaatcatttccagggctacttaatgtctatttaaccaccagatgccaagcagagttctccctcaaggctatgatgatactcttcatgcttgacctaataaattcagttcatgtcaaaaatagatggcttatgcctatagttccagcactttcagagacagaggcggagtttgagtccagcctgggcaacagagtgagaccccgtctcaaaaaaagaaaaaaaaaaagaagaggtattttatttcaatgacttaatacttccggttaatgtcatgtgttatatagttatgcagtgtaacacagcctcatgattgaaggattgttttagtatattgcaagctgcagaaaggcaaaggcccagtctttcatctttgtgcatatccttactgcttaggataatgttgggtacacagtaggcatctaatcaatgcttcttggaagggtgctagaactagtgaaaatcatctgttaccagatgttgctttctttttattcgtacacctccgttgatcataatagcctgtggccgcatcagtagctaaaatccaaaaacaacctggcagcttcatcatattcttgtctgttatgcatttttctggctttttcttgatcctgcccatccaggaattgtgctaactagtagcaaaatggccaaaaggcagccaggaggaggaagagagctggaaaatctctaactgccatcacagcccctgaatctgagaagattctatttttgatattttcagaactgaatgccttttctcccctttcatttgtttctgtatgtgacacctggatgtgcaaacattttgtgtgatgcaaaaacagaaaagaatatttagaaatagggggacctggtgtgtgtgaaaacagttataaccaattccttatgtaggttttgacctgttgaagaacatgctcagcacttagatatctggctaatttgatattgctttttttttttttttctttttttgcagtctgagctttgtcatttgtttctaagctgtcatttttattagtctctctggctgatcttttggggctccccatcaggtggcatgtgctcgccattgtctggctgtgcttggcaagcggagggcccttttattgctgtgtgatgtgggcgtgcttgctggggtagcctgtaattagacccaccacaggtgacagttactagagagcccagtaatcgttctagctgcctgatctgatgtttatggagagaagccttctttgtggtctggtcagggtttactacagcgtgttgtacttttgccatttgatttatgatttagaaaggtgtgttttgttactgctccctttatctaggggttgtgtcattggctttttaaataacagatgtgttttagagggagatttttattataaagcctgatcatccccatctcacgtatacaaaaaaaaagattttgatatttaatcaaaatcaggttcaatatgtaatcatctaagccttgctcttgcacagtgtttactgactgttctagtctccctgggattctcttattacctaaatccatattggttttggccttttaaaatgacttttctattgcttcccaagctctttaaaatttctgttttaattcattgtctgggatgcttcattttgtcaaggaaaaaacccaaaacaaaacagaaatatacttgtgggccccattggtgttaggcaagacccaacagctgttgtttttaatataggaaagatggagccacagaatgaggtaggaggggctttcatggtcagtctgaggggaagaagaaagctgcaggcttcagaaagtgattttcccaaggcctcctcatttgtttgaatagaggattctcagtcctacactacttttacaatgcacggcttgtatagtcataaactttgaaattacggttttagttcttgagtacaaactgcatatacacaggatccttggactctgctttttttttttttaggtacattttccctcaggtcttacatttgagtaaaaatagtttgtgagtctgtggagttgctattcagagtggtaacatgccgtagggagatgtaaatctgtattgctacctcgtgctcacttgactgactcttccgttggaacaggtgaattttcctcatcaaaatgttgtgtccatggtgatgagagtaatgaagatgataacgatgatcacaatgatgacaaggatgatgatgatgatgaacggtgtttttgtgtttgggaggtgtttaagttttgacttctgctctaaaaccttgctctttattaggctttagcgatgctgttagtgaagccttgtcttacattgtcttctctttaaggaatagagtattgcttcttcagctaagtatgcctttgttaatagccacatttcttctgctctgggttaagctaggtacatgcaattataaacattttgtgtcccatagcaagagcagttttccttggaaatcaccgagaccctcaattttttttgcaaggaaacttttataggctaattcattacccccatccccaaattctacttttcacaataggaaaatgcatagtgtgtttagctgtgaaaaaaaattagccgactgtggcctcattaactgcacctctttcggcaaatttgattttgcatttcattggcgatttttacatttttgataatctacatgttttcaaaaaattgatttcctggaaatttaatcaaaaacagggttggggaataagaggagggagagaaaaaaggaaaaggaaagaaaaataacaaatagcttggcaatcgcttgagtttacttaaagatagtcctgcaggtggcgatagaaactcataaatgataaaatcctaaggtaaatttctgtgggctacttcttggggattttaatttcagcaatttatttttaatttgatacaatcgtctataagcagaaattattacattagtaaaaaaaattcaaattttcatgttgtgtacttttctgtttttataataattttcttgaatattctgtagcacattcttccttatgcagaagaaataagatccagattactgcccagttggtacagatttcattaggaaaataaccattttaaggcttcttttttttttaatttcatttttacgttctttaacctgcagctaaaatttgatgcttatgtcattggctaggtttcacttctataaaggcctttgctcttgggtgtgacatggcttgcttaggcatgacgctgagtgtgtgtgtgtgtgtgtgtgtgttcacagagacattccttcatatcatagtatcaaatctagttgcttccagaggccatttcctcccttagttaggtgtttcaagttagttttaatgtgactaggatcacaaatttcttgaaagctattttatctagggataaaaacaaaacataaatatgtatatttttaacattagacaatacatagtgaatatgataacattttttcaattcttttagttattttgggcatgaggcattgtcaaagcaaagtgaaagcatttggaagacaggagatctttcttttctgctagttaaggttcaagagtttttaaattgctttttgtgactatatatattcatttatggttttttaagtttgaatctgaaaatgcaaactctaaaggataaaactaattttcaactttcctattttcttgtagtctcatttagaaaacctttgcagtgtacattttcaaggtggagctgccttgattctaagaaaatgtaattattttggtttaaacactttaggctttagatgttgagtgtcatcaacagataactgtgatggtcttgagcaaattatgtgaattgcagtctctgcctttcttctgaacatttccctaagtcttatggtaaagttcaaaccagtaatgtcttatatgctgtacccttggatccagaattttttttatgatataatagaagaggcagaaaaagaaagaaaagaaacctctggccttcttatattctgtttcaattgttcttccaattactcatgagggagaggagtggaatgcaagtcagacactctgaaaacctattttgcagccttcatataaaaaatattcagttctctgctctgttagcagctgaccaaaatctaatccgttaaaaaatacatcgtggtaagcagttcttgaaaatgtttataataaatggtaaaagccaagcttccactgtgagattagcagttggaacaggacgtgttcatcaggaaataggttattgcctgactagtgtgtcctgcagagtaacctgcaggatagatgaagatttaaaagcttgcagtgcaaggattttatttgattttccccctttgctttcttttgcatattccagtgttgtttatcactcatggtatttttcccaatgactctcttatgaagttcattttacaaacaaaaagtgtggcatgttttgggggttggttccattcacgccccatgatcatctaatgacctatgggtattaatgttgctaatacacttttttacattacagacttcgtagcttaaagataaatgtgaaagaatattttccagagatctggacctaccaccagcttccatcttaaagatacaggaagtgctgcagagaattatggtgtctttcctgctttttgcttgactgcagtccagcctgagagtcagtggacagtagtgctcatgaataatgccttctatgtggatgatacctacagtaacacaggagtgactaagagatcaaatacactggctaaaaagccttagggaagcattatgtgtctgaggtctgatctattgtctgggaggtcgcagagtgttaatgcactctgcaaagattacactccctctctaattgctcagacacttccttaaaggatttaaacagtcaggaaaggtgacgctccttgtcaatttttgtcttctgcctgcagttgaagtttatctgtctttccactgagaccactagatcaagtaacctagacggtgtcaaaggcataaactctgaattaggagtgaaagcaataagagatgttatttaccgtaccgttgttacttgctctttaaatgctctgcattccatttctggtgtttacatagtgaaaacgacagcatctctgtgttccaaagcggggcttaaaagggtccaaggcttcactttgacttttgatcaaatttgttttcataatcctttcgcagtgccataacaccccgtgcagcattctccttttaggttattatttcagctaaatatgtagaaaataggtgaactttaggattccctcggtgcgtccccccaacctcacccctcccaacacacccccattctgagatgtttcccctgaattaggcatatgcaagaccaacccacatttaggacgtgataactttgtccagaccatcattgtaaacttcaaatgatacacagacacatttgaaaaaagatctcctctctgcattggagaatcctaactcaatcttgtgtgtctggagagctgatatagcaattttatcagactctgtatctcttatattgctttgattataactcagtgtttcctaaatgacactgaaaagcttaaagaaaggttttactagttctttcccaatggcagtttaggaaatatcggggagctgtctgtttgtgaagagcataatgaactccttaaattcatagtctgtgttgctgctgtaggaaggagtggggagtgcaagcttgcattccacctcgagcattttctacccactatgcacagttgcatcattgagaagtaagcattcctcttagatcagttcaaattgctaatatatgtgtcctacagcctgcaatataatatttacgtagcttccgaaagagacctgcaaggattccctgtaattcaagatggtagtctgactgatgggtgtagaaggatttttttttttgttttaaagaaattcttgtttgtcccatgagattttcacacttttcggctgacggcactgtattttactcatcctgtataaagctgtcagtgtattcattatatgtgtgtcttgaagactctgagcagatgacgggaacaattgctggagggggaaaacacatttgaatcaaaatcttcagaagagcatttctgtagtctctcctgttcctgcttctgcgtggactgtccctcgcactttctctgattgcatgttatctcacactgttggtagattacactgaatgtttcatctgtatataaaaattaaaaattcaaacaaaaatctggcccacatgaagaacaggccctttgggcatatggttcattatgcatattcgtttaattactaaaacacttgcgatggctttagtgcccttgctttcaacttgcaaagttggatctcttctattgcacagaaaatatagtgcagaattctgttatgaaggaggaaaaaagaaaagaaaaaaatagagcctttgaagaaattattggaattcaccaaaaggaggtatgattgtcagtatgaaataaatgggaaaagggatttctccccttcctcgtctttgtcatctccttctccctcccatttctaccactaccccgaaggctgtttttactgtggttagtttataagtaatgtgagactaaggatttaggtttcaaacatgttccctctgagcgcctcaagtctcatgatgaagcaaagttttattgtttagaagggggctgctatgaaagtgtgactttaattgatttttcagggcaaacaggtggtgatggtttagacatctcctggcctgagtgccactcctaatttgggtctacacatataatagctttattaaaataaacaatcccttggctttggttttacctgaacatctgcctcctggtttttagagggcttttaaaaatattttcactgtgtgcttaacaggatctgatcctaacatagctaagaaagactttattttctatttatgccatcaaattttttatttttatctgatgttaaagacactaaaatttagaagcatctttaaatgggataatcagtgcttcagtagttttctttagagcaccttcatttacaggatgcaacagattttgaatgtaacaggtcaaaaattgaatttgtagttgctgggttttgatttgaacttttattttggtgcacaaaagattgtttgagtgagtacacgtacgtgtgtgtgtgcgcacatgttttaagaccatattttggatttattcctgagcgctggtgatgtttcagcattgtaagaaagcttcttggactcctcttgatcagaataaattcaagactcctaacagcatttctaagggaaaggaggatccaagccttggcatcgttcttgtttttagtggcaagtatgtgtggctctgatacaagcacaattttgcttttcaattaagcaaataggtagtctatctgagtaacgggagaccatccaagacattcttgatatgattcctaaaggaattgtactttgctataaatagcatcactcactaatcactattggagggttcctgaattcgggtaccttagtcggttttaaacacattgaatatgtacagagctattgcaggcttaatgtgaacttactgcaagcctgcttcttttagtgccagaaataaagctgcaagtggagtaacttaatacagcgaactgctttactctatcactgcactaatgctaattagatacacttgctttattacccagagcatttttttctgtgttcgttctgatctaatctttctatgaacataaaggagtaagtcatgaaggagtaagtcgtaagtgttatgtttaagcttttagtcacaattgcagcctaatgttcatgtgagcaaagtcagagaacactcttagagaatgctttgtccacttacagtccaattagaatcccattggacttctcccatggagggccccacagtgccaaaaattacgcttctgaaatgagtaagacacttatcgatacatttaatggaattttgttcttgacctcttcatctacctacctttatggagaataaataaatgtgtgaagattttttctcccttcctttaatcagagcagagaatttgctgatggctttgaaagatgtatttaccaaaatcagactttcaactgctcaattaccaccttctgcaaagacgtataatgagaaatttattgtctgattctagacctgaaattatgatcattctagggggaaaaagccaatagtgcagcacattagatgctttttctctttcatttagttcagtgcttttctactttttaaactactttttctgcctttatgagcggtgtggggatttttattggggcataggtgattgtttgacttttccatttatatgaaatcatcacaaaatgtagaatatagtgtggccagtagcatgatgtaaacattaaagggatggaattttaataaatgcttcacatttaagagaataaaaactaataagaagtgaatgtatgatacaggttagaagccttcttttccccctgtttaaaaatgtccattaatgtattctaaagaggaaaataaaagtcaacaaaaacttcatgtctagagcaacggagtctaaaagcctctaatttatatttaatattaagataatacattttatatgtactttctttaaagttagaatggatcagccatattcttcatagaaatgttcagtatagttatactgtgaaactgacagtttgaaaatgatatgcattgtttatttaaatagtcatagaggataataaaagcgagaaacatataatcgagatgtctgcctacaaaagcactgggaataaatggccagatggggttatacccacaccaaactggaactactggatggaaatgtgtctttaagagccagacaccaagtctgatattcccctaattaactgaccaggtcactttatgacacatagaattagtcaaagacaatgtcaagtaaacaccagaaatagtacatttcactgctcatggatcttaagaaaacaaatggttaaagaattttgatttggtaacctttctttatattatggtaccgagagcatgacttagaggtataagtggaaatatgaaggttttattagagggcagggaaggaaagggagagtcagggcaggaaaggacattttgattctggagcttcatgaagctgagatttgccaaggccattcttccattattggtgtctctttccctttctctaaataggaccttgactgggaagaacatgccacctcctacacccactgatttcttccgaaagtgtagaattagttttctggtcagtctaaatagcctttcatagttgccctatgtatcttcacctcttttacattatataggcaggcatccttttatcaggcttcactttattgcactttgcacatactgcttattttttttttttttacaaatcgaaaatttgtgcaaacctgcatctaacaagtttattggcaccatttctacaaaaaagcaagttatccagaagttctagctgagataattgataaaggtggctacactaaacaacagattttcaatgtagaagaaacagtcttctgttggaagaagatgccatctaggacttccatagctacagaaaatgctttactttaaagcttcaaaggacaggctgactctcttgttaggggttaatgcagctggtaaccttaaattgaagccagtactcatttagcattttagaaatcctagggcccttaagaattctgctaaatgtactctgcctgtgctctataaatggaacaacaaagcttggatgagagcacatctgtttgcagcatcatttactgaatattttaaacccactgttgagatctacttctcagaaaaaaatgatttttttcaaaatatcactgctcatcgaacatgtacctagctgctcaagagctgtgatggagatatacaatgagattaatgttgttttcatgcctgctaacataacatccattctgtagctgatggatcaaggactaatttcaactttcaggtcttattaaagaaatatattttgtaaaatgatagccgtcattgattgtgaatttttctgatggatctggacaaaataagaaccttcttgaaaggattcaccattctagatgccattaagaacatttgtgattcatgggaggaggttaaaatatcaacattaacacgagtttagaaggagtcgattgcagccttcacagatgacttggaagggtggagtggaagaagtaagtttagatgtggcagaaatagcaagaatagaattagaagtagagcctgaaaatgtgactgaattgctataatctcatgatgaaacttgaacatatgaagtttcttcttgtggatgagtcaggaaagtggattctagagatggaatctactcctggtgaagatgctatgaacattgttgaaataacaaatgacttagaatattccatcttggttgataaaacagtggaagggtttgaaaatgttgaccccaattttgaaagaagttctactatgggtaagatgctgtcaaagagcatcacatgctacagagaaatcttttatgaaagcaagagtcaattgatgtgatagacttcattgctgtcttattgtaagaaattgccacagccaccccagccttcagcaaccaccaccctgatcagtcatcagccatcaacattgaggcaaaaccctccaccagcaaaaaggttatgactcactgaaagctcggatgatagtattttttttttttttttagcaatgaactgtttttaattaaagtgtatttacttcacctttttagacatacgctgttgcatacttaatgttgcaacttaccattgcatatgttgctgtacactgtactagactgtagcacagtgtaaacataatctttattatgtactgggaaacccaaaaaattgtgtgactcactttattgtgatttttgcttcgttgtggttgtctggaaccaaactcacaagatctcagatgcatgcctgtacaattgtattaattttcttttgctgctgtgacaaattatcaaagacataagtggcttaagatgacacaaatgtattatcttacagtgctggaggtcagaagtctaaccctggtctcactgggctaaaattaagggagggctctttttccatctggaggatctaggggagaatccctttcctttgcttttcaacttctgaaggctgcccccacatcccttggctcatgggccattcctccatcttcagatccagcaagggaagatcgttgagttctcctgtcacatcactctgaccttgtttctgccctcatgtcttttctgggctttcttctgcttccctcttcaacttttaagaacccttgggattgtatttgtcccactcaggtaatttgggtcatctacctattttaaggtcagatgattagaaaacttagcttcatctgcaaccttaactctctttgtcccataacataacaggttctgggaaataggatgtgggtgcctatttgggattccattattctgcctaccacaatgaggtcgtgcattcctgtcttccattcatgtggcttcctgaaggataaggatttctaaagcaagctctggtttcttgcatacaaagtgtttcaatgagaggcttaaatttgggaaaagggaagaggttatgtactatagacattttaaactgagagtggctgggaggacagcaattagaaatatgtagaagtcacatgttgtgggcaacatgaaagatctttgatacttggtgtgttcagtctcctttccccaaggctgctagtatacggctggagggcaggaagtctgggaggaagctgtgtacctgtccacagcatgggtcttgggcacgtgagctttcatggggagaggaatggatgggctagttccaggggccaatcaaaagggaaaggagaatagagaataacttggagggttgtgcgggactcagaaataattcctagttagtgagtgagtgtaaggggcactaaatccatggtgtttccccacgtgactctacacagttagtcaaacttcaagctacattttgaaagcaagtaaaatcttgtattctctgtaaaacatcctttagcatcccaggcaaaagcgatcttgccctttcccagtgactgtcagagtgaaactcttcctaatttttttccagtttcccatttcccttgcccacttccataattaagggtaccatgtcacctgatgtatctaaatatttgatcatatcatttctttgtttagaaatccattctcatttcaaatcacattctcaacttcccactgtgacatacaggattttccatgaactggtccccaccaagttctccaaccttattgccagccgttgctctatgaaccagcactgttggatattttaccatctccaagcatgtgaagcctttttaaatttttaccactgtcatatcttttgcttttacttcctccttcccactaaactatcagtcatcgtcttttttcttttttcttctgtaaagatggggtttccactatgttgcccaggctggcctctaactccagggctcaagggatcctcctgctttggcctcccaaagtgctgggattacaggcttgagccacgacacctaggctaagctgttagtcttacctaagcactttcattgtttagcattgagcctaacgcaaagtagtaactgggtatatgtcttctaattgaaccaatgaattatctgagtgcttttctacaaagataattagtgaaatagagcctaacaaactttgtcttccaagtgattttcttctcgattatacctctgtcctttcacttggatgtaaccacttatccaatttataaaaacatgatggcagccattcaagttcatcgttgcatttaatcctctcaagagcccttgaggcagatattaccattcccatttcacagaagaaaaatgtttgataatgtttccaagatcacacagctagtacggtagagccatgatttagatccaaagtgaatattttctacacacctgtaaataaatatttactgttagaaaatttaattgctttaaaactgttggaattaacacaaaagggaaaagtacaacagaacagttaagagcatttgactccatattcaaactcccccaaagtcaaacagtaatgattttatgtcgttatttaaaaagaaatgttcctttgactactgtggaatcatacatagtgaggtaccctgacatttgtacttaaaactgtatttaaataaggcaaaatgggggcttgaatttagatatgtgtgtgcgcataggtgcatgtgcgtgtaagagttcatattggcggctgccaatggtagtggctgcttgggaaccctgaaatcatggcttttgaaagcattcctaggccagtgcagaatcacactcagtgtttccagtggtacgtgatctactgtaagggaaagcaaatgtaaaatatgtcacatgtacaagggagtttgtaaaacgatgtatgcacacatatatgcagtttaaagaatgatgataaggtgaaacatctgtgtacctactgccccacttacaaactgaacattttttgaagttctttctctacttctttgtaattgaatcctccttcctgctttgtccccaggagtaatggtaatactaaatgttgcatgtcactcactgtcaattgtggttttgccatctttgtgtctgtctttcaacaatgtgttcaattttgtctgatttctgaaggttttagaaatcataaaaaaaatttatatcttattctgtgacttgcatttatttacttagtatcgtttttgatattcatctatgtagttcatttacatcctgtatagcgtatagctgtatgagtaaattatttatccattctattctagatggacctttgaattgattacatatttggatattttcattttgttttttgggttttttttttccattatcaaaagtactcttgtaaacatcattatacgtatcacctggtggacgcgtgtaagaatttagagcaatagttcccagtgaggtgcctggagggcagcatctgaaaacttttcaggaatgcagtttcttgggcccccctccaaatctgctgaatcaggaactctggggatgggacttagcaatcttgtttaaataacgcctccaggtgcttctcatacaggctcaagtttgagatctactgctctagggtatatgcctaggagtaggaccactaggttttgggatatacagtttctgcttcattagttaatgccaaccatttcccaagtgattattgaaccatcagcatcaaatgaaagttatgattttgcatcttagaaaactcttggcgttatctgacttcttaattttgtcagtctggtgtgtgaaggggtactttggtgaggtcttaatttgcattttttattataatacttacacgtttcatatggttgggggcatttggatccctccttctttgctctatctttgcctaatttgcctaattttcttctccccctacatttttttttgtataagcatttaatctagatacacattctttgtacttaaaatatcttctagaggtttctatttttttcatgctgtttgttttaccttttgatgaacataatctttaatatcaaaattacccaatttttcctgtggttggtgcattttgtgacatgtttgaaaaatcctttcttaagcccaaagtcataaaaatattctttaattttgtttaaattttaaattacatctttaaatctacttgtgttttaatttcatttttgtgttctgagtagtatccaaatgacttggtatcacttattgaatattctgccttttctcaatgatctgcaatttctacgaagtcataaatcaagtttacatacatagatgggcttcttcattggtctcttgtctattcctgtaccagtatcacacaaatatttaggtttagcacagttcttcccaatttccttttcttcttcaagaatgtcttggtaagagagctcggctctttgttcttccatataagaggtagaattcactttttgtgttccacaaaaacaggacaagaccaatattgaaagtaagtcagaggcaaacttattaactttcaaaatcaatacattataaaaaaaacagcagaatgataccaagttgattagcaggagtaaaaaaaaagaacaaaaatcatgagtaaaatcaaaagaaaaaacaaaaataaaagttatctttttgaaacacttagagaactgattattcttttctcagcgttttcaatgtacaaagagaaaagacacaaacaggcattggaaggggagattattcagatgaggcagagattaaacataacagggtattatgaccaattttaaacttaaaatgttgaaactacatgaaatgaataaagcttatacaacaacttatcaaagttgcaaaagagacttaaacagtactaaatccattaaataattgcatctataatttaatatcatcccagaaagctaaacctaaggctcaggcaactttagaggcaagttttaccaaacattaatggattaggtaaatcttatacaaactgtttcttttttttcttctggctattagtgttttttggacatgtcaattgtcaattttattattgctccatggaaggcaaagtgtcttttttactcctgtgcctgcctttcaaacttgcttttgaccattgattattttcagttttactctgagatgccagagagagagagagagagattgagagagagagagagagagagagagagagagaatgtgtgtgtatgtttctctagtcatcctatttggcattccttaactttatgactccatgtcttttataaattttggaagattctcatccagtatcacttatagctttttcctagtctctcttttctctctctttctggatatcagatttttacatataaagtaaacctttctcagtgtgccatacttcttattattctatttctagttttaccatatctatctctacttgaagtgtagatattttctactaatactccaaattattaatttaattccctactccaaatcacaaattctctcttttgcttgatctgttccactgttaaattcatttattgagctcttcattttgtttatgaagttctaggtgtttatttgactcttacagatctcagttctctgctggtattgttttcatgaacatatggattataattattttaaaatccatatcttatgactgtaatatctaaatcacccatctattctggttatcttttttcttttgatttttggtcattgttttttccttctgtctatacctgattatttttactagaacattttaaagggggcatggactatgttatcttctaccagagaggatatagagtaggcatttagaatatagcaagtcactctgatcccatcagagatggagatgatccaaggtaggattccaggcatcttaaggattcatctatttctagttttaccccatgcctagccctttttggattctcaacaaaaccatgcagtatttactagggcccttctttttaaattgtccctcatctctaatttttgtctcccaactctgtgacattgccagaagattttagcagccactttctgcttggtcttaaccttcatcctaagcatgcatggcttaagaattagtaactgttttaaggagaaatgaatgtagaatgtccagcttgactgtctgctattctttttttatcctctatgtttttgtcttttaagtcctagctgctgcagttaccatgcatgcactccaatttttgcctccccagatttttaagattgaagcaaactctatgttagtactttgtactctgttgattgctgtgttctgtacagtgaattgacaaaaacaagtgtattagtccattctcacgctgatatgaagacatacctgagactcagtaatttatgaaaacaagaggtttagtgaactcacacttctgcagacttaacaggaagcatgactgggaggcctcaggaaacttacaatcatgatggaaggtgaaggggaagcaccatgtcttaccatggtggggctggagggagacagcaaggaagagagaagtgccacacactttctaacaaccagatctcatgagaactcactcactatcacgagaacagcaagggagaggttcacccgcatgatttaatcacttcctgccaggcccctcccccgacacgtggggattacaattggagatgagatttgggtggggacacagagccaaaccatatcaacaaggaaacaaacaaataggaatgaaaccaaccctgaaagacatgaagcagtagcaaactaagggagtgcatttgtttttgatcctgtctcctcaggtcctagaggccttgattattctcagatatcttcaaattgtttgtttgtgtatattaagcagatttcacagctttttttttaaaggaatattgagaaaaatcttctccttcatactgaaaagctgaagtttatcttgcacttgacatgctagcttaacaacaatagtatcggaattcttcagatcaaaccatacccctcccaatttgtaggcttttgcttttctctatttaaattctggacagtctcattacaaattatgcttcactctcgtaagtcaatgtttatttacactggcatgcacatttaccattgtttttgagcaccatacatttttgcattttgcctttatacttggggcagttgtccttctgtttgaagtatatctttgatatttaagttcatgagggtcttctggtgagaagcactactagctcatgtttttctgaaaatgtctctgcttcactctcctttaaagataatttgtgacatacaggattctaaattgaaagactgaaagaatatatacgttaaattattctactgtcgtcttgctttccctgttgctttgaggaataaagtcactcaaattacttttcctttgtagttgaactattttttctctctagctgcttttaagtgttcctcttttccccagttgttttttcagttctactatgacagttttagatatagattattcttaatttatcctgacaaggaatttttaggggaaggggggcttcctatattaatctttcagcatttctggaaaatcctcaggcattttttctttatatattgctttttctcggttctctgtttaacccctttctccaccccagacacctatcagaccttctcatttctaccttccatgtgtcttaacctcacttgtatatctataaccttgtttctgtggtctgtgtcttcaataatttctttggaattatctctcaatttactaattttctgttcagctgcttttaatctgttaattagtgtacccattgtgtttacattttattttctctcctttataccattcctcaccaataactcagatcacatagtccatctttaaaagaatttccttgccttctctactttcattagacttgattaacagaacctcaggtaagcatggctccaaaaaaaaatatttagtgcatcctgacaattgtattacacttctataatccactctccttttcactcttctagacaatttcataacttctcttctgccttgaacttttaatacttcttttcctcatcctcactctcgtagaatgaccatgattgacataagtgccccctctactgctaccctaccccctctatatctatccccctaccgacgtctatgcctgtgtcatctgcttttccttctgtagctatggatgacctgaattgttgctaagaccaacactccattttacagtggattccacccttatcactgattcaaaggtagtgctccaactgttatttcccatctcctgcctcataattttatttatctctctctcctcatttattgctacagtcccttccagctatcaccatatttctctgctcttcattgtaataaaccctttcaaagagttatgtctcctgtctacaattttccccgttctctcaaactcactcttatctcatttttgcctcatcattttactaaactctcatttcaagtcaccaatgaccacatctcagcatcttacttataaatatattgtggccatcctctttaaaatactttatctattttcaagaatacagccatctcctaatgtatctctttgtctctggcatttcctcaggctctttttctgatcccctatcttctcaaactctaaatttggacttttgtagaaatcaattctgggccatttctttctagttgcttccttgctaaggttatccagtctgatatctttaaatgctatctggagtctgataatccacaaatttacgtatctaaccataacctctaccctgaattccaaaccatatatctaaggtttactgtgtgtctccacgtggacatctaattggcacctcatactcccctccccaaacctgctcttcctacagactttgtctcaatgcatggacaaatccattcatctaagtttttcaagctcttaatcttcaaatcattctcaatcattccctttttatcttctcatctaaactatttgcaactcctctgtccctactttctaactagtcaaaacatggtcacttctcactaattccactgccatcaccttaattctaggccacaattaactctaacctggtcttttcaatagctttgtagatgaaatatgtgttgtctcttcatgatttgttctcattatgcaaccacagtaattcttcttaaatatgagtcaaatcatgttattctgcttcccgccctcttggcagtctagcaactcccttagaataaaaggcaaggaccttacagccatcaaccaggccccttgtggccaactcctgttcctttttcacttctctttccaatattcttgctcactctgcttcagacacaaggagtccatgctgcctttttaaaaaaaaacaaacaaaaaaaacccaaaaacaatcacacacacacacacacacacacacacacacacacacacacacacacacactggaaggctgggcatggtgactcatgcctgtaatcctagcacattgggagggtgaggtgggaggataacttgaggtcaggagtttgaaaccagcctggccaacatggtgaaaccccttctctactaaaaatacaaaaaaaaaaaaaaaaaaaaattagctgggcgtcgtggtgggcgcctgtaatcgcagctacttgggaggctgaggcaggacaatcactggaacctgggaggtggaggttgcagtgagtgagctgaggttgtgccactgccctctagccttggtgacagagtgagactacgtctcaaaaataaaaaataaaaaaataaacaaaacactggaagaaggcatactcccgattctgggcctttgcatttgctctttcttctgcctggaaacattattcacctagatacccacacctcctccaaagtctttgctcacttactgccctctcagtgatttcttccctaattacctcacatgtaattgcaaacccagccccactgcctgatactccttcccttccttgtctctcttttgttttctcatggtggatccttttaccgcctgatatatatagtttattttttctatctcatcttcaatcctcatatacaatctaagctacataaaggctgcttttggtttgtttttgtttactcttgtgtctaaatcaatgtaggtgtttaacaaatcagtactgaagaaaaaatgagtaataaacttatccaggaaataaagtagtgacaagaagatgaatttagtttgaatggcccagggatagaacattataagtgaagaaatagtcaagcagttgagaaaatagctttctaaatgagagaaaggtatgttcaaaagcaaagtcctgaacatcgttttatatcttaaggtttgcaaatggtgcggtgtgattaggaacctagaatgtgtggtgcagttggattatgacacacaaccaagtctgagccagttaatgaaaggtcttaactgttaaatcatgaagtctgaatgtcttaatgttggccagggaaaaatggaatattttaatcagttcgatgctgttgataaaacctagtggtgttttgttgttgttttgctttggtatagtgatatgtaagacatgtttttcctgctttaacaaaaaaaggcagttacaacttcttgagaaggggctacttattgatttgttaccttagaaatgaatgtatacctggtcaaattataattttttttaaaaatttaaccctggattttttttgaacagaattaacacagctttgtttcacctttacccaatatgtttattctaaaataatcatacttatgtgttttccccctctaaattatgccctatacaataggatgatttttcataaagatggtatgattatttaaagatacactgtttcaaatatctagattttatctttattatgacaaatgagttgatgtacacagtattctgaaagtgtctgtgtctgtgtgtgtttgctgccctttcttattttcttgtctcaaagaccactccagtggtttttaaaagagatttagaatcttctttagtacttttcagatgaaccagcttctagccctcttaagtattcatacaaaatcattagattttgaatgagcagtaccttacactagaagaaatcaactagcccttccttggacttcctgagatgttgttcttgtttcagttttaacccaggagtttagtaaggttggagagtttgggttggtggcaaggaaggtggatgttgggcctatctattctttttcttacatttggtttgtggtgtaggaatgggtaacacaacagaaagcagatttttcattagctgaaacttaatttatatgatggcaaatatagagaacatatagcattctcttaacgattttctaccacaaaagaacacttaattttattattatatatttaatgtacttatgtcatcttaggtgactataaaacagaagagcaatttaagatcacctggttactttgaccaatgttgggtcaaagttctattctaaataatggccatgttggctagattcccaaatgtctgtggcatgcctagctatttacaaaatacaagtataaaacaacccatgattttgtatgaacaaccataatgaaatatatttattcaaatgaggctcttgatttcattgttcagtttttttaaacactactttcatggacagtgtgtaagccataagatgcaaactctaatctctataatcatactttgctttgtttcaacaaaagcaatgtttttgagaattattcagagactcagcttcttgtaatttggctgtttcctaatctcaaattcactcttgaaggacaaaaggacagaatcttaagataatttcaaatgaggagatcccagagtacttaggcgaacagccatgtcattcattgaacttggtgtctgaagttaactactttttagtagaggcattctcttggatgtttacaagatagttaatggcttggttgattacttaattggttacagatcacttcatcaccatttcatcatgaaacctgatagacatgataaatttttttgtgacatgaggttacatccttctcgtgttatacttaaagaaacaatacataggggatttgttagatttgttcaagtgtctatggcaatgctagctaagttcttcagtcacagctagcttggaaccatggactcttgaaggtatttttatctttagggttttcctcaggaaaaaattaatcttttcatgagtcatgttctcctatctgagatttagcatgtatacattttcataaaaactattgcagataaattttaggatagaaagtgaagaaatatttgcagctgaaaatttaaggcgatttttttgaaattacacctactggtcgctgctgcacctatgtcatggaacatattgggaagacatgcatggtagagtaagaagtttccttggtgccagagaaaccaagcttcaagcaatggtcctaacatacgtgatttttctgttgtgtttctgagtattgttctactgtgtggatatattcacttttttgttgacatttgggccatttccagttttgttatttagaataatgctgctgtgctatgaacatttgtggacaagacttttgtgagacatattatacagaagtagaaaagctgtgaattatggtaaatatatgttcaatgttttgagaaactgccatacagtttttcaaattggatgtaccattttgtgtttttaccaaggatgtgtgagagctgcagttgctccacatttttgtcaacactttatattaccagtgttttaaattttagcccttctaatacatgtgaaatcagatttcacagtggttttaatttgtgttttcctaatgcataatcatgttggatatcttcctatgtgtttgtaggtattaatatggcttttttgtgtttgaaggatttggtcaaatattttgcacatttatattgagtcgtcttattaaattgtaataattttttatcttctggaaacaagatccctttcagtatatgtagtgaaaatattttcttcattttgcgacttgccctttcatttcctttcaaagagcaaaaggagtatattttatattttgatgaagtcttttttttttatttttttgtggtggggggttgctgtctcactctgtcacccaggctggagtacagtggtgcagtcatgggtcactgcatcctctagcctctaggcttgagtgatttctttgcctcagcctcccaagtagctgagacttgcaggcacatgccatcacacccagctcatttttgtgatgttgcccaggctggtctcaaactcctggcttcaaacagacctcccaccttggcctcacaaagtgctgagattacaggggtgagccaccactcccagcctatttttttttttctatttttctattactctttatattttttgtgtcctaagaaatctttgcccactctaagatggcaagattttctcttatccttttttcttagaagtcttaaaattctagaatttacattcagatgtataatccatttagagttaaattttgtatgttatgtggtaagagtaggtgattttttttccccatacatatatccagttgttctagtgccagtgtttaaaaaaaataccattttttcgattgaattacattggcaactttcttaaaaatcaaccacttttatgtggatctatttctggactctatcttctactccactgatgtataagtctgtcttttcaccaacactactactactttgctacagcttcataataacttgtgaagtcagctagtgtgttatttgctaaaattgctttgactattgcatgccatttgcattttctctttctttctttctttctttttttttttcttttttttttgatgcagttttgtttgctccttcacccaggctagagtgaagtggcgcgatcttagctcactgcaacctccgctcctcgggttcaagcgattctcctgccttagcctcccgagtagctgggattacaggcacatgccaccatgcctggctaatttttctatttttagtagagacagggtttcaccatgttggccaaggctggtcccaaactcttgacttcaggtgatccacctgtgttggcctcccaaagtgctagggttacaggcatgagccaccgtacccagcctgcattttcatatagtgtttagaatcaggttacccatttctataaaataaagattgcttgaatctgtaggtcaatttgtgaataactgccaccttaacaataccaaatcttccactccatgaactaggcatatttattttcttatttacatattctgtaatgtttcttaataatctttcatagtttccagtgaggatatcttgctcatgttttataaattttattctaaaatactgtgttgctttcatggtgctactataaatggaaattaaaaatttttattttttaatgttttgctgctagtattaacatctgaaaatgatttcgatattttaataataactttataccatggactttgctgaatttagttgtcatttctaggatttgctttgtagattccttaggattttgtacatttaaaaaatcatgtcatctgctaaaaaagttgtactttttttattcttttttttttttttttttttgagacggagtctcgctctgtcgcccaggctggagtgcagtggcgcgatctcggctcactgcaagctccgcctcccgggttcacgccattctcctgcctcagcctcccgagtagctgggattacaggcgcccgccactacacccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctatgctatattcttctaaacaagttttttttaaggcatttaattttattagactcaaaatgcaaactttgtcacatgtcttagggtgatagctttgatcttagactgcttgagtgtgctctgcatgtatgccagcaactttagcggcattcacatactgaatgtggggtttacctttgcttacactctcctttcagcgtacctctgcgctctgcagtggctctggttgtccctgagtgcattcccgtttcctccattcagaagtaatggtaaatttttcattggagttttactcagctggtaccaccagagtgactgcagctgctcttggatcaaagatacaaacatttttaattaactccatgcagatctgattccttctttccaagttacaactctttctttctttgaagatgcttagataattagactttttttctaaaaaaaatatttttctggggtttatatttgctttccttgaaagatgtttgttaggaaatcagttctttactacagaaatgggaattatgcattgatttaaaaaatatatatctaaaggcaatatggtctcactgtaaaagagttttaggctatttgaatgtgatatttaaatataactcaatttttgttgtaaaacatttctaggattgcttaagtattcccgatagaggccaatgctatagcaaatgaggtgtttacctaaaacaaccatctccttaatactggtggttgttcaagtaattttttcaaagacatacatagttttataatgaagaaaataaacatgatgtgtcctgatttttctccatagctttatgtcagcctcttcttacttgaagttacatttagtaatttaaaataataataaaatccatttacccagtagacaggcatttagaaacaaccaccattgagtatgccgttaaaacccttaatccccccaaaaaacgtaacaatagggaaagggaaataggtaacaaacaggaaaatctctagctttacctaataaagaaattactattggctctactttttgctatgttttattttataaaaaaagaaacatttgaaaagaagaaaattataggaacagattatatatttgacattataaaactttaaataaaggaaagttgatggagcaagccacactagaggaaatcagtgtggtttgatttttttcattgatccaaaaagtatttcaaaaatttcacacttacacatccaaaaaaaaaaaaaaaaaaaaaaagaggtttagcactaggaggaacgtaacatatagaatggaagaaggtgaaggaaaatcgtcatgatttgcagttgatatgattttctacatcagatctacaaaagaatgtatttgcagtctcttacagctaataagaggtgaatgtgaatatataaaaaagaaagaatgtgaatatataaaaattagtgtttctgtacccagcattaacaattaaatgataaaccttaaaattgttccgttgctatttataatagtgttaaactccaagttacttaaaaaaaatgaaacatggaaaatcagtacagtgaaaaaatattttgagatacataaaaagttctgaatatagagaaataatcattatgaaatgttaatatcaagataccaattatctttaaattatcaagacaatctcagtcttaatttttctgagttgtatagaaatttataaattaattctgaaatacacgtggaagagtaaagggtgaaaaaatatccaagatcattttgagcgtgtaataagagacttgcccactcagatattgtatggttacgaaattatagtttttaaaatgtggtcttggtaaaatataggaaaatatatcaatggagaactgagagggctcagaaacaatagacacactcatgtgggaacttggtatattgacagaagtagcaatgtagatgaaagagaaaaatggggatcattacaggaatttagctgtaaaagatggctgtaaggaaaaagttcacattggattgcctgagttaaaaaaaaaaattaaaaacaacaaaattgagacagaataaagatcatacacagtcatctttagaagaaaacacaaggaaatagctgtatgaactcaaggtagaatatgatttcttaagtagaacactgaacattaaaggtagaaatcctaatgtaaaagactaatatatttgattacgtaaaaccactatttcagcccatgtttgcattgatgagcgagtatagtcgtcaaattgcagagcattcatttgaatgggaactatattagttaaaataaatgtacttgatttacgcatacaccgtgaaaagaactataaaacatactattggttaaaatatttgcagaatgataggaacatttttattttgttattactaatatatacctaaggtgccctgaggtggaaaaaattcacatcaaatttaggacaaggttgtctttggaaatgagaggaataggactgaggaaggttgacaaaaagaacacgagcgtctatgcaaaacatctttaagtgttagaaaataaaatacagcaatacgggttcacctcagtgaaggagtttctcccagaaatacaagattgcttcaaattatgaaattacaaatacaatacttcaccatattgatgtctttaaatgaaaaggataaaaccatccttatctcagaagatactgaacgaacggttggttagctaccaaccattcttgatcttaaaaattataccctgttaaaattgctggacaaatttttgtttaaaacatgtttttattaggtttataacagatatgaaagagtatttataaaacatttcaaagatataaagaataatgatcacctatatgtaaattttctggtattaaaaatggtttgtgtgtgttcttaatgtggtatgatttatcactctagaagtattttcattaaagccacgaattaaacagtgatatccttctgaacagtttaacaattttttgtaggagtaatgaaatcaagcaggaaaaaaattacaaatagaaaagaggaaacagaagaggatccttaattgtagattatgtgactatattcttagaagcctcgcaggaatgaaataaactatttgatacaataaagaatattcagtaaggctgctaatgttaaaaatatatatgtaaattatttgcttttatatgtaaataatgacaagtttgaaaaacataatggaagaagtgattttatttacaatgggcaccaaaaaataaaagcaatatatgataatcacaaagagaaaatttttaaatgttagaaaaagtttttagcaatgaaacagtattgcttttggaaaggaagatttcatatttaagatgcagtaatttgccttttctaagttgatatgttatagcagtggtttttttcaagcacttacagacagctgataaccacaaattaccttatttcgtcttctagactaccggtgagtttgaaacgaaagtgagactcaaattttgaagtaatttacccaaaatttcactcctgcctcatgttataattaaaaggtgttctcaccttatttatcctaattagtgtgtttcttggaggtagaaccatctacctgcattcatgtctctaataaccattgtagcataggcagttggactcagtctcaaattctcacttgcctttctatgtgaggagtcacaaatttcagaggttgacagaaattgggcagctaagggcataccttttctgatgtagacaatgctagccaatcattttcttgtgtccatatagtctcgaaattggtagattttaagcactttaacaaaagtttggaaatccaaagtctttctctgaaatatttggatttttcaatattggcagccaactgaaaaagtagtggctctttcctgttcaaataaacctcacttttggcaaaatttggtctctggcctgcgtctttgtgaccttggactttttccatactactttccataaattctggcacactaaaatccatgggcttttcaggtatgaagccactgtatctgtctattccagagcgtgactaatcagctctttctatgctaccagttctaaaaatgagttgatcattgtgtgtgtgcgtacctgtttggaaatgtttctgaatgtgactagaaagagtccaattgaatctccttacatcaatgagtaggaatttgattgctcccctagtgttttatcaagcagtcgtgtattcttatttgtctttcaatcaggtatttttgatcactgtctggaattttgaactatatatgatccccttggcattgttgctgatctttgtctacaatttcatcagacctgtgaaaggcaaggtcagcagcatccaggacagccaggtaagcaaggattcggagttctgacatttgactgccgagaaatgtgttaacaacaaactaccaccaccaccaaatcatggcccaagtccatttcgtttgaggtgtaaggagcagccctgcaaaggcactcattttgcagtggaggtcttctatcatgaataatctggagtcttctttctgtggcatcttacgttcctgagtcttggcctgcatgaagggagcctctggttcatggttatcatttccatgctggtagcacatgtctgtgtgctcatctgattctctgtagagttcctgtgaacaacctcctcagtcactagcgagaaacctttgctggctctgtgggccattgctgggcatgcagagagctctgcagggctaactctggcctttccatgaaggcaccttatgcaatgttctctctggcttgaaggctcaggagattcccagaggcttgtcaactcccagggcaatcagagagtgggtgggcttagatccatctatttgcaggtgcccacatttgtctggaaattcccaaacttcctgtcctgttgaagaaagcaagaccctttctcaaagacatctctccgcatctactcatctcacttccactctgactctcctgctcctggccccctcattgcaccccataagatctttttctgctctgctctaggtggccaggaacttgtatttgtaggctttttttttatgatgtaatctaggcattccagcttcaagaaccaagtttttaaaacaaaaatctaaagtcctaagacttgattaattttctttctagatggatcaccttcacatttggtttcccaagagtcaatcaaaccctgactgtttttatttttccttatgtcctcataatggatttaagggaggtttctggtttcacttaggaaggaaggtgggaaaaatgagtattgtggcaagaggaaaaacctcaggcaatttcaaaattctattctgtttgattttaattatttaatgcaataggcatgaacacatatcagtgagaaaatagaaccagctaataaatgaatggctttaatagatccatttaaggactaggtttcacagagttatagataatggaaatttttacaaagaaacatctctgatatctatgttgtcaactaacatttttacaatgtttacgcaggttttatgttgcccactgtgtatatatgtttatagtatgtgcatatgtgtgcatgtgagagcatgtacatatactggcatacatgtgcatattaatatacctatatgcacataagtgtgtatgtatgtataaagcctttatttataaaacattgaaaataattacctaatttagttcgataacacaactatgagggaggcaagaactattttcattttatgtcttatgaaactacagtgcatagtgacgaagtgatttgcctaaagtcacaaagcaaaaactactggaaccatgtcccaagctaaagacttctcccaattatagcgttttttcctcccatagcctgttttcattaccttcctgtttatccattggctttcatgagacatgtttgctgccagttgtgaataggttagttccccagaggacccatgagtaccacacaaactgctagctgaatcttgtgagaattctaggaggtagggctataccggccctgaagaaatttcttgatgactgctcagtggttttatggaatgtagcagagtattctctggatactttagagttactcccttttaagagcatgatattgacaattctttttactagtggaacagtgacatctgaacagcgtgcctgacctttgcaaggttaagcagaaatgcaagtgttcaagctgaaaatagaccgtgttgtctaacactgagctttctttccaaactactgaccctatttgattatgtaccaacagatattagtttttaaacattgcagtgctatgatcaaactctggccattaaatagccaagatttttatattcatctaaacaaggccgttagcagtacagctggtgctgtggcacctgagctaaagccaggcacccttaagtccagatctgagccttgagtttccttccctcacctgccccttctaaccctaaacccagggcaaaataataatgccacagagaaacctgtaacttattcttaagattgattatattcagactaatgcattttatactgtctgatgtttcagtaatggccccaaagggagagagcagtcattataacaatgagcccagcactagtggagtatggtattctcagccttaacgtagcagttggttcatttgtcagaataagaacaacactgtttacagaaagtacaactcagcaatgcatttttaaagctggatgccttcaaagggcactggcctaatagctttatttatagtcaatggttttatgtagattatgcatattgtttagagtcctgccacagtgtccctgaactttaaaagagttattgtttaagaggttgtaatgcatttcaaaaatataaatgcttgaagtctgtaggcaagctttaaaatgtgtctgagtttaatttgcatttgttaatttcggttgatgtttctataaacacgtgggatttcctttcaggagagcacagacatagatgacgaggaggatgaagatgacaaggtgcgtatgttcaagaaagaacacacacaaaaaaacactagtgttgtcaacagatagcattccttcaggttgagtctctctcctctctttttttttttttttttaatatgatagagttaccagtatagtaatattattgtaacttttaaaaaggatatccctttttaagatttttaaaaatgaggttgagaagggtaaaatagaaggaataattgaaatgttataaaaagcataactataggaggcctttcattggatacaagccaagattagccttcccctttatagataaaaggtagcctgggaagtcaaaagtaaatcaagtgaaattgctgctgctttaggctcatgtctgcactctgtggggtggtcacccacttccgcgcctgtcattttcccagctgttcctggcagcgttttcagctatatgtctgtgtacatctgtccttttccttctcctgggagaatctctcaaatctgctgcttttgttgtcattacgctttcagacaaaccttctggaataaaatgaaacaagtgaaatgccaaatgagatgctactagcttaatgggcttccagtccccttcacctgtgggtatctggggcgagggatggtaacatgtaggaagcttgtgcagaggaaagggtaaaagggggaaccttgagagtaagtatccagtgtaaatgcccattgaatagaaatgtattcaaagacactggctctgtgatacaaagagccttagaattaattgagtggaccagatggttttgcccatttgaagcaaatggggtggattacaaagtaaatcttatttgttgtgttaagaggatcattaatagcaaaataataaaatcaagtataatacttttagaggaaaatgacctttttcagaaaagggttcacacagatgcaagtttcttattgatgtcttgatgttagctagcggtttctgagtgattaagtcattgaatattgtcaaagggaagctaagttaataaggtttataatgggatattttaccaaaaaaaaaaaaaaaaaaaaaaaaacagaagtattagtgaaattattttaaacctgtatgaggtgataactgcaagtctaggcctcctgttcttcagactggccagctatcaggtgggggttcccacaacccctttcttggattcaacaaatttctagaacggctcacaaaatttagggaaatattttcttatatttactgattattataaaggacacaattcaggaacagccaaatggaagaaatgcacagggcaacggatgggggaatgggtgtggaacttccacgccctctctgggcataccctagagcacctccatgtgttcaccaacccagaagcttccagaaacggtatttttgtttctatgaaggtttcattacataggcataattgactgaatgtttgggcattggtgtttaagtcaatctctggccccctcttccttccctgcaggtcagggctgggagtactgaaagttctaaccttctaatcatgggtgattctcctggccaccagctcccccatcatcagaggctttccaaaagtctcctcattagcagaaagtcaggtgtggttgaaaggggcttgttatgaatagccaaaagatgctcttctcatctctcttgctctggagctattttaggaactgaggaccaaaccaaatattatagcaaaagatgttcgtatctctcttatcacttaggaaactccaggaattttaggagctttgtgccaggaaccagggacaaagaacaagcatacatttcttattatatcataacatcacattaggcaaaattctaaatatttataaaccaaggcctggatgaaaggaagatttcttcctgtttggccaagcctgtttaaatgaaccaccagtagaagaggatgtcctccccgctttaggaataacggtgaccatgtatctttggcccatctagtaaaggagagtatccaacaagatgatgaatggaaacatggtattcagtgactggcaagcaacaaaatcaggtcatagtctagaccagtggttgtcaaggtctagtctaccactgatgtacttcaagagctacctgaaggtctggagagacagccctttggtctgtgctttaaacctttctgggcaaggatgactgaagaaagagttggaacagcagcatccatagggataagcctgggagctgttgcattcatctcagcatggcccaaacccataccagttgtgccaacctgtcccaagttgagggtgctggcattagggttctcctccttccctccagagaaagtttattcttaacatgtttttattatagtatttgaatagcactttgtaatagacaaatataaccatggtggttttgctttcccaattttatatttctatgaaatcttctagaggaataaatctaaaatgatattttgacttctgtttatgcctcttctgcttaacacaacccttctattgttaggaaaggctggtgaatttttccatccttgtccatctcttttcattcttccttctgtaagggatttgtaaactaaagggatcttcaactttcagactttttgagtgcacatacacatatgtattacgacacttggtttcttctctgtgcagatcagcttctcccaccgaggtatgcttgtcatagaccaggacatgcagtcactgggtggctccccgtcatagtgagctggaagaaaggtctactcactgagcccttctggcttctgttgtgtgttagacatgacagaccatgcttctgggaactgtaacacactcagtgagagatgaactgtttacaaattataaacacacagccattttgttcaaaaccagaagaggagagaaacttctttctacccaaaccatccatcttgaaggtgacactctttaattgccagtgctccttcccaccacataccatcacggacgactgtggaagataaaagcgtgccggggcctgttggcacaacttcctcaggagatgaatgctttgccatgttctgcctgtctctgatgcacagaccaggacactggggtctgtcattcttttattgtctggaacagggattgttgtaaaatgacatcactgtaaccccttgttccttagcattgtgaaaagttcatggtagtaacttgtattagaaaccagattagacttcacaattttgccttttcttttgcagactttcagggataacatagaactttcaggtaactaggtttttgccttgtaggagatgaaatgtacaagctaaactttgaagagaggaaatcctcctttctaatacctgacggctcatgtaagaaattgcttgttacaagtctagttttctagagactccagaacaaacagataatagctaagttcagccaacagcaatcagttgacatttcctatttgtattagattccatatgtggaatccttccatgtggaccttatttgtacggatggattacaatgaaaattgcattaattttctacacagtaaaggtcagtaattgaagcatgaaccaagaaactattgtgtaaaatgctgtatcccatacttaggaaaggtcaagcaagacaataatatcttgttttcattacagaaggtataaatacttgcactagagtttctttctttttccagcccaacaatcacttacatagaatatttcagcattttctattaacatcaggaagaaggaatcataagggcatgtaataaaagaaaaaaagccctgcttaatgctatcaaaaagaaactgtgctccaaggcttgcattgtgggttggtttgttcataactaggttgtcagaaacaggacttgaatgatctgtccttttagcatcttcaatgaggtcacaattgcctgacagtgtttatgaaaaacaatatgacccttttatatcagttgtagatgaaaaacagatatggacattttcctttaagaaaataagaaacatctaatccatttttgttgattgattgaggagcatattataatggaaggatacaaatgggtattgtatctatattctattttcacaaattagtttgtcatcattaaaatttaagtacagtttaaaccattaatttcagtgtttaaaatgattttccatcctctaaattgattagtcagtcccttcctcattacccagacagggccttcttagtgggagaagcacatggcatgtatctaggagttctcactgtgaattaacctgtagagtgctttggatgatgtggttaagtccactgtgcctcattccctgtgtttccttgtgccagaaagagagaggagatgatctataatatcctaaccagagaaaactgatgttcatagaggaggtcttcttaacaatctaacaatgagagtagttttgtctataattcatttgtgtgtgtgtgtgtgttgtgtttgtttgtttgttttttgagacagagtttcactctgttgcccgggcaggagtgcagtggtgccatttcggctcagtgcaatctctgcctcccaagttcaagtgattctcgtgcctccgcctctggagtagttgagactacagccatgtgccaccacactgcattagagatagggttttaccacgtcggccaggctggtctgaaactcctggcctcatgtgatctgcccaccatggcctcccaaagttctgggattacaggcatgagccaccatgaccggcctgtttgcgctttcttaagaatgtctaaaacagtaaattggttagattagtaattttttaaactatgacataagcagtgatatttaacaatgataaagtgttgtatttttaagaaaataaaaagccagagagtatctttgaatggttaacaatagttgcatgtgcacacactcaccttcagggatatacaatttatacacagggcatattgtaaaagacctgcttatggctaactttcaggggaataaagtgcatgggaattctaatttaagtccttttaatttgatttaatatggtttttagtgatgaagtgacttaattgctaacatttttatcataccatctttcaagccttttatagtgaagtggattccagccaattcttaattatcagtttatgcatgttttggatgagagggggttgccttcccaatttcctgtagtccgctggcaaatcaacttgcttaaatattctttttaaaaatcaaactctcattcttaacaatgttttgacttgataacctttagaagtcatccagaaatagtatcagtctggccttctggaaccttattcagagcatcctgcttattatcaagctcactaatattcctagtacaagtagatctttctgatttctattctaaggattgtagtatattattctcaaatattatgaaatgtgatatgccagactcaattagatgaattacctgtccttctcttagcgaatgtgcattgcctgaccaaatttcgtcagaggcgctgattttttcgtagtctatatagattgagtatccctaatctaaatacttgaaatccaaaatgccccagaatttgaaactttttgagtgctaattatcaaaggaaatgatcattggagcattttgggtttctgatttttaaattaggaatgatcagccagcatgatgcacgtattcccaaatcccaaaacaatctgaaatccagaacacttctggtcccaagcattttggataaaggatactcaacctgtattgcatctagatatttcatttcccattgcttagaattgtcacatcatgagaaggtagaagacattggacattgcatcctgattatccacaagtgattggttttctgaaaatagtagctatgtcttttgtatttaaaaataaatctgattgagaccatcctggccaacatggtgaaaccccatctctactaaaaatacaaaaattatctgggcatggtggcgcacacctgtagtcccagctactcgggaggctgaggcaggagaattgcttgaactgggaggcagaggttgcggtgagccgagatcgtgccactgaattccagcctggcgacagagcgagactccatctcaaaataaataaataaatccctgatctgttttactgtgactcacccaattatccaatgagtttatgagataattgatagaaaggggggataccacttttttcttcaagggaaaagtaatcactggaataaagtattaaacaagaataataaattaaaacaaggccatttcaagtaagaattatttaagcaattagatttatgaaaatattaatattttaatttgcaggctgcttttatgtgcaggagctcattcagtactcaaaacaaaatattaagtttcataatatgttcccttgtctacaaatgaacaaaccaaggctaagagaacttccgtaacatatatgagatttctcagccaggatagtggcaacactcaaacccatctcttctggtctaaatcttatttttgaccatgctccgttattgtgaaggaaacctgtcattaatttattggttcatttttctgcattattttgccaatgtttattgatgtctttgtaccaaagcctctatgaatacaaaaattacaaccataaacaaggtgctcatagtaaacaaccccagttccctaggacttctgctttcatcaaggtttgtaatgttgttgtagatgctatgttgggaaacagaggagaaatgctaggtgaggcaggactgctaaaaggtgatgtttgagctgaatcttaataatgattttttaacttgttccattgctgaatcacacaaatattttatcttatacccactcctttattgtacctgggagaaaactaaaggattcacacagctaaaccagcaactgccacccctggtatatttatctacagtagttacagttatagaaaaccattagccttgtttaccttgtggtggcttggtgttctgtcacttagtgcagagagacttttaatgaaatcaatctttcaagggtctaggttccaaatatttttttccctaatctgttgccaatttttcagttgtattttgtgagtatcttcctattgagctgactgtgtattccttttactttttcaaccctattatttgatactagatgatattcatgttgcaggccacaaaaaaaagtgttggtaaataccagtacagtaagtgctttatgtaatgaacagatagagcaatataaaaccacttagaaatgatattgattcaaaatccaaatactattttatattcatttcccaaagcaaaagaactacttgagaaagaagtacactccagaaagagtacagatctccccactccattttaatagcacgagctgtggcgttgactccatgtgtgtgtgcgtgtgtgtgtgcacgcgcacgtgtgcgtctgcatccctgcatgcccacaaaatgcctcatgggaagaatttctaaatgacagctcctggtgcattgctgggattcccaaagaataatttttaatttcatgtatcagaaatattgctgcttgttctttgttatgacagatgctaagctttttttcatgctaaatgccactcaatctatttctaatgtttataattcttcaagttttcaaattataggcttttaatattcagtgggatgaaacagaccaaacatattcttatttaaagtctaaaggtatatttttgcatctttagtctagatgattgaaattactgggaggattttgagataaaaatttttgcattaatctcttctgagaattctgttcatcctgtgacaaatactactcagtttttaagcatgtcagaaggattttttcctgacatggtcaattttcaggactttgtctcctgttttgcttagggaattaatagagaaatgagaagttttctaaatcagaacatgtaggagagatttaaagtaacaccctgattgtgtaattaattcttagttgtaaattcattttgatggtgttaattctctgcctgaggctcgaagctagtttattgcacctatggtgctatactcattggatacccaacgccaacaaggccttaagaaaggaaagatttgccctgatttttaaaattttttttcttttttaaaaaagaacaattgtgttacaacacagacacattatttgttcttagttctgcttacaaaagttagcaaaaatactcaatccttttaacattttataaatgaataatgaaaaatggtgggcttgtactcatcttcatatgatatatatttttaggttaccaagttagtttacttttctcacagtgaatgctcttcttttttattgtgtgtttaaaaaaaacaaggaaaccttatgaaatttgaaaaattccatgctttcatctcttcattatttggtgatgcaggcttgctcacaaagtagacccctaaagcatgtgaattttatttatgcctccacattttttcacatttgtaacgagaagtgatatccctctttttcaaatataggaatctaaaactatgtatttagccacaataatcttgttcatttatttaatcacaccagtggccttcactatttttattacacatttccctctgtaaattggaagccttatatgttaagggaaaatagaagcacatgtgacagcagttctgtctttctgaatgaatcactgttactcttcctaggcagtttggtagcaacagcagatgtaatgttgtgtttgctaaactgtgttatcaccacattccctggttcaatctgaaatgtgtaaataaagccagcatgatacagatggaactgcagacgatctttcatacaactcagggcaacatgagtagacttgtcctggaagatcattttctttgaaacttaaattaaccccagtattctttaaactagacaaaaggttgttccttcttttgtagctttgccttcttgaagggaaggaactggtgtttatgaagcacctggaatatgctaggtactttacatatgtgataatatttaattttctccacactccaatcagagtaatgacaatgatctacattttccaaatattaaacttgaaattcagaaagggtaaagaacttgccatgatcaccaagctagtagatgtcaggaccagagttgaaccccattctctgactccatggtctgctgtatataacatcatttaacttccctggacttcagtttcctatacatggaaatactaatactaaaggctatgtaatacttcctgtgatatgtccattggtatattgctagatataaagagaaaagacccataaaatcaatagcatcttgttttaaaagagaaattttgcagtacagagagtgaaaagagcatttgctattaggatgattaaaatgatagaggtacaatgcaaattgagagaacaaagaccgtagtcagcatagactggaatccttaggaagaggattcacaaaagccatcaagcttgagttgggccttccagtcattcttctataaggcctggaatcttctctcaaaccacaagcatttgcttatttcttgggttgatgtaaataattacttaatactactataaacctgataaactatttttttcctggatccatttatttctccatcaaacaagtactgtagcaacactgaggatggacccaccacagttgttggtgctgagaacacaggatcagataaaacagccgggtcttatctgttgatcccccagttcaagcagggtatagccaaaaagagggtaatggaagatattaatgaagcatccaagctacaaaaatataatcttcttgtagcatagaagctaccatactttgataaacacatattatccaaaggccatttttaaagcctttcagagagcaaaaactacatttactgctaatcataaagatacctgagctcagatggaaattttccctgtctcacatgagtagcaaatgcattttaaggaaggggtggaaacacgtgaaaaaactttgtttgttttgttttgtttttttctccctgtctagaagatactctggaaataactgattcttttctttactgaagaattttaggaaaaagtgattcaggttcaccacaggtcccagttttcccagaaagttttcatttactaattatcctcatttttaaactattgtatttaatatttccactataacaaggtgggatgtgttgcttagactttcaatttaagctttcagctgtttctgtggtcattactggtagcccatgagatgcatgcactgtgaccagagttctcaaagactaacaccaggttaactctaacaaccaggaatgacccatctctattttcctgactctcttcagggcctgagtgactaacatccagctttaaaggaaagcttctgcatggtccataataaaacaaactgctctcagatgagctaatcccttcttgcttcaggcagtggtagaaagcatgtgatgtctaccggcccattaagctgtggccactgccagggcctgtaagattcaggaagctttcaaactgcctattcagaatggttagtaagggagatgagaaatgatagggtaggtgtatgttaaatatttgcataatttaagccttcctgctaacagaataaaaagtagtctgaacactcttagaatatactattttactcattgtagtgagtaaatgtgcacttatcttttttactttttcagtatataaataaaaacacaaagattacatatttaatgaataatcatgtacagatagtacatttcttaagacagttgttgataaatgtttacatttcttgtctaccctggggccttgacttgatcatgtcactgacatttgtaaatctaagtcataaacctgccaaagaagcctcaacagctactttaagaggaagtatccaagaaaatcatttctgaaaacattattttaatgcatacagctaaaaatgcatgttgatatatctctctgtggagcatgacttttcatttagatcaaatggctatttcttccacattaatttatatcattttccacttcaagatttcatcgtacatatatgaaaaatgaccaagtagctgttaatcttcctgccaaaggatgcaaacacaatatcagagaactttgtgaaattattttcatttttttacctaatatatgaaaacaaagcttttgcaagttaactctacaaatactgtaatttctaacatcagcaatgccactataaatttaaacatttagtattgagaatcatttaactttataatgataatatgaatgcaaattttgatggagcaaatattacaactaataagatattcctccaaaatgaagaaatatgaggcagaaatgtacttggtgttggctgtgatgcactaattattcataattgcatccagacaagcaataatgttccaccacttgcaaagttgtagtgtccacacttacaatatttttatatacacagttgggatatcaacaaggttgtgtgataaagatccatcacatataaaaataaacatcagcatggcagtatgcactttctcttctttacccgtcatcattttaggaaggtttgaaccttcgaagatatctcagttaacttaaacattctccaaaattggactcttttgtggaaaaaaaaaaaaccctaaattatggtcataatcagttggaaagttttattcaaaatgttttatgactgaagtactaacttcatttttggaagctttttctgaatggaagtgaattttttttttaatggccaaaaaacactttatttttctacgaaagcaacatataaaaggtcaaatgttatgtatgattcagtttttaaattctgaagttatactttaggttatttttattattattaggtggagtctcgctctgtggcccagactggagtacagtgccgtgatcttgcctcaccgcaacctctgcctcccaggttcaagcgattctcctgcctcagcctccctagtagctgggattacaggcatgtgccaccacaacaggctaatgttttgtatttttagtagagacggggttttaccatgttggcaaggctggtctcaaactcccgacctcaagtgatctgcccgccatggcctcccagagtactgggattgcaggcgtgagccaccactccctgcctagattattttaatttatgggaagaatccttgtgatttttaatacaataaatatacattctgaccattaatggaaagaaatttagaaggcatttacttttcagcatatattttgttaaatgttctaacatattgtcttaaaatgtttgacaggaaaagttcctgtgaatgaatataaaaatacagtgcctttgaaaatatttgggatgaagtatatacagatttcaaaattttaaaaatagattgagaatattgtccatgtaccacatttttgttgtgagttttcaaggtacctaagtgctcatagacagtgttctttctgttgttttttttttttagacggagtctcgctctgtcgccaggctcgagtgcagtggcgccatctgggctcactgcaacctctgactccctggttcaagtgattatcctgcctcagcttggactgcaagcacgcgccaccatgcccagctaatttttgtattttttagtagagactgggcttcaccatgttggtcagaatggtctccatctcctgacctcgttatctgcccgccttggcctctcaaagtgctgggcttacaggcgtgagccaccatgcccagcttcagaaagtattattaaaagtatagtctacagtggagtcaattaaggtgtcaatttaatgacacctctgaaggtgattaataacaatttcgtgcaatattagaaataaaaagatgccattaaaaagtacattcttttgaaaagtaatcctgacatcggtatatagacagttgtagctagtaactgactaaaatatatgaatatatatcacaaataatcattcttcgtgtgtcatttttaaatatccagatgatcaaatttattttaatgcacaaaaatctattttttatttgaaaataatgtatttgtgaaataaaaatggaatagttttataggtccaatataataaaaccaagttatcagtcatcaataatcaaaaattaattgtttacttctactcttaaaagtattaacaagtccagatgataagttattctgttactcaagatatagtaagactctttagcctagtctttggatatttaatactccaaacatcaaattcattataaagtaacaggactcatgagcatcgttattttggcatactaactcatgctttcttcacaaccagaacctcactatttgggtgtttcacagggaaaaaaaattagacagttgaaataggaagtttttattaaatcgaatgacatggaaacttgagtcattttccaagaaattgttttgacctaaactggatgctgccgaaaagaggaagccacttttggcctttgggtcaaattccctcatgctttcaaatgttcctttataaacatgaatacttatgtggcagacagagctgggttttcaccattgtgcccattaatagatgtcggtggactcatgaattagtacgctctggcagcatatctaatttgtagcacaaactgaggaattagagtaagggaaaaaattcaaattaggataaaaaagtaaaagtatcttgaaagtttgatattgcagaaggaagcaatgaacctggttttccttctgcacagaatgaatggataaaggagtacagtcctgatggtaataatttattcaagccattgcagcaccctttactggagaagggctggcaatgaggcattctagcctctgttcttcctttgtctgtttcagccaagtagtttcataaaggcagatgcaagaagggtggtttgtgtttttcaacatttctgacatcttggtgcttttacccgcaatccctattggtagtgggttctctttcactccatccatgactccagtttaatggaacaaaggatacaagaggaaaatgattttattttttccttttgcagcacagatggtattacaggaatgtcctcttaaatttagaagtgtttgcttgatagtttagtacaattttcacccaactaaaattctatataggaaaaaagttctgtaagaactatttgaggttttaggtttcatacaataggtgtaatgacccagagaggtagaagttgagagctcattgactacatcccaattacagcaaagtcaataagggagctagaacatagcatcagaatattaaaaatagtgtaaaaatactactctttagggaatctcctgacatttgagtgatttctaagtaacctgcataactgttagttacctggcatggtaaaaacacatgtaaggttttctataagcaaagtaaggataatatttttagaaagctgaattccatttcacatgaagcattggaaattacggaagatgaatttgtatttgcttctaatgtcatgaggagatcgcaatcaattgctgatcatcctggaagggaataatctgggtaggctgccctcccagcagtgcactgtggggttactttgtagcatgtccacagctgcttgctttgtttctgaggtggttgccaaaggatggatgaaatgtcatcgggctggcaatatgtttagaacatgcttaaaaatgcagcggagtttgactaagatgctccagtactaggaatcatactacctctgtctccaacatgccaggaacatctctgaagaacactgataggagaggagtagggtgagcttcagaaaacctgtggagacagaggaagtcagagttagccagactgacgggattgcagaattctgcgagggacgcggcagcctccacggggaagtgaagtgcttggttctgtgggcttccctttatcacctcatggcaatgaggtagcaactgaggcttgcgcgttaggagtggtagcatctaagtgactgaacagatttttctggggggggagtcaatatttaagttgtaaaacaatgatttatctcttgtgtcactctattggtaaaaaccttgttattataacatgttataatattttctgtatcagcatgataaaaaatgaagtaactgagttaaatcttgcttttatgttttctaggaatctgagaaaaaggggttgattgaaagaatctatatggtacaggatattgtttcaactgttcaaaacgtcttggaggaaatagcttcttttggagaaaggattaagaagtaagttctaaatttgtgttgtggtgtttgcagtagacctgctatccacaaggacagtggggtaatggcagtggtgtgcgacaaagggaggcaagaaaatacaaaaacacaccaaagcaacactgttgggttagcactgtctgacttcagttggcttcttaacttcacagttgggtggtgcctcagaactggggtgaccatacggcccagtttattccagtcaccccaacataaatattactagtgttccctttcactcaaaaatatatcagtttgggtgacaaatgatagatatttaaaatgttaccctattcagaaataaaaagagaagcaaatgtgctatacaggagcctttgctatctgaaccacagaacttagtaaatgccttgagtaacttttctctccaattctccaaagaaagatacacatctagtagcaccatagatggataaatgtgaagttaagtcaccacatatatggatgtcttaggacaggatactactctgtggccctttatagagaaagttgacaatattttcagctttatgggacatatggtctctgtcctgactactcaactctgttgttaaagtgtaaaaggagtaacagttaatatgtaaatgaatgggtatggtatgcattccaataaaactttatttatataaacaggtaacatgctggatttgatttatagtctacccacagcttgccacccccatcttaggacatgatagctaaactctctaatggaactccagttaagaaagactgtagattcataggtttttttctgttttgttttatacattatcaactctgcattacttagttttcatttggcaccaataagtggaaggtttttaatttttttcctttgaattattaacttatttccccctttaatctagaattgtgtcaaccgtgttctttctaaggattaattcttactttattggtcgtgtctacggggatcattctagtttctttaagaatatattgttttggaattgcatgggtaaacagattaaaagtggtgctaaaaaccaagggaaagccttatgcattaaaatgcaaggaaatcaataaatgatattaacatcaggaaatataagtagttaacatgcaactttatgtaaatactaatgttttctcagttgcacagccaatgacattgccctcgaatgcccatttattataagcatagtaaacgtgtatgtttaaaaaaagtaagttataaatgacttttaaacaaagttgatgaatttttattgaatttacagttatacccattattaatatcttaagaaaaaaataatttttgctcacagatatgatgcctatttgctttattcttgtaggtttcatataaattggcaaaagattcctgaatttaccctcaaaatgtttaatataaacatatttgaaagcaaacatgaatagtaaaatgaggagggcatcataattctttattcatttcctcactcaactatcagttattgagtttcagacactgacttggtctaagttggtctaagaatgagaaatgcaaccataattacaataatgatagcaacaccaactgttatcgcatgccagccatgcactcttctaagccctttaaacacactagctcctttgaggagctacttaaaggaataggattacatcattcaaaccaccctataaagtaaggattgttaatatcctcattttacagatgaggaaactgaatcacagagtgattaaatttgtagtccaagatcacacaactagtagctatgtagcttggattggaacctgtcctcctcattactacactataatgtcattaccctcaagaaatctctatttcaatgagggagaaacagagtaatagccaattagaattcagtagcattagtggtagggagaggtaagagagaattctgggagagatctgatcagcccaggaagagatgtaggagaaagacagaccgcaggcaattctgaaacagaagaaacttatcagcatctctgagaataggaagagatagctgggcaaagaattgatgaatgagggcttcagtagtggagagcccttgtgcaaacgctcaaagcccaagactatgtgggagatacagggagatgtaagggattgagttagtgtgtccgtgccatggaggtgcggttggcagtgcctagagatgaggcatgtcatgcaggccttgaggagatggaaaaagtcagtggaagaaagttcagtgaggcacgtattgacagcaaggaggataagaggacacagagtggggtcaagacccaggaaggaagatcatgttgtttggtaaaactgtttccattctggaacatctctaaaagacaaaagtgactgttgtgccgttgataatgtaaaaggaaatgtgtctgaggagagaagagggcagagtgatttaaacaggctcccaaccctgcagtgctttgaggggcagctgtgcccagcacagctgtggtggccatgtctgagatgtgtcttcagcccatgaacagagtactgttctgcccagctgcagcacaggaaggctgctaaggctcaactcctattgattcttggccattcattattacaatgaccttaaagtccctgctgggcattcaagtgggatgtcgtgtgtaattctgttggaattccattgtaactcagtgcttaagaaccaggaaaacttttattcaactcttggcaactggcaaaaatacagaaatacataaaactctcaaagtaaggcttccctgatactgatgggttgggggggaccccagtggtgttgcatttatgtggaatgaactgtattccttttttcctactcttaccttctctagttaccttccctaatattacacaaattttaaatgtatgtatatatgaagccaaaatattttactcaacatgtagcatttggctgggcacggtggctcacatctgtaatcccagcactttgggaggctgaggtgggcggatcacctgaggtcaggagttcgagaccagcctggccaacatggtgaaaccccgtctctactaaaaatacaaaaattagccgagcatggtggcacatgcctgtaatcccagctactccagaggctgaggcaggagaatcgcttgaacctgggaggcggaggttgcagtgagccgagatggcaccaccacactacagcctgggcaacagagtgagactccagctcaaaaaagcaaacaaaaaaccaaaaaccatgcagcatttatgctagacagcaggcagagtggtgcaggagagtgaagcatatcatgtgttctatcattatggagtgagggctctaactcttgtgtccttgagtggctagggaaatctccacagaggagatactgagattaagggagacctagaataggcaagttatgcctacagatgttccagggtaaagcttagaagccaccttcataagaagtagaactgccctggctagaaatgatgtgaaaaaatactaagcagaagatgggcaagcaggttaagtggttggaatcctgaggttaagtggggctggaatccaggtttgattccagttaagtggttggaatccaggttaaatagggctggaatcctgatggggacatggggaatgagagacagatgcattttgtgtttaaatcaagagtgacatgtcaaaagggacaaaggaagacaaaggagggggccaggtgtgaggaaagcaaacacaggctagtgtagaaccatgcatatgtgaaggaaagcctttagtagaagacaggacaaaataagaacctacagcagaatatgaccagtagttttcatttccctgggaagaagagtcagaggacctcatttgtccaagccttggaaacaaggaaataatcccattgacacaaggtcagtgcagtggggcagccagttgggggaggacccagagaatatacctgcacccaccttctgggatgtgtcacaatcatttttgttaagtgggctgaaatttagaaaacgatgttcttccatattagtgagctcatgtggttgaatgaatgaagaggattccttgagttttttcattaatggcgaagttagtcatttgtctcataagtgcctaagtcagggattaccttctgaggatttagggagctcccaagtgaggaaaactggagaaatctatgaaaatgttgttttacaaagtgtcttgttttgagatgggaaagctttgatttaccaagctccttcaacttcggattttctatagaagatgttctatgataaatggggaaagagtctagtaaggttttaagtgttaggggtattgctacttagtgtctttgaattaaatcctcagcattttaaacaggaatgttcagctagattacatgagtaacatgtgcttatttacattttttaaagcgcctactacagaagcaatgaagacgggatcgtaaccaattttctgagttcaaatcccagttttgtcactggaagtgaatgatcttaggcaacttatttaacttttaggactcagggtcctcatctgtaggatgggaataacaataatgatttctgcttcataaaatttaaatgaattagtacatataaagagtttagaccaatggatgacaggtattaatcacctaaaaatattaactattatgagtattattttatggccactgacttgactttcttcttgtgtgtcttaaataaacccagggaatgtcccctgccttccttctaaaccattttaacactaaaattgtgggtcgctgaggggaaaatgcattagtcaactgacctggctcttagaaggcaaatctgacaggctatgtgggagagtgagtgtgtcgcccaactccatttctagaaagcccatgacacaccatacacttgtgcacacacaactgttgggatctttattaggactgcattaattgggaaagaattgatatccagatacatgcttaagttttctaatatatgagcttgttatattccagtgtaatatctctttagatcgtctttaatttatctcattattattttagagttttctgtatagaagtctgactttttttgtgtgaaatatattcctgagtacttgatagtgtggtgctagtttaaatggcatcttttcttcacgtttcattttctacctgttactcacatatagacatgaaattaatttttctgctttgatttgtttctaataaccaggtaaacttagttatcttatttttatatgaagattattattctggatttttttccttagataaatgtataagaataattttttcttcatctttccagcccttacacatttcattttcttgacttgctgtactggctattagctgtcatacagtgtggtttagaattggtattttgaggcattcttttctcatgggatctcagaaagaaagctttcaacgtttcaccctcaagaatgatgtttgctgtaggttattgtaaatatgctttatcaggtaaaggaagttccctttttattcctagtttgctatgagtttttattttgaacatgagctgagctttccctaacattttcacctgcattcattgaaatgatgttatttttatgctttattttggtttatgtggcgaattattttgattggttttcaaatggtaaaccaatcttacattcttggaataaacccaacattattgttctacagtccctttatatctggctggattttatttacttgtttttgcttaggatttttgcagttatgatcatcagtgagattgacttattttgtgttcttgacattttcttgtggctagaagtttattctaaactcataatacaaggtcaggtaggttctctgtcttttttctggaaaagtttatgggagtttgatatcattacttcctttaagatttatagaattagctgctgaagcatctaggcctgaagttttcctttggagatgattttgcatgaaatattatatgtttatatatataatatatatatatatatattatatatatatatatatatataaacgtcagccattctattatttctcatctctgtttctgtaaattgtaattttcaaagagtttgtccctttcatataaattttctacttgttgatttaatgttgtttataacatcctcttatttaatgtcagtaagatctgttgcattacctactcttctatgcttgatattgttatcttctttcttcttgacagggatttatcaattatattagtctttagaaataagcaccatttgccttcactaatcttctctatttcctgcttgtttgttcattagttactactcgtatatttttctaactctttaagatggataattagatcacttattttcagtctttcttctttcttaacataaacatttaaggctctacaatttcctgtaaacacaactctagctccatgccaaacattttggcatgtaatattctcattatcattcaaatttagttaaagctattttctggtttctattttgatttcttccttggctaagatatgtattgctaaatttccaagtatatggagattttctagttatcttttcgtttctgatttctagattaattgctttatggttagaaaatattgatccagcaatggactacttttgtcaattttccatgtgagcttgaaaagtagatcattggatacattgttctctatattcattagattaaatttgctcattatattcaagccttttatatttgtactgatttgtttttgtttggcttgttctatcaattacttagatgtgtttaaacttcactgtcgttgtacatttgtctaatcctcccttgaattttatctgtttttgctttctatattttgaagctacattatttggtttgtagatgttaaaattattatattttcttggttgattggagcattagtatgaagcaacctatttcttgctaacacagttttttcctaaataccttgttgaccaatattggtatggctatacagtagtcccctattatccatgggggatatgttctcagatccccagtggatgtctgaaatcatggatagtactgacctctgtatatgctatgctttttcctatacaggcatgacctatgataaagtttactttataaattaggtacagtaacagattaacaataataatgaaatagaacaattatggtaagataatgtaataaaagttatgtgaatgtggtgttcccctctcttttaagatatcttattgtatgtaacatttcggaactccgactaactgaaaccacagaaagccaaactgcagataaggggtgactacagtctcacctttcttttctccttttctgtacttttctttcaacctgtctttttgtttcaaatgtttctcttgtatctcaccatcactgtcatttcactgtagcatgtaatccctgcagaattaatgatgcttacgattgcatttagatttaaatctgtaatttattaatagtagtgtttacttgcttgttccgtgtctttttatttcttctgtatctttcctccacttgctaggaattgaaacactcttgctattcttttagttgtcatcttagagttaacagcgttatgtgccacagtctaatattgtcacttttaatgtcttcccagtcagtgcaggaaccttcttaatctatgttccacatctctttgatatctgccatctgtttcttctttgtgatgccttctaaatactttctttggaaaatcttggactgtattagttctctgcagtttaaaatcctgtccaattcattcattgggttcttaacttcaattattatggtttgcatttttcaaaattctacttcatcaatttttcttgtttttcattttcttttggattatatcttcaagcatctcttacatgatttttaacatattaaacattatgatttaatatattggattagatttcaatatctgaaatcttttctttcagattttgctggctcttactcatggtgtcatgtgtctttttgtggtttgcatttttaagaatacacctatattccttggattttcatgtggagagtactcaaacatcatagttgatgatgcatttccttggagaggattactgtttaagtcaccttgggatactaccagtcccaggacctaccaatctaggtcctttcttaaatttttttgcttgaggcttttcaagcaacactggtagcataaactgaaatgatagatttctccacttagcaccgagggcatgatttatgtccactctatggtacaatgtgtccctccttccttattcttatcctgaatatgtaagctttatgcaatggtctcatattaaaatctccccgtggagagttcctaggcttcccctcgtgcccccaatctcccatcgtaccatgcagacaacagaaagcagctcagaatcccaatatttggcagaaaatattagagtgaaaattgacattggagcttagttacctccaagagttcttgcagtttattttatttttacagtgtattatatttttattttcatgtcagcctagtcatggctttttttctgttgatattagtattttactttctcttcggtgtggaatggtattgctagaaaaggaatgataaagtctattcctttttaaaaagtaatttgatttatttttgtagctagtattattttcaaaactctaccagatatcaataactttctttccatatttgtgtgttttgtgcaataacaatgagaaaaatgagggtagctaacacttattaaatagtgactatatgccatatatctttataaatgatttatatgtataaatgtatggaatcccctcaccaactctgtaaagtagatgcagttattattcctgttttagagatgggaaaatgaaagcacagagtggtggggtaaattacgtaaggccatagagctaacaaaagttgcacaggagctatttttacattataggctacaaagttaataagtaatcttccagggtgaaaaaagagtgggttttgttgccacctagctatggatttatgtccaggatctgccatccactgtgtctccactttaaaaaaaatttgaaagggggcaaatttctttttccttagttatttgttgtacctgatatagttgttacttacttttattataataatcaaatatgaccaatggaatataaagtctttattttatatatgtacattacttctacagtttagttttttactgtatgtagctttgagcccgcgggttggggttgggggttgtgtgagtgtttttagtgtattctcaccttttttttaaagctgcgtagcgttgcagagtataaatctaattaattttttctttatttcgagatttttcaacatttattttactgagtttatttaaatattactaaccagcctggagaagacatttatgtactgcccctgtgcccttgggcaaggaaagctgcaagttaaatttcttgccatgctgaactggatcccgttgtggagttcagatgataacatttcaacgcatattgtaaaattgccctccaaaaagttctgttacaggttctgctgtggaatagagaagttgggaatggacctatacaaatgtagaaattcaaaatgtagaaattcagaataacaaagatagcataataaagaagggagaaaaatagtgattaatcagttggtggagtcacatcactggatgaggggagggctttggtaagcctggccaaatctagacattgacaaggaaaaactgataaatttgttcatgcgaaagtttataatttttatgttaatcataaacaaagcaacaaactgaaagaatatataatataacaaacatgacaaatgtctgatttttctactatccaaactgatattggaaatcactgaggaaaaagttaagcaaaacagctcaggagaaaactagcaaatagtaactattttgagtttttacaatgtgccagacactgagctaactattctgcaagtttttaattctagcagaatctgtgatataggtattattattattccagttttacagactggaaattatggttcagatttattcaatcaatttctgggagttacttaacttgaagagataaaggttgaacttgaacccaagtcagtttgcttataaatcaattttcttaaataaatcaattttcttaagcacgttcctaaataatagccccaggccaaaaaaaaaggttagaaatcatagagaaacaaattaaaatgaccaataggcatattaaaaggtattcaaatttgcttataatttaaagaattgaaaaagacatatatatataatattttacctcataataggcaaagattaaaaacaataacactcagtcttttgtttttgagagggagtctcactctgttgcccaggctggagtgcagtgatgcaatctcggctcaatgcaacctccacttcccaggttcaagtgattctcctgcctcccaagtagctgagattacaggtgcacgccaccacacccggctaatttttgtattttagtagagatgagatttcaccatgttgaccaggctggtcttgaacttctgagctcaagtgatctgcccacctcggcctcccaaagtgctaggattacagacatgagccaccatgcccagcctcagtcttaaccagaggatgagattactgtagttctcctatactgttgatagaattgtgattatttatacaagttagacaatctctgtcagtcttaatttgctcatctataaaatggggcagaattattaagagcattacattctaaatatgtgaacaatgttagcacaatgcctggcacatataaaatgcttaataactttgtggtattccctctaaaatcccgtctcccataaaaaacattctacctttctgtattcctagcacaaggcaatgaggctctacggttaaatctgtatgtgaagatgaagaccattaagaagaaatactctcggcacctcagtagggcgttcgatctctaggaatgcacatgaatctctacaatatatccaagtccatgtcccatcttctagatctccatttccatgccagtcaaagcaggcaatagatacaacaaaaggagccaggagctctgtgaaaataatacatagtgtaatcacctacattatctattaatggcagtgtgatgatttatagtcaaatgcttccccatttatttcaagacactgttagatttctggtgtaaacaagtctggaaattctaaatataagtaatcagtgaacacaaaaccaccaatgccatgtaatacagtcctccccatggggcacagtggctcacacctataatcccagcactttgggaggtcaaggcaggagaattgcttgaccccaggagttcgagactagcctggggtgacatagggacgccagagctctacaaaaattttcaaaattagaattaggctgtggtgtctcttgcctgtagtcccagctactaaggaggctaaagcaggaggatcgtttgagcctggggggtcgaggctgcagtgagctatgactgcatcactgctctacagcctgggtaacagcaagatcctgtctcaaaaaagacaaaaaagaaaaaaaaaaagttctcccttttctggtaaaggaaaggttaccataattactagtaaccgtgtgtttattgagagacaattgttgaattagaagtgacctaacccttagttttgaagatctccatgcatagccatcgtggcaacattgcagtttttaatcacttctgagagccaaaagtcttctctggaactatgggttccagggaggtaaagtcaccaatattctgacaaattgaatggcaattggtttgtgactgtccttttaagaatgtttttccagtacccaatcattttggcagactctcatcttgaggtttttaacaaaatttttccaatagactgtaaaaaaaatttctataattatgaacatgaaataaacatgacaagttgactctgtggcagttgttgaacatcagaggaaattatatttatgtggtttgtctacagcacatttaactggacggtccccttcctttcatctctggcctgtttgattctggcagcagccaccatcattttgtatttcattccactgcggtacatcattttaatctggggtaagtttggaatggtccttttgctagcaatcaattccaggtaagaaccaattactcatttttaaagtgcgactattaattttaaatgtgctcttgttggcaattaaacatgagattaaggaaagcatttggggaacaaaaacttccaggacctccctgaaaggccagttgcatgagtgatcagcatagatatttataggcctcttgcataattgcaatcaaataaaaatgtgattgtacatgccatttccctttgggctttgctagtcataaatcctcttggataatatattgctgtgcccgggtaactttaaggaaacactgttcaaacagtgagcaaacacctacctgcatcatgcccttgatattatgtaaaagtggatctggccactaccaggttgcttctgacacttcatccctcttggagaaaaaaattcacctaaccccattcttaaatccagaagcagggagagggaggggagggggcgttctgtgaatacctaaccagtgcctgaacagagaggaagttattatttaccaggggaaatggtgtgcctacataaagtttagctgctttaaaaagaaagtagaaacaaaactggcaaactggaaataaatgtcatgacttgatttaatactcaaactagcggttggacaaaatgcaagcagcttggtgagtattagtgtctgttcctgggtgggctctgagttgatataaggagagggaactgcaataactgaaatgttggagaagcagttagccgttctccgtaaagggtctgccaatcctggttttccatgacttagctatgactgccgatgaattctcaatgctcgtcacttccagggatcttcagatgttaagatgtttggggaaatcacaaagagaagagactgtgttgagacgcattcatccttaagcaaaagctgagagcctgcaaatgctggatgaaagctacaacctttctaaaaaccattaaatatagactttttcaaagagcatccaacaaagtagaatcctgctgtcaagaaaagccaaacttgggcaataggaaaaagtcacgggaaaaatagagtagctcatacaattacagaagtagaatgatttagggattttgagagagtataatccaattattctctaaactattcagggatctattttaatacttgatgatcctgattcttggaggaaagtctcatctgtgcttagttcttgttggtattttttgtttacttggcaacaataatagcaaattggtccttaagagagaacatagagctcttcagggccactgattaagaaggcatattttgaaaaaaaaaaaaaaaagtattttcctgaataatttatatactgaatgttatttgcatcaactggttatcttatttttcaattatgttttcgtgcgtactactatcttgtttactgataacatttagaacatagatcttgagattgttgtctgactctaaccagaatgtgattaaaaattgcaatcatttggctagtggtttgttcacttttaagttcatgtaagttgagtgccatggtcagctgttaaacattgcttcttctggacttcctcatcatcctggtgcttgcttggtctgtttctatgcatctttccttccacaaagaagactaatactggctgggtgcagtggctcacgcctgtaatcccagcactttgggaggccgaggcgggcagatcacccgaggtcaggagttcgagaccagcctggccaatatggtgaaaccctgtttctaccaaaaatacaaaactaagccaaggtgatggcaggcacctgtaatcccagctacctgggaggctgaggcatgagaatcgcttgaatccgggaggcggaagttgcagggagctgagatcaagccactgcactccagcctgggcaacagaacaagactccgtctcaaaatcaaaacaaaacaaaaaaacgaaaaagacaaatactctattttctcatttgatcatcaattttgagattccaatccctctttctctatatccaaatcaccttggcttctgatcttatcctccaagatcttggcagctttccaacaactttttgcatctacttaatgaaatattgttctattttccactttatggataaagttattaaatggtatggagtttattatgctctcttgggctgtcagtaaccctctgagctttgtactttacgtctggttcttcagttttacattttaaacagaagctcatagtttattgaagagcttaccatagtgaatgtagttacaagccttgacaatcaccacgtgatctattgcctcttctcattatgtaaaaactgccatgccatcctagaatatattctgtaattctgttaggacttatcctaagacaaattagttactagctagcatagggcaggacattattttgcaaatttcttgtatgattgcatcctttgcagcaatttttttctcacaaaggagataaatgtatatgtcttaaagttttagtggtttttctaactttaaggatcagaagactttcttattctaagttacttattcattttttattgagtgctaaaatggtgaataatatcctaaaatgttttgttctatgtttttaattttttgaaaaaaatgtaactatatatactagatttccatattttatatcctcaagtcatatttttatataagtatcagaatcatttcacataagcacataaaacagcctaattttatactagctattgggaatatttttggacacaccaaaattattttgacaggtgagatgctttatttcctctttagccctataattcttagtgcagccacatttatgtaagagatctttaatgagttcttaaatatttttatgaatgaatgagcctgcaagcttaatacctgtgctctatatagatgacattttgttaggcctatgacctctcctgtgtaggagtgtgatttttgaaaattaagtgagaagtagattttaaggatatctgaagttttctttaggaaacattatctactgcattttagtcacttacatgaagtatgtatttccagaaggcagagcttttcttaggattagatcccatgtgggtttccttttgagagatttcccatattccttctattgtagaggttttaattatactttttcacttctagttgaaaccacttctgttttttcagggtagatattaattctctaagctaaatttttagctttttgcaagaaggacctatgcctcgtttaagtttgtatcttcacttgatagcacaatatttttttacatggaagacactcagaatttgataaatgaacaggcaaggaacccctgcctcaccccaaccagtgtattacagttggagctacctgctggtcgctcatatgaatatctgaaaaatggtgttttaattgtgtttcaagtggttattctcaagtgaccaaatgtgcaaagcagccatgcaatttttccatctcttctgattttctccaagtgattttttttttttaaactgtagggctcattccacattccaccccactgatcaattcaatctatgatccaggaccagtacatgatagcatctttcccaacaaaatgttattcttcagtattttatcccacttgctttttttctgttctttcttttctttcgctaaaagtaattttacaacagatataccctccctctgtactatttaggttaaaaaaatctaaggtatgtttagcatgctaatagatgaagccacaatttctaaatgtgtctgcatcatcatagttggctttaatagtattaaaggctcttttccatgctcacttcctttgtctccttagcttgtttgcatgtacagtaatgatggtagccctctgcattgttgtagaatttcagactacagtatcattttgcctgtactgcccaatgtgattctcccatctacccaagaaactctataaggaggtctttattattcaaatattaatgtaagaaatgtgaggtacaggaaggttacgtgatttttctaaaatcacacagctaatacatgaagccagaacgggggcccaggtattcctacgtcacaaccttttttttcttgtcccttaaagaatgaccaaggtggctgggtgtggtggctcacgcctgtaatcccagcactttgggaggctgaggtgggtggatcacctgaggtcaggagttcaacaccagcctgaccaacatggcgaaaccccatctcttaaaacaaaaaaaggaaccaaggggtctgtgatttcctgttgacagtcggtctcacagagttgtgaatagggcaaaattattgaaacttttgatcctggacaccttcataaataaggtgtgcatttgaaacatgcaatctgagtgccctataatttttatcctaagtttttttttttcaaacatagatagtctcagtgcattgtggaatacttttgccctcattggtgcatttgagctactgtgcaggtttataatcttctcagtgactaagaatgcagtgttttgatcagctgtgatattatccctgccttgccgttcattgtgaagactccagatgcgcacaccatatataattaacaatagaagatatatctgttctcaatacgtctttgtctcccttcatcattttgccttgtctgttttcttttgccaaaaagcccatgctacaattaaatgtctttagaataacacagtgagagtatttcagtgtaaaggaacactgggggaaattttagctagaaacgtgaagcttgctgtgggggtagagggaaaaaaggcagagtgcagctttgacttgagggaaaggcgatcatttgctaggaaccttcaccagcccaaccgccaagccaccatttactcgggcacaatggctggctcccatttgcaaagcagatgtaaatctgaccctccaaagaaataactggaggttggcattgtgtcaggtataatgccatgcaggaagcctagtcctcagatgaaagcaaaataatacttaatgaacaacaacaaaaaaatcaaaccctttgtgtgttggggactactgaacagttaaatgttaccttgacttctgagtaggagccattcagagtacaacgaagctaagaattcattcagcgtcattgggactgacagcccttcagatatgatccttgttaaacaagcaccctgtggcaaaacttcagaaggccacctagtctttctgcttctaaaactcaacatgaaaaacgggttgacatttggtgaaaagactacagcttatgagctccggatatagtcaaagcagctccaaagagcagagtagaagacaaaacgtggttgagaggaactcccctctaaagagtaaaccaggggcagagcgtgtcctggatatgcacgggaacccaaggtgcagccaccaaagagggacggtctataggatgttgacatcttaaacgttcaacccgtttctaattatccttgtccttgtcctaaattagcatgttctccattgcccagacagacccacgcaccgacgttgtgatccataaattaagttagcaaccatagtaagataatttgccaataataacttttcacagtttcctgcagcatcaaagtacaatcaacatgtcaggttctgttctgctgtgagaggagagaaacctgtgaaaatgagttggaggtggggaaagacagatgactgcggttttctttgtaacaacaagaaaacaactcccgccctctacctcccactgctacgtttggtccagagcctccaagcagggacttgtttgggctaatgaaggccttttcccatctgggacatttgttttcatagcagaggcggctgttaatcagcgtattccaaaaaagccaacgtgctccccagtttgagcgtgtgtttctgtcgccctgctgctgggattgtaatgggattttcacagctgaagaaggcagagcccctcttcaccagcccctgcttcctgccttcaggaaaaggcatttgtgaatgattctacatgacagcaacatgtgcttgacttgaggtctggtaattgttttcacactaatttttacttgtgaatatcccctctcccccgagtcaggcgagtttttgaagatagatgctagatagatagatgattgactgacagatagatagatagatagatagatagatagatagatagatagatagacagacagacagataaagagatctcctgtgtttctatttttcaggcataaataaatttactaagaagcttcgaaatccctattccatcgacaataatgagctactagacttcctctctagggtaccgtctgatgttcaaaaggtatgtaatgaatggttaccaccaacagtggccccaacctgaaatctggccagccccggagccagaggaacacaaggctttgcttgtgtgagtaattgagataaggaaccagaaaatccttaaagaggcctggcttgcagagaagtggcagaaaaatctttgtccaaagcatgaggtgattgggggaaattgttttgaaaaagagctacttaagtatgatctggaactcacactgtgtggctactgggcactgatgcttgtcccctttcgattgcttgcctccctaaagaggataagatgggctcagtgagtagaattgcatgagatccaaacccagggagtgttgcttattttcttcttccgggtggcaagcattttaggggaagtaggggacaaaaggattattctttttattctcatttgccctgatttatctcctaggcctcccttctatcgtcttccctctgaagacttagggatgctgagaatgcagcccccatttactgtaatacacaaagaggcagaggcagtgtgaaataatgtgagatcaatcagaagtattattcacagataatggtcacctagtccagcagtgtcctgtttctgtggatacacagagattaacgaaggcaacaatactagaaagtcgtgtagagtagctcgatcctggcccctgtggatcagcctgctataaatccagaggaaggagggcaggcggcagtttctctaatggagaacagagatcactgaataggtagatggggagaccatggcgtgaaatatcatcaagatgatcaaagacacaatcctttaatatctcagagaatcccaaatcaaatatcgattttcatatttgagccactgtagcataattggttccctggcagctcagggaggatttcaaagatctggggcggaaaagccttagagtttctttccccttcattccgagttctagaaattaaaatggactctgtgatgctatcttcctttaaaattcatttcataattagctgtgaaaacacattctagaaagatgaatttactctttaacatttgtattacttaattaaaaaataataacccggcccctgtttgttttgcattgaagattgacaggtatgtcatcctctgctcccttagggcaccttcgcaaaacaccataaggaatggggtgttttcttcatttatctgcctctgacaaagtacagcctgacttctgtgatcaggcataatgtccttggggaatttgtcacaaatgctaaaaatagggagcacatgtggtctgtaatacaatgttttaaataaagccattccaccagcagcctatcaaagcccacacaccaaagcaatatatttgcaacgtaccatcacttgggtcgcagtgtgagttcacactgtatccttgaagaacagaaatttccctcaagcccccaaggattctctgtgcagagtccagtcactagccctcaaagtggccattccagttggagatggcatgaacacagagagatgcagcaaaagaacattccaggaagatgtacagtatgctagtaagatcctccgtgtatcgccaagggcgctttctaataacacagtgacagtttgccactggggactcccaagtactcatatttatcacagatgttttagtcattacattgcaaatgaaattaatttccacgagaaatctatataaaagtctggggtccagtatcaatttcagcattttttcctctcaggcaaagtaaatgtgtataattttccgagatgttttccccaagattttagatatttttaaacgaataatcctcagtaagttgctgtatcatatactaagataaacattcccaagaggcagttattaagcttacttatggttgaaaactggcacacacaaaacgaacatcatctagcagtgcccagcgaaggtagaaacccacgcatctcattagaaaaatctgcttttaatattttggtttcaagaaatgatgcatgacttctcaaatccttcctgcaattaatccctccatgttcctgtgtttagaaaatgattcattacctttgaaccttccttcctttgccttcggttgtccttggggagccattagcacacactgtggcgagctagggttacctaaccgccagcatcacggctatttgttttcacaggtgcagtatgcagaattgaaactctgcagcagccacagccccctgcggaagaagcgcagcgctctctagggcacacaccgactttggacagcagcacccaatattgtgtttggttgagtagaccaatgttatggctgtttcagtggtacccaaggtgtccttctgaaatgcatgccctgtggcaccctctgtatacttcctcctccttcacgtgcacagacatacacacatgtgcacacaccctcatgcatgggtgtcctagttgcgtagagggtcagcccagcgaaaagcaacaaccccaagactgtgaaagactaacatccattctgaaataggagataacaaggctgccatggatctgaacaccaccttccttgagaacagccaggagcccacttggattcaagagtgactttgaacttgttttcacacctccaacagactctcattaagattcagttatttccgctccccagccccacactcctttcagattatcgttcatgggcgtaagtctcttctcagagttaacaagtctttggtagtcatcctctgtccaaatattgtatattattaaaaggcatttttaataattaccagaattagctcaaacctttagggatctttcagccatgattattaaggatatgtatgtgaatttttgggaaacctctcggtgctggatgccagcctacagcagggtccattgctggcaatggatggcccaggaaggtccctagagatcactcacttgaaaaatgagggtcccatgaaagtatttggttgccttctgatgccacttcttctcactttactttttgcttattttcaaaatattataaaatgtcaacatataatttcagaaaggcaggtgggggtaggggagaaatgaatgaataaattctctaggtatttagaaagataagaaactgaagaccgagagactaataaggctgcttacctaattattataatcatttcatttgcctgaatgttttaagcaggaagtagaaatactttggctgcccaaatgtatcttttgttcctcttagaagtaaaataagctacatacaataaaaatttatttcagaaccccatttctagaaaataccaccccagagtcctcatttgatagcatctgtctcctgcagacctcatcattccacagtatttccctgccatgtaaaaatcctgactttgtgcgtatataaaatgtatgcaattaagtctgtttaaatgatatttaagttttaaagactgtattttgttgacacatactttgtgcagtttttatgtatgtatgtattataaaaaaagttaaggttaaaaagatctcatttaatagtgagttcactatttttttttttttgtctctgggttgtaatttaataatcttcaaacaaaatgtttacgaaaaatgccaaagattctaaatctt

SEQ ID NO: 123 - DNA, 77618 bp, Homo sapiens
tctgcggcaccaggactgagtagaagggagagagtggagaaggggaattgcagagagaaaaccaggggctgtttttctctcggagaggcgggtaggcactgggcgggcagaagcgccgctatccacccggatgcgcagctgctaaggggccgcctctgcaagcggctgcaaattcccggagggcagcgtctcctttcgctctgctgtgtccgtagcacatggcaggtacttggcccatcaagagtgagagagggtgagcgagtgagtgagtcaccggcttggcgagggtctcctctgacccacttagccttgccagcgctcagaactgccagccctgctgggtgcttgggacttttcaaagccctgggaattctccaagggtccacagtaagtcttcttgacctaagcgggaaagagcgcaggcccctgcggggttggcttttacatggcatttatagacccgcccggagagggtgcgctgcgctcccgccatagtcccaccaccggtgagcgccgcccccactcggctgactctccgcccgccccgcgcccctcccctcacgggctctggccttaaccagagctcgcggactggcggggacaggtcccacctcctggctcccaggacgggtctgcaccaacctcagtttcggggctgcggctcacagaagtctaacctgcccgggacgcccgcaccaactcctgcgcgcggtgagtttctgggctctcgagagcgctggactcccggcggaaaggaggctgccccggctgcagctccgggggctccgggggctccaggggctccaggactcggttctcaccgcaagggctcctgcggggcccatcaacttcgccgctgggacgccgggctcggggtacgggtccggagttctttggagcaattgaggctgaacctggccaggggtcatcaggctaaatgaccgcagcgccaggactggcccgccgaggatctggccggccgcggtggtagggcccttacggagctggcgccaacctgtggggtgggcactgctggcccggcttatggaagagaaaactgaggctcgataagagaaagggaccagcgaaggcgacgcgatgatttgtgactggggactacctgtttcctgggcccctcgaccccattctgtgacagggaaaggtcttccctgattggccaaatctgggggcctggcacgagggcctcttgtgattggaggggtcgacgtgagcgctcaggggctgcgctggagtcccagctccagccactgcgctcaagtggacggtcgcgcgtgcagagggaggccggatagcagaccccacaacgtggctcctggggccccgctatcgagagctcaggccccgcgggcacttgcctaggagaggaaagaatcttcccaaagtgcagacagagacggaatttaatcaggagtcccagacttggagtttggaggcatgggctctggtgtcaggtgactttgtttcctccccacgcctccacttctccttgaccttgggcaagtttcttgtgttctgaatcttagtttcttgtctctaaaatcgggaggggcaatgaacagtagtgcctgcctcccaagattgcttgagaattacatgagactgccccgcgcctggccctaggaaaccctcggagaatgttggctgctgtttgtttgtttgtttgtttgagacagagtctcgctctgtcgcccaggctggagtgcagtggcacgatctcggctcactgcaacctccgcctcccgggttcaagtgattctcccgcctcagcctcccgagtgctagaactgcattcatgggccccagggccctagcaccagaacagagggcccagagctgcagtcctgcagggtggcccagcctcacagggactagaagctgggtcctggagagccaagcctgggctgggaattgggtaggagggttgggaggcccaggaagcctcccagtgtccccacaccaccaagtgaaaggacactgagcggccatgactgggggaggaggtggaggcctggaggcggcccatacggcccacaaggggctctatgggcttcactgcaggcccctgctctttctggggccaaagggcaagcctgattgaggcccctcccaaggctcccgtgcctgccattctggctttccctggactgtgacaacagccccttggtggccacctggactctgcctccctgcagggggggaacgacatactcttttatttttttttttcagaagtaatcatgtacaatataaaaaaagaacattcagttaagaaaacaaaataattacagtcgtcaaaaacctctgaaacccaaaaccctttacccagtaactttcaacatttcagtgtaaattcttctaggcttttaccctgcagataaacacacgcatgcacacacagacacacacacacacacacacaaacttaagccttacacaattatcgtggtttgttacttgttgggtgttttgacagtgtcaggtttgtataactcaatatttaccaatattttctaataatttaatgttttcttcttatatttgattttcaagtatttatttttaacccaattggactgtattttagagtaagatgtgaactatagagctagattcatttatttatttcaattagtagacatttttagagcagttttaggtttacagaagaattgaggacggagtgcagagttcccatattctcagtctgtcccttcctgcgcgctttctcctatttttctttctattcttttcctttctttttttttttttctttttttttttttttgagacagggtctcactttgttgcccaggctggagtgcagtggcacaaacacagcttactgcagctttgaactcctgggctcaagtgattctcatgcctcagcctcccaagtagctgggactacaggcatgcacaaccacgcctggctaatttaaaaatttttttgtagagatgggtctcactttgttgcccaagctggccttgaactcaagggctcaagtgatcctctgccttggcctcccaaagtgctgggattacaggcatgaaccactaggcctggcctcccctatttttaacatcatgcattgataggatatttttgttacagcttttttctttttgaaacagtcttgctctgttgcctaggctggagtgcagtggcacaatctcagctcactacagtttctgcctcccaggttcaagcaattcttgggcctcagcctctcgagtagctgggattacaggtgcaccaccatgcccagctaattattgtatttttataatagtagagacagggttttaccatgttagccaggctgcttttgaactcctggcctcaagtgatcagcccgccttggcctcccaaagtgctgggattacaggtgtgagccaccaggcctggccaattttgttatacttggtgagccaatatcgatgcaatgttattaatgaaagtccataatttacattagaattccctcttggtgttgtaccttctatggttttggacaaacatataatgatgagtatccagtgttacagtatcatagagaatagtttcactgccctaaaactctcctgtgctctacccatccaccccccaacccccctacctatccctggcaaccactggttactgcctttgtagttttgccttttccagaatgtcatatagtatgtatgaatcatatggtatatagcctttccagactggcttctttcgcttagcaaaatgcatttaagcatcctccatgtctttctgtgacttggtaacccatttctttttatcattgactaatattctgttgtatggatgtggaggtaccacagtttatttctccattcacatactacaggatatcttggttgcttccaagttttagcagtgaataaagctgctatcaacatttgtgtgcaggtttttgtgtggacattagttttcttctcctttgagtaaatatcaagagcgattgatggatcacatggtaaaagtatgtttcgtgttataaaaaactaccaaacctttttccatagtggtggcataatttttcatttctaccagtaataaataagagttcctgttgctccacagcctcatcagcatttgttgtcagtgctcttaatttaactcttctaatacgcatatagtagtatctcattgttatattttaatttgcaatctgtaatgacttacagtgttgagcatctttttaaatgcttctctgccatctgtatatcttcttttgtgaatgtcggttaatttacttggcccattttaaaattgggttgtttgttttactgttgagttttaatagttctttgtatattttggataacagtgctttaccagatatgtcttctctccccaaccatggcttgtcttttcattctcttaacagtgtcttttgcagagcagaagttttaaattttaataaggtctaatgtaccattttttttcctccatgaattgtgctgttgttgttgtatctaaaaagtcaaatccaagttttggcagttacaaataaagatgctgtaaacatcagtgtacagatatttgtgtgatttttgtgcaatgcagattttctccattgtcttgcctttgtctctttgtcaaagttcagttgactgtattgatgtgagtttacttctgggctctctattctgttcaattgatctatctgactattcttttgccaataccgtactgtcttgattactgtagctttatagtaaagtcttggggacaggcagtatcggtcctctaacttcgttctccttcaatattgtgttgactatcccaggtcttttgtctctccaaataaacttgagaatcagtttgttgatatccacaaataactgctggggttttgattgggattgcattgaatctatagataaagtcggaaagaactgacatctggacagtatagagtttccctacccatgaacatgtactatctcttcatttatttatacatatttttatgttttcatcagttatggttattctcacatagattttgacctattttaggtttatgtataaataattcactttttggtgctaatgtaaatggttttgtgtttttaatctcaaatttcaattgtttattgctagtatataagaaagtaatcaatttttgtatattaaccatgactttacatccagcaactttggcagaataacttattatttccagttttctgttgctttgttggcattttccacatagccaattatgttttttgagaacaagaacagtttatttcttccttcccaatctgtagacttttcattttcttttcttttctaattacattagccagcacttccagtataatgttgactaggaagggtgaaagggaacatccttgccttatttctgatcttaggggaaaagcttctagtttctctccattaagtatgatgttagctgtaggtttttcatagatcttctttatcaagttaagttcccatttattactagcttgctgaaagctcttatcataaatgaatgttagattcttgtcaaatgcattttctggatctattgatgtgatcatataattcttccttagcctattcatgcgatggattacattaattgattttcaaatgtttaacctagaataaatcccatgtggtggttatgtataattctttttaaacattgttggattcaattgctgatttttttgaggattttaacatctatgtttatgagaaatattgatctgttagtttcctttcttgtaatgtttctggttttggtaccagggtaattctgacccaagaaaattagagaatttcctctacttctattttttgaaagagatcatagagaattggcataatttctttcttaaatgtttagtcatattcattaaccctagtgctttctattttggaaggctactggctccagttctttaatcagtataggcctattcagattatctatttctctttgtgtgagttttggaacgttgtactttcaagggattgtttcatttcatttaacttaccaaatttgttgatatagagttgttcatactagtattttattatccttttaatgaccgtaggatcagtattgatggcccttctttcatttttgatattagtaatttgagtcttctctctttttcttcttagttaacctggctagaggtgtctcagttttattcatcttttcaaggaaccagctttaggttttgttgattttctctattgacagcatgttttcaatttcacaagttctgctgtaatttttattatttcctttcttctgtttattttggatttaatttgctcttctttttctagtttcctaatttggaaacttgcttttagctctttcttctttaataatatatgcattcagtgctctaaatttccctctaaacactactttagcagcatcccataaattttgatgttatattttcattttaatttagtttgaaatattttaaattttttcttgagagttattctttgatttgtttacatgttgtttagaagtgtgtcatttagtttccatttttttaatgtttttcagatatctttctgttattgatttctagtgattctgttgtgatctcagtaatctccatcatagaagtcattgatatttgttgttgtatgttttatggcacagaatgtggtctgtcttgatgaatattccatgtgaacttgagaagaatgtgtattctgttgttgttgggtgaagtattctctaaatgccaattagatacacttaattgatggtgctgttcaactatgtccttactgatttccagcctgctggatctatcagttagtgggtactggccaggcacggtggcttacgcctgtaataccagcactttgggaggccgaggtgggcagatcacctgaggtcaggagtgcgagaccagcctgaccaacatggaggctctactaaaaatacaaaattagccggacgtggtggtgcatgcctgtaatcctagctactcgggcggctgaggcaggggaattgcttgaacccgggaggcggaggttgcagtgagccgagatcgtgccactgcactccagcctgggcaacaagagtgaaactccgcccccccaaaaaaaacgttagtggggactgacagagaggtgttgatgtctccaactgtaataatagtggattcatctatttctccttaaaattctgtcagtttttgctttacacattttagcactgttgttaggcacatacatattaaggagtattatgtctgctgggataattgactcctttaccattatgtagtgcttctctttattcctaataattttcctttctctgaagtctgctttatctgaagttaatagaactactccatatttcttttgattagtggtagcacggtatatctttctccatccctttatttgtaacctatctggtttttatgttgaaatgggtttgttgtagacaacatatagttaggtcacgattctttattcactctagatagtcacatgttttaattggtatatttacaccattgatatttgaagtgattttttgatatagttggattaatatttaccatatttattactgttttctatttgccctttgtttcttttttcttccacacttttttctgccttttctgatcttaactgagcattttatatgattccattttcttttctctcttagcatatcagttttacttttttgttgttgcttttttagtggttgacctacagtttgcaatatacacttaaatctaatttaagtctgcttttgaataacactatacaactttatgggtagtgtaagggccttattgcagagtattcttgattcctccctcccatgccttattattactgctatcattcatttcacttatccataagctacaatcactgaatacattgttgcaattattattttgaacaaattgttatctctcagattaagaataagaaaaaaaattatttcacatttatttctaatactcttttgtatgttgagtttctgacttgtttaattttcctttttttctgaattacttcttttaacatatcttgtaaggcagtttactggtgacaaattccttcaatttttgtttgagaagtctttctcctccacttttgaaggacaattttactgcatacagatggaatctagttagttctaagttgatggaatgttttcagttctttaaataattctttctattctattcctgattgcatggtttatgaagagacgtttgatgtaatcctcatctctctccctctataggtaaggtgtcctgccctgcctctccctggcttcactgaagattatctctgtgtcttttattttttgcagtttgaatatgatatgcctaagtatagattttttggggggtggggggtgatctttatcctatttggtttcctctgagctgcttggatcttggtttggtatctgtctttaattttggaaaattatcagtcattatcacttcaaacatttttactattcctttctttctttttattccatctgatatccctattacaaggatttacacctatggcaattgtcccaccattcttggatattctgttttgtcttttttattctatatttccctttgcatttcagtttgggaagtgtttgttgatatttcatccatctcattgattatttcctcaactgtatccagtctattgataaacctattaaagacattctttgcatttatcacagggtttttatttctagactttttttgatttttttcttaatttccatctctctgcttacatgaccaatttgttcttatatgttctccacatttttccattagagctcttagcattttaattatcattgttttaaattttccatctgaaaattccaacattgcttccatatctgattgtggtttaggtgcttgtttcatctttgcaaactgtgtttttgtcttttatatatcttgtaattgttttgcagaaaatcagatataatgtattgggtaaaaggtactgaggtagataggcttttagtgtgaggtttgatatttacctgtctaggagttagaatgtgtttactatttgctatagctgtgggtatcagaggatataattttctctcttcatcttcttgtttttgtctaccctgttgtctttgggtttttgtagaaactccttaaataggctctggcttgcagttctcttatccgtaatccccttgttactatactggagccctgtggatgtagtagcaaggtgttttggtggggggaagtgttttacagtcctacaattaggtcttagtgtttcagtgagcctgcacccctgggctgtgaccttcacaagtgtttctcagtcctaccccttttaggtgatgagaaaggctagaggggctggatttgggtttttcctcatcacttaggttagttaggccctgggtgtccattcacttaggctctggtataatagtttctatgagggtagatatgttgagaaaaaaatgactgctttccttgcctcctgccaaaaccagaaggggatttttctccaatccttactgtgagaactgtaagaattaaagaaagaggaaagaaatacaaaagctggcttgccagttaagacatttattttagagaaaatcaacctgaaaggagccttctggccaagttaggtcagaggcacactctcttacagactgagtttttaaggattcaggatgggagagtttatcagaggcttggactgcttctgtgtctctttgttgtgcttatctgggagggagagttgtgtgcctgttttcatacatttttcctgcagctgcaggtatagtccctgagtctgtttttacttatttattgagacagagtctcgctctgtcgctaggccggagtgcagtggcgccatctcggctcactgcaacctctgcttcccaggttcaagcgattttcctgcctcagcctcctgagtagatgggactacaggcatgcgccaccacgcctggctaattttttgtagttttagtagagacggggtttcaccgtgttagccaggatggtcttgatctccttacctcgtgatccgcccgcctcggcctcccaaagtgctgggattacaggcatgagccaccgcgcccagccaagagtctgcttttagctttcctgtcttagtgcccctgaaggaaagggaatgtgcttgttccttattattaaggcccactgttttactggggcccatcgtatgagggtgaagtttggcagttacccaagatactttccccccacctccctttgtgtcccagctgtcttatccgtgttttactgtctgctctttctggctgcttgtagttagaagagaagtgatttccttgaaatgcatgaggctagaaagggagctggaatttaaagtggcggtgtttgtctgagatgacagtactcctgctctatcattccagaccctatggttataaaaggacaagaggggacatgttctttctagctacttcctgctgatgcgggggtggagagttttttggtcttagattgactgtaggatcaacaccatttgtagatgtttttgggtagttgcgaaatggccatgattctgtcggttaaaaatttttgataaaggttaattaggcagagtaaaaacattagtcctaggcttttcagcagcattttttattaggcccgactggttgagacagaagtaactttttttttttttttttttaatgacaggcagaggtgcatgtttggaaagacccatgtgttattttttgttagtaactgttattcctgctatgaggataataattaagcaaaatgctacagtaattgagattctctgtcagatattccactctgagggttcacagtcctactgcaaatagtagagtgagtacagcagttcccgcgagggtgtcatagtaaataattttcattaaaaaaggttttaatagttggcttaaaaggagaagtagaaacgacaaaaagtatttggtgaggtggggttgagactgagtaagatgagcaatttttacttagttacttaacttttatgatttttagcttaagatttcttatttatttttttacatgaataggactttttttggactgttaggggttgctttctcagctctttaggctttgacttgaatatgatgtatccaggagttgatttctgtaacggatataatttaaactgtaaaagataataaaaattgaaaaatgttaggcaagactagaatttaacaacaggtgtgctatagtttttgaaacataatttttacttttcagtttcctatttttattaaaagaatttatgataggactgatttgctttattatacttggcttaattatttgtatacagtgcagcaataataattatttgctacataggccttttaaatcagctttgatggaactttgttacatagaaggaatttgagataagagttgttaaagccaagcccagccatggatttgtaccattaaatacttatgagttgggtgaattccttttcttttgaggttttaagataacttggggttcctggcctgtcagaaagtgacattctttacttaccacacatcagaaaccctgtacagggactgtgcacacaaaatatgaggccagttttccaagggtttcattggcttcttaagtttgattccttagaggagagcacaccattccagtcaaagccttgggaaaataaccagtttttccaattgtattctgttacaaaagaaaatagattcttattgcactgatgcaaacaactgtagtgttgtcctttaagaatgcttataactagtttttaaattctagaggaactaggcaaagagaaaaaaacacgctttaaattctatttacaggagtatactttacttagttgttagaagctgtagctagcttaagacaagttttcttgactctgaaaaataagataaagattagcagcattctaaggaaaaggtaaaaacttgtttttgttttttattagtttagtgcattttattaatttttgttttgcttgatatttataaacattttagctttttgtgagttctgcatgttttgttgttgttgttgctgttgtgagaaacctgcctttgagagcgcttgttaaagtttcacagcttgaatataaaccacgttttgaagataattcaaacaaaataaaaattgtctgtaaataacaaaatgtctagtttggatactgttagaaacacaattgacaaagaaatgtggttgtttttgtggtttacaataacccaacataacaactttaagtgtgattaatagcacatatttagacataagaaccttagacatcccatacagttttggaacatatgttagtattattccttagaatataacctattagacagtcttttggaaattttatgttgctaaataattctgtttacctctttttggatggtttaggggttttgtgcagcaccgaaaagccaggggttaggaaagacaacctcgagactaaagtttgatttggggaagactgttaaatatgtttaaaatttaaaaccctcgatattatgaaatagaattttagattaccgttaagtttttttctgtttgttttgttttgctaaaatgatgagataacaatctggaaaagcaaaaaccatttattagccttttgtattacaggaaaattttgtttaagagagaaagttaaattttaccctttcattagtttgctattaatgttaactttaattttaatgaaaccttatagataattttatttaattttaatgagtttgactatgaagtgagatttttatatgcccattataacccttgacaagttttgctaaagagtagattagcattttaagaaaatcttgtggtgcttttattttagtgtttaatttacagaaaaaaagcatataatactcttttgagtttagttaatgtgttaacacacaagagttttatttgcagaattaatttttatgatgtttttacaatttgcctaaacctttcactttattttatttaattttaagacaatttattattcttcagcaaaatgtacatttttatgcctttttataatttttaactaaaaacactttttactgtttttatacaccttgcatgcaaatccatgtttagcagttttaattacatgttataatgataacttttagcaatttttaactttaaggtaaaatgtgttaagtttttttgtgtgtgacttgaaactaaaaacactgactcattttgtaatttgggcgaagtagctctgaaatataatgctgttttttcaattttaaacacttgggtaaaatcgcaaggtgagtgcttaggtagaaataagtaactactgaacaggtgggagcaaagtttagttgggcaatactctttatgataccgacatgtgaatgcttactagttttaaaagtgctggctttattgttgtagtcacagaggagtctaaaggcaaggctgggtagcttctggctcccacgttaacattatttatttagtatgccagatttttcttaaggtgcactagccactgaggatatttttgctggtgggaactgagattttctagacaggtaaattagctgccaattatggtttatcttagggacatgtttatagagatagtattcttacttagcttgcattctaaattttgttcccttattatcttgttaaagcgatgaatatgtttgtacaatgaagacaactttttttgcctttttaggttagagcttcagcatgagaattatacttcaacacagaaagttaggtctataagtgaaatataataaagtgttctgaaaagaaggagactaccttacaaccccaagagaaaaatatgcggcactaagccctggttccttttttccttattgttttgtcatttttttagaactttgggaactaaaatctttttgcttaaatgctgaatttataaattgaaacagactcttgggttttgttataaaggcaacgtaataatacttctatgtattttataggcttatatagtataataacttgaatttatggttggatttgactgaacctacgtagatactaatctgaatgactcatatacagaaaatgtgcagtattttaagtataaaaaattaaactggactagtttgcttttgttttatagtataaatgaaaatgacccaaactatttaattgtatgagcagaaattatgaatgaaagatgtattttagagctatatgacagaggggcattttaacttgaattccccagtggcaaaagtagtgtataaactaatgctagtgtatacactactgaagtgccaacttatgtaacatttttaaatttaatttttaaaatgaaagatttttttttcactgtgaagggcagtaacattaaattttcccagtgggtatgagtgaatgatttacttagtacattgatatacttaactattagcatttttgggaagctggatttgatacaaatttattttgaaaaacatggtttatgaaattttataataaaattattaataaagacattgttaagtttctataaacatgcactaaaagtggcaagacagagtggagaaatgtaattttggctgagaaaaaaacttttttcaggaaaacaagatttatgaagagaaaaacataaaggacttttgaatatactttcttggatatccattttaattaagctgagcactcttttttattaaaggtaagggtggattttggaattatataaatgttatgccaagttaaatgaaaggattgagttatatgcaggaattccctgtgataatgagagggatttttagagaaagatcccagaagctgttctatctgccacaaatcagacatggagaaggggacatgaacgtgagcaatgcctttaaccctggccacttcccggagagggagaatggcaggggaggtttgactggttggagcagtttttgaaccggtggagaaggacgaggggtgcggtttaaagtagaagaaaccctgaatatggggaacctattgccagaatctctgagatacagctaaagcagtgttaagaggaaagtttctagcactaaatggcttcatcgagaagatagaaagatctcaaattaacaaactaacttcacctaaaggaactagaaaaaaagaacaaaccaaccccaaagccagtcaaagaaaagaagtaaaaattagagaactgaatgaaattgagatgcaaaaatccatacaaaagatcaatgaaatcaagagttggtttttcaaaaaaataaaaataaacaagatcattagaccactagctacattaacacacaaaaagagaagatccaaataagtatagtcaaaaatggcaaagatgacattacaaccaatccacagaaattagaaaagattcttagagaatactgtgaacaaatatatgcacacaaatgagaaaatctaaaggaaatggataaattcctagaaacacacaatctcccaagactaaagtaggaaaagattgaaatgctgaatagaccaatattgagctctgaaactgaatcagtaatgaaaacaactaccaaccaaggaaagctcagggccagatggattcacactgaattataccagacatacaaagaagtaatgacaccaatcctattgaaagtattacaaaaaaattgaaaaggaggggatcctacctgactcattctgtgaagccagcatctgcctaataccaaaatctggcagagacataacaaaaaaagaaaacttcaggccaatatccccgatgaacatagacacaaaaatcctcaacaaaatactagcaaaccaaatccagcagcacatcaaaaagttaatatactgtgcttaagtgggctttattcttgggatgcaaggctggtttaacatacacaaatcaataaatgtgattcaccacataaacagaattaaaagcaaaaactatatgatcatctcaatagatacagaaaaagctttggataaaatccaacatcccttccataagcgaaaaacaaataaccccattaaaaaatgggcaaaggacatgaacagacacttcccaaaaaaacacgtacaagcagccaacaaatgaggaacatttcaatatgttcctcatcactaattaaaatgaggaaaattttaatatgttcctcatcactaatcattagagaaatgcaaatcaaaatcacaatgagataccatcttacactggtcagaatggctattactaaaaagtcaataacagtgctggtgaggctatagagaaaacaacgcttatacactgttggtgggaatgtaaattagttcagccactgtggaagtttcttaaagaaaagtttagagatttcttaaagaacttagaactaccatccaacccagcaatcccattactgggtatatacccaaaggaaaatagatcattatatgaaaaagacacatgcgcttgtatgttcgtcgttggactattcacaacagcagtgacagggaatcaacttaggtgcccaacaatggtggattggataaataaaatgtacatatacaccatggaatattacacaaccataaaaaggagtgaaagcatgtcttttgcagcaacatgggtggactagaggccgtaatcctaagtgaattaaggcataaacagaaaaccagatactgcacgttctcacttgtaagtgggagctcaacattgagcacacatgcacataaaatgggaacaacagacactgcagactgctagagggagtacgggaatgggttgaaaaaactccgttgggtactgtgcttactacctgggtgcaatatgttcatatatcaaacctgcacctgcaccccctgtttctaaaataaaagttgaaagaaagagaaagctacaccaaaacctgaataggacatttgttacaatgaagtatttgacacatcaatatttcttttcttcttttctgcctcaccctgccctgccccgccctaccttgccttgccttgccttttttttttgagacatagtctcactctgttgcccaggctggagtgcagtggtagggtctcagctcactctagcctagacctcccagactcaagtgattctcatgcctcagcctcccaagtagctgggactacaggcacgtactaccatgtccagctattgtttgtttttgcagagatggggtctcactatgttgcccaggatggtcttgaactcctggcctctagcaatctgcccacctcagcctcccaacgtgctggggttgcagtcatgagcgactgggactggttcatgtcaatatttcttacaagcatagatttaaaaacaaataaaataccagctcttcaaattcagagatatatagaaaggttatacatcatggtcaagtggtattcattccaagaatgcaaaggtggcttaacatttaaaaatcaatcattatgatccaccacaataaaataaaaatctcatgacctataggaagaacatttggtaaaagtcaactccttgtcatgattggcagccagaaatatattaataagacaactttcataatatgctagtctatctaccaaaattccccaaagctaaccaatggtcaaatattgaatggtttcttcccaaggtcacaggaatgagacaggaactactatcaccatctgtattcaatattgtagtggatatattggcaagtgctataagaaagtaaatgaaatgaaagacttcaggattagaaagaaagaattaaaaccaacatcataacatgattttatacttagaaaaccacaaagaatctacacagtatgaaaatttatatgtgaagcaattaaggtgctagttaatacaacgtcagtgtacaaaatcaattgtatttctatatgctagcaacaaaaaagacaaaccaatttttaaaatgggtcaaaactcgaataaacattgctccaaagaaggtatacaaatggccaaaaagcacatgaaaagatgtttaacatcatgattcaataggaaaatacaaatcaaaaccacaatgaaataccacttcacaactactaggtagatcagctacaataaagctttaggttatgtatcttcaccactacaacaaaaaacatttttaagctatactaaatgcaaagatagacaaactgactaaagtttcaaagatagatgtgtacatgtatgatccttttcaatgaagaaacgtcttttcagtaactagtgctgggttaattttatatgcagatggaaaaaaaattctggacttctaccttatattgtatgaaaaaatcagttccagagggattgcacatctaatgtaaaaggcaaaacaataaagatcttgaatgacaaggagaacatcttcatgaagttggagtaggcaaagattttttaaatagaatacaagaaccactaaacataaaggaaatgtttgataaaatgtactatattaagtttaagaacatctgttcatcaaaagacattatacgaggatgaaaaaggcaagccacagaattagggaagatattttccatacacatatctgacaaagagctcaaagtctagatgattaaaaaacaaaacagagcaacaatacaaaaaaactccttttcaataagaataaaaccacccaatggaaaaaaacagacaaaagatttgaagagatgattcccacaaaaggatatccaaatagccaagaaacaggaaaaggcattcgacttcattggtcatcagggaattgcaaattaaaccccaatgagacagctgtatttcatgttaggaaaagcgctaaaatgaagacacaagccaaagtggagagcacatggaagtggaaactaatacaaccactctggaaaactggcagcgtctgttaaagctggaaattttcacacctatgacccaggaattccaccctaagtacacacctgacagagatgtgtacatgtgtaccatgaagaccatgtgcaagtatctttgtagcatcctatttgtaatacctttaaactggtaactacccaaattccattaacaatagaatgaataaatgaactagaggtcatccacatatcaaaatactctgcagcaatgagaataaactcagtacaactacatgcaaccacaaagataatgttgagggagaaaatctacaaaacactgcatggttccatttatgtaaaatgaatacatataaaggggatatatatatatatcaagcgaaaccattcgatgctgttagaagtcccatcattcttggtgaatgtagtgactagaagaggctcaaagagttcctggagtttttctctttctggtggtgttgacagtggtgtgtttggtttgtgaaattcattgagctacacatctatgatttgtgcactttctgtatgtatgaagtacacattactttaataaaattttccaaaataaaatcttattttcgtaaaaggacaatttaaagaactgtattaagtgaataatagttcaggttttacagatatgcgtgaggtgaatgaatgaccaatctttggagaatgtgcatgattagctaggcttcattctacacatcttccttagtggaatcccattccactttccaccaccttcatcctcaggcgcccccacgcaggccccttttctgttgcagctcagctggacagccccttcggcggggactccccttgctccttttgtgactcctggctcagaggaataagcctaatttgtaggctgaaagccatttgagagatgtggcatctttctcatgaacaagtgtgacttgaccaaggccatagaactggttagttacagaaatatgctcaaatacatatcaaacatcttgacacccaacattccatgccagtttggaaggtttcaaaaagaaatcccctaattctacaatccatttccagctcacctgctgtcgcattgaatattctgacattagggatccattgggtcatgtgtacatgtttcatctggtctctcttacagtggcagtctcccctcagtggcctgccacccacagagccacagaggggactggggtagagcaggccaggtgccatgaactgccctgtcttgaaccagggctggcttctctgagaccagcgatctctgtctaattgctgccttattccttctccaggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtgagtgagccaatggagcagggaagctgatggagggcggcccgcccatccaggtagaagggaagcagtaggtgggagtctgggagcagaagtctgcagggcctgtgctctagctgggaggcagccataagtggtctaccttgaatcctgctccagtgccaacaggctgctgggcttttctggaataaattggagatcccctccccacctgatcatggggtggcattagggtcctggagaagggctatagagaagcccagcctggtcccaggtcccacacagagcttctctgacccagcacccatgattgggaaggtctccatgttctgaactgggggtccatattctgaaaggtgggcatgcgcggcatcaccattgctggggctgccgtcaaaacacatagtgctctacttacccatcaggggagagaccatgatcacaaaggtggttttcccagggcgagtcttctccattgtactctggatgtgctgatccctgcaatttccccaaaggtgggaaactcgacttcataatttgtggtaatggggaactgcatttgcactctcccctggcattttgtaaaagaaaagaaaaaaacacagagagtactaagcgcaccctgagagtttcggattcagaatgaggtggaaaagtcagaattaggtgaaattgttaacctgggacaagttcctgggagatactggcatctcttgtactaggaaaagcacgttttgagaatcatgggtctgggtcactgcctttgagctgggaacctcagcagacaggatgcaggggcctcagcttggatgaacagaccctctaggaacactgactggtccttctcaggcctgatggagacagactgtggggcagggcttaaggatagagggccaggattaggaaagggggcttgtaggcctggccaggcacagaggtgtagtttgttaaggaaagccagtctccctcagtggggaagctgcagcctggccctagaatcaactccaacactcaacacccaatgccagccaggcttcagtcttggacctgaccacaagtgacccatgacataccctgaccccaccacagcctgggtcctacacccagccactaagtgaccactgaccccagctgctgaccctggacccagaccaggcctggctgggactcctacttggccttgatctcagatgtcctgaagcagtatttcattggtcactgtgggacagcttttgcaagtgcagtccaatctgctgacatcacatcccaccctctctcaaaactaccagacaccaggacagagtgacagaggaggagaccggagaggagagccagtccagtcagggcccaaacatcacaccagaggctctaacagagaactgaatacaaagaagtgttccttgggtattgaagagtggaaggcagagagcccaaagttattggggacagcgactgcaggaagcagctgccactgtaaggctaagataaaggaggacgctttaactataaaaacttgggagcttgggcctgtaatccagacctgtgaggagggtgtgctggtgacggggcaggaggaggggccctgcaggctgtatctggtcctctggggtgtgtgtgtgtgtgtgtgtgtgtgcacgcatgtgtgcatattgaggctagttctgcagatgatggaaaaactgatttagccattgctctgagaaggaacgactgtgactgggatgaagaagctgggctgggggaggctcacaggacaggaacccactggacagaaaggagtggggatgccctgttgcccttcttccccttcttcctccatcagggaacagctgacaaagcagaaatgccatctgcaggggggcagtccccatcacagagtgagcagtagagggggccggaagacagtaactcagtgacggggatggcaaggcctcaggagaggaatgagggcagaggtcagccatctgggttctggaagagggaggcactcagaggtcctggggttcagcaaaagtcaggatgcaggcagggcagtccccagagcctcatgcttggctggtgcatccgtctgtgttgcccagtggagcctggctggggtgtgggtgagggggcaggaatggagagaagtcctatgagctgctctgctgggaaggcagaggtggctgcgtgtgggtgggttatggagaggggccagtttcttatccaccgtcccacaggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggtgagatggggcaaaaacacagggggccatccccatacatgtccctccatcagcctgacttgtcactttccattagcccaaagcatttctagggctgcagagtgggcatcgtgcaggtgcctgtcctgtggctgccagatgtcagccacagaacaggctgtgcaacgttatcaatgagtgaaggctctagagcactgggagcaggtgttgctaagcactctgcattcccacagttattggagaagctggcactgtcagtgttcccatcccccagctgagacagagagggcaccagaaggcgcagggacagagagggcaccaggaggcgcaggggccagggtgccaccccaggcggtgggctgggggtcctactctaacttccactgccgctgctctgggcagcacacttcgtagaaagagataaagatggagcaaaggatggcctccacaaggtactctgaggggacagaattcccaagacaacaaatggggtgacaaggcagatgggtggtcaaagagggaagacatttgagttgagaaaagagagtggatttgtagtcggactggtctgttgagattcaggctctctgatctttgtgggtgtcgcttcacttttctgggccttagtttccctatctgtaaaccgagtatacctgttatccctgctgtgaggactcagttacataaggcatatagagcttttagcacaattcctggcccatggttgttatcaatacatgctgttttccttcttccgtttcccgccggagccggtgtcagtcctacccctgggaagagagggcctcctggagggtggcaggtccacgggcctgtacccaggacatcctccgtggcccttcatcgtggactccaggtttcactcttctgcttcctaggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgaggacctggagccggccgcgccctgcccgccccgacgcaccctcaagcatcctccctagacccagcccaccgctcctggaggccaggaatctgttccccaaattcaggattctggagggagaggagctctcacttcaaggtttcagaggcaggattaggacaaacagtgtattgtattaggagggaatcttgctcacaacggacagaacccagctcaaaaagcgtttggcaaaaaggggacattttggggcccgttcaatagacaaggaaggctaaaggcagggactgggtcacaccctgctgaatccaggagcttcaattatgacatcgttaggattctatttctctctccttcactcgttgattctccttttctctgtgtgatttgtttcattctcagtttggctgccctgaattagaggaaagatagccactatagctcaaggattctaattcttgattccagggaaagagaaacactttttctcctagaattcatcaatcacaaatcaggggagattctgattggccagcttgggggtcatgtgatcctcatgagccaatcaccagctggggtgatggagtgctctgataggctgtctccgtcacatgcttcctgctgggaaggccgtgacctgtggtcacatggcctgagcggcagggcggctcagtcacctgggcagctggtactgctgagaggcagggtggcaggctatgggccggagcccacagctgcaggaggggcccggggatcatatgtgagggctgcttgcccctgcccgaggacaggctggcagggacggccacaggcagaggtgctgtccaggcatgcagcaggagggaaggaggccctggggagcccttgctgtttgggcgcagcaggaagagcagctgcagtgtccactgtcccctcgtcctcctcagctcctggccactgccttttatttttcggttgtgttaaacttgtcttccccacagattgaccagctcacaaaaatagtgaacaaagtagagttgctggagatttagtggtacagagagggagcttacctgtgcttcccacggcaagcaactcaaatactccttgaagctgcactgtccaacaaggcagccactggtaacatgcagctattaaatcaattaaaatgaattatactgaaaaattcagttcctcagtctcagccacattctaagtcccctggccaccgtgttggaccgtgcagacttggaactcatccatcaccacagagggctccattgggcagccctgcctcagatgctctgacacccggtcacttcccattcttggcacctcccggtctcttccctcaggctcttgctcacgtgggcccagactccttggctctccttctccctctctgattcctttcccaccaccttcctctttcctgtcacagagaaacaacttcctgcttcatctcagacctccaaacttccaccttcaagcccaccacggggctcaggacccactctctttaaaggcagagaaggcttagacagcaacatggacatttgtgtctgtgttatacctgcagggctttacagtttatataatcatctaagatatcagaagatgtaagatctatgtaatctaaacctttgccaggtagagaggacgggtctgtgtccgttgtgcaatagaagttaggttcacgctgactcccttgttcatatggcaggtgtttcttgggtgactgctgtgtaccaggcaagtctggtcagtctggggaagggtccaggctcaatgtgggccctggggctgggaaggaggcagggtcctattgctggggatagcaacccactggatctccccaggtgcaggccgtgaggctgatcgctgagggcaaagcccccagactccctcagcctgaggaaggagccacctatgaggggattcagaagaaggagacagccaaggtgagtgctgggtccctccacaccctcatcctgcctgtgagcagactggggttgtagagggcagcctgaggaggctggggttcagcccagatggtgcaggttgtaattctttgaggccagaacacagggcagcccaggtcagggatgcatgaagagagccgtggaggaggaggaccctggcacctgggagggtagcgaacagggtccattccaggttctttcctgttcctctttaggaggaatgggcagacaaagcccacagggagataagagtgggagttagggggcaaaacgtcagccgtagtgcgagcagtcttcaaggcaaggtgtgagggacagtgcgggtctctggagcaatagccagtggaggagcctcagaagcctgtaggctgtgtctcagctcaggagtatgggttgctgtgtggggacccacaggggccctgccagtgaaaggttgggccctatgggacgggcctgagtacattgtgctggggcctctgtgtagggtctgggccatcttgacagcaacagaacattatcttccccaaaccattctgaagtctgctcagcccatgagagactgagggtcagagagcacccagaactaggggcaccagctcagggactcctgcaagtgtctaagaggaagctggggttaccagctgtctcacaagagcttggtccactgtccagatgtcatcagggtgggaggggagtgaggagagaccagctgagcacacacaccttgctccccacagatcaactgggaccagccggcagaggccattcacaactggatccgcgggaacgacaaggtgccgggagcctggacagaggcctgtgaacaggtgtgtccctgcatggctggaatccagccacgtgcattggtgtatcccactggccattaaactgtcacacatgtttgaactggttggtataataaatagctactgccctggcccctactcccactgggtgccccctaaacatcccagcctttccccaggagtgagagacctacccagcctgcagtagctaaaggatagatgtcctgcgtagctggaggcctccaggcccttgtagtgcccctggggcccagctgtattggtggtgaaatattttgagtctcaccactgggcttgcggagaccccaggcccagtactcactctgacttggcctcaggcagggtggagcagcacattcagggccaggctgaccgtgggcaggccagatgctgaagatggggagacttgggggtcacaggctctagtgaggcatcaggggtggcgggactgtgtgtggtggactttgtgcaaaccttgagggcagtcttgtcccccacacagtctcagactctccagacccctgacccccagccgactgcccagactgtggccagaagcctctctgctgtcctcatcaacgcagagccctttgtactagcaaatgcatcttctgatcaaagcaaccactccttggcagcaccctgaaggcaggtagcctcattccgtgatgcctggagcacattctcccccagtctgtgcacctcaggtctgaggccatgggccaaggagaagggtcttatggcagagttgaggcagacctgccatcagctccctgaggccactgaggctcctccaggtcttgtttgtgccccaggagaaagggcctcaggggtcacatgggctttgagccggctcccaggtctcagctacccctggcccctctccctctcccagccctgctcagacctgcctgggctactggcttcgggggcttcttctcacccaccatcttctgatatttctccccttgacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatggtaagggcacggctgtgggtcacttgcctgctcaaagccacccatgctcctgtccttggactcaggcctcacaggaagaccctaggctcctctggagaaaatggaaaaaaccagacccaggaaggaacactgaccctgatttgtccctgaccacccggctggtcctgagcacagggtgtccgaggcagtttacccacttctctgttctgggaaagctgggctccctacccttcctggctaggcacccatctccaggctgagtgccctgtgtgggtgtcaggcaacctagaatcagagagaagccctcccagggagcctgggttcagggcctctctttggtctatcagaaacacctctgggtgtggggtcattaagcctctgtgcctcagctcccatctctttgaacggcgatgccatggtaacttagcacgtgcagagccttgggagccatgccggccacctgctcttgttattagcagactacaactcacggtaccagcaaacactgatggagcaccttttataccagaacaatgtatatgcgttaaatttaatctgcctaacaacactatgagatatgtataaatattatatccttatagaggaaaaaaacagagatttaaataacttgtccaggatcatccaagctagcccgtggcagagctgggattcagactctgaaattctggctccaaagccgtgatgctggtcttggccatggtagcttcctgttcatatgcactctactactccttctcacatgagcagccgggggtagggagagggcaggcagggatcttcccacacactgacagggtccggacaaaccccatgggcgtggtacccccagccgtgttgctgtgtccggcctaccagagtgaggcgtggcagtatggggcctggcctttgctcgctcttggtgtccagtctgccatgctcccctgtcagaaggtctaggctgctgttgatgtctgcaatgtagtgttttgggtatccaagattgatatatgcagttgcaagagaatatctgtctgtggtcaggttccctagaagcagcatctaaggtaaaaattcttgtgcaagtgatttattgagggaatgttccagaaaatcatgcgaggcagtaagggcagaggaaagcaaagcaaaagtaaaggttcaggagaagtctagcctggggctgctcccagggtgggttttggagtattaactgcaccctccaattatacctgcctgtccccacctctgtcagcctttggtttcagtggcccctggggtggggtggaggacccaccaggcataatccctcggcctctttgtgtacaggagctcttatccatccacagcaagcaaggatgggacagtgcaggccgttatcatccagcccttgctgcagctggaggacagggcaccagccacaggggtctgagcagggcacccacagcatctgtccagagacctgcaaagacaggaatgcaaagaaggcaattaagtgtcttaagaggaagctggggttatcagctctctcacaagagctttgtccactgtccagaggtggtcagggtgggaggggagtgaggagagaccagctgagcacacacaccctgctccccacagatcaacccagaagaccctgggttgaagcatctctcagccacgccctgtggagtctggctgggctttagcttgcagaaagctccagaacatctttgaaaggcaatggggcgagggtcaggccgagaggcaagttccagttctggcagagcatgcatacagagtaccattcttacacagccactcttaacgcacagtgacatgcacccacccatgagcttatccataactctttttgtacatgtgttttttttcctggcccctaacaaaagcatttgttgaaaaactattgataaacaagcaggccccaaacaattcaaacatcttattaaatacagtaaatctgaggcagacactagagtagcccagagtcatgagctacaatgggggcagttcatgtctggcagccagaatccccttgaactgatggctggacgcaggctctacctgggaccagcttgaagtgctatcctgaagctgcagactgcagggccggccagaccctttttcagcctctcctcttcccacctctgtatcccacacaggcatctggtgatgttctccaggtgtttctgtggcagttctgggagctactgggtgattgcaagattagtttttttttctaagttgactttctatgtggtgcctgaatgacgttttctttttttgttcagtaggaatccttttttatagaagtaataaagtcattacacttaaaaacaaagtgaaagtgtggtgggagtgggtgatggaaaatcgagcagctggtaggggacacaagctctgcaattccctctgtgtccctggaatagtggcctccccactctgaactcatcactaatctgagactccctgcttcttcctcatctgaaggttggagacaaggctggagcgcccagcacagcaccccttgtgggacaccttcatcactgcctcaggtccgaccacaggaactgtgaaatccttccttttggccgggcgcagtggctcatgcctgtaatcccagcactttgggaggccaaggtggatggatcatgaggtcaggagttcgagaccagcctgaccaatgtggtgaaaccccgtctctactaaaaatacaaacaaaaattagtcgggcatggtggtgcgcgcctgtaatcccagctattcaggagggctgaggcaggagaatcgcttcaacccgggaggcggaggttgtagtgagccgagatcgcaccactgcactccagcctgggcaacagagcaagactctgtctcaaaaaaagaaaagaaaagaaaagaaatccttccttttgcagctgctggtgaagaatattcagctggaggatggcaaaatgatcctggcctcgaacttctttaagggggcagccagcagtgtccttgagctgacagaggcagagctggttactgcggaggctgtgcgggtaagaggcaacttcagggctgccatccagttgggcaggttgtgccgtgcacatgtgttctgcaaatcacactccccagagttgggcagcgccagccctctgtgggtgtctgttttggctccaggtgcagtgttggttctatctcgtcttggagctttctgttgtcttcttgctgctccttcctctgcaactggggccctgggatctggccagttcagtctgactcttctaggggctcattgtcaacacttaataagtgaaacagaagctcctggaatatttgaaagagtcaggtgtcaagcccatgtccctgtgattagaatgtgagcactggagccttccagaaaggctgcaccagaggcagcatcccgggctgtgaccaacacaagctgcccataaggcacacctggtctccaatccagctttgccccaatatgatgctgtagggagctttcgtctctaagactcagtcttctcaacatgaatttccatccatgctcacttcctggaatttgttcctgacccttcatgctccctcccactgtatccttcttccctgggtggagagaagagatctgggggaagaccttcaagagagaaggaacagcaaatggcaaggccctaacagggcagaggcctccctgtgttcagggagtcaccatgggagggcactgtagctggagcccagggggtgaggggcagagtcaggtgggcacagctggggaccttgggtgttaacagcacatgtgcggcaaggctcagcaaggatggacatgaggcatttgtgtgatccaaaggtgctgagagccagcaacttccttcttgaaagtggaacaccttgaaggtctgtttaaaaaaaatcctatttattccaaagatatccctggagcagttgctctggccctgacttggcctgccctggtgttgcagggccagctggacagacagccctcctggagcccacagctgagtggctctggggatgagctggggtcatcgtttgtagatgtagacctgagtcaaacgatgctatcttacaacagctgcagccaagtcctgcatctgtaaaatgggaataacaagcccttcctcaatggaggattggtagaggagataacacacatgaagaggtttagttcagtagctggcatctttgaggaactcagtacacatcggcaatacgtctaagcatctcatgagaaaagcagatacttctggagtgtgtactgtggacaaaagttctcagaaaatgagtttggagaacagagactttattccagtgaccagtttgcaaaccgtccaaaggcagcttctggtgtaacaggaaggtgcattcctgagaacaacgggaagggtggggttttatagcaaaagctctcacccaggttcccatgcaaaggaagggttgaaaccagttctaattggttggtacagctgagccctgattggctggttcaggtgagctctgaaagactcaaagataaaaaggtgcaggttttaggggaacctagagtacatgtgtgaccccctagacagcaagtgtccacttggctctgttttaaatttaggcccagtttgctgctggggatccatcttgaaggattggctatttcaggtttgcatttgttcaccgtgcacattcagagttccagatcctcctggaagagcggcgtgtttattcatgataacaactctatgcagtaggtgccctcagtacctgcaggtctcagctgtggagccaaggcctgaggagtggagtccgggctctggagggctgggctcaagtcctcctctagctgttcaccgtgcagccccctaaggccatcgctaggatggctatcattaggcctcttgctcacagctgcactcggcctccaggatgtatggtctggagaccgatgtgatagaggggacatggccaaaacgaggggaggccagtctggggctgtgcagctccccggtgttggtggaggggcctggcctgtggctgttcaggagaacgctccaagagcctgctgtgggctcggcaggtagtgggccacaaccccctatgccttcatgagctgaggctgggcagttgctgcccatggcagaaacgttgtgtttgctgactctccctgtagtccagactctctgcctgcctcacacacggaatccttacacagctgctgtcagcactgaggggctgcctgcattttcatggcttggtgggctttggctttgtggtgcactcagtgaccagtctgccgcactgcccctttgtggctccactctcatctgataagggccctggacgctagcaggtgccatccagtaggggacaactggtggccccaagcggtgtggtctgaggcaggtagatcctgccagtagagtagccagcaaaggttttggggaagaggtgacacaggaattggacccttaaggatgcccaggacttaaatattagctggggagtcaggggaaggtgtcgccagcaggtgagagcctagcagagacctcgaggggcaggcagcaggtgtgtggcagacagtgcgtggcttggtgtggtgttgatgctcgccctgaggatgggaagggcagatccatgacatttttccaagaaagaaagaggagagccgggggtgcttgtgccaggggttgggggaactggttctgattgggcctggaccagcatctcatgcctcacccccaacctgggcccatgattgacaatggcctggagttcatccagagagtggggacctggcctgatattgctggggcccctcctgactcctgccccactgggcctcaccagcagcctgcccagagagcagtcatcccatcttgactgctggacagccttactgggtgccttagtgggagctgagcacccacatccacagggccagctggctgggcactgctgccctccataggtcccagactgaatccttcagaggacacagaccagttagcatcttggtgaggtcaagacccaggtctcctgaacccatctgtgagcctcatagtcaccttcaggcccaccctgtctccagcctgctgctacaacacccgggcatcggtgtcacactagggacaccagaacctgggcgctagcaccaaggtgagtgggggtcaggagcagctgggccccaccttcctagtccccagccatgcctagaggcctggcacatctgtcctccatcagctggactgtcatggggaccccagagaagctgggggttgaggtgaggtgggcatgaggacagcagccagcatcagagggccctgggatgtggcagctccttctttcccagaaggtggtcactccaggaccattaagcctcctgggatgaggcaacaacttggaggtacatagagaagcccagcctggccccaggccatccatgagtctgttcaggggttgttgtcctggagtggcacttgtccccagctcccctggggccagcctctcatcaggtcttgctttgcagagtgtttggcagcggatcctccccaaagtcctggaggttgaagactccactgatttcttcaagtcaggggccgcgtctgtggacgttgtgaggtaaggccaggagtggaggggtcctgtcccaggtacttggtgctgtgtcacaaatctctgcaaaactgagcagcaggaaacaaccatttgttacactcatggatcatgtgggccagggacccaggaagggccagtgtgcaggtctgcgtgcacacatggtgggcagcacaaatgaatggttgcaggtctttatgcaaatgttaagggggcgtagttgcatgcagcctctctggggaagttctaggagggaatttgggaggagttgattcagaagaacagtactgagttcatagggagaattagggttatgtattgtgccaaccatttgtgctgtgcaacaaagcaccccaaaacattgagatttaaaccaacaccatatccttagctcacagtactatggttcgacagtttgtgctgggctcagctgatttgcatcagattcagctgctgtcagctgggctcacataagggcgggatctgccaggtcagctgggggctggctggtcctgtggtggtggtgggttccaggagggagagcgggagcccagggagggggtctcagagtgagcacgttgtgttcattgcattctgttggccaaaatgagtcacagaacaggtccagcttccagggttggggaaagaaactccacatcttgctagcaggtgctgcaccttcacatggccaaggctgtgactgcaggggtgggcattgtgaccagttttgcaattgaccatgcatatgagttggggctgagtgggctgagttgggcctatgtgcttggcactgtggacctctagtaactcactgtgaggcagtatgcagtttgtaataattgttttgtaaaaaatatgccaagaagaagaatgccagacacctgagagaatggtgtccagaggccaggccatgccttgtgtacagctaccgagctgaggatgcaaagaaagcaaaactgcttttctgtaaatagttaagagtatatgtccttttaaaaaaaatgtggcaaaaaaacacataatacaacatctaccttcttaaaattatagctgtatattgtaggattgttaactatgagcacagtgttggtcagcagatctttagaactttttctcgcacaactaaacctttctgtccgttgaacagccactccccatttccttctccctagccccagcaacagccattctttttgctctgatgagcttggccactctagtacttcatacaagtggaatcatgcagcatttgtccttctgtgactggctttttacgcttagcatgatgtcctcaaaattcagcccttttgtagcacatggcaggactgccttctttttatggctgaatcctatttcattgtacagatagaccatattatctgctcatctgttgatggacatttgtgttgtttccacatcttggctgttgtgaatcaatgtggaagtgcatgggaatttgagatcagttcttttggacaaatacccagcagtgagattactgggtcatatgatagttcttcttttaattttttcaggaacctccatatcattctccacagaggctgcaccattttacattcccaccaacagtgcacaaaggttccatttttcccatatctttgccaatgcttactttcattcctatcttccttcctctccccttttcttctttccttttgaacaataaccatcccaacagtgatgagatggtatctcattgtagtttttattttcattttcctgatgattagtgatgttgagcatcttttcatatacctgttggtcatgtgtatgtcttctttggagaaatgtctattcaagtctttgcccatttttaaattggattatttgttttgtttgctattgagttgtaggaactccttatatgttttaggaattaacctcttatcagatacatggtttgcagaagttttctcgcattccatgctgattgtttcctttgctttgcagaagctttttactttgatgcatatgacttgtatatttttgcttttgtttccagttcttttggtgtgatattcaggaaatgattgcaaagaccaatgtcatggagactttcccctatgctttcttctagttttatagttttaagtcttaagtttttcatatattttgagttgaatatttttatgtgtggggcaagataaggatccgatttaattattttgcatgtggacatccaatctttccaacatcacttgttgaagggactatcgcttccccattatgtattcttggcacccttgttgaagattagttggccatatatgtttaggtttatttctaggctatcttgttcattggtctatatatctgtgtttatgccagtatcatactattttgattattgtagttttgtagtaaattttgaaatcaggaaatgtgagtcctctaactttgttctttttcaggattgtttgaactattcacagtcccttgatagtccatatgattttaagatgatttttgtaatttctgcaaaaaatcacttgggattttaatagagttggcataaaaattgtacataactttgggcagtattgtcatcttaacaatattaacttctccagtccatgaacacagatggctttctatttatttagatcttctgtaatttttttcagcagtgttttgtagttttcattgtacaactctgttggctacttggttaaatttattcttattttattcttttgatgccattgtaaagggaattgttttattaatttcctttttggattgttcattgctaatttatggagttgcaactgtttttttgcatgttatttttgtatcctgcaattttgctgaattcctttattagctctaacagttttttggaggtgcagaatatttaaagttttctttttctgttttttagacatggtcttgctctgtcacttaggctggaacagtggtttgatcatagcccaatgcagcctcaaattcttgggctcaagtgatcctcctgcctcagcctcctgagtagcaggactgcaggcatgcaccactacacctagctaacttaaaacaattttttttacagacaaagtcttgctatgttgcccgggctgattttgaactcctaggctcaagtgatcctcccacagtgcttgaattacagggtgaggcgttacacttggcccatttaaagatttctacatgtaagatcatgttatctgtgatgagatatgatttaacttcttccttcacaatttggattaatgtttctttcttgcctaattgccttggatggaacttccagtacagtagtctccccttatttgtggttttgctttctgaagtttaagttacccatggtcaatcatggttggaaaatattaagtggaaaagtccagaaataattcatacgtttttaaattgagagccatttgatagaatgatgaaatctcatgctgtcccgctccatcccacctgatacgtggatcacccctttgtccaggatatccatggtgtatgcactgcccacccattagtcacttagtagccactggtgttatcagaaaaaacatagaatatatagatggtcccagacttatgatgcttcaacttaggattttttgactttatgatggtgtgaacatgatacgaattcagtagaaattatgctttgtgtacccttacaaaattctgtttttcacattcagtacagtgttcaataaattgtatgagatactcaaaactttagtataaaataggctttgtgttagatgagtttcccaactgtaggttaatgtaaatgttctgagaacatttaaggtagcctaggctaagcgctgatgttcagtatgttaggtatattaaatgcattcatgatttaacattttcaatttataatgggtttttgggatgtaatcatatcataagtcaaggagcacagtgtaaggttcagccctatatgtggtttcaggcactcactgggagccttggaacaaccccaacccccgaccctgcccgtgggtaaggaggaactactatagtgtattgaatggaagtggtgaaagcaagcatcctcattttgctgctgatctcaggggaaaggctttcagtctttcaccactgagtatgttagctgtggatttttcaaatatggcctttattatataaaggatgttcccttctattcttagtttgagtgctttttaatcatgaaaggatattgaattttgtcaaattctttttctgcattaaatgagatgaccatgtgtttttctcttcattccattaatgtggtatgttacactgattgattttcataggtgaagtatccttgcattccaagaattaatcccacttggtcatggtatgtaatattcttaaaatgctgctgaaatcaatttgctagtattttgttgaggatttttgcatcagtttccataagggatattggtctgtagctttcttttgctgtagtatctttgtctggctttggtctcagagtaaacgctggccttatggacagagttgaagatgtgttctcttctcagttttttggaagagtttgagaaaaattggtgttactttcccttcaaatgtttggtagaattcaccagtgaaatcattcagccctgggcttttctttactggaaagattttgattactgattcagtttccttactagttatatatctattcaaattttctgtttctccatgagtgagttttggtagattgtgtgtttctgggaatttgttcactttacctagttatcaaatctgttgccatataatttatcatgtattttcttatgatgctttttatttctgtaagattggtataatgtctccctttgatttctgattctagtaatttgagccttcactttttgtttcttggtcagtcagataaaggtttgttaattttgttgatattttcaagaaatctaaatttgattttgttgatttgctgtttttttttctggtctctatttcatttatctctgttctaatctttattattacttccttctgctagttttgggtttagattgctttttaatctcattccttaaggtgtacagtgtaggttactgatttgaggactttattcttttctaagtatgtatttacacctgtaaacttctttcttagcactactttccccgcctctcataagttttggtatgttgtgtttttattttcctttgactaaaggtattttctagtttctcgtgtgttcttctttgacccattaattgtttaagagtgtgctagctcattttcatatctttatggattttccagatttctttctgttatcgatttctagtctcattccattttgattaggaaagatattttgtaagagttcaatatttttacatgtgttaagacttattgtgtagcctaacaaatgatttatcatgaagaatgttccatgtaaccttgaaaagaatgtgtgctctgttcttcttgagcagtgttttgtacatatctgattggtttgtggtgttcaagtatcttattctcttgagttctatccatttttgaaagttgggcatctaagtagctaactactattgtagaaatgtccatttttgcttcatatattttagggctgtgttaggtgtgtatgaatttataattgttatatcctcttgcagcatcaaactttgtatcaatataatgtccttctttgtgtcttgtaaacttgttagatttaaagtctcttttatgttactatttgcatggaatattttctctatccttttacttccagctcttttgtatcattatatctaagtgattctcttgtagcatatgtatggatgctgggttttatccagtcatccaatttgtgccttctcatgtttaaactttaaatagattaaacaggagagtttaatccatttacatttaacttggttactaataaataaagatttatttctgccatttgttttctgaatgtcttatttttttgttcctcagtttctctatactgtccttttttgtatttggtaattttttttgtagtgtatcactttgattcccttctttcttttactgtatgtttttagttatttctgggttgttacttagggattacaattaacatcttaaatttataacaaggtagtttgaataatatcaacctagcttcaatagtatacaaacactctcattctatacatctcttttccttcccctttatagtgttactgtcacagtgtacatttttatacattgtatacccattaatatatatttaaaattattgttttatgcacttgcctattgtcatataggaaaaagagagaagttacaaaccacaataaaatacaataatatggactttcatacttacctatgtagtggcctttacctgtgttctttatttttaattgtgtcatcaagtctatggtacttttatctcagcctgaaagactcttttcagcatttcttctagggcaggtctactggtaaccaatttcttcagcttttgtttctatagaaatatcttaatttctgtttcattcttgaaagatagttttgatggatatggaattcgttgttgccatttttccccaaaacttttaatatgttatccaactgctttctggcctttaaggtgttttagtggaagtcagcttttaatcttatcaaagacccattgtatataacaagccatttctctcttgctactctccaaattatttatttgtctctgaatttcaacaagctgggtgtaatgtgccttggtgtggatctctttgatcctgcttggacttcattcattgtatgtcttagatgtgtatattcatttctttcctcatgtttgggaactttggggccactatttcttcaaatacatatttagagaaacctttttctcttttttcctctggagctcctgtgagtatgttggtgtgtttcatggtatcctataaatccttcaggctcttttcatttttcttcattcttttttctttctgcttctcagactggataatttcaagtttgctcatctttccttcagcctgctcaaaactactgttgaacctctttagtgagttttttgtttgtttcagttattctacttgccagctcaagaatttctatttgacttgttattatagtttctgtcacttcgatattctcattttgttcatacatcactttcttgatttcctttagttttttgtccataatttcctttgtctcattgaacatatttaaggcatttgacataatgtctttgaccaataattccgatatctgatcttcctcaggggtaccttcttcaaattattttttgttcctgtgaatgggctcttctttcctatttcttcatatgttttgtagatctttcttggtcataactggacattttgggtgttatgttgtggtaattcgggaaatatatttctcccacttattagggattattgaatcttccttgttgagggctagaactgtctgtttgtgacttttccaaattattttttgcaaggtgtgttccttattgtgtgttgtcgttgaactttctgttccattgttcctgcagtcagccagtgacctaacaaagatttccataaatgtctggctaccaaagtggagggaaagtattgccttttaaaatctcctagaagctacttcagcctgtgagggttgaaacaatgactgccagcctttgtgatagcttctcagcaatcaaaaggaatatcagtgctcaggacacaatgctggtggtcagaggacaaggtccttattgcccaccctggcttcagcaagctgcgtctggaatatgacccagccctgcttcaactttttgtggcagaggtgggaggtggggggtgacagccaatatcttatgagaggctgaaaatcatttaaattgattgacatttaccagcttctttaccagtctttctccttggtgctgaaagcatttgactagaccccaaagttccaacatatttgattcatgtaagttccatagttatttagataaggggatacatttttggagcttcttgttctgccatctgctgtctagacattggcctttatttcttttggataaatacttgagagtgaaataggaagtatgtttaattctttagaaagtgctaaactgctttccaaagtggtagcaccatttacatccctgccagcagtgtgtgcaagctccagttgctcagggtactacatctttcccaatagtgggaatggtcaggcttttaaattttagacattctaataaatatgaagctatattccattgtggttttaatttgcatttccccagtgcctaatgatgttgagtgtcttgtcatattcttatttgccgtccatatttctccttttgagaggcatctgttcaatcttttgctcatttttaattaggttgtttgctttcttagtattgagttttgagggttctttattctgaatacaagtcctttatcagataatgtgatttggaaacattttcttccaatctgtggcttatgttttcattcttttaacagagatttttggagattattattaatctgctaattattattattattagatgggttgtcgtatttactcatcgcaaaatagcagagcagctattattatttctgttttacaggtgaagaaattaaggcttagaggagttagtcatttgcccaaggtcacaaattagaaagtaatggagcgagaatttggacccgggaccatctgagtccacagcctgagcccttctccccagttctgggctcatggctacctctcggtgctgggatggagcctctctggggtgtttggccccactgccactgctgctagcgatgcaggcctgctgagcccctcccgtgtccccatctttccatctccttcctccaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtgagtgctgggccctccctgcagcaggccctgcagagccctcaggcagctgcatctatgactacataagacaagaggggaaacctggacattcagaaagccagggccccaggagcccacccttcagtttcccacactctccctgcacccgggatagcctggggatgtcagtacagtggggccagcttgccagaggatgttgctgtctgatgctcaggacatgggccaaactctgagtcccaaggcaggtgatcaagatattaagaagagacttttagttcccactaaggaaacaaataatcctatacattcaacttgtgtgtatggaagtgtgacaagtaattgaaaatctgttttttaaggaaattaagaaatcttccttgagctatcttggtagactgccacctcccataagaatgggctttagcatagtttgtttggctggtagattggaacaaaagtgggtgaagtaaggggccaaggtggacctaagggtgtccttgggattgaggacaaatgactgacgaacagatttcaggaggaggatcatatcccagaggtgcctgggttcagggaggaattgccaatccacagggatgtgagtggtgggttgtagcatgtctggggcttgccaagggcttcactagccactggcattttcctctgtctgagtcctcttagcccaccctaaggaggctgaggagccagcccaaggtggcacagggagtaggtggaagcgcagagctcccgccaggcagcctggcctcagagcctgtcctttgtctctcccctgctcagctgttgcctacatgcagctctgaagccccaggaggcccctgggcagtgtgtgtgtgtgactgtgtggccatctgtgtatgcttcctgcaccctgcatgggtttgtgcttgtcactggggcctttctttcaggtggaaatggcagtgaacaagcgcactgtccgcatgccccaccagctcttcattgggggggagttcgtggatgccgagggcgccaagacctctgagaccatcaatcccaccgatggaagtgtgagtgcaggcccagcaccccttctccacattccccagcctccctgtccttccttccctgcccccactggcctctgggggtcctgaccctgagagtctctgcttggacatgtgcctttgagagggacgggaaagaatgccaggtcgtttccagcccaccttactggagtggagtggagaggaggtgcagggtggtggcaggtggcaggagggctcggaagggtcttgcacctgcttcagagactgggaacagagttcctcctaccccaaggaagaaattaggccactgccacacttgcacacttcagcagtagccccagtgtgagactaccttgtctactacttgagccctccaccgttaggacattcttcttcgacctgagtcctgtgtttgccactccttcttgactgtgaccttgtggcatcatgagccaaagcacgcctatggtagatacacacgtgaacatatccaaaacacaggtttcaaagcagggcttgcttttatggctgcatactgacatttttctatcctgtccatcctatagaattggccaagtccttgcagaagacagagagcacactcaaaatgagtcatttgagaggagttaatgaaagactcatctgcaaagggagagggagggggtagggacacagacaggacagtgcggtgcccttgggacggagcatcaggaggggctgaggatggggccttggcagaaggggcatggctgtcttgtggcggcagacaggaggcactggctttgccctccctgggctgccctcaccacaccccaccggctcccctcaccacacccagcaggcaccaaggtgagggagcctgcacggatggcacactcagggcaggaacagggtggggaccttggggtgtagacacacaaacagccctctcccagggccctgtcttcccttcctgtgtaaaccctcccagggttgtcctttggccatgcttctcctccacacctgctcatgtggacaggggccgcctcactggggccccaggaggaggccagggaagcaggcaggggtatctgtgtgcaactggcttagggagaacttgtcatggctctgcttccactataggtcatctgccaggtatccctggcccaagtcaccgacgtcgacaaggcagtggccgcagccaaggatgcctttgagaatggacggtgggggaagatcagtgcgcgggaccggggccggctgatgtacaggtgggagcccaacatgtacctgccagccactgccaccatcagcttctgggcagtggcacgggggggacttctgtggaggcccttttacctgccaggaggagctgggtcctggggaggctatgggaccgaggccatcagatgggccaggctggggctccttgcctgaggctcagaaaaggcttctcagaggaagggatatgagaaacaggagacatttcagcagagtgggctcaggggaggtgcctggtggaggtgaggaggtgcggaagccaagggatgcttccaaagtgggcgcaggctgggcctcccaggcagacaaagcacttccctcaccagcctgggctggaggggacttagctcctgcacgcagaagacagcaagggccagagaagggctggcctggtctctgcttgctcagccaggctctgactactggaatctataggtttcacattttctattaaaaaaaaaaaaaaaatttaagccagggagaaaggggccttctctccttagttccagttcagacgtcttaggcaaggacttatgatgactttagcttatgaccttagagtgagaggaaggcctggaagagaggtgctgtgcccctggaaccacagggcctggcgggaaggagcagtcaccctcacagaggtggagtgatgttcctgggagaagagagggtgcggccagatgagccgagaacacaggtgtcttggggcctggctctttcgctggggtcctgggaacgtctaggggtgcgaagccaagttatggcgtggtcccaacgaagctcctcacctggcaggagagaccctgccttggccttgcggtcagaatggcttctgtttctgttatactccagaggccagaaaagccggggcagcccagcagcaggaaactagagagaggggttgcaagagcatggtctgcaaaaccgaatggagattagggttggggcagggagggctgtgggggtcgggcatgcccagcctttcataggttccagtccccttcgcaagcccctcaattctagaaaggcactggccacgccaagtggtccctagagttcctggaggtcaggaagagctgtgaaacaagcacgacaggtggcgggagaacctctggcctgggccctgcgtgcgcgtttggtggaccgcacaaccaacagcgtgcgtggggtccctcccttggcctctgctgccatctggtggcttgtatcataacagattctactcacccataatgacagtgaggggggcaccctgggcagctgtaagtggaccccttcctgtcctatgcaaactctcaggccccgtgaagacctgggagtgcccattactggttctgcctcagctcagcacagcagaggctgggtctaggtgtcccggagggggcagttcaggagctcccagataaatggctgcagagcaccctgtcagggtggcgggaccaccgtgggtgttagggaacacgaaattcactgcaggaatcagacattacacaattgtggaagctaggaagaaggatccagagggagagttagacaaggttcctaggcagtcccctgaactcctggtagacaggatagaacctccagggagtaggagcagccgtatccagctgccaagtggggccacaaagaggagctcctgggaaagaccgtgggggagctgctggctctgcccagataccactgtggtccacggctgagaatctgacggtggtccaggctgctggtggtcagtagggccggccgagcctgctgggcacccctgcatctgccctgcagaccttcagagggagatggcagcagcttcacttctcctgcactgctaccctggcacccagggactgggctctggggagcatgggtgccagggtgtgaattcagcagcctaactgaattaacaatagaatagtcctgcaaggcagcctctcagagcttcccgaatagtgcactcgggtgatggatactttagaaagtgtgtcctgggaactggattgatgacacagccatgtcacacacaggtggaattatctagaaatgtgggggattcaaaggattggggctgatgaaggagaaggatgtgagcaggggaggcatggcacaccacaagctttagtgggctgcaggttgggtagggttgcaggagacgagcagtgagactgtcccaaggctgccgtgtgggcttccatgtccaggtgacaacacacagtgatgcagtgggagcctctgggtctgagggctgccaagggcagtagcagctttcaccttatcaccccaaggccctgttttatcaatgggcaacaactgctggttgaggttcctctgggtatgcaaagcagcgggccctaagtggctaaaaacgtacctgtttgggctactttaagcctaactgggagtgggaaaatttgagtttggtgccagcaggctttggagcaaatgggtctcatttatataacaaagaggcagctcctgtcttcgcagctggggagcctagtcctctatcggccgctaggtgatgttttcactatttgctgtacaaaatcggtttttctcaggaaccgatttacgcatgggctctccttgcccagggtggcctcgctcagttggttttatgcagcaaacctgagctgagtgcttcccagtgctgtgctggagctgggcgctgcagagagcagggaaccagacagcgccctgcctcctgcagcctggattccagtgggcaggcaaatcgtgatgaaattatcatctacctgaatgtctgttacaaactgtagtggtgggggagtgaagaaaggcagaggaggctatcagaggatgtgacagggagctctgatcagtcagaacatggttggggatttgggtcggcttcccattgagtccgtgtctgaaacaagtacagaaggctaagaggagaaacaggagtgtggaaagggggcccagacatgcaacacagcccctaaaagccaaggcaggaggcctgactgacctgagcacctggaagaggccgatgtgaggaggaggagggaggcagaggagctggggtcttgtggccccagaatgaaatggaaatggccaggagctgcttggccaggcacagagttgcagatgcatcctgagtggcgtggacagctgtcacgggtcctggtgggtgtaggcaggtgaggaccggagcaggcctggggtgcgtgtgggcttcatggtgcctgggtgcagaggggagcagtgtgggaaacggctggcaggctttggtcccacacttgcctctgggcccgagctgccctgtctccaaggctgagtttgctctgggcctgtggtctccactttccctgtccaccctccccctaggggatgagaggggcaccctcataactcccaggctgcccacagctgcacatccgtcagaatcaagggagggcaacccgacctcggcatgctcaggctgaagccagtctgtgtaaacgcgtcagcccccacgttgctccctagtcagcccttctgtgatggggatggggccacctctccatctctggagatgccaggctcaggagcatgcccccaccatcctggactgaacagttggtttattggtgctggaaagacagatggactttctcctggttcaagctttccgaagacaggaagggcagcctcttgggccatgacccctttgctgtctgcagcaagtgggtgaatgcctctgcaggataatttcggaggaataggataaagtagtggatccacaaatacttcaggaaggaagcgagggaagatcgaggaaaggagagagggacagagggtgtcatcctcacagctatccggtggagtaaacggtgctggcccattgcatggatcagaaacggaggtccgcacatctgagagtggcagaactggggtagagggcaggaccccagctccttgaagaagggccttgtgagggcagatgaggccgtgccaggcctgagcccacctcccgcttcccctcaccctggtcaggttggcagatctcatggagcagcaccaggaggagctggccaccattgaggccctggatgcgggtgccgtctacacgctggccctgaagacccacgtgggcatgtccatccagaccttccgctactttgctggctggtgtgacaagatccaggtggggcccaggctcccacccagtgtgagcacatgcagactggcccagccatataggagaactccaagggcagcacagtcatctgcatgctgcgcagcaaatgaccacaactggtggcttggaatgacacctgtttattagcttgtggtcctgcaggtgggaattccaggcaggctgggctgggttccatgccaaggtctcacaaggccaaagctaaggcgctggctggactgggccttatctggagactctgggacagaacctgcatccagacgagttcgggtgttgacagagttcagttccgtgtggatgcagggctgaggccgcaggtccttcctggctgcaggtccctgctcagggcactgtatctcccagcggcagcaggtcactctcgggcttgggatccctgtgacactgtcttctgcctgcttttctgggggctcctgcagttattctgggctcatgggcactatgtccccaccttagggtcaacagggacagtcaacacctcataggagggagtgtcaccatatcttcaggctcccgccatcagttgtggaacttgggggccatttgtagaggctccctggggaggtccacctctgcaggactcatggcgtctctgccagatcagatctgggctccatggttcctcctctccaccagggcatgacagcgacaagggaggtgggctgcctggtgcccgcccctactccgcagctgtgtagcttctggctgcagctggaccccccaaggcctgggccttctacatgtgctcaactgcttagagctgtggggagggggacacccggccctgcccccaccctcaccctttcttgctcgaatgtcaaagctagaggctttgctggtaccaggaccagcttccacccaagggctctgcctgccaggctcagagtggagcaaacaccttgcccctctggctgcccccctgcctgtctctcaagcctcaggtcacacctaagctggtcgctttgacttcctcctggagaccctggtggagacttgctgcctagaggggaaggggtgtggaccctgggcccctgggtgactgcccctgttcctcttccagggctccaccatccccatcaaccaggccagacccaaccgcaacctgaccttgaccaggaaggagcctgttgggtgagttcctgcccagggcgaggtgcagcctcgcggtgctttccatgcagtacacggaactgtagcacagcctgcgggagctcacagcaccctgtgcgtgcatttatcaaacagccatccatgtgcttcttgagcacctgctccatgccaggcattgttgtaaggacttgaggacaattgtatttaatctcccagtaacactggatcagtcaggtccacggtgggaaacaagagtaaacccaaaaaatgtccaaaatgggtatggtggtcagtgttcataaagatgaggaactcctgcacagcactgaggaacaggaaatatagaacaaaggaggaacaggcagaggacgagagctgctcagcaggaggagttcggaccccgctggatgccaagcatgtaggcgccgggaaatgaacctggcgtgaggcacctcacctcgccacccagtggccccagggcaggagtagggagaagggcttggaacacagccaccgggctctgggttttccctgctagaggaaactgggcagtgacctctcgaggccatacatcctgatttggccccagtcctggtgagttactcacacgcgtgcctgaggaggcttacccaagagtgcatggccactgtgctaggccggtgacagcaaacaccagagcagcaggtgctggtgcagccctgatccatgatctgcactgaggatgcgcctgcaactggacctagagagccccagccctgggtccaccctcactgcgcctgcacgcggtgccacaggagagcctggccagggtgacctgggagcagggcccagctggcatgagcaccacagtcattcccacctgctctgtgccccttgcagggtaggggacctcacagctgtgggcatggccaaaggcccctcagctccacctgaatgttggagtatttgcaaggagaacgtgctccaatgtccctgtgtcactgacagctcatgcagatgaacaaccaactcctcaagcacgggctggaggaggctcctgtgggaaagtgggctgtggacccttagagccccagagaggagccaggctgcaggtggaggcatcgcctccagggtccccacagaggacatcgggcaaggtctgcacatggttttggttgtcccatcagagggggtgatagagtacagccccccacaacaaagaactgccccgccccaaatgtcagtagtgtgggagccaagaaaccctgctatggggcagtggtcagagacctttgtcgtgctttgaaaggggctgggctgggctgggcagggcagggcgggtcgtggcccacctggggccacagttcagagccacacttgggtctttgaggctgcccacccctcccagctgccagcatggggttggggggtgtccacccccatcagactgaggaggaaacagacactgtgtcacccagaagcatccctatgtcaccctgtgaggctggccttggacccaggactctgggcgcctggtcagcaccccagtgtgaacacatcctgccctggggcctggtcccagcagctcacacagaccagggctcgcccaaaggcaggtaggcagggccactgctgaccatgcacctggtgggccgtgattctggaactaatggtctctgcctggcagggaggccgccagggcctctgggcttcacccctccccaccttcacaggggacctcgcctcagtgggaatgttctggagccggaacccaaggttggaatcccagctcctcccctttctagggcaagctcccagcctgtctgtactcagtctccccaactgtcaaatggtaataaaacagtcctgtcctcactgagttgtttggatgggtgagcatcaggtgtctagggcacagcatgctgtgaaggagttaggagggccaggtgaaggagccatgcagggccgggcctcctgggtaatgggactaagaggagaattctgtatgtggttctgagaaggagcagagtccagctcttttggatgtttgtgttaggaaatttactagagaccatgtcactgctccactcggaatcctcgggtggcttcccagtgcccttgacatggaatcaaacttctcgcttggccatgcaatccgggcctggtatcctggccccctccccagtccactgtggttggctgtgctggcctcacggatcccaggccctccaccctcatgccccactgagcacttgcacctgtgtcccacctccagccctcaccagctgtcctccagctctcatctgtgatgcatccgccagacctctgctcccagcctgccctctctaatctataatctcattttattctctgtgtgagcattcagactgatgctgccctgtgcccatgcctgtcatcatcccagcacacctgcagtgtcccataaatactgcagaatgactgagtgatcagagctagagagccccagccccgggtccaccctcactgtgcctgcacgcggtgccagaggagggcctggccagggtaaggggctgcccatctcctcccctggccagtgccaccgcaacctcagcagtgaggctgcagctgcctcgtggggagccccttcccctcatgtcttcagccgcaccctggcccaacagccactcgagctccctagtgagccaagcatttcttggggacaccaagaaaccttgcttggtgtcccctgcccaggctccatgctcccgagagagagaaggaactccaccctcaccgtccatgcagctccccaggagcgtcagagggcagaggagggggctcagggccgcacagcaggagaatggccccaagggagggagggacgggcctaagaaccatggggtggttgtctcactggatgtccactcagtctcccactaagaaagcccactaggaattagaggcagcaaggctaatgaaagtcggttttcacagcagctgggcagggaggattcacctgggcctgggtcctgcagccctgctcctttgaccccgtgccagggccagctctgcacactccagtcccggggctcggcctttcccctaaccagtgagtgtgggcgtcagttcgggctgctgtagaagagaccaccaatccagggcctaatcaatggaaactcgtctcctggttctgggagctggaaatctgaggtcagatgtgggcagagctgtttccacatgagggctgtgagggtctgtcctgacctctcttctggcatctggtggctgctggtgacctctggccttccttggcttgcagggagaccccgtctctgcctcatgccctcttggcattcccactgtgagtctgtctctccatgtggtgttctttgtatgaggacagcattcctcctaaattaggggcccgcccaccccagtgctaccacatcctaattaattacaacacagcaatctggtctccaagcaagggcatgccattagactctggagattagggcttcagcatacgaattggggagtgggggcacaattcagcacataattgtggggcttttctgatgtgttttcttttccgagctcccctcagccccgttcactgtaaccgacggcttcacctgctccctgggaacactcagcagcccgtgctgtgctcccaatctcctgggtgtgtgtggggtgtggggcagctcccctatctcagtgctccctgctgctcccccctgatgcctcacacgggtcctgcccaccgcctgtgtctggctaagcagctttcttttggggaaacacccagtgatggtggtggggtggcgacaggagcctgtgcgtggtctacggggctctgtgtggatgtcctcatctgactgtccagcgctcaaccaaagtggtgctgtatggggggaaggcagggccacacaggattcatacccggccagtgtgcctgctggtccctgggactctgcggcctccccagtgcccacggtgctctgagtatgaggcacctgtgcctggccagaggctcgctctagaacccagggtggcactgacactgggcaccatggcttcacacagagcaccctgacttcatcagtgctgccttgctgactctgtcttctcttcttgaggattgacacctggcctcacactctggaggaccctctccaggccctcctgacccacccctggtgacccctgaccctctttagctgaccctggcctgtgtcctcacctgtgcctgcctgccatcaccctctctcattgcctgtgccccagacagttccacagcttccatcagaaatggtccagtatcccatgccatcctgccctgctaggaagaggggctgctgccagaccaattcttactgtagcatccaggacagaaacagcaggcgtgagctgcctctcagagggaccttgggtgccttatcaggaagcctggctttgagagtggatgtcaggccctgggtgaggtggagggaattggcaggtccactgtgggcctggtggagaagaaggacaaaggccaacctcttttgtgtggcagggtttgtggcatcatcatcccctggaactatcccctgatgatgctgtcctggaagacagctgcctgcctggctgccgggaacacagtggtgatcaagcctgctcaggtgagcgtgggttcactctggacagggcctgcaggccacagagaggatcaggaactcactctataagggaggaagggaagggcctctcttggccacacgggcactggaagaagggtcctgctaatgccagctgccctccatgggccccactctcagtgggcagaggcgtatgtggcaggcagagctctccaaagcagactctttttcagccatggctgcttgaggccatctggctgtgctggaacttgcagctgctcgggtgagcagaggcagggatttctgcactctggattcatggggcagaaaccaggccccatgctctaagacagcctgagtagtctatccataaagctggtgccatgtcccttatgtggcttccgagaccagaagtcctggagagaagcagggtgagcggtgggattcgtggtccccatccctgcacacagaagctacgcagtgtggtgtctgagaggtgtaggtgggggagtagaggcgggatgtcaggggtcacccaggcatgctgggaaggtccttgggagtgaggacatacccagtgagcctcagtttctccatctgtacattggcaatgacagcctgcccgctgcctgcctcccaggatggtgcatgacatggcagggatggtgtgcccaggagggcacccactcgccagcttctttggggtaatttcgcggcaagggcattgatgtaatgaaaaacaataatgatggctgacattgatagtatttaccctgagtcaggcatgcctcaagcatttcaacatgtatcacaaattaggtagtaatttacatacatttgcttatttaagcatcacacacaaccctctgaggagaccttaacctctggctttagaaacttatgctgtgcagaagggaacccaggcctggccggctggagccctgccaggaggagaagctagggcaccagatgttggcccaccctgattcccagctggtgctgtgggcgcaccggctgggcaggcagggccccctctggtggctttcctggggtcttcctggtgccacaatctgcagctactctcccagcttgctgctgggctgctgggagaggaaggcggggagggaaggcagagccccactttcaaaaacctccttacccagtctcctttcctggccccacacccaggtgaccccactcacagccttgaagtttgcagagctgacattaaaggccggcattcccaaaggtgtggttaacgtcctcccaggatctggtaagagccattgtcgggggcagggctagggcttctggcagctggagatgccattgggcagagcaggccctactggatagtggcgtgagggcagagtagcctggggagagcccaggcgggggccagcctgtgacaaaggaggcccctcccatgggggagagcacctgcacctggaagggctttcgtcttcagatgccccagctgaatgtattccagtgtgtgtgtgtgtgtgtgtgtgtgtgtgtgtgtgtgtccgcgcgccctggaataaacttgttacttggggattttctgcccttggaagtttgagagaatttttctttagaacatttcaggcttaaagcatttagggaggtcatacatgaatcactttttaagtttttgttgtgtttagttgtctagtttatggaaaagtctcttcttgtgcagatttcaaatgtattagcatgaagttgtatataataatctcataatttttatctcctttttggattttccttttgattgttgtaatacattctttatatttttcctttttctctctctttttaagttgattaaattggtgaaaagttattgcttgtttgtctccatcctccactctaaaaaaatcaaatacagctcctggatttccttaccttttccatggctatttttatagtttcccccttgcttttattattcccttgtgtgttctcctgagtggttcttctattttttttttttttgcagctttttgggttgaaaatttagttcagtttttttctagttcaaataaggaaagcatttgaaaaagttttggtgatggccaggcgcagtggctcacacctgtaatcccagcactttgggaggccgaggtgagtggatcacctgaggtcaggaattcaagaccagcctggccaacatggtgaaaccccgtctctattaaaaatacaaaaattagctgggcatggtggcaggcgcttgtaaccccagctactctggaggctgaggcagaagaatcgcctgaacctgggaggtggagtttgcagtgatccgagattgtgccactgcacttcagcctgggtaacagagcgagactctgtctcaaaaaaaaaaaaaaaaaagagttttggtgatacctcacaccttgtgactgacacttttatcattcattataaatgcccctgtttatctttcatgatcgtttttgtgttaaagtcaattctgtcttagtattactacactggctttcaaatggttgctgttgacatgatatatatttttacatttttttactttcaacccattcatacttttgaatctaaaatgtgcctccatatataacatatagtcagatcttgttttttatccagtctcataatctctgccttttgactggagactttacattaaatattgatacagtgggtttaccattttacttttcattttctatgaatctcctgtcttttttccctctgtttctcctgctgtactactttcttttgcattaagcaaatatttcctagcataacattttaatgctttcaataattattttcagtatacatttttagttattttcttagtggttactctaagacttatcatatacttatcaaaatcaacttcagatttatacgaacttaatcccagtgaaatgtacaaatgttacttctggataggtctgttatcttctccctgtttgtgctaggatcatgtatttttgtacacatataacatctatatatgttacaaacccaataatatattgctatatatattacttaattttacacctactaaagaagttgagaaaagaaaggagaacaagtccctatgtgcagagtttatatgttatctgactcacaagttctggtcctcttcagctggtcctatggatttgagctactatctggtgtcatttccttactccatttaagttttattcccacctacctcctttctgcttttattgtccaatatgttagatttctatttgttaccccacaattatacaattatgtatataatcattttacacaatcgctttttaaatcagttaagaaagcaaataaaatatgcattgatactgtattttataattacctaattacctttacagtgctccttgctttttcctgtggattctgactactgtctgtagtcacttgccttcagcttgaagaacttcttttagtatttcctgtaaggtgggtctgctaacaacagatgatctgtttttgtttatctggcaatatccttatttgcctctgctttttgaaacacagtattgctagatgtaagattctgggttgacactcttgttctttctttgcacttgttctgccttgcagtttgaatacagtcatgtactgtcttctccatctggcacacctgaggtagagtcttccccttatgagtgcggtctgggtggaggaaagggccccagcatcttagccatagtcaccaagaacttagcttctgcaactgagagttggcagaaatgagagggcttggtggcctgcacctcctggtggatgccagcttccttcgctgggagctgagaaggaaagaagcgctgccttcctggccacacctgcctggagtggagcttccctcaaggggagggagcagactgtgccttcagtgctacagatattccctgctcttactgagagtcagattttcttgaagaatgtttctccatttgtcgtatgcccttagaagaatttccagggagtttaagtggttgtttttagatcatcttcaccaggatagtggtttccctggggaattgtccgcagggctcctcaagctggccttccagaaatgcactcctgcctcatgccttttgagcaggttgtgttcatgtttttattactcttaaatatcatatagttgtagttttggtcttctctctaacccagtaagtaaaaagagatttaaaaacaattgccaagttgtttttttgtctaaaatttaaaattccgttcttatatttctaattgtattatgtcatgatcagagactatggcctgtatgtgagtttgccagggctgctgtcaccaagcactgcaaaccgagtggcataaaccactgcaaggcagcgccgcgcagctctggaggctacgagtctggatggaaggtgttagcagggccatgctccgtctaaaaggttctagggaagactaattctttgcctcctcctagcttgtagaagcatcatcccgatctgtgctttcatcttgacacggcatttccctgaagatgtggtgtctgtgcccaaatctcccatttttataagaacactggtcattttggatcagggcccaccccagtgacctcatcttaactaattttacctgtactgacttcatccccaaataaggccacattgtgaggtactgggggttaggatggtgacctatgaatttctagtgagtggttgggggaggcacagtccaacacataacagcttgtaaaaattttgttttctaaaatggagaattttcgtggtctgatatatgatacctttttgcaaatatttcttaaatagcctaagagagtgttgttatttttattactattattattattactagtaaatagacttgattttagagcagttttaggttgatagcaaaattgagcagaaagtacagagtccctatacaccacctgcccccacacagacacagccctccactactaatatccagcaccagaggagtatgtttgttacaaacaatgacctacattgacacctcattatcccccgaagtccgtagtttaggggtcactcttgggttgtacattccatgggttttgacaactgtgtaatcccttgcatctaccattagagtgtaacacagagtagtttcactgctgtgctataccttttatctcttcctctgtctaatccctggcaaccagtgatctttttcttgtctccatcgttatgccttttccagaatgtcatgtaattgcaatcatatgcgggcttttcatttggcttctttcacttagtgatatgtatttgaggttcttccatggcttcttgtgacttaatagctcatttcttgttagcactgaataatttcccttgtctgattcacatcagttacttatccatccactttctgaaggacgtcttggtaacttccaagttttggcaattctgagtaaagctgccgtaaacattcgtgtgcaggttttggtgtggacgtaagttttcaactccttcgggtaaatatcaaggagcacagttgctggatcatatggtaacagtgcatttggtttttaaactgactgctaaactgtcttcccgactggctgtgccattttgcgttcccgcagcaatgactgagagttcctgttgctccacatccatcccagcatctggcatcatcagtgttgtggatttttgttgtttagtagctgtgcagtggtatctcattgctgttttagtcttttattctctaatgacaaatgacattgcgcactgtttcaggtgcttacttgccatctgtctgtcttctttggtgatgtgtctatttctgtcttttgcccagtttttagtggttgtttgttttcttattgttgagttttgagagttctttgtatattttggacacctgttctttgtcagatatatcttttgcaaacgttttctccccaaaacagtgatttaatggggagtggtggaatggagttagtatcaaaatcactggtagagctttaactgtatatagagggaggatacaagggtcttattccaaacctgccaaactggaaccttcatgggcgtgcctgggcatgtgaattttacaagcctggaggcaggggagtggtggaagatggagggactggataggtgcaggagctctggactgagcgagtcatgggatggaaaagggaggtgtcaagaatgactcttgggttcttggattgaaccaaatggctgccaggagaagttgtttactgaaatggagaaccctggaggaagagcaggtctaggtgaacgattaagagttcagtttcaaatatgttgaatttgagaagccagaagacatccaagtgcagatgccaagcaggcagaggagtgaccaatggatctgaatcccagaggagtttggctggagaggccgatttggttggggggtgacatacctgaagatggcccttggaagcctgtgagatcagctgagcacgcaatgtaagctgaggagagaagagggcctggtacagagccagaggtgctgggtattttaaggttaggtgagaaaggagatggaaaaagagccgtcagagaagtaagagtcgaattaggagggtgcagagtcagaagccaaaacaagataatggcttaagtggggagctacgctgagtctgggaggaggcagcgtcagggagcccactctgaagtctcgttgagatggagacctgagggacagagaggacttagccaggttggggacagggtttgtgcagggcgtggctcggagtaggggctgggggcgtgggacggggcaggaatcacggcattccctgggaggaacagcaggtggcaaggcctctgtggctggctcacctgagggcgggtgttttggagtctatgatgcttaggatgccacatcctcggggacctgatcaggcatccttgggtctctgttcgagcccctgcaagagctgaaggtttggtgccctcaccttggggtctgcctgatggtgaaaagccatgtggggagtgggttgatttgcttgggctaccatgtcaaagctccgcagactggggcttcagaaacagatggttatcatctctcagttctggaggctggaagtccaagatcagggtgtcagcagcgtcagcttctcctgcagcctctctcctgggcttgcagacggctctccaccctctatgtcctcgcatggtcattgcccaaatctcctcttcttagaaggacaccagtcagattggattagggtccatctcaatgacctcattttgccttaatcacctatgtaaaggccacatctccaaacacagtcccattcagaggtacaggggatgagggtttcagcatttgaattttaggggacacagttcagcccctaatagggagcgaggctccatgagccccaggcaccatggggatcaagcatgtggggagcattttgagggcctcagacccccagtgaacctgtgcagtcctggaggtgggctcctgcctccccagcaccagggggaccactctgattcccccctccctcccgcccacaggctccctggtcggccagagactctcagaccatcctgatgtgaggaaaatcgggttcacaggctccacagaggtgggcaagcacatcatgaaaaggtgcgtggctgggggtggagcagaggaggggctgctgtgggctgcgcctgggacatggcagtgctgtcccaggagctgtgtcctgcttcccaggctccagggcacagccacttccgtggccctgctgggctctatgcaaacgctgaagaggcatctgcctttctggcaaagccccggggaggcctgggcggagacctgtggagccctgtcagaccagcaaggggctggatcgagaggtgctgagagtataaaacacgcatggatttcaagaactgagcacccacaaaaaagtgaaatagctcattaataggatgtttggggtttttttttgttttgttgttgtttttttttttgagacagggtcttgatctgtcactcatggtggagtgcagtggcaccatcatagctcactgtagccttgacttcctgggctcaagtgatgctcctcagcctcccaagtagctgggactacaggcatgcaccaccaagcccagctaattttttgtgtttttcatagagatggggtctcatggtgttgcccagactggtctcaaactcctgggctcaagcaatccacctgactcggcctcccatctccgtgctgggatgactgacgtgagccactgtgctctgccttcattaagtttttatattgatttcaagttgaaatgataatattcttgattagttgggttaaataaaatataataaaatatactattaggattaatttcacctgcttcttttcaggttttttttttttttcaatggagtctcacagtgtcacccaggctggagtgcagtgtcgtgatcatggctgcagcctctgcctccctggctcatgcgatcctcctaccttagcctcctgagtagctgggactacagacacgtgccaccatacctggataagtttttaaattttttgtagagatggggttttgctatgttgcccagcctggtctcgaactcctttaatgtggctaccatcaaaaaaagtcccattgtctatgtggctactgtttgaagctttcattctatttctatggacagaagtgatctaggtcaactcatgtcttcatccttggactttggcctcaaattgactggtgtcatctcccagactctgtcactaaaccacaatatgacctgggccacacccatgccttgggtcccccaccagttccattacagcagtttgatagtgcaggggttctggtctccatcactgacaagctgggagagccagccagggccagaccacaggtggagccctgactgacactggagcctgccccagccctgacactgaacttctgggggtgggttttggcacctgcactttgagtgacgtgggtaggggaatggggtaactgcaagtagtcactgcaggtttgcctctcctaattcaaaagctagctggtctcttcctctgaggtgtgtaggttgtagccatgtctgagcacatgtgagtcaagtccagggtgagggctcaggaaatgtcagctctgagcactccagagctggacagagggtttggggggcaagatatgttgatctgcctcaccatggtaaccattttaccatcaatatgtagttcatgctataaccaggcatgtggtggcacgtgcctgtagtcccagctactcgggaggctgaggtggaagaagcctgggacacggaagctaaatgagccgagatcacgcactgcactccagcctgggcaacaaagaaagcctggctcaaataaataaataaataaatagaacagaacaaaaaaaaaagtacctcaatttgaacattttatttaaaaaaataaatactaggctgggcatggtggctcacacctggaatcccagcactttggggagactgaggccagctggtcacttgaggccaggagtttgagaccaccctggccaacatggtgaaaccccatctctacaaaaaatacaaaaaaaaaaaaaaatagccaggtgtggtggtatatgcctatattcccagctactctagaggctgaggcaggagaatcgcttgaatccggaaggcggaggttacagtaagctgagatcacaccactgtactccagcctgggcaacagagtgtgactctatctcaaaggaaaaaaaaaaaggctgggtgctgtggctcatgcctgtaatcccagcattttgggaggccgaggtgggcagatcacctgaggtcaggagttcaagaccagcctgaccaacatggtgaaaccccgtccctactgaaaatacaaaaattagccgggcgtggtggcacgtgcctgtaatcccagctactcgggaggctgaggtagaagaatcgcttgaacccgggaggtggaggttgcatgagccaagatcatgccattgcaccccagccggggtgacaagagtgagactccatctaaaaacaaaacaaaacaaaacaaaacaaacaaacaaaactaaaaaacgaaatcatgctatgaacctcaaatatacacagtaaaatttattaaaaaaaaaaaaaaaagaagagcaaagcagagctctgagcagcttcctgccccagcatccctggttctgctgctttcttcttcccaggcagccgtgtcacacagacctgcagctgagatgggtgccatctccctgggttgcttctgcagaggaggcctctcctccccagtggagcctcctacctgccggctattgactgagtgtccagctgaggacagcatccctgcagtgcatttcttgcccactgatgtgatgtgttcatgactcccagcctctctgtttgctctgccactaatacaaggaggtgccccagcctctgggcccctgcagctgtgccagcggatggtgctgttttgtattccttaatttgtgcagcaccagctgcgtgcaggcactgtgcttggcaccggggctgtaataggacccagacagatgcgtgcctgccctggccaggctcatgctctgcaggtggggtcagaggtcaacatgcagtagaggaaaggacagcagatggggtgcacaggcaggctgtggttttatacggggcgatcagggaggcaccccagagaagggaacacaggcctgcaggaaatgaggtgtggagtgggcagcaggaagggcagtccagggggcagtggggcacaggcctggtgtgtacaggccagaaaggaaaggcaggtggccgtgtgaagccgcaaggggtgggggggagtggggaggcactggccgggtcttgcttcttgcagcaaagcatgctttgggcctacccaggtccctgccacctggggtcccaatgcccctacctgccctggagggaccggccccaccagccctctgttccttgcagctgtgccataagtaacgtgaagaaggtgtccctggaactgggcgggaagtcacccctcatcatctttgctgactgtgacctcaacaaggctgtgcagatggtgagggccgggcctggagggggcagggacagtgagcgggaacagggactgtagggaccaggaggccctgtctctgattccacagccacactcacacgtgtagccctggtggagtccatagcgtcatcacaagcatagcgtggcaggcagcaggcttagggaagaatgacgtgtgccctccaaacatacttcccaagaagtttcatagctgccaggatagctgagatcaactgcctataacatatgtgtgtgtgtgtattacatataaatatgaaattgggaaacacacgccacagctccatctgttctgaaataaacattgcagccttttctgtctgatgagagggcaaatcagatgtgttgatctgcttcactatggtaaccattttaccatctatatgtaatccataacttcatgctgtaaacctcaaatatacacaataaaatgtgtgtttttaaaataaaagagcaaagcagaactctgagcacttgggcccagccctgctgacagtgaccctctaccggtggccgtgggtgcagtgcctggctccaccactgacttagtgggcagccttgagcaagttacctaacctctgtggcgtctgtgctcccacctgtggatagggaccatggtgatacccacctcccgggtggctgcagaatgaatatgtctgaagggcttaggttagtggcaagtgccacttgagacatgtgtcagtccttgttctcaccattagtattgttgttgccttggtcctgtcctgactcctgtgggagcaaaccagtaagaccatgttcagccaggtccccaaatatgcccccggccctatctaagttccactgtgccgtggagggtggcctaacaccctagcttgggtgtgaaagggagtccaacctcatttggtggagaaactgagggaggcaagggccttgttcacgggcccgggtgaacccatcagcacggggatctagctgggccctgtgctgagctggaggtcggggccctgtcattggctgtgcagtcccaggttccaggagagccaggcttgaccatggctctccgtcctcccctgggtctcccacagcaggcgagtttgaaaaagcaggctgcctggggcctctgagggcctttgttctggactcctgccaggagttccctgggccagggctgccccacctctcacccacccatgtcggggctgcctgcctgtgtcccaccctctgccctgtcacccaccgcctgctccatgcttacacacacggctggcatctctcctgtcagctcccaagagtgtagactctgaaacaggagtcggcacctcctgggccgccccagtgagccacccagggtgcaggagggtctcaggcaggccaaggctcactcccacttggtccccatgctctgcagtgtggatggcagccttatcctccagtggtgggagttggggcgtggtgtctctctgtcactgcatgggcctcagcgtcttcacttcccacacagttacctctcacctctcctcttgaggtgactgaggattgagtggggcccacaggaggagatcaggacacatgggtgcctcctttcctaattagaagaggcggctgggccctggcagagccgggggctggtgtcccaggaggagcagtgacctggtgttcttgtccattctctgaaggggatgagttctgttttcttcaacaaaggagagaattgcattgcagcaggccgactctttgtggaggactccattcatgatgagttcgtgcggagagtggtaagtcctgccccagggtctgcgggcggctggttcactgggacagcagcgcctggctggagggggttggaggaggggagacagggcagggtcaagtgaggctgggctcctcctggaggacactccccccgggggtcagggaacccacagcgggagctgtgctgagtcttcactggattttattatttcaccaagaaatagcagacctgtagcaaaactgacatcaccaaaaagggcccatcttgggttggtcccctagaaatagagcctggggcaagaattcagtgcaggtgatttactcagagtggactcttgggtgaagcctggaaagagaagagaccaggggaggactggacagaatggagcaagagcctggtctcaggtcagcctgggcctgaccatggacaggggccctggagcacgaatccccctacacaggcatacccctggagccaagtggccaggctgtgggcccctgtggcaggtaggcttggctgtgggccgccagcaggggagagtagctcccgtcaggctctgcagccaccttgcatggcctcggggatctggtgggcacaggacagtgtctcccaccagatttatccactcagccacacctggaagagcaggcttgatgctggcctcgggacagatgggccatcctgagtccccttgggaggtttgtaatgcctggcttctcagttcctcagcgggttggcttcatcctctccaagcagctcggatatggtgggagtatggggctgatggcaccagcattaccttctcaccacatggtgccagagtgggacatgactccttcctcaccacctctgttagaaaacactgtggggttgacacgagccaggcctcagccatccttcatccaggccatgataccagggggggagcaagctgaggttggcttagcttccgcgaagagcaccgccccccaccgcccctaggttgtggagagcagcatctaatcccagtggatagtggcagggatgcgggagaaacagccagcaaccgccacacatggtttcagagagatggtacctgggaaaccagggaaaaagacggcctatgagcagaggggtgagggaggggcccctggaggagagctggtgctggacctggggaggtggctcagagtccggaagcagtgggaaaaggaaggactttctaggacgggctagaacagtttttgccatataacgaccctcaacacggagtggctggaaatgaagccctgccctcagctcatgtttctgtgggcagcagtggcagtctaggctggggtttgttggggctcatctgggtttgtcagagcttgcccaaacatctgcagtgagactcaggggcagcggggcagcgggtggcttcgtgggacagctgtcgttgccctgggggcctgcattctgcagcgtgtgctgggacatgttcacgtggacagtggaaagactcctaagagtgagagcacaagttgagaggcctcttgaaatgcacgaaacattgcttccatgcattgtgctgcctaagcaagtcacaggccggcccagattcaaggggtgaggaaacagactctaccacgtgatgggaggcacaagctcatcttccatagttggggagctggcctgcccggccaagtgaggcccactgccacgatgggcccggcacaggaatagcaggaccaggatacagacccagggactactggagataaagtggcggtcatggggggagtgtgactgcggggacacagagctgtgcacacaaggtcctgtctgggggtcttaagggagtcatgagacttccacagaagggtgactgcaagggccagagtcccagggataattctcaggacagtcacaatcccaaataaaggaagtgaggccagtgttcaggaggctcagtaggctgcttgttctttgtatccaagatacaaagccatttgatcggggtgcggtttggggcgacaggacaggagcagagaataaggaacaaaagcaaccgggtttggctacagggtggagacaggacagtcagaggcacacagtgggccctggtgagaagagcagaggggtgtgccgggtgctcgagtcacacctgtgtctgattagggctgattaggggtgcagagtttgcaagatgtgagatgccctggccttggaggaggagggtcagcagactagagccttgggcccctccccttcacttaatttctttcccactttggcaccaggactattgcagcagggctggtgtatcccacctaccgcacatcctggagtcccccggacaaacagttccttcagcttcttggtccatgaggctggtgcaggaccagagtcagatacgtgttgtattgagccccatctcaactagtcaaatatgccggcctctgtcctcctcacccacacccctgtatgtctccatttccagcccatatgttgctgggctcctgtctccttggagacttctgtccctctacacataggagccatttgggatttcagcctggaaggtggatttagagtcagaattcagaaagccctgaggctagaacagagtgtggactttccccaggggtcagccatgagagctgagtcaggtgaggatcattgtcagaaactgtggcagcacaagccacacctgacttggaggactttctgcaggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccaggtgagtcagagtgtgtcaggtccgcttgggtcaattgaggcagcaggtcccatggcctctggttccctgtccagctgaactggagacatctgaaggccaggtacctacacagtcaggctgcagccccatctgggacctgggatggactgggctgtggctatttgggcaccagccagacccggggatgggacgagcattattcagtgctggtttattcagtattgaactggactctgacttgcccttactgtcaccgcagccttgacagtctctcccccatagatttcatgagactagattttattatttttcctctatttcactggctgttaacctctcagccgttgcttcacctgttctctcaatgcaggtgcatccctgcctatccttagcttggaacacctctcatgggggactttttgcccgcaggatctctcccctgcagcagctcagaccctaccagatacaggcctccaggctccaccccacccagagctcctgaccgcacagccagcggcactggacacttccacctggatgtcccccaggcccttcaaactcaaaggtcattgcaatgtcccagctatagttgagcccagacacacacacctgctgctccaggaccctctgtctgatcgagcagtccaggccagaagcgcagcagccacggggatggaccgttgacgctgctgctgggggacaggtgccatgactgtcttcctcacccctagctcctttgtgcctagaccgggccttgcacagagttggtgctcagttaatttgatggcatgaaggagggaaggaaagaaggaatccctgactcttctctttctgtgaccctcatttaaattattggcctgattctgtcaaatctgagaattgtcccactctgggcctcctctgcctccctgacccttgtgcgggctccctacatcttgcctcgctcagtgtcacagcagcctcccaagtggccttgtgagcctgctgatcctttattcacacagctgccagggtctggtgacctctcctctgttaagaccttgcagcagtgacccatcctcctgcagtgcaagttcggactccttgacctcacagccggagtccttcatgatctgtgcctgacttgcccttgacctgtactgcagctgcatttcattctctccagaggcttctcctgctttcttgggctccatgcatttgctgctgctcggcttagtggaggctttccagtgtccccacctggagagctcctgcttcttcagctcacaggacatccaagcccgggcatgcccgtgtcacagggcatcgggcaccgcacacctcaacagagctctcgtgaccattgcactgctgctgtcactgtccacttaccctcttcccactcccgctggactgtgagttccatgaggcaggtggggttgggggagcatcaccaggacccttgcagtgcaaggatggccgggttcaggattggtggaagacagtgtgatggaggccttgtaccaggagcagggctagggagccagcaaggggtagagcagcacccaggaaccaggaacagtggggagccatcaccccgccctggagggggtatgagaaggaacagaattcctgcagcccagtgaggggcagagcatgggatggggctgccttctggtggcccaatgaccaggagaccagctctcagggtctagaggggacaggggagagtacaaggtagatggggaggggatgacagaggggtggtcagcatggctcacatgccctggcagaagtggtgcaagactgtggagtaaacacaggccacataaaccactatgcatgtacatgagtcacattttcagaattgtaatcagtgttaaaacatcatttatgtatgtatgaaaaatattgaacattttattaaataactttttaacatggtttgaaattttctatttctctaaaaactagagtgagaaaattcccagtctcttgattattcctaagttaggcaggattgaatctcagtgaggtcaggcaggattgacctcagtgcagcaggtcttagggctctgtctctagagaaaacagagaggaagcatttcagttgtcagaagtgcttctgccctggcaaccagggcctgtaggggctgcatccagggttgggagtaggtggtcccttcttgactggagagcatggagctgggccttggtagggaccctgggagggcagagggaggaagccccaggaggtcccagtgcccagagctcctcccctctcacctcctcctactccacgggttgtagccaccagggtcagtggcagagctgcctgggaggtttcacctgccaaagaatctaggtggttttagattagctgtcaccagaaaagctcaagtctttgcttcggccatgggttctggcactaggattggatggacttgggatcaggtctcagctctgtcacctgccaaccggcggccccatttccctcaacagcactccgttaaaagcacggtgagacccacatcaaagaacaagccaggtgggagagccatctgcagcgtggtgacacccatcacacgggtgccgtgacccggtgcttatgtcgggtcatccgcaggtggctggtgtggcccaggccctgctgacggagaggctggaccatcgggcaccgtgtctcccatgtgcaacgggcttttatctctcttgcagggttcttctttgagccaactgttttcacagacgtggaagaccacatgttcatagccaaggaggagtccttcgggcctgtcatgatcatctctcggtttgctgatgggtagggaatcctgctgatgtctcaagggccctgactctctcccacgtgttactggggtcttcatgtgggctttgggaggtagtctacgggcagtcaggaggagaactcaggcagggcgcaagccgtggacaccccgcttgtgccgcctgctgagtctccacacccctgagaagagagcccagtgacctggggctttgagtcccccctgtgagcaaaggcagctcccttccctgtccttgtcacttgtcacatgctccagcatgtttctcacagcccgctgggctctgttctaaggtctgttaccatgcattaaaccaccccccacactgagtggcttggaataatcagagatttattttagtcacggtctaggttcaatgaggcaaacccatctctgctccatgcagtgtctggcctcagctggggtgacagagtggctatcctgatgctgctgggggtcttgcgggaggcttcctccgcgtggcagcctcggggttgccgaggcacctggttcccttcggaggccaggtggaagccaaaaggctctttataatctagctctttagaatcccagagcatcccttccaccacggcctgttgatgaagcaagtcacccagaccaggctgggctggaagggaaaaactgtactccactcacagtggggccactgaggcccatgctgtcacttctcaggcctgccccttgtctccgtagcaccttggagcaaattgcaaaatcgtgcctcgtcctcacattttactatccaactaccaaaaaaaccccagaaattatcatcgtatgtcagtggtattagaataagagacttcactgccacctagccaataaatatggttgtagtaagtctccaaatcgctgatgtctggtgaatgcccaacctgcggcgggcacatgtgggtccttctgcatgtgaggacccagcggcccctctctgggcccctgctcccagtctgtggaataaagggctcacccgatgatccaggagcccctgtggtggccacctgcccatgggcctctgcccttcctcctcgctcgcagcccaacccaacccaatcttgcccccggcgctgcagcccggcacattttctcctcggaaggtcttatgcagctggggtgtggagtgggccggggtgtggagtgggccaggctctcctctgcacctccctcagggagttcttcctggactttctctccagggacttggatgccgtgctgtctcgggccaatgccacggaatttggcctggcttctggtgtcttcaccagggacatcaacaaggccctgtatgtcagtgacaagctccaggcaggcactgtgtttgtcaacacgtacaacaagaccgacgtggccgctcccttcggaggattcaaacagtctggatttggcaaagatctaggtaacctactcctgcctgtggggttgctttcatttattcattcaacaaacatctgttcaaaaccacttagggccaggtcctatctcagatgcagggacgtagccttgaacatgatggctgtcagggttcgcttcttactgggagggaacttgtgacaagtccgtgagcaagatgcttgcagaggggggtcgtgctgggaagaaggcaagaagaggggcctggaggagacactccagccaggaggcactgggggcctctctggtgtggtggcacctgtgctacccagacctgcatagcagggaggagttggccatgaagacccaggggcccgtgtttctggctgagggttcagcaggtccttgggggaaccagctttggtcgtggagctgcagagaggccagagtggtgggagtgggccaagggggagcaggagggaggagagaaggcctgagaggcaggtaggggccagattgaaggcccatgggccatggtcaggggctcaggttgcatccttagtgtaaagaggagccatgggaccaaatgtacccccgggtgaacaccacgggtgttgcaagtctcccagtagaggtgaagttactcaggcggcagcaggcggggtccaccggcacatagcaggcggggtcccccggcacacagcacaggctccccagtgctctgcctgctgggtggcatggagttctgctccggccctctctccctgggctgctccaagccttgggcctcgtcctgctctctcagcaggggggactagacaggtctgatgggcaagcttggcaagggtggctggcaaggtccggggaagccatatgctgtctcagaggtcccacctgtctctccaggctcctgtgccagcccagagaccacagggaaggtcatgctgaggctgggggtcaaaggctggtcactgtttccagttttctctcctccccctgcccccatctttcaagccctgcagaagcccccaagggtacccatgagaggggcccatgtgtgcccacagggctggactcacatgcacgcatgtgtaggctggacactcctgcttcctctgtccctgtcggcctcctcttcctgccttctcccaggccaccttcctggtgtccaccaggggaatccatgaggcccatggccacccagggaaggctgtggctgccaagtccccaggacgtgatctgggccccttatgaatcctccccgagttccctcagctccctcctaaccctagtccccatgtcctgctgagaggaccagcaccctcctgggacaggcccacaagccaagccttccaagcagcctgcctgggcagactcaggacctcagagggacggggcagtgccactcctggggccagccagagctgctggggagctgtcaggcagccccaggcctcacacttgtcatggggctgagatgcaccagccacatagcactgccaaggcctggggcctcagggccctgcgaggcatccccttttcccagccacagcttgatgcagacgtagctgggggcagccatgagagaagagatgggccagtgagtctgggcagtaacgccaagtctctccacccccttccacctgaaggggcttcccactgtccagacaaggcggtgggagctggggaagattcttaaatggctgcctcagattggctttgtattctggggagtcctggcccactatccactgccagggataacctgggtaagattcatgacctcgctgggcctcgacttctcacctggaagtggggtgagccagagctgcccccacgtggttgctgaggaataagacacttgcagccccgagcagtgccctgcctgtggtgggagctgctgtgacctttgtggtgtcttacaggagaggcggctctgaacgagtacctgcgggtcaagacagtgaccttcgaatactgaagaaaggtctttgtgagaagaaagtccctgcccctccctcgtggctggggccccctccctcttgagcctgggtgcacagcacctcccacctggggggctagtggaagccctcctgcctgcacaccatgtctgcatcttggacgccctctgtccagtcagaagcagcccttggctgggtgaggtgtgcccctcccagggagaataaagcttctgaagagagac

SEQ ID NO: 124 - DNA, 55613 bp, Homo sapiens
gcccccgccgcccccgggccctgatggactgaatgaaggctgcctacaccgcctatcgatgcctcaccaaagacctagaaggctgcgccatgaacccggagctgacaatggaaagtctgggcactttgcacgggccggccggcggcggcagtggcgggggcggcggcgggggcggcgggggcggcggcgggggcccgggccatgagcaggagctgctggccagccccagcccccaccacgcgggccgcggcgccgctggctcgctgcggggccctccgccgcctccaaccgcgcaccaggagctgggcacggcggcagcggcggcagcggcggcgtcgcgctcggccatggtcaccagcatggcctcgatcctggacggcggcgactaccggcccgagctctccatcccgctgcaccacgccatgagcatgtcctgcgactcgtctccgcctggcatgggcatgagcaacacctacaccacgctgacaccgctccagccgctgccacccatctccaccgtgtctgacaagttccaccaccctcacccgcaccaccatccgcaccaccaccaccaccaccaccaccagcgcctgtccggcaacgtcagcggcagcttcaccctcatgcgcgacgagcgcgggctcccggccatgaacaacctctacagtccctacaaggagatgcccggcatgagccagagcctgtccccgctggccgccacgccgctgggcaacgggctaggcggcctccacaacgcgcagcagagtctgcccaactacggtccgccgggccacgacaaaatgctcagccccaacttcgacgcgcaccacactgccatgctgacccgcggtgagcaacacctgtcccgcggcctgggcaccccacctgcggccatgatgtcgcacctgaacggcctgcaccacccgggccacactcagtctcacgggccggtgctggcacccagtcgcgagcggccaccctcgtcctcatcgggctcgcaggtggccacgtcgggccagctggaagaaatcaacaccaaagaggtggcccagcgcatcacagcggagctgaagcgctacagtatcccccaggcgatctttgcgcagagggtgctgtgccggtctcaggggactctctccgacctgctccggaatccaaaaccgtggagtaaactcaaatctggcagggagaccttccgcaggatgtggaagtggcttcaggagcccgagttccagcgcatgtccgccttacgcctggcaggtaaggccggggctagccaggggccaggctgctgggaagagggctccgggtccggtgcttgtggcccaagtctgcgcgccgagtcacttctcttgattctttccttctctttcctatacacgtcctctttcttctcgtttttatttcttcttccattttctctttctcttccgctcttcccctactttcccttctcccttttctttttctttcttactctctccttgtccctgagctttcattgaccgacccccccccatttcattcgccctcccctcaatgtgccaacctttgccctatttccgatcttcccaggtactgggaggcgggatgggggtgtgcgttttcctctaggagccctgtctttccaagacccacagaaaccaggacctgcccttattcaaaaccccatgcacttcaagtctcttttagacaacacatttcaattttccgggctgactagtctccctgtgcagaggcagttgagaggctttgctctgcagagggaaaagagctctctactctcccacccaccatataggcaaacttatttggtcattggctgaaggcacagccttgcccccgcggggaaccggcggccaggatacaacagcgctcctggagcccatctctggccttggcgttggcgcagggactttctgaccgggcttgaggggctcgggccagctccaatgtcactacctacagcgagggcagggtgtaaggttgagaaggtcacattcaccgctttgggaggacgtgggagaagagactgaggtggaaagcgctttgccttgctcaccggccgtccttgccccggtcccagcgtttgctgggatttgccaggatttgccggggctccgggagaccctgagcactcgcaggaagaggtgctgagaaattaaaaattcaggttagttaatgcatccctgccgccggctgcaggctccgcctttgcattaagcgggcgctgattgtgcgcgcctggcgaccgcggggaggactggcggcccgcgggaggggacgggtagaggcgcgggttacattgttctggagccggctcggctctttgtgcctcctctagcggccaagctgcgaggtacagccctctattgttctaggagcacagaaacctcctgtgtgggcggcgggtgcgcgagctagagggaaagatgcagtagttactgcgactggcacgcagttgcgcgcttttgtgcgcacggaccccgcgcggtgtgcgtggcgactgcgctgcccctaggagcaagccacgggcccagaggggcaaaatgtccaggtcccccgctgggaaggacacactataccctatggcaagccagggtgggcgacttcccatggatcgggtggaggggggtatctttcaggatcggcgggcggtctaggggaacaattcgtggtggcgatgatttgcatagcgcgggtcttgggatgcgcgcggttccgagccagcctcgcacagctcgcttccggagctgcgagctcaggtttccacccccgatcccccgggctttcctcgcaccgctgagcccagcttgtggggtgcactcgaccaacgcccgacagggctggggaatgtgacaggcagcaggttcacccgggcttggggagggggagtttccgctttgacagcattttcctttgccgtctgctggtggattcctattcccagtcggtaatcgccccgcagtgttgatctaagaaggtaaagaaaactaggtttccctgcaaagagcctcccccaaatcggcggactccggatactttgagtggatttagaaatttatgtaatctttctcctttagtttatttttcatcctctcctacagttttctctgatttgctgttggttcggggcaagataaagcagccagtagagagcgataataatagcggcgggaaatgaactggagactggctgacagttcttaacattttgtcatagatccccccgaatgtcccaggctgtctctggtgggttttagtacccgccggcttcttgggcaccggggaccagaaggaacttggcagctggtcttaggggtacagttaaaggcaggatgacagctattctcctgctcatctcagagcgctgccgccccctcatgccggtcgcgcaaagaacacagcttttaaaaaacacgtgccttctgcccatataggtctgaaagtgatgaggaaagtaatgcttcgcctattagcgagtttcagcttttaaaatgatcccaagcgttgctgagatgagaaagcgtggcatcccgggggtcctcagccccacccgcgcccatggtgcaagtctgcagggacaggcccgggacagcactgcccacgctgctagattttccgcagaggatcgctgaagctgccttcgtgggagacagaatgcctcctccagcgagtggaaaaggcctgctgaggaccccgctttgctcgagcattcaaatgtgtgtctgttttattaccctgggttgaaaagggacaagagctttagcctttttatctggccattttatcagcaactacaagtgtgttgagtggttattattacataggaggcttttcagtttggggtcagtagatcagtctcttcagacactgatgcagaagctgggactggtaagtaggtattatgtgctcggagcgctaggggacaggagcaaatggagaagaaaagcggaggctttctccgcccggagtatcgatcggaatccccgccggtacgccgcagagggccctcgccgttgggccccgggggtttaacaagcccagccgctccgcaggcggctcggccggactctcagaccggtgcctggaagacaccgtccctgcccccctcccgccaaacctgcctcttctctttctctcataggttataggttccctttctctctcattttggccccgcccccgggtcctgccaaacagccaagcaggccggggtttagggggctcagaatgaagaggtctgatttggccagcgccggcaaagctcacccttaggcgaggtcacaacagaggcaggtccttcctgcccagcctgccggtgtagtcacagccaagggtggcacttgaaaggaaaagggagaaaacttcggagaaatttagattgccccaacgttagatttcagagaaattgactccaaatgcacggattcgttcggaaagggcggctaagtggcaggtggttgcaaccccgcccggtcgggccttcgcagaggttccccaagaccagcccttgcagggcggttttcagcaacctgacaagaggcggccaagacaaatttctgcgggttcgagcacacactctcgggcgttgggccccagagacctctaaaccaagcacaaacaagaagggagtgagagaacccaggctagaacttgcacgggcatcccactgaggaaaagcgaggcctcggtggcaggcatgttttcttccgacgcccgaaaatcgagccgagcgcccgactacatttactgcagaggtttccgcctccagtgagcccggatcccccagcggcctgcccggagctggtctccagtccccgccgtagtccgacgcacggccctctcctggcagcaagctcccagcggccagtctgaagccaattctgttcaggcggccgagggcccttagccaacccaccatgatgtcgcctgggccacctgatgcccgcagcggcgggacacggcccgggcagtgcgcagtggctcctgctaggggcaccgcgtgcgtgcttgtctcccgctgcgccggggacgtccttgggtgacacgggccgctgggcacctcccaagccgaggaaacggacccccttcgcagagtctcgcgcccaccccccaacctcccacctcgtttctcgctgctagggctcccgactcagcccacctctcctggcggtttagttagggatcagagctggagaggctgaacgcaacccgtgccagtacggaacagacgatatgtttgcctgctagctgcttggatgaataattgaaaagttcgctgcagtctgtgcttcgtcaagtcccgggtgccgggagaacaccttcccaacacgcatcagggtgggcgggagcgggcagaggaggcgggacccgagggaggagagtgaacccgagcaggagaagcagcccaggcagccaggcgccctcgatgcgagaggctgggcatttatttttattccaggctttccactgtgtggttatgtcactttctcaaacaaatgtgtatatggagggagatcgatgctgataatgtttagaagattaaaagagcattaatgctggcaacaataacgtaaacgtgtggacccagatttcattgatctggaacttgatccggcgcgtttccagtaagcccgacggcgcgctcttcccagcagagcgctcaccagcgccacggccccgcggttttccagcggtgccgcttcgccagctctgcgcgggttctcccgtctgaccgcagctcctcccccgcgaggccccagcccgccttacttccccgaggttttctcctcctctcgcggggctctctgccctctgcaccccctcccccgacctctgcaccacccgcccctgtgcgcacacaccgctacttgcgcttccggcgatccgcctgggcggctgggtccgcgaagccaatgcgctgaacggtgcccgagtcttcctaactatcctgtgcttggccgttgccactgggccctggtgactaagcccaagtttgaaaatgacgtggctaaagctgcctgctaacggcagagcttaatcagccgcagatcccctcctatcctcatcggttctcgtactaaaaaggctcacgcgcagactttttacgcaggtgcattcgttggacaattaaacgtggccctagtaacaaaagcctgagcttcatccctccgagtagcaggctctgcgctggactggtcgggtctaacagggagaatcttgtgtcctaccttggctgggacaggaagtaagagaagcaaactggggaacccctgccccaccccttcccaccccctggacgtcctgggccgaggcccgggtcactggcccatcgcgggtaaggaggtgtcctgtggaacacctgcattgactggaaaagaaagaactttaaagctcttccttcccgcttgtgggggacaccaccacaccctgccaaccactcccctggccaaatggtggcttgtttttccagaaggagcactaaggtgaattttatggaaaaaaaataaaagatcagggacctaagtgggagtaggatgagaactaattcttctgggttttttttttttttttttgaaattatgaatcccacctgttgaagaaggctgagcttttccaacagcgggtatcaatcgggagggaaagcagtgttttccagccctctccaagaacagtaattaataagaggaaggaaaagagagatgggaaagcaaatcgtgcattgttctgctttgagttgaggcagagggtaggctggtgtttcttcctcatcttcccactagtgttcttccttaaagaagggagctttggtacaccaccttggttcctagtcagaaagtgccctaccggacccttttaaactacaatgagatagctgggtaatcagatatgtaactaaggaggagagcaggtggtttccctttggtctggcggacaactggctccctccccacagcccccacttgaaagactcctaggccctgggaggggcgagtgggcctttagaggatagaatcatagactctctcctactcccatcttagaattccaagattgggcaggattcctggtgaatggtgaggtctgggcaaaggataaactgattaccccagattctctgtccctacaaggcaccagcagctgcttcactctccttttgagccaggtctgccctgaggtaacagtaccctaggccagttttaccatcccaagtgccagacttcagccctgagggaaggagagccagcctctcctgctgtcttcaaaccaaggcttcattttacagtcacccccgatatgagagagagcctccccaccaggttttctggcctttagacacttctcttcaaagaagagaccagaggaacaggactgaaaaactctcaggaagaaagtcctgggctccacactccatggctagtggctggatttggcagaaactgtcttcatgaaaagtggtatcatggagggggatccctggagcaaggaagacctcaagggagaagcagagagatttagtttctgggttcttgccaaaggaagggaaattaggagggaataaatagaaataattgcctgtataaagggccctggggaggagggtgaagacagaggcaccctaggccttaaacttcatctagactccctgggctgtgctgacttctgacccttttagggacctttgtttttgctgacttgggaaaagttgcttcctccagggagacaactcttcttagaggggagagtccataatgaggaagccctctggggtgatttatttatgctgtcaggtatagagctccgtcaggctaactcaccctgtggggccctatcaccccctcttatcacccaggctttttccctaaccaacctctgtgcctttgggggaaaggctttttgatttcccagtctcattcaaggcaatggctgaaaaatgtgcataggtttttctaggggcaggtggggaaaaggtagggacgtggattgtgtgacccagcccatctaatgcctgacatggtgcagatgggcaagacttggaggcaggctgtgggctgtgcagatagagatagcctcacttcgggagcaggattcctagaagctgtggacgtttattatgaaaaactgtcccacacaaattgtcccaaagggcagggaggctctgcattccacctcggcacctctttcaccatttgaggacccattactcttctgtagaaagcagactttgtttgggttggaagcacacctccaatgtaatttaatcagcattggactttggctcttgtaatcaaatatacatatactttctcctgcaagaagaaaaataatttctctgtaactggtattgacttgaagtcatgtaatctctggaaagcatcacatttttaaagggaaaggtaaaattaaggggaaaagaacccgcagtgttagtggtttgctttgtcatactaagaagagccagttaccacttaagaaagggcagaagaagcattcctagagcataaatacttgtgctgctccaattgtagatatttcatttacagttttctctgtgcaatcagccttggagatggttaaggataggaaactaggttgactggctcaccaaattctagaatgtgggctttattacttatgttgcattgacatccttgaaggaacctgtttgacggctcatttttctgccgtatttggagaggccacaggcagcagcagctccttgagttccagcaggatctgggtgggtagcaagcctttccttttaagggtgattggcagccattggcagcttgcttcccactccaccccagtgcccttgagcatgaagctgtgccctactgcgtcctcctggagcaagcttggagtccccaccccccagggtgaggttctgggctttgcccaagttgagtctgctagggaatctgttgtaaacacagatccattgatttgcatttgtcagagagtaaagttaaaccagtgaaaagagaagcccttatccttttatgcagggccagggaaacctttcatattgatcctattgatccaacctttccctttaaggaaaccacatagttaaagaccctcgttcaatagatttacccttcgtgcttgtgatattcctttaagtgttctcatctaggatagctgggcattaagcccacactccaaaccaaacaaaaatgggaaggggggtgggaagagagggggtcaggaggcagaattgtgggaagtgaaattaaatcaaactgaaatgtgtaatgacccagttggggatgtttttctcattcttctaaaatgacatgcagggataaagacaaaatagatgcatttggcatctttttttttatgagaaaagaaaatctgtttatatgcctagagtaaaaatgtctcaggaacatcattttctactgtaaaattatttcaattaagccaccagtttgcttcattaagattggttcacttaaaagcagtgatgttgccacaattattttggttcatttgtagcaaatcagaaaaaggattctccccagaaatgcaatattttggactctgtatatgagcataaacactgaagtcacttgaaaagagagaggatttggagtttttgtgttctgctggatgtgggaagcaacgggtagaacttttgttgtggagcagagtagacgcaataggaattgccagatattgctcagtatccctcttgcttgtagatatgaaaatgtaagtctcatttgcctccagaaccatcggcacaatccatttcatttcttccctgatccttttttcctgtctaaataacatccatttgtgatttttttcaacacggtacatgacctgtttctaattggctatctcttgggttgtttttgtacattcatgtttgttttatgtgattgaaaaatattaatgatttcgtaggtgagctaatgtatttatctgctgagcgagttcaaagggcagagttcagctatggttcaggttaattgaacaggaagcagtgagctctccaggctgtgttgaacaagggatcagtcccttaaaatatcacactcagcaaacacaatttcactgtcttcatcctagagtctgatgtaaaaggctcagatcaacttggatcacttgtttaaaaaaccaaagcaaagcacagtaactgcagcaataccctggagtccccctcggggaagaagagttttctcattggctaattgctttattggtagcactgacctgcagagcagctgcaggagcctggatgaaggcttaggcctcagaataatgtgctccattagaacagggcaaggcattttttgtttactcaattggagctccctgcaaagtgccattaaccccggcccaactgcttgtgtgctgcaaaagccaaaggtcacgccagtcagtctgtaggcatagcagctctgccctggtaggaaggttggggtcgcatcctgctggcactgccctcccaggggctcgggccagccctctgggccctttccagagttttgactaaagcaagcaattgcacaacttgtttacatttcccaactgctgaatcatgttttgatgattaaacagttttgatctgagcaccatcaatcacacacatacagaaaatccccccactgcccctctattttctatttatgttctcttcattactgtgcattacagtaaacagaattgtgcaaacggtgcttttagcaggaatatagttctgataagtgcttggatcaaggggaagacagacctccaaacatggctggggggctgtttggtggaagaaaggtttcaagtggagtcggggagcacagtcagggcttccaccgccagcaggtgaactagagtgccacctgccgggagtcttctaactgcactaagccctgcaccttccacaaggtccaagccccttccttcactttgttcctaatatccttgtccccattccccaccctgcagatcactacccatgcaagcattatcttcctagaagtagcttaaagggctttttcctggtcctttgaaactgtaacctctgcctcttctaattcattgccaaggagaaatcaacagttctgctgtcataggtgaggtgatttgcccatcctgcacattgaggtaatagtctcctgcttagttggactgtgcttgggggaagagaagcaaagaaagcaaaaaatagccgtgggagggaaaacgaatgattatgtgtggaagaaaaatggctccgttgattgtgccagtgagggctgtgccaactgtaaggtgttctgcaaagataaaatattgtacaaaggagagaggatgggagagaattagcatctacagggaggacatcgagaaagagatatgccaaatcagcaaactcgagtttaggctttgtgaaatcccctggaaagagaaaaagtgaaccagccgttttgcaattgcaaagaagtgagccagtgagctagacttcgagccagactgtggagctggctgtagctctgtgggtggcagctatttccacacttgcttcacatggacccctgcctggagcccctggtagcagagcgcctgtgggtgggttgctgcctccacgccccggcgcaggcttcagcaccacgaacagcgccatggaggaacgctgtttgagcgaattggagatggaccctctactgcggttaaatccaggcaagagcctgaccagtatctccagctctgtaggtctcagcgccccagtgcagggcctcatattttcctctggagccctgtggcttttcagctctctgtgtgagatcagcgataataaagggaagaggaggcggcatctgggtgagaagacaaaagatgctgaaagactttccctctgaagaggaagagcattaccaccgctggggggcgggggattgaactatttttctccatgttgctgccttctgcaggcatgattgccaccctcaacgggatgttttagatttaggatttcctttcaagtgttactgtctgcctgcccccacgccccaccccccaggtatacacaaacggatgcttttgtttccccagatgcatgctcctgatttttgaaagcatgacttttattatattaaacaatattctcacattatagcagcagtaatgtcacaaggagaaccaactgtggagcatcaccaccttcgataaatctagaaactggatttgatttcttgagagtctagtgatgaggctctttttaatgaaaaccttgccactgcttctgtccctgaccccctacgaagggccagagatgttgagtgacttcctccaggccacacagtggagtcatatggcactggccagggtgagaactgacagtaggcactgacccctgactctggcctttttcaatcagttgctttgctttatttctggttttattccagagaaaagagataggagagtccttttggtcaatgattgagcacaactcacatctctttgggtttcgagtaaaatggtccttgacttcccaaagctaattaaaatgtaaaactcttgctttatttcaaataactttagttcagacctaatttattgctaaggtggttctcagggaggtagagcattggaatagacaagtgtgtctcctttaaaagtcaagggtatgataaatgagaattttttttcccctgtgacaatttatcttcaagttccaggtggccctttgtgtaaaaggagggaaaatccatcccaaaacaaaacaaacctggtagagcattcaaatttgatgttgaaaaaaattgtttctgtgtgtctaaatgcccaaaattttgttctaaaaatgagcaggaacatatctgaatcagatataaaaatgggtgttaaatgtattttgtaagctttgactaaagaagtttcttccagctgtgtagtcttcgaatctgtggacgtgcctttctcaggagttgttgggttccactgtcaaaaccttttccagtaaaacatggatttggcaacagtaagtgtagcctttttggcctactttatatgcatcactgcatcttactaaaatgaggcattacactctacaaggacttgtactgaatgcatttcctttgtagtgaactcaatatgcttttgaaaagatattttacagaactgccacataaacaagaccttttctattatctgttttgaccctaaatactgaaaagtgtgtggagtaagataattttatgcttttctgaatcagtgccatagatccccaaacctaaaagatgtaggggaaaaattcgtcttggatgcaattgcctcctaatgtataccagagttcatttctgttcatgttcaagggacaagagtgaattctgtattcactttcaatgactaacccttctcatcctttccttcattcttctgaagaggaagaggtggacttcctgttgaagaccaaatcctctcctgccttctcaggaccccatgcttcctgtatatagatgtccctgcttttgtgaagttttctctgtcctcctaaattgggatctctttggaccatccctccctttgcatttagaacatagataggtatcgcctgctgacttgtcagtgtcagcccattagattaagatccagaagaggaggttagatacagcatacaggaggcagccaataaatatctgtgaataagttaataaatacttttcttttatatgacactgtttctacccattgtatttcccccatattattgtagatggcatctgagtaggaatcatcagccccagcacatcatttaggagaagcatttcacaatgtcaagttctcatcaatgtcattttcctcccaaattacgatattataactatgtattaattttaagggaatctcaaagtaggattgagtcttatccaaatcttcagattatcgccagtggagcaagagatgtgaaatgatcatcactagactctagactaaggacccattttgccaattggctctagttaccccaaagtaaccctccccagtcagtcagttctcctcgttttcctgctcaggcattgtcctcactgtcctgtccatgtctttgcacgttctgttccttctgcctggaattccttatctcatcagtccttctccaggtcctatcattcctagccacctccgatctgcctctgaaatcttcccagctaactttggcccattcctttctgtttctttctgaactcgatttgcaatcattgcaaatgacagaacagccttgttggctctggtcttacactgctctctaggtcttttctgtgtctccctttcttccccatggctctggaggggagatagcatatctttgagctccccatggactgctggtccatggctgaacccacaccaggtattcttttttgagtaagtcatttggtggcctcctgtctatctttacagaagcccctattctcaacgagagaataggttgggtatgtttacttacatctatcattcttttctagcttcttctctcaaaagggggtattcttttcttattttatttttttgatctggagccgtactttgtcacccaggctggagtgcagtggtgcgatctcggctaactgcaacatccgtctccagggttcaattgattatcctgcctctgcctcctgagtagctgggattacaggcacctgtcactatgcctggctaatttgtgtatttttagtagagatggggtttcaccatgctggccaggctggtctcaaactcctgaccttaagtgatccacctgccttggcttcctaaagtattgggattacaggcgtgagccactgcacccaacctgaaaaaggggtattgttttctataaatgctttggtcattgttggaaatattggctacataatttaaaatggatttctatgttaatctgaaatgagacataagcttaatatagagaaacagggcttgtgatgtcttcgttaatagcaaaggttgttctgcttcatacaagatggaaaattttacccacctcagggcaattgtgccagcaattatatcagcaaatcagagggactgctttcctattttaagtcattttaattatcagtaaactaaacttgcatctaaacagccattacttgagatactgcaagtgcttaggttgttaataacgtaaagttacctgtgaagaaaaaaaacagaggttaatatttttatctttttattttattttaattttatattttattattttcctttgatgaatccattgctgcctacactgtactgaactaagtagttgggagtgaaaatatatgaactagcccttgtccctttttgactttactgtatatttaagatttgaatggatacatcctcacttacctttacatatccatatggaattgagtgagaacagagtttattactatgtcaactttagttggaaactgaaactaagatcatttatttgctatacatcttacgtggaaattatatattagctcgtgatatttcatcttttttacagttatgttttgacgttcatattacatgagtaacaaattatgaagactaaccatttatgaacagaatttagtgttaaatgaaagcattccagatttttattttctgttgccttgaattgaatgcattgctgtgctgcatgataactaggtaagcaattgacctgtgtgactgtcatttctgtgccttgcataaccaaaccaagtttcctctgacactgaggcagagacaggcagggttgcgctgggcaggaagcagctctgaggcctccctgaagggccttagactcccaatgggggagtcagaggccaccctgttctctggctacggcaccatagcctagacatgggtgtcaccaaaggctatacacttctttacctccttttctgccctcttcctaaaggaagcatctggaaccagaaggagtccatatcgctagccccactcctccctaaccagttctccatcccgagccttagattcaggcttgcataggcagattctggaaagtccattaaaagggcaggatgtggagtaaataggtgattggattggagggtaaagggcggaaaattcacagcagagacaggtggacttttctaactggataagctacaccaactcatgaatccaagtattccacccctggaaagcaagaggtgaaagcaagttggttccattggtgaaagcaagtcacctgcctgagcccagagacagggtggaaaggctctacaaagttacatggcaggaagcatgggcacagaaaaggcaagcatgaggaatggggggggcggtgttggtgtttttctttgtttgtttgttttgttttgtttgcattctacctcatgccatgtattttagctcatttattcttggaagctgccactgctatggtgatacacagacatcaaggatgtccaatagtatagggctaattttggcaacacagaagataagtgtgggggtatttcacattcataagtaacaaacctatgcccacctggacaggaaccacgcctctttgtattgagactgtttgtgacatgcttgatcttctcgactagatcatagcaagcagggaccctgagctttgttctcctgcatcttccctttagccccaccacaatgcctaacacatagtttgcacttagtaaatatgcaaggataaatgatccccagaatcccactgctctagtgtcccaatgggagatcccctcaagacccaccaggtgattgcttgtagctcaacctgtattttattttattttattttattttattttagagacagagtctcactctgtaacacaggctggagtgcagtagtacaatcttggctcactgcaacctccacctactgggttcaagctactctcctgcctcagcctcccaagtaggtgggattacaggtgcccaccactatgcccagctaattttcatatttttagtagagatggggttttgccatgttggccaggctggtctcgaactcctgacctcaggtgatccactcaccttggcctcccaaagtgctgggattacaggcgtgcgccaccacgcctggcctcaacctgtattgtaaaatagggtttcactttaaacttttaaattttgttctactacaataattaccaaattccaggggagcaaaggtccaagcctgttgcctacagaattaaggcatccaattcagatctcaattattttgtgttaagaaaatctaaacaaagcaaacactgcttagggtttaccaatgaataaagaagcaagttggaagggatatcaaaaagatcaaaatgtttgcgcatttataactttaacaatgtctaagtttttttaaacttaggttctacatctggagcatacttttttaaaaatcataagcagtgttaaaaaatacttgacagttttgtcttgattcttaatgtgggtgttaagggatgccgtccattagtgagtacaccccagatcatgtgtttattgcatcctccttcttccctgcctgtcccctaatgatctggtgcacagagggctacttgagctgagttatatggatctcagttgctgtcatttgcacatacttaattcagagaggtgatcacattgatttccaagacccaatttttaagacactgtactcacgtagatatcttagctgctctgactatgttgtctgaaaaggaaaacattttaagcctttggaagcaattttgatggacatttcattgtgttctatattactcacataattaaatttccttcaagtcaaagtctgtttaaaattaaattgagaaatatttttgagttccatcaggcagataactttgtttagctagatttgttctgcattcacatgaaatggcgtcctacgaatcaatacccagtgctcacagttcccctgaatgtgaagaaatggcacccttagtagttcttgtgtttttatgcctatggttttgcaggctggtttattcagattctgagcattgtgaactaaattcataacttctttcatgcattagccggagtcataggactctgatttacagactcgcagtccagctcacagcggctagctttctttgggtcataccagagtttcatctgcatggccaaaggggtagaattccaacttgggtttgaaagcaaataggataaattgtcagaagatgtattcctgtgtacatctttggaaacaagacataggaacaaacccttatttttcaactccacccaccctgctactgaggacagaagaacaagccctcctcatcttttatcctgcctctccttgagacagccattccattaaattctatggcgagggaatctatggtgttcgagctgtaattgaagaattagcattccataaatgctgccttaatttttttaaaaaaattgttccaaagaactgctttttgttgcattgttaattagcctttgaacatttttgaattcattataaccttcaaggtctgccaaggtctttaaggtttcttctttatggctttgcctctaaataacaataggtacattgtaaggttattgtgagccttaagtaagttaatgcatacagatgcttagaataactggtaaatagtaaatacttgctaaaatatctgccattattgattgattgattaattttttgtaacttctccatatatcagcaggaaatttggcctgagtcaccaatgttcccatagcttttatatattaagaatattgcttggcattgtcaatgacagcatgagccaaacagatccagtttgtatctgagccaccatttactagctctgtgatgtcaggcaggggacgactcttgaagagcctcagttccctcctctgtaggaggaggacaaggtaggtcctgacgttatctagttggtgtacagattaaatgagacgccataagggtatatggcacctggtacattgcctcctatctcctcagttttacagctaacatcctattacacatgggccacatctgtacttcaacataaattttttgtcattttctcagatgagatttaggatgagtgagattgccagactctacactcatcactgggcatgctgtttgcaaactggccaaccatgcagccggactatttactccccacccccaatgtccttttaagactcccttaacagttatggacattttgctaagctcgtgcttagaacccagaagttgactgtgcacacagtaggttctgactgaatccctacaggcttagattggaatacagtccattttgcaagtgtggtatgtattgagcagacattctgtatttgatggaagttcacatataaaaatggcaactgagccaacaaaactcacatcatctgtctctataatgatcacaggtttggggggccttatcagaaagttatttttatagacaccccggtggtcatgagatttaaaatgctaaggagaatggcttcctctttaacctcttttctgtttttgatatgtctgggccctgcttctttatcttgttccccaaatccattcacttaggttctgacttggctccctggagagctcctgttttggttcacaccatcatctttattcccaaattaggatccttaacaagaaaagagaaaagaaagaaaacctgtagacatccagatgttgctttttctgaagtaacaactttatttgataatattttgaagccatgggccaccgaattctcaacatgcaagtttatttaaacagtctctagtatcctttcctgaccccaaattactttcaagcattaattgtcctagtggtttcatggccatattatttcatattcattagtgttttcatgaaaaattataacactaattagagtggcttccagttaattcacttggtgattcattactctctccttcttggtgatctgcatgtggtcatcctggagaaagcatccaagggtaattgcagctctattccctgagtgattgcctaatgccattagttctgatccacaggagcatctcgggaagctctgatggggtctggttacagctgcacccttgtcctgccctttggatgcagggagaaagggaagcctgcagtgaggactggtcctccggaggggtctagggaaacagaggggagggacgtcttagggaaaaggaagtaggggcaggggagggagttcagggatttgaacatcactttaacatcttctagaacttgggtaaggacagtatagagtaaaatctgccctgagaacttgcacgtagagtaaggaaggtggtttctcttcagtttcagcagacttgtggccaggcactgagctggagtttggaaacccggttccctctcagagctctgacatccagttcttccaactgaaagtttatttgacctcattcccattaggatggctgctgtaaagcaaaatgaaaacaaaaaataacaaatgttggcaaggatgtggaaaaattggaaccttgtgtgctgttggtgggactgtaagatggtgtagccactgtggaaatagtatggcagttcctcagaaatttaaaatgtgagttatcacatgacccagaaataccacttctgagtatacactccaaaagaactgaaagcagggtctgaaagagatatttgtacacccgtgttcactgcagtgttattcacaacagccaaaaggtggaagcaacccaacagttcatcaagaggtgaatggataaacaaaatatggagttttcatacagtggaatattatttagccttaaaaaggaaggaaaatctgacatatactatggtctgaatgagtcttgaggatattaagctaagctaagtgaaataagccaatcaccaaaagacaaatactatatgatttcacttatatgaagtgtctagaatagtcaaactcatagaaacggaaagtacaatggtgcttgccaggtgcctgagagagggaaatggaaacttgtttaatgagtatagagttttagttctgcaagatataaaagttctggagattgtacaagaatgtgaatatacttaacactatggagctataaccttaaaagtagttaagatggtaaattttgttgtgtatattttaccataatttcaaagaaagattgtttgttatttatattgtattgcttgctcaatttttaaaaaaaattaaaaatagaaaaacaaaaagccaggtgcggtggcatgtacctgcagtcccagctactggggaagctgaggtgggaggattgcttgagcctgagttctggactgtagtgccccaggcccatcaatgtcctcactaagttcaccatcaatacggtgacttcctgggagtggggtatcaccaggttggtgagggaaaaaacaactactgccatgttgctttcagttcttttggagtatatactcataagtggtatttctgggtcatgtgataattcacactttaaatttccgaggaactgccatactatttccatagtggctacatcatcttacagtcccaccaacagcacacaaggttccaatttttccacatccttgccaacatttgttattttttgttttcattttgttttgacagcagccatcctaatgggaatgaggtcaaataaactttcaactggaagaactggatgtcagagctctgagggggaaccaggtttccaaactccagctcagtgcctggccacaagtctgctgaaactgaagagaaaccaccttccctactctatgtgcaagttctcaaggcagattttactctatcctgcccttaccccaggttctagaagatgttaaagtgatgttcaaattcctgaactccctcccctgcccctacttccttttctctaagacgtccctcccctctgcttccctagacccctccggaggaccagtgctcactgcaggcttccctttctctctgcatccaaaggtcagttgtgtttgctcagtagtgggatactgcctgtgaatagccactgtactccagcagcttaaaactccatttcttaaaaacattttttatcaaaagttctgccactccactattcacaatagcaaagacttggaaccaacccaaatgtccatcagtgatagactggattaagaaaatgtgacacatatacaccatggaatactatgcagccataaaaaaggatgagttcatgtcctttgcagtgacatggatgaagctgaaaaccatcattctcagccaactatcgcaaggacagaaaagcaaacgctgcatgctctcactcgtaggtgggagttgaacaatgagaatacatggacacagggcggggaacatcacacactggggcctgttgtggggtagggggctgggggagggatagcattagaagaaatacctaatgtaaaagacgagttgatgggtgcagcaaaccaacatggcacatgtatacgtatgcaacaaacctgcacgttgtgcacatgtaccctagaatttaaagtataataataaaaaaaagttctgccactcaaagagaaccacattaatattttgcttttattaaaattatttttaattatttaagcaatgcattaaaacattctacttataaaaatcaaaacattaatgatcagaataaagtcctctttgcctatctcctttaataccagtcttcttcattacttcccagcagtaaccactcttctggctacaaagagtgggtctgccaatccaggcacttccagtgcatttatttacctacatatgtactcatataaattgtataaataggtagaaagacagatagatagatcgataggtatcttaggtttgcgtattgttttcacataagtggcatcacactgcatgcatcattccaaagctccttctttcctttgatagtatgcctacccagcttctacatataaatgaggttcttgcaacccacatttattgcatagtgtcctatggcatgactattttcatttatttagccatttctgttttgatgggcaattaggctgtttaccatttttggttgtttgcattatttgctaagcagtgatgagtgaacatccttgtacacacctccctgtgtacccatgggaatgtttcctagggtggacaccgagaagcaaaatgagaggtcatggagatgcacatactgtaattttgataggcactaccacactgtcttcgaaattggctccccatcagcagtggaggagagagctcctatttccctgacacttgccagaagttaatatattagccattttacttttttttgcatagttgctggatttaaaaataacattttgtggttgctttattttgttatatttttatgatttctaatgaaccttgatataatcatatacttgctggtcatatatatttccttttctgagaatgtcctgttcatatccttgtttggcattgttttttatatattctggatgcaaatttttgctttacaaattacaaatgtggtctcagttctccagttaaaaggcataaagtgattgaatggttaaagaaacaagacccatctatatgttgccttcaggaaacccacttcacccataaagacacacatcgactgaaagtgaaagagtagaaaaaatatttcatgcaattggaaaccaaagaagagtgggagtaactatacttatatcagataaaatagactacaaatcaaagactgtgaacaaagatgaggagggtcactacgtaatgagaaaagggtcaatacagcaaggggatataacaattataaatatctatgtgcccaacactagagctcccaggtatataaagcaaacattaatagatctaaagggagggatagactataatatattgaaaacattttatcccatggtattattttgaaacttaataaggcttcttttaactttgatgtatcaaattcatcttttttattatttattttttatgagacagagtttcactcttgtcgcccaggctgagtccaatggtggtgcaatcttggctcactgcaacctctgcctctgggttcaagcaattctcctgcctcagcctcctgagtagctgggattacaggtgctctccaccatgcctgcctaatttttgtatttttagtagagatggagtttctccatgttggtcaggctggtctcgaacttctgacctcagatgatccacccgcctcagcctcccaaagtgctgggattataggcgtgagccaccatgcccggcccaaataaatatttttgttgctcttcctttactttatgtgttttgcttcttgggtcatttttatttattttatttattttttagaggcaggatctcactctgttgcctaggctgagatgcagagccccaatcatagctcactgcaacctcgaactcttgggctcaagcgatcctcctacaaaagcttcccaagcagctaggactacaggtgcctgccacctcatccagctaattttattttatttttttcatacagatggagtcttgctatgttacccaggctagtctcaaactcctgagctcaagcaatccccccacctcagcctgtgtgctggggttataggcgtgagccaccatgcctggccttgggtcatttttaaacatttgaatctttattctttaatttttctgaagttgctttttataaattatgtgaaattggaatctatttttttaaaatctcaaatggatagccaactaatccaacagtttctgaacaattcatctcttctcactatttgaaatgcaatactttctttataatatattatattcccttatgtacttgggtcagtttctgcactccattctgttccatggatctattaaattctgtgtcaacgtcatactatttaaattatttttgctttatgatatatcttgagctctaataggatatatattttctctcctcatcttctgtttctacatcttcttagccttccttgtattttcacttttccataggaattatagaatcagcttgaatttatatattattttgatcttctcaattatacatagggcacagagttctattcattcaaatcttttttttttttttttttttgagatggggtctcactctgttgctcaggcctgagtgcagtggcacaatcacagctcactgcagccttgacctccctagctcgggtgatcctcctacctcagcctcctgaataactgggactacaggcacacccaccacacctggctaatttttttgtattttttgtagagacagggtgtcactctcttgcccaggctggtctcaaatgcctgagttcaagtgatcctcccacctcagcctccctggcattatggcgtgagccaccacgcctggaccccaaatctttatttatgtcctcagcaagtaaaaataagttttagttttggccttttgatcttttggttagagttatttctagctacttgttactgttgtgaaggtttttttctgttgcgttttggtttcatagttctttatactcaagtatcctaaccactatagtttagtgttgctgttttttttttaacttcatataaacagactcactatatgtgtattcctttgtgtctgatttcttttttccaacattatcttcatgctgttatgtgttgctgcatgtagtagcagtcattccttctttttcataactctataatattccactaaactcatatgccacagttaatcaattctcctgtcaatgagcatttggattgtttccagttttactacagagctgctctgaacattcttgtacatgtacatgcatcctaatgtacttaaccatacatttctgtggggttttcttaatttgagtttcttcagaagcaaaccctaaaacaagaattcaagtatgggtagtttatttgaaaggtgattccagaaaacactagtaaaagagtggagaagcaagacaggaaagggaagaagcccaataagagtcacttcatgaagcacattagtagagtgggcaaatggagcttaatcctgctgagtaactctgtgaaactccagagaaaatatgccttagagttgttccagctgaagaacaagggtgctggggtatttatctggcagctccaattattccctaattgaggaaatctcctggacccttccccagcccttctggcctgcactgcatgtgggcagggcaggctctggcagccagacaaagccctcaggcaaagagctgaaggtactggcagttagaagttgggctgtcgtgccccgcagtggtgaaggccaggagagtgtggcagcacatgacagagtctgctacaagagagtctttccatgagcagaatttctgggtcatagggcacatatatattcaaccattgcagatactgccaaacagtcttccaatctgttgtcccagtttgccctcccaccagcagcctaggagaactcccgcaaggctgtgtccttgccagctcttggtattgacttttacatttaagccattttgataggtgtttaatgttgtctaatttgcaattcctggattactgataattttgagcatcttttcatgtaatttttgaaaatttggatttcttctgtgaagtgcctgttcaagtctcttgcctgtttttctattggaatgtttggcatttccttattgatttccagaagattttatatattctggattcaggccctgtggcagacatatgtgtttaagatatctgtggctctcctttttactgtcattcctgtcttttgaaaaacagaagttcttaaatttttttaagagacagggtctcgctctgttacccaggctggagtatagtggtacgatcatagctcactgcagctttcacctcctgggctcaggcagtcctcctgcctcaaccttccaagtagctgggactactataggcatgcaccaccacgctggctaacttcttaaaattgttttttgtagagacagggtctcactttgttgcacaggagaagttcttaattttaacgggccccaatatataactatttctctttgggctagtactttttgagtactaagaaatctttcctgtgattatgaagaattaccctatgttattttctttctttttttttttttttttttttttttgagacagagttttgctcttgttgcccaggctggagtgcaatggcccaatctcggctcactggaacctctgcctcccaggttcaagcgattctcctgcctcagccttccgagtagctgggacaacaggcatctgccaccacgcctggctaatttttgtatttttagtagacacggagttttaccatgttggccaggctggtctcgaactcctgacctcaagtgatctgcccgcctcggcctcccaaagtactgggattacaggcataagccactgtgctcggcctaccctatgttattttctaaaaactttattgttttgccatccatactaaggtctgtaatccatgcagaacttattttttgtgtatgacatgaggtaggggtcaagaattacattgtgacacaatgcctatccagttattccaactccattacaggagagaacacatgttcctcatgttctgcatatccaaccttgtcattgaatccagtgtccatatgtgtatggatctatttctgggtttctgtccttttccactggtctggagttgtatgtccttgctgcagtattacaccatctattgtagcctcattaaagatcttggtagttgaaacagaaagttgtcctacgttgttcttcttcatctagaatagcttaactgttcttcgatttttttgcattcccagttaaatttcagagtcagcttgtcaaactcaaactttctttcctttcctcttgaaaggaaggaaagaaggaaggaagagagggagagaaatctgctgggattctgattagagattgcattgtacctgtagatcaatatggaaagaattaaaactcttcacaatattgagttttccaatcaatttatttaggtattctttaatttctctaacaaagttttgtagttttccctgtcaatgtcttgtatacctattgctagatctattctatgtacactcttgatgttttgatcctattgtaaatgatatcattttcatttactgtttgatgtgttatggagaaatacaattgattttgtctactgacttgagtcttagaatcttactaaattctcatactaattctaacagttcattgtgtattctcgtggatttttaagtacacacaatcaatattgattttctatgttcatcttgaaactggccaccttactgaacttttttattagttctagtaatttgcctttcaaaatcttgagttttctaggttacaaaaccaaaaaaaaaaaaaagtccctcatattaacttataattatgaggattctgtttctggctgaagacgctgttaagtaaaagaagtatggagtcacactacctgaatttgactcccagcctgttatttactatgtaactttaagtaatttgcttaatcctctgtaccttggtatcattaattataagctgcctcatagggtggttgtaataattaaatgagtttatacacgtagaattctgcctgtcaaataatgagcactcaacttatgtaagcttttgccatttcatcagtttcctaaattcctttataaattttctttctaaattttcacttcttatttattttttcttattttattgtattggctccttttccgatataacattgaatcatagtggtgcttacacccctcatctgaaatttcaacactttgaaacatttctttctagtattttttttgttttttgtttttttgtttttgtttttgtttttttatataggcatgttgttttgttttgcttttcatgtttgacgtatctgaaattgtctttgactggacttccaaatctggtggtaaactatgcaagacagagatacttttccaaaggaatgtcttttgttcaaactatattattcacataaagatgaaaagtaataacgaaacaatttgtttttaaacattgagatttggttgtgaatggagacaccgaccctttttccttcctgcagattcattagtgtagtcttaacaaagaggtgctcttcattcatgtaataaaactttttaggatgtttggaaggagctcagggatattcgtagccacatagggctgttggccaattcttttttaagacaatatcacattcttgagcttttaagtttgattaaattcttagtaagctagagtatgtcttcaagttattttcatagaaaatattttcatagaaaattttcatagaagttattttcatagaaagcctatagttagaatttttgagtcattaaataactaagaatgcctttctacgggaaagaccacctgaaccacataaaattctagcattaccgccacagtgtcagttttgctcttaatttcctccaatgccactactgtatttctcattttcctgcaaattttaaaaatcttactcctctttttttgcggggggcgggggttgtttgtttgttttgagacagggtttcattctgtcacccaggctggagtgcagtggcatgattgtggctcaccacagtctcaaccctctgggctcaattgttctccctgcttcagtctcctgagtagctgggaccacaggtgcacaccacccacgcctggctaatttttgtagtttttgtagagacagggtttcgccatgttgcccaggctggtcgcaaattcctgggcttaagcaatccgcccgccttggcctcccaaagtgctgggattacaggcatgagccacctcatccagcccatcttttgtcttactactttttcattacatatggttacttacaaattgctattttcttcttaataattttctgttcctgtttcataaaagccacctctttttgcatcatattgttatatcaaatgattctctaaaatgttctttaagtttctggaagatattatctggtaaattttctctggttttcagatgaggatccctttttgtcttctactattttttcaattgtctctttttcctgtttattcattctcaaatgagaagagacccattctggcttgccatggtcaatagaaagggtgtatgttttgctcatgacctcttttctggatgttagtgcactcattctctaagccctatactaaatcgccagttgatacacctaaccaagcttccatctaatcagcttccttgttgtgtggccctgctgaactgatgtgcactcatctcctgcatccgatcctgggatgctgagaagctgatcaaatggaatacacacgacaacccccggtatactgcacatcgagggctcctcttgtacctgtgctcaccctgagtgctctggaaactacttctccaagggagtgatgtaccagccttggtgtccctcctccaccctgcagttttgttttgttttgttttgtttttttgcctagttgttttctgagagttgcagttcttaattggcaggtggaagggagtggggagtactctggctctttcaaaaggcagcacctaccaagtagatggatggctgctgaatttaaatttctcaacagttggaggactcagatgttattttttcaatcctgatgtcccatttcaacccagttccattggccttggccttgtgtttaggtaaaaaatctccagatcccccaaaacagactgactgcagtcctggtttttggtgtgctaagttttgtgtttcattacaggacttcgagatgattttagcagaaagttgaagaagctgccccatgctctcctagccattttaagccagatgtttgtatctggaattaaatatttgttttagcaactcacgacttcctggatggcttacaggaatgcagcttggcagcagagctaaagatccctctttgccaggcttctgcataggcagaagagatgactgggaattgtgatttcaaaggctgagtgccccaaactatttattctaataggaaggtgggaaataaaagccccactggactagacaggagggaatatgggttctcagggctgtgtcactgcataggtgaccctagctgggagttctgatctcttatttctaaaaacaaggttagaccaagtgctctctaaaatcctgcctttctaggagtctgtggttttagcagctgacctagaccatctgctattagaagcctgttctttgaggctactcatgtttgttagagcctctgctggagagaagcagaagtaagaggtacatctccactcggtgtacaggctccagtgtgcttcctacaggcagcacctgcgggcagctacaggggcctgaaccttcccctgggagatctgcccaccaggggcactctgggcctttttcaggccatgcctccatataagaaagtcgtgagacatccaagagccctcatttcctgagtccccttcagtgactttgtattgaaagtaaaaatagagacaggaaataaaacttgtttttttcagagaatgtctttgaagcttgggaacacagaatggtcgctgtgcggtctgcctccagccgacagtaagtggacactggggagttgctctagcgcttgtcaagaccagcttcgacatccaagtgaaagcagaggcggcggtgtggagaaagagcagagatttgccattgatcatccacatttcctttggttttttttttgtttgtttgtttgtttgttttttttcctaagacagagccttgctctgtcacccaggcgggagcgcaatggcgtgatcttggctcactgcaatctctgcctcccgggttgaagtgattctcctgcctcggcctcccgagtatctgggattacaggcacacgccaccacacttggctaattttttttatttttagtagagacagggtttcaccatgttatccaggatagcctcgatctcctgacctcgtgatccacccgcctcagcctcccgaagtgctgggattacaggcatgagccacctcacctggcctatcatccacattttctagatgagaggaagaatgtactacaggaaatctccccaggatctgagatttgtcctgtgtcagaggtgaagcccaagacacggctcacaccgacattccagggcagtgccaagccttcccggactccgggcagctcggaacttggggactttgcccccaccctccagcatctccagaatgaggggagtgtgtatgtgtgcatcgtgcatggcccctcctgccttcttgttccttctccctcctgtctcctttttcctcttgctccgccattctcccgcccacaatatctgctctaataagccaggcggcagtgctccaactagcccataggtggttcacgctggagtaccttgtgcaggataatttgccaaatgggttagaggtctgtcttgcaaggcctgtgcatacatccacaattagaagggagtgaaaggaggaggggaacctaacaaccaagaatggctccacatccatttgcacagtgtccaccctgtctctgcccttggcctcccaaatggatgttggtctggacgtcactggctccgctgcctgtctgtattggcatctggtacatgaagaccaagtttctgaggaaagccagctctcaaccttgaaacaaagccattaagtttctcatctgactcagatcaggcacgtttggagaaatgagggccaagttagagtttagttctagaggtggttgggggcggagggcaggttcatggtactggctccatggtcatctgaacctaagtggcctttggtgatgcgtcagaaatcacaatgaagcaaggaaacctgcaaggcatctaactgggaactatttatagtttccaaaatttagggagcacaaaataatccaataatgattttaagacagaccctccccatccatcaaggcctggctcctcccaggtgggtgatcagtgcttctggcaccagctggccctgaatggccagtggagctgcttagagcctgagccccaagtcttgtgtgttaggccccctgctcccagggtctctgtggcaatgtgctggcacctaattatttgctgaccctgagaagcatgcattgctgagatttaccagcatttatggcttactgaatatcaaatatttattagcagagtgtacagttattctattttctttcttccttgtttgaattcaaggaatcttattatttttactttaaaggctcttgatcatgcagattagttccaaaggaagggttctctactggacaccatcacctctcccatagtcttgtcattctatcagtactgaagggccaccagttcagagcagggaagtgaaggggggttatttccattcttcttacctcaaacacctgtaggtttctcagggaacaagcccagaggtacaaatgtgaacctacttttgtaattgatttttccaacataaccccaattgactgccttagttaatctttccaacagaactgcaggccctatgtcctcccgggagagtgccctccttagtggaaagggtcacgctccccactttgcacaagccttcctaggagggaagctgcgagctcttcagctgaaaagcgaaaaggcctcttctgcaggtgtacttttcaaacctgtatccttggaggttaagtgtctgctgacaaatgcacaccctggatggtctctctccccactccccacccttgccctgacaagatcacattgaactattcagggaaagtatttactgaatgcaaggagaatagagcacttctgcattatttattaggggctaacaatacccatcatatgtagatgatattgatacccatcaatgtatttggacataaattagtatgttaggaaactccagtggtccaaaaccttttaggatctctgacacgtatgtaaaaacacgtcgtagtcttacctcttatatgaggctgggaattggctatgagacaacctcacaaagaaaacaaacatctttaaccttttatttgccattagccctctgggcagttcatctactatcgagtaagacttgaaatcatgaactcttaacctctccttacacaccttctttctgctttctctaaggaaggaagaatgttcacatttcctgagtgtctactctgtgccaagtgttacagcaagccttttgatgtcctggagtgctggacattagcatccccactctataggatcaggaaactaaggctcacagtcctgcagctgataagtggctgacaaggagtaggaaacagggtcttggcttccatctgagcttcttacagtacatttgactcacccctgggcaggaaggcaaaggtcattcttggcttctgtatcagttacctgtcaccacaataatgctgcaaaacacagaaccacagcatgggtgatataaaacaataaacatctatttttgcccagaagcttgtttgttggctgggtgtgtctgctgatacaggccgtgcttggctgatctcagctggactcaagtgtgcatctttagtcagctgctggatcagctggggctgtcccgtccaagatggccttggccaggacagcccatccaagttgagtggggagttccagttctggggcagcgaggactggaagattctgacccggtgttgagttgctcttacttcacaggcttcccagaaactgtggaggctgggaaggggttttccaagatcaaatccaggatccagtgctaattgagtcaccctaaacaaacgtgtttccttctccaagagtaaaatgggaatccatacctctgccccatcttcctttcagagatgttgtgaaaagaaattcccaatgggggatccagactttggcttccactgggactcacctcactgtgccttcagttccttatgtgaaactgacaaccctggactggacaaaacactgaggttctatggctctgtgaggaggaccaagctaagggagataaaagatgttcaggtgccttgaagagctaacaccactgcacctgcggaactgggtgtcaaggtgacatgcggttccagggtaattccccaacctgtatctgcctccctgaaccaaccagatactgtcccccttaccttaccctccacaccacacacacacaaccacacacacacacacacaaccgaggtcagtctaccctctgttcgggaatgggccctcccccatctctctccttgcttcccctccccaccagcacaaaggccctggcttccaacaccccattactgctcagcatccaaatatccaaagacttttgttactagaaggaaaacgcacgatgcgtgacaagcagcctttctggccggggaagctactctgttactgaccacgcagtcggtggcaaggtccctccccaagctgagagagaagggagagcacaggacaccacggggccttttctgtcctccatgatgttctccagtctcacacaatccctcaccctgtcccgcctccctttgcatcccctctggatgggaatcatccctggcttgatgagcgttgctgcacgactctgaccacatacctttgtgctgcccatgggtaggcgatggacagggccagggccggttagtctgggtgtcagagggcagctgagctcctagaacgcccaggagcagccactctggaggcaaagtagacctggcccacatggagttgggttgggatggggaaggcatggagaaagggtcagttgtggagagacattctctctctccaggttagaggtggggaagatcagctatggggagcagcacattcttggaaaggcactttgtttgtcctgtgtctgacctcctgaggggcaaaaatccagtggccaccagggagaagcaagttggtgtctgaagatctcagagagggcttgtgcccgaggccagggcttcccttgttttaccctgggaacccagtgttttgaaaaatttatctaccaaggaacctatatttttaggcagtagctgtctgccatccttgttaatcacagattatacacagatgtgtacatgcctgccagtaccaggtcctgggccacaggacacaaccagcatgaccaatctgagtcaatattatttctttcaaaaagtggggaaaggtagccttattgtaggtaaacaaatgacttctcttcgagtctttgaaatggaagcgagcgcttggccttccatgtggtcctacataggacctgcttccctgtgagagggagggagctcaagaatgtctgagggcttttgggatctacacccacctccccatcaggcagtgacacatcagctcctggcatgccctccctgctttcctcctaaaagagagaggagaagaatcagatccaaatggtctagacagggctgggctaaccttgcaccttccgtggcagaactggctttgagcagttggagttcaggagaccctgaccagcatgtgactgtgtcaagactgaatccatcaatgccactggaacacctgctgtttcgttgggtttctatcgcatccttgggttggagggagctattgacactttcctggctgttcaaaaatgggcacatgtggactatagagtgtagtaattgaacagcaccaaagccgtttgcactctgcttgtgcctgcaggcacacctggctccacagcccgggtctgaggatgctgaggtcacagcctcacaccagctcccagacgtcattggatctgtctcctttttcttaggctttcaaggcaggtgttctccctcctgtttttattttcctttagctcctgaccaactgcttttgtcaaaatcaacagctggcaattgctagctataaaaaccctgggcaacatatggacatactgcctcattatttagggcatttgggcttgctgtacacttctagactgcaagctacagctttgcatttgttgctgtggcatctggtggcttccaaaggctgttgggaaggcataggcaggatgtattgatctgttctctctgtgcagtttgcttcacgttaagtctttaatatttttatcttaaatatgtgtgtgtatatatatatataattttaaatatatgtatctcacacaaaatataatccgacaagccaatgtggacctgtacccaaactgtctaatcaccctattaaaagcacaaatacagcattatctgaagaataatcaatattggtatgaaaattgagagctatgtggttaatccaaaggagcgtgaattgacagaggacctcagccaatgtttgcagaagatatttgcctggattttgttatcaggagattatcatgcatcactatttattcagaatcctccagatgaaggcttgacaccagttgtcccaggggtagggtcagggacggttgtccagggacctgaagtggcagtaggggcaagcatagtggtttctacatcttaaaaggggctgcagaggtttatagaagcacagattccagaaccttgccccacatggtgaaaatcagaatttctgggggtggagacccagaggctgccctgcaaagagggcccctctgatgtgcagttgggtatgggtgccattccctacaagagaagtgtttattctttctttccctgggtctgcagcaaacctgggatgcggtgtcagtgtcatcacatatactccaaggtctccatgtatttccttttaaaatgaaaatcatttttcctgatttgcctagctcagagttactggggtaatacaatgagaaggagagtatgaagtgaagaggtacctgttatctcacttaagcctctctagaattgaacatttttatttccttatttagatgaggaagacaggcacaaagaggctacgtaatttgcaaggccccaggtcttggaggtgtggaagcccaggtttgaatccagagctttccattgcataacatgctcctctgagactgtagaaatcaggcagacccttgcaactcaaaccgaggcatgtggaccagcagcatcagcatcacctgggtgctcatgagaaatgcagaatcccaggccctgtccaggctgaactgcatgagaatctgcgttttgatgagccctccaggtgattcctatgcaccttaaagtttagcagcactgctgtagaggacttcagattgagcaagagagagtagacctcaaaacaaggttcccctgcaaaggctatttctgtgtgttaccaccacacaggaatcatcagaatccaacaaaaatatgcagtcttcacaggaatgagcaaagaagaaatcattaccggtaagctgttggaaggatggcagtgagcagtcttagccctttctgtctgagttcccactgcaggggaagcgctcctcatccaagaaagccaaaaggccccaaaagaatgagttttaagatgaaaacaaattgtttttatgtggatgtgttgtgtgtgtttaattttgaagacaatatgaatacttttagaaatgagagaaggaaaaatcaggaagaaagtttagccaagctgatacagcctagcagctttcccattcaggggctctcctcttcctgccctttgagagtatcagtgcattttgattatttcaggaatgattcatttatattactttatagcacacagcatccagcagggagggcagccagttaggtagaaggaaattcagcttccaagtatctttcccgtaagtgtttgtcttcaggttaaatcctgtcttagtctgttaaggctccagtaacaaccacaacaacaaaataccgtgacttagtgcttataaacaatagaagtttatttctgacagttctggaggctgggaagtctaagattaaggtgccagcggattcagcgtcaggcgatagtctgtgtcctggttcacagagaagactttctcactgtgtcctcccgtggtagaaggggcaagaggtctctctcaggcttattttataagggcactaaccctattcctgagggctccaactttatggcccaatcacctcccaaaggccccacctcttagtaccatcaccttggatgttaggattgtaacatatgaatttttggggggacataaacattcagacaccgtagcagaccgtccacataagatgctgcctgcagaacacattgaacaggaaatgcagtgcccgaaggccaggaaacaaaatatacaagccagtgctttgagaaacataggaaagcatctgagcagcaccctgggtgccagtcttgggggaatgtcagtccactgcaaagggattctcaacctctggccagaatatccagtaggatggattctgagggcgactgccccatctgggcctctgctccttcctggcctttccccagtttttcctgttgaggccacactgtcaccacacccctaggggagctgggacttatttcaagtgattttttttttttttttttgagatggactctcaccctgtcacccaggctggagtgcaatggcatgatctcgactcactgcaacttccacctcctgggttcaagcgattctcctgcctcagcatcccgagtagctgggattacaggtgcccaccaccatgcccagctatttttttgtatctttagtaaagacagggtttcaccatgttggccaggctggtctcaaactcctgacctcatgatacacctgccttggcctcccaaagtgctgggattacaggtgtgagccactgcacctggccatttcaagtgattataacacacgttctcatgttttagcattatgatttgtaatactgtatttaacctttacaggtcacttttctgagacaccgaacctgtctgtgaagtgtacagattccctgaaagcgtcaagaagccatttgtcctcattgtcccaaacattcattgtatccatggctccaaaaagaatcagtcaggaatactacagaggcctggttgctgccttctaggaacttgtaggctaagggagaggtcgtgacacataatggccttgactgcatatgtcagcccaggcatggatactcacttctgctaaatcaaagagactctgcatatactaacatgtctacaagcctgaagtcctattgtaacattgggcttcttcccccaccctcatcccctgtcttgtactagcttccaatttcaaactagccaaatgagaattggctaaaccaatttttctagtctttctctcccttggtcttctgtttgttttgttctaatttttcaaaagtctggacgaaaggaatttgggttgggatgataccatcattctgtcacttctaaattcattctgttaacaatttttagagtcacatgggtagaagctttgattctgaaaaactatgcacttttaagttttgactccagaaggtaatttcaactcagctgtaaacaattcgagagggtgaatatgaaagaggaactgcctcaccaggcttcccccaccctggcgtctggagtcctccctgccttcgtggcacctgatttcagagataaagaatttcaaggatatgctagagcagggaggatgtaaaagggaaagacaactgcagttagctcaaaaccagactgtgtgaaacagccctgctgctttgtcctttctcccatcccccactcactcactgatgccttccatcacccggagattacagggaaggctggttattgacagctgggcagtttgcacaataaagtttaacggtttacatctctttgtacaactttgtcaatgttttccatggatcaccttctcaggtgagcccactgactcctctccttcttctctttcccttcaagcgtgcaaacgcaaagagcaagaaccaaacaaagacaggaacaattcccagaagaagtcccgcctggtgttcactgacctccaacgccgaacactcttcgccatcttcaaggagaacaaacgcccgtcaaaggagatgcagatcaccatttcccagcagctgggcctggagctcacaaccgtcagcaacttcttcatgaacgcccggcgccgcagcctggagaagtggcaagacgatctgagcacagggggctcctcgtccacctccagcacgtgtaccaaagcatgatggaaggactctcacttgggcacaagtcacctccaaatgaggacaacagataccaaaagaaaacaaaggaaaaagacaccggattcctagctggggcccttcactggtgatttgaaagcacaattctcttgcaaagaaacttatattctagctgtaatcataggccaggtgttcttcttttgtttttaatggctatggagtccaagtgcaagctgaaaaattaatctcttagaaccagacactgttctctgagcatgctaagcatcccagaaacccaaatggggccttcctggagcgagttaattccagtatggtgtcaaccaagctcgggattgcttaaaatatcatccatcccacttcaggtcctgtcagcttcttgcagtcagagttcctatgagtaacaataggagtttggcctatgtaaggactctgagtttaggcttccaagatacaacaataagagaagaatctagcaacgagaatgacctcatttgctttccacatgcttagcctcattataccatgttatgtccaagttcacagccacaacatcagaatggtaattactgagcacaagttttaaatatggacgttaaaaaaaaaaatccaaggacctgtttttccaacccagacatcttttcattgaatgatttagaaagctttaagttgatccagcttacaattttttttttctttacctcctggaaatctcatatggtcttggatccgtcaaaaaaaccagtcagttcacttgcgctcaaagtatcaagcacaacaaagataaacagaagtgaggaaggttctgggttcactacatctggattttcaagacacctattgtgaagtcattagggaattgatgagaatatggcttcaagcacattttgcagtttgctacaaattctgttgtacataatgcagacgcacactcaggaggccaatttaactgttaacagtgcatggagcgaatgcagcattttaaaagatctaggtttttttaggtcattaatgtgtccttggttgatcagtcatctggtccctcctactgtgtgttatgaccaccacgtaatccattctcgctctttctgatttggggtttttcctcatccatcccattagtagggatgttttctgtgttttctagcaagaaaaaaaaatcaatcaatcaaacctgcatacatgttactcatgactgtcatctagtcctaaatctcttctgttgttgaatcatccttgcaaaacagctgaatacatctggagaaaacacagcacaccaaagaagcagaatactgcaaaccaaagacatttatgacttgtcattttctagcctaaaaatactgtgattacttttagaaatcagaaaacctctgcaactccgaatggcattcagctcttgcatttggcgcatcatcgggctgagcggaccagctacaccaaggacattagccaagccacccagaggggtggctttgccacaccagttgtcaccttcccatagcaagtggaagagcgcccacagaactctgggagattgcaaaggtcacaatgtgcatatttaccagtgaatggccccgggtggggccacgtgggggtgttcaaagcaagccaaacgctgcaatcattctttacagacacttgagactgacttttttatgaattacttagtcgaaaccaaagaaactttttctgcacctacttctgcaacaaacaaaactgtcccattaaaatgaataaataaatccgtaaatcaatggaaatcaccaccaataagaaggaagcacgccagaaaataaacgaaaacaaaaacagggagacacactgtgttcaaacagacctcttgggacattttttggaagcagattttaaagaaagggttgagacaaagatagaaataaggaagagcctcagtggctgctgcttcatttgacaactcacacggtaatcttaaagctgaagattgtctttaatttgtgcctatgcagtttttcaaaagaacacggaacagagcaacagaaacctcaacagctacaataccaaagatgaggatttctcacaccttttgtttcagttcattatctcctcttgcctggctaaaatactaatagcgccattgaactgtataaaggtaatcaattatgtttctctgagcaacaaaaggaaagggccatttatttgattttattgtttcatttcaattttgtcttatggttttttgccccaacatggaatctctcaaaagtttccatggactccaagtttaagatgttgggatattgaacagttctctctgctcagcagagggtagggaataacattatcacttgaatgttctttgcttaacccttagacttggttccttctatgttcagagtctcatcatcaggggaaggaaagggagtgagggtcagggataggggtcttggtgatgcatcctctcccgagccacagaaccaaagagtttatagaggaatttacagcctcgttttcatgtgattgctacatcctaacagggcttcatttgggggtggggggaaacatgtaaaaataattgccagtttctacttttctattagctttttaaaaatcagctgtaaagttgcatttctaaagaaagatatatataatatataaaatacatatatagatcaacttgacattggtgataaccaaaattattgctgtccaaattcatgtcttgttttggtccagtgcttcatttgctaagtattcggttcagaatttttctcatttctcatgccattccagagttaatttgccactgtggatgatttgaagtattcagatctctatggaagtttctgggacaggtttaaagtcaagatcaagcattttagcatttaacctgttgataaatggatccatggtgtacatgagttttatttgtattcggagtcatctctattctatccctcagcctcgattaaggtggtgagtgaagtgcatccaacagactcggcccagaactgggtcctgacagtggggtgctcatcttctgtaactgttgggaaggctcggtggtccattttcaccagttaaagaatatgaggccagcccagaaatctgttctccaggagctgccctgtcccatctgggtgtgccagaccccctcagtgagcaggtccaccaaagggacttctcacaggggaagcccaactcctgttgcaatgggttgatagatttcctcagggtggtaattaccaattcgtattttgacaagcctatgtgcaaccacagctggcactggggtgggcagtggtgttgggtgggatgggggagagtgtctcaatcctgaagagaaaatataaagcaggttttggggagacttctggagtcctgcccctagagagccccattgttgttctttgtgccccctcctcattccccctatgtgggtctccctatgcaggagctgtgagagaatgtgactctccacaatttttataattcatccttcctaggagattgttcattggctcttcccttgtgtccctttgtcccttgctcatactccatgtttcctttgtcaaaggactaagaaaagagcatatttcagcagaggagtgttcccatgtgggttgatttcaacttgggtatttctaaaagagtccttgtgacatgtgtccagtggaaatggttgctcttttccagactggattgaggaatggagcctgtttgatttggttagtgattctttgacatactaatctcagcgtttgggtctccagcatcctctgaagatgtctagactagtagaggctgcctttgtgacctgacattacaacattggtcaaaccagtcctctgataatcagaagaacatgtcataattgtttaaaaaaaaaaaaaaggcaagaatttctctccaaggagctttaataaatgtctcattccagataatgtcataccagagaaaagtgcttgcttttagaaaattatttacatacatatataaatatatatgtgtatctatacagttatgtatcaaaattttaagccctgcagaatttcaatttgttagaaatctaacagaaaaaaatttctatattgaaaggtaatagaatttaacccagtgagtttactcaaggatttttaaatttaagttaataatttcagagaaaataaccatttgggtgtggttatagtttagtatccattacctcaatccaaggaaaattccaggcattcctcaaccatcaggaaaaggtacagtgtgaaggaacagttctcagccaaatttcacattcttgaggcaacagaaatcaaaacactcagagccattgagtggaaaaacaatttactttattcctttacacaaataggcttgcattgtttttgttttaatgtgattttggtactagggatataattatttcattccaggaaataataaaaaaaaacagacagagccaatacatttctttttttaaaggaaacagcaacaacaataaaaactcagcaccaatatttaaaagcttttccaaaatgtaaaagaagtgtttagcttgcaccatgcataaaggtgcaggctagttgaaccaggaagcatggcacttcctctggagaaatccagaaagagttgcttctaagctcccttttccccctgcaggctcttggcaattgtaggctttagcaaatccagaataattttcaattcaagctaaaataaaatcaacatttggaatgtaaatctgatacacacacacttttctaagtcaaacaacatatttcaaaaccaaaaataaataccttttagataatcagttattttctttgtctatactgggcacccacctactagtgccagtaaattcaagttgaacagatttttaaaatcactattatctgggtatgggggaaacttccccacttttgaaaatgttggtagaattataggaatgtctgtttgattatcattaccaaagtgtcatgacagtatgcctttgtagtgaactcggattttcaggagtttgaatagttggatattttaaaatctaagaagaaaaggcctgtttccaatgttgttgaagaataatgaactctattaaaaagtggagaaaaagataatacatgtggtcaaggttgaccacaaggcccaggcacaactaccttggcgataatcttctagattcgtaacaggttagagctgactttttgtttttgttgttgctgatgctgtgtgattcagacttctcagcctaaccaggaagagtaagtggaaatggtagatgaagaaggggtagagctggtgtatctataactttctgatatttgtctgccaaacttgatatattagtaatttttttatctttagctaagatcaagtcacccctgaaacaacaggagattctagttttaaaataaggccacaaaaatccttacggaatgaagaatggcaccccagttggttgtataagtctcataagataatgatgttgattttaaatatggatgtctcaatgcctgttttctatcaatgatttgtttgtttccaaggtcggggagggaaagaggggagggtttatctgttttagaaagtctcagaatacttataaaatacagaagtagttattaaaatatataggacctcacataggtagatacagaacttaccattgaggctgatgggctgttgtgtgaatcacacaggaccttaaatgaggctcattattctcacacaccaaaatgactctgacagcctgaagcagttattgctagagcccaagctttccttggaggttttggagttaggttgattggaagtaaccagctaataccttttctagtggagaaaaagacattgctaccagcttgttcatcccatagaagtcttccactctgctccatttttagcagcaagcatttcatgtagcataaaccttggcagataagtgtgcctaaggtttatacagtctgtccgcttggatgtatacaaatttagatacatattttaacatgtgttctcatagatgactttataacaacacacattacctataggtgtctagactgtgtacatacaagtgtgtacagacaagcttcatacgtatatactgtaatccgttacaacaaataaattttaaatcatcgtttaacatgtatgtggtacttctacagtgtacattgttttcattatttattgtaacattgaaaaccacagtgcagggaaaacaaaagtatcccagcatcttcatcctgtacacttggaattaatttcatttgggcatatccaagataaactcaactttcaagaaatcttgtatattatttaatcatctgtgttaggatgacacctatgattgatgacttcggttgaatagctttattctggatttttcataactaaagctaaatccaaagacctgaaaaaggacaaaaagaaaaaaaaaaaaagaaaaaacaaagaaaaagaagaaaaaataataaagtcaagcgcaaactgatggggagacagtgggctctggtttccaggattgagacaatggtactgcggtcttggggagactgcgttagctagtggggagtggtgatttttttcatgcttgtcacatctaaatggtctttaacatgagaaagttttagaggttataatttcctgctttgtttttatttagactatcaaatgaagttatacatgttgtcagtcaaaaaatgaagacaccctctgccccaccccacagaatgctttttatcttgtctctttgggttatgacccaacaagctaagtaccattaatgtaattaacttatttaaattagttcctagtacataaatgtataggatttgggtaattatttaatcatccttccttagtttgattctactccttgtacttatttatcaaaacctagaccaatggtgcatcagagatgcaaaattctacttggaatactcttgaagtttagtttgctttataaagcagtgaaattctgttacagacagggaagaaatacaggttacaaaaagagaatttgggatattcttccctcttaaattaacttttaaaatagtctaagtaacaatttttaaattatttaacttaagttcgcagccccacctggtaccaggcgaacttcacctcttaattattgtggccctcggagccttcatattgtaacttatttatttaacttattcagcatctgtgaaaggtgcactgtatagtttatatttttaatttaaaacaacagagagcactgcagtttgtttgctgtcagaacaacagagcaaattttgtggacaagcaatgactattcagcctgaacctgtgcattcagaaaacataagctgagaccctgcttcaccagcctggatttcggggcttctatacagaaactggaaaaataaattttaaaaaaatcgtaaacaaaaagagagaaacccttacactagctgcttccaagaatgaactctgtgtgtatgtaaagcaacaaaacaaaaaaggaaaaaaacaaaaagcagaaaaaagaaaaaaaaaatgaaaaactttctatttctagtgagaaccaaagaaggctacctcactgactttttccatttgtaattttaatcgtgttgatgacaccaaagataccaaagatttctttctctgtgcggtctgcattttgcttgtgctcttttataatttgaacgattttctctgacatatggtatgtacagccacagctcagataccccaaagaaataattatctatgcgacggcggctgctaatttggaaagggatattttctgtgtttctcttatatgtttgctgtctgctcgacatgttcaagatgcgagttcagatgctgctgtaattggattccttaaattctgattacaaattgaggaaggaaactggttggaaatggccttcagtcctagccatggcctctatccccgctgggacctgtcacagtaaagactgccaattactgaaccacagaagctctgaccattgagtagttgagctggaagagaccttaggaatcatttagtccaagccccggtggcccagaggaatgaaatagttatccaaatcaaataactcttgagagtgaaagcccacacatgcctcctggttcctgccccagtgctccgcttattgtacagtgctacctctgcatgagagcggtcccacattgacaaataggatggtggcaatcctttagcaatgagcagggactggggtttatctcttaacattttcagctgtaaaattagtcacaagcattttcagtgtcccattagtacatagtcacatatggtcggttgcttcgtgaaggtggcctgtcttgaaatactagggctcatacgggatttttgccctaggaaaaacatgttgatcccaatgatgtgatcacttttgaacctttccattacaaagcattgtatagataactttttaattcagtaggaggagaaagttcattcttggcctgttggctttgattattatgggtactttaaagtcagtatttatcaagaaagggaacttgaccaccattggcacatgtgacatttaagctcttcagccttttcctttttagttgtaggtgtttacatttcatttctaagccaactctgtatttatgagagaagtttaagccttacatcatttgatactaaagggttatttgtggtaaatgaaaaatgaccccaaaattacagaggaatatgccagtttaagaaatggctacttaaagttgcttctctctttccttcttactcatgaaattaattggtcttcttcaagtttctttagattccattaaatgattaaatcactattaagagccattcatcaacgtgatttgtgtgttagccaatgaatctgtctcagcttttgaccaaatgggttttagacaaatgcaaagatctgcctctagtccatatggctctttttgagtgctagtattttgcatttcacataatgtagttattttgagcttttaaagagagcatttagacaaagaagcaaagagaggaagggaccaatcaactcatcagttccatgcatcaacaaagcatagctagtagaggaatataaatgacagattgacaaactgtaggaaacactgttactctctttctgaagttttcaagcaccatcctatgtgaaagttccctcctgtccaaacaagctcaaggcccatcttctccctatacaaggcaaacctgtaaggccttccttccaaagagtacattgctttggttttcttcctaaattcctattggaattagaactctcagaatccctgggagacagagcaaagatgacttaattcattgagcagcagagctccctataagtgaacatcaccttccccatctttcctactgccacacccatacgagagaggatctagaaagagcgatggcagcctgaacacagaaaacatccccacttggcagacctctcctcagcaatccccccagcctcatgcttcacttgcaaagtgtgacataaccacgggacgagtgccttgcttgaaccaaagcaacgatttagccagtctggacctctctgtgctttttttaattcttcctgtgaatacctcagcttcaactgggcctccatacagtcagttggtgggcttattgtactgtggtgctttgcaatgcaaccctgcaaagaacaagatttgtactaataccaaaggttctttctctatgtctcctcctctgcctccctcgttcttcccttttttctagttcttcacggttccaaagctttactatgaacctgggcatgttggcaatgcagaccgcgcaattccttaccgaattttctcagatatacctcatagacaatagtgtttagagtaatgttattatagcgtatgtaataaattattcactgtttcttttggtaactgtgatttaaaaaaagaaaaaagaaaaaaaagctttatacgttttaggttgtgcttttgtaatagatgaaaaaaggtgcgcttaaaaagaaaatgtatgtttttttccccctttggattttatttatgctggattggggaaagttgcagaatgagcccaaagtttacagtttcatattttgctgaagaaacaatctgtgttcatttgctctgttgaaaagaataattattttctacatttgtgccacttggtctgaacaattaattgttccgtgttaacagtgtagtattatgattagcaactgccaatcagtgctataattttatgcatgaggctaaaaatttagcagtgtgatgcattgtggtcttaatagcaacatttttcattttgaactagatcttcccctttggttcaatggactttatttatgcatgggcgcctattgtttgttagcagttgtggaacagttgtgtatacattaaactgtgaaaatgtacacagttcagcctcagacggtggtaatattggttttattgggagatgtgtcacctcgaaaataccctttacatctgttgggatctgaaaatgagtcacattgaattgggttccagctttataatgagaaacgttattcctaatttttgagttagccaatttgcattccacaaattgggatcctcataacccaaatatatcaccgtatgtgagagggatttgaaagcgagtattgaaaaactcacctttgcatatttaatttccaccaaaaggagttattttggctttatgctcatgaacttagacctaactggccatgtatatgtagatgcaaattcatctagctgtggccctctttgatctctgcttgggaatggctatttttgactatgcgtggtttcttctcgtattttgtgatcaggtcagctcccagtagaaactcaaatggcatcaatattactaactcttctctgcccacttctcttttgtccactctcctagacattcccaccaactgttccagtgatttgggcaaaaatacgcagccatttcccaaaacttcacatgtgcagctatcatggctgtccctccctagacttggaggtgactctcacttaatttttacctgcccaacaatgttccatctaccatctaaaaggtaatataagaagaagttttgaaacccactttaggaaaaccatcttctttaaatccttcaattatctgaggcctctatatgtcaaaactatttttcagttgcaggggattgggcaaacttgttctttcttatacttgggttcaaagacccattctccagtttcatatttcccaaaccaaaatgcttgacataaagccaaatcaactgccaagcacactttattttgcataggagtatgcagcctagggaaccttggttgaaaagcagcagtctgctatgcaaaatattggaaatcactgacagtgtagcattcatattatctgtcaatgagggtatattgggaacgtgctctcgtgaataataaaaagcaacatatttttatttggccttataaattaggttgtggtaatgtaaactttgatatatagtctttttatttttctcttattaatctgccaaagatgggaacagatacaagaatttttcaaattggcttttgtaagacaattgatgattgtaatagtgtttaatcttccagaaagctttatatgttgttccacaataaaattgatatttgtttcagcaaagttttcctgacactcacaaacccacaaactgttcctcttaatgcagatattgtagaatctacaaagttcaaatccatttttgatccaaagaaagtagaggagtatttgagacatgagtgtacccagccctttttttaatcacaggcaatgcatgggtctggctggttacactttgccaagaagacttgtcttatgaaacccaaggtatattttgttatgccattttatgtccttttcttttaacattgtggaaagtggtatgttgaatcaagtgtaagctgagttttccagacaactgaagtagctacatcatgaatgttattttgttattaaagggtttttactcagtgctttgtgccaatggatgtccttttccttggagacacataactacaaaattacctcagcttggcctggttttctctcctgccctcttggggaaacatgggcctggcctgggaaaaggcaggtcatgggctggaaggtaggttttggtactaggaagaaatctctgtatctgtcagctttaaagagaactgggccaaaaatctctaacctcactctctctggactccaacacttccctgcaatcctttggtcttgagcatgtgccagcatgaaggcagactccagttcatacatgaaaggcaagaaaaagaaaatagtaaccttgaatcttctgtgggccaccaggcactcacctttccccaccttgcacactatccagtcaaggctattgcagcccatctggtggctttacatgggacattaccaaaggcttcttcctccatcctggggttgcaaaggatccaggtcccctccatccagtggggctcttccacatcagaagtccccctcccaccatcctctgcatcctgtttagctatcccatctataccttttggagatgattatttagaaaacaaagaaaggtatggaatggggtttcctattgtttgctaggttatattttagcaattctcaattctttgatctggaaaaatacaagagggaaaaggagaccccactatctccctgtgctttgctcccatctcagggggcaggggcagtgcacattgcctatgctgttgatctgtcttgggcgacaggctgaatcacagctattgccccagccaaaaacatggcccatcaatgcctactttatctctgcttgaaaatcctattcaaaaagttgtagagtttgaggtttttatccccccatatcctttgctttggtccagtttggcctttagcataagagtcagctttatctctaggaaagttttttcagattatgacaaggaacctgccacctgggaagaaaagagtccgaagactagcaatcggataggtagtcataccattaacagatacttccttgaaggtagaatattatttcctttctttacagttttgtgttacacaagtccaagtggtgccagcaaacttcttaccgtgaaatgttgtaaaacacctggcatactgaaatttctgaaacaaaaacacaagctccacattgataacttgataaataaccactaaagtttagatgcagggactgagatgatacaggcaaaatcttggtgttggtttctcttttaattcgtatcttcgatcacctaacctttctcaatccaagagcagttcagtcttttctccccaagtctaggatgccaaagagcatcataggaaaagataattagggattgaccagcatttcaattagttctcttcttcatctttgcatttctcaaaagtgttctcctggaccagagggaaagagctggtccattttttttcattctttctattcaaatttttccacccagacaatactttattaacacagatactgtagatccttccttggtcagtgaattattacaagaggagctatccttccaccaaagtgagtgaaaacaagttccagtatcttttcttccatccagttttgttctcagaatccaagtcagtcctgggtcttttctcactttagaccctggcctcagatgtgtttattcttgctatttaaaaatacctttaaatttcacatgctggcctgcagaacttgcatcctttgttctatactgttgactgcttgatggtattgaaaggtgactataatgagggaagaaaggaggaggtaaagagagaagaatttgtcccagatctgtttaaagtttcaaaatttaaaaagggacccattaaattatgggaaaatggctatagagtgtgagcctccgttgaccatatgctcaaagaccgtactctgccacctgccttccaggtagctattctagaaactcagtcctttgtggaaacccaactaccttttaaaagtctctttccagattccaaaaggacaagagatcagagagtcacatatacgcctcttgttttattttcttgctttcacgggtattattgccaagaaaatcgtagggaaaaactttaaacttttcttttcagttgatccctttgacatcacctctcatgtttaaaatcaggaaaacacacccctaaaatttgcactctcttccgttttgaaaaagaaaacccacacacaaatgcacactattaccgtctttcaccctgcgctatatttccaaagtgtattataatccagatattgccccatctcaaacatgttaagtcagactgtgctgaaagactttccagggacggtcaacagggtatatgttcagtggctgccctgaaatcctggtggggatgaggatcacgcttcatcatcaaggggatgcccatcccctgataagctcccagtccttttggaagatttctttgaatgttaattgcattttcagttttgctcatttcccaccccaatgttttgtctgcaacatcgcttacactggattctttctatttttattcctatcattaaatggtagtgctgtaaattctgcaattaatgttaaataaactgctttaattcattg

SEQ ID NO: 125 - DNA, 17688 bp, Homo sapiens
actttcaattctagatcaggaactgaggacatatctaaattttctagttttatagaaggcttttatccacaagaatcaagatcttccctctctgagcaggtgtgtgtatgtgtgtatgtgtgtgtgtttattattcaagatatgagaaattatatttcaacctcaaaaaaataaaaatatttacactataaggtaattctaattgtttcttagatgcttgaatagaactcctgaggatacggaatgcttatcatttctgatgtatattctatcactgtatctgatgataggtaattaggatatacttattgaagaatcagaagttgtaatattactataagaagaagccttgtctctaagcaaaactagaaaaatgaatctttacatttaggatgagaagaattgagattcaatttaaattgtcaaatttttgagttttctgatgctgtagggggcacttacctttgatacacatctttacatgcaaggtgaaacaagttatatctgtgctttccaactatcataatcaaatatgaaatagcttttatttttgaaatctaagcactatgcttatttattaaatggttttttctggaagctctgctgtgcattgctaagatgttactatataaacatgtgagattagttttgttaatgatgatggtgatgataatttgttgatgatgatgatatgggcacgttggattaaaatgcactagaaaaggacattcaacaaaagtgcatataacttacctgagtttagcttgcagaaagaaaactaaattattgccagataaaataaacaactggaaacacttgatcttagctaaaaggccaagaagcaataaacgactataaacagaaaactgggtgtgttgttatctaatatcagtaaagtaaaatattggtattaaatatctcaatgtaggtgaattaataggttcattatattgttatgacattttgaagtaattggcgattattttacaaccaagagaaatgtataaaattaattttgcctggctttatgtgaattgtcatttctattcttttcttaaaggcatgcacaggggaaaagtttctgcattttacttttctattcaaaatattttatctcaccacgggaaagagaacaaaaaacaaatgcccagttttattttattcaggaatcctttgtgcattgaagactttagattcctctctgcggtagacgtgcacttataagtatttgatggggtggattcgtggtcggaggtctcgacacagctggggtatgtttttaccacataagtgtgtagttttgtttttatacaattttaagataccaagaatttcatacaagcatataaggcataggcaagcaatttactctgattcttttcatgttctatttatgttgatttcatgttatgttcatattgtattttaaatcaagtcttccaaaacttaaaaacttttttccctttattttattaactatattatggtaaagtcgctcacaacttgggacagcttgaaatagtgaaatagatgtggagtcagacttgaattttactcaaacttttaccgctctctagatttgaagggtcaatttgcaacctctgtgtagtttagtttagtttctttttctatcaaatacaggcatgaaacattccatatttatcttagatttgtgtaatattcaaatcaactgacatgtatgttaaagcactttttatcctaaaggtgtttataaatttataacttattcacagttggtaacattatattaaataagctttatgattttggccatctctagcattcaatttcttcatccataaagtgatacctactctctttactccatatgtaaaataactgagttaggtattacatgcgcaatcaatgtctaattttacctataaaatataattcatattatcatttaatttataaaaggcttttgtacaacaaacccccgtgacatgaatttacatatgtaacaaaccttcgcatgcacccctgaaccaaaaataaaagtttaaaaaaggcttttaagtaaatattaatcatcagtaaataattaatatttcaagagagcaaaatgattctttaggtattttgttcagaggcaagattatctgtctttgttctaaatcattagaccccactattttagcctatgtatgtccttcattataaagaaaattagatggctgggcacagtggctcatgcctataatcccagaaatttgggaggctgaggtgggtagatcacctgtggtcaggagttcgagaccagcctggccaatatggtgaaaccccgtctgtactaaaaatacaaaaattagccaggtatggtggcacaagcctgtaatcccagctactcaagaggctgaggcaggagaaccgcttgaacccaggaggcggcggttgcagtgagccaatatcacgccattgcactccatctcaaaaaaaaaaaaagaaaagaagaaaattagacacactgctatttactaaaagcttactaaatgattgatgttattgatgctaagttcattatatttttattttatttttaaaatacccatactggattgtgacagtatccttttcttttttatttctttcgtcttttgcaaattaggaaaactgggatgcaaaagctaggttatttgtgaagttatcaagtttgtatatgtggatctgtgatttaaatacatgtctttctccctacatctgccttttcactaaccaagtccctttctggtaatgttaggtttcattatacattacgaattaactaattttaatagtatataggattttgctaagggtactttccatggcataaatatagttttatttatatagtaaagtgtaaacataataatgtagtactataaaacaaaagtaagttcatgttgtactttaaaaaggatagtcaggggaagtacatagatggaaatggcaagctgaatttttaaaatttatgccccaaatggcagaaaggccatgactcatataagcctgaattctttttctctagagatgagtgaatttcataattataacttggatctgaagaagagtgatttttcaacacgatggcaaaagcaaagatgtccagtagtcaaaagcaaatgtagagaaaatggtaagtcctatgttccatttgtctactctcagtatattgaaatgaatcttggaaactatgtgattaaatgaatggcaatcattcagttgactttatcttcatgaggaaagcaggaataacatgaactctcatataatattaaaatatataataaaattatggtattaaaagctattgagtttagaatattgtcacgccctaaaaaatgatgagtttattatcatgataatataatcgaggcaggagtttctaagagatcactgaaaagaaaactaaatagaaatgaaaaagagaagagaaaagatattttaaaaaccctccagagatatgttcctaaacattatagaagtggtagcttgattattatttatagaattgtttctgagttcagtgaagaagatatattctccaatgacttttttcaaagcagaatattattggtaatagacctttatatagtttgtatgaaaaggaaaacaacagatgaccctcacttatcaatttttattaaaaactaagaaacaaattattaacaaatagcatctctttacaagaattaatttaaggaatgcaaagtgctatatgtaaaaatccctttttggactaaaatattcaattgttaccaaaatttaaaacacacatgccctttccctcaacaattatcattgtgggaatttatcccagagagagactcaaaaatatgcacagatgggtatgaaatgtatcattatttctcatagcaagacctaagaaacaatttaaatatccactggaaaaaaaaattgacagtccgtcaaaaattagatctgtccagagttgtcagtgaaatacaatgcagctatttataaatttggtatccttatacgccatgaggactaatcaccaggatattgtcttaggtaaaaaaaaaaaaaaaattcataggatattttgtgtattatagtttctttaaaatgtatttttaatatgtagttaaggggaacggtaatttttgtttatttttagttggcatgtaataattatacatatttatgggatacagtgatatttccattcaactatacaatgtctaatgaccaaatcaaggtaattagcacacccatcacctcaacatttatcacttctttgtgttgggaacattcaaaaccttctcttctagctatctgaaaatatacaataaattactcttaacagtactctccctacagtgctatagaacactagaaaaatcccgcatgtagctgtaattttgtattcattaaccaacctctcccaatcttctcctcccccctattctttctagccttaaataaccacaattctactctctacttctgtgagctaaaagtttgtatctcctacatatgagtgagaacatgtggtatttatctttccatgcctgatttactctacgtaacattatgtacttctgactcatccatgttggtgcaaataataggatttcattcttttcattcttttttttatgactgaatggtattcctctgtgtgtgtgtgtgtgtgtgtgtgtgtgtctgtgtgtgcttagctatttatctgttaatggacacaggttaattccatatcttggctattgtgaataatgctgcaataaacatgggggtgcagacgttacttcaatatactgatttcctttccattggagaaagacccagattgctgagtcatatggtagttatatttttagttttttaagggacctccatactgtttccataatggctatactaatttacattcccaccaaaattgtataaacattagcctttccctgcatcctcactgtcatttgttattttttgtctttttaaataatagctattctaactagggtgagatgatattcattgtggttttgattttcatcttcttgatgatgaatgatgttgaatttcaaaaaatatatctgtggctatttgtatatcttctcagaaatatctattcagatcctttgctcattttcaaatcagtttttgttgttgctgttgagttgtttgaattccttgtatattctggatattggtctcttgttagaggaatagtttgcgagtattttctcttattctacaagttgtctcttcactctgtcaattgtttcctatgcagtagagaagtgtgttagtttgatacaatctcatttgtttctttttgcttttgttgcctgtacttttgaattcttacccataaaatctttgcctagactaatgtcctgtggtgtttctcttatctcttctagtagtgttatagattcagttcttatatttaagtcattaatccattttgagttgatttttgtatatggtgtgagatgagggtctaatttcattcctctatgtggatatccagttttttcagcttcatttattgaagaggctctcctttcccagtgtatgttattggtgactttctggaaaaatcagttggctataatacatggatttattcctgggttgtctattctgttttattggtctaggtgtctatttttatatcaatgccatactgttttggttgttgtagttttgtcgtatatattgaagtcaggtaacgtgatgccaccagttttcttcatttttgttcaagattgctttggctattcagtcttttgtggtaccatataaattttaagatatttttctatttctgtagagaatgttactggtatcgtgttaggaattgcactgaatctgtagattgctttgagtcatatgattactttaacaatattctttctgtctatgaacatgagatgtctttccatttttttgcatcctctttggtttcattcatcagtattttacagttttcattgtagaggtctttcacttgtgtgattaaatttattccagggtattttattatttgtaggtattacaaatggaattgacttcttgatttctttttcatccagtttgttattggtgtatagaaacactactgatttttgtatgcagatttttgatcctgaaactttactgaatttgtttatttgttcaaaggcatgttgtttaattttcatgtatctgtgcagtttccaaagttcctcgttatcaatttctagttttattccattgttgtcagaaaatttacttgatataatattgacttttggaaatgttttgagacttatcacctagcatatggtctgtcctgatgaatgttccatgtgctgataagaagaatgtgtattttgcagcagttggatgaaatgttctgtacatttagttaggttcattaggtctatattatagttttactctgatgtttcttttatgattttctgcctgaatgatctgtccattgcttaaaatgtgttgttgaactcccctgcccttattgtattcatctatttctcccttcagatctattaatatttacttaatatatctgagtgctgtaatattgggtgcatatgtatacttataaatactatattatattgctgaagtgacccatttgtcattatataatggtcttctttgactcttttttactctttttgacttaaagtctattttatctaagtatagctgtgcctgctctttactggttttcattttcatggaatatctgttttcatccctatacagtcagtctatgtgtgtttttatgagcaaagtgggtttcttgtaggcaatatattgtttggttttttttgtttttaatccattcagtcactctatgtcttttacttggagaatttagcccccttgcatttaatattattattggtatgtaagaacttactattgccattttgttccttgttttctagtggttttgtaagtcttcctttcttcctgtcttcctttgtgattaagttgctttctctggcagtgtattttaattccttgattttcattttagtgtatctattataggtttttgttttgtggttactgtgagacttacaaggacatcttatagcttatagcaattattttatactgatgacagcttaactttgatcacaaagcaaagaaaaacaaaacaacaaaagaaaaaactaaacaactctacactttaactccatctcctctcacatgttgacttatgtttgtatggatttacatcattttatattgactatctcttaataaattgtaattactattattttgatagagttgtcttttggtcttcataagatctgagtggttgaggcaccacaattacagtattagaatattctgaatttgtctgtgtacttacttttatcagtgagttttatacattcaaatgttttcttattgcacatttgtgttcttttttttctgactgaaaaaactctctttagcatatcatgtaagacaggtctggtggtaataaattcactcaacttctgtttgcctgagaaatactttttctctccatcatgtcgatagttttgctgggtacggtatctcagttggcattttgttttccttgggtctttgaatatgtcaccccacttcctcttggcctataaagtttctgctaagaagtctgctaacagatgtgttgaagcttctttatatttattttgctttttaaattttgcttcctttaaaattctcactttgtctggagctttgaacatttaaattttatatgtcttgtggtgatctcatttgggttgaatctgcttgctaatctttgaccttccggtatttggttattcatatctttctctgggtttggaaagttttctgtttgtccacagcctcccagaccagtgctgtgccagggcttgcccaagggccatggttgctatggcctgcaaccactgaaattttcttgggaccaaggccactttagtcagctggtgataaagtgggctgagactaaggttcttcctgcctaagcagtggattcacctctggcccacggtgggtcaaaatgctccccatatgagcactggtttggaatcaagggccatggggtctctgtcttttgctgtgttccaatgtggtggggccaggtctaagttccgacacaaagtcccacactcttatttccatttcccaagcaggcagtttttctctaagcactgcactatctgggtttggaagagaggcgtttaggcaaggcaagaccatcttttcttacctctttaatgtgttttttctcgttatcatgctaaaatcagggtactgtgatagcgcacctaatttcttgaattcttttgaaggtattttcttgcatggataattatttaatttgatgtttctgtgagaagataatcactaaagggttcttcacagccagcttgctcttctgccattttcttaattgttttctgatatacctgttgttttgcctacccattgatttttttctcctctatcattatttatctttgtggtttggtggttctctgtagccataatgtttgattcctttctctttcttatttgtgtatctgctctaccaaccagttttatacttttgtgtatttttatgatgatagatattgtccttttgcttccagatataggactcccttaagcatctcttgtggggctagtctagtggtgatgaattccctcagtttttgcttgtctggaagagtatttctcctttatttctaaaggatagtttcgcttaatacagtattcttgtttgggaggaggtattttttttttttggcattttgaatatatcatcccatgcttttctggcctgctgctggagaaagtgggattgctggcagtggtggcactgggctccaagtgagtggctctgggaatctgggggggcgcatgcatgactctctctatgctgaggacagactctgtgcttggctgcatctcctgttccctgggcatagggctctgtataggcttgatgcaagggtcatgactacacctttggttgggatcacctggtgtggctatgctacagtcctctaggtggatttggtggaatgtcagcagggccccagggatgtgaagatgcataagctattgggccccaaacatgcgaagataaaggaactattaggccccagggcagagcgtactttggtggtggctacactctcaaaatggtgcagtgctgctgcagcctgtgttccagagaagaggagggaccccagtgtgaattcccactctggaataatgcagttatgtggatgtcagtgaactccctatactggactcagggatcgtgaggaatgtggagctctcctatacctaggatagcaggtatttataatgggaatgtggactgctggggagctcctgtttaccttttctcctcagtggagagtccctcttggctccaagctgatccatgtcacctgcttctcttccctttctatgctatcgccctgagcatctgtgcctcagagagacttggtcactttcttgctgaattccagccttctcccttcaacactctattcaatgtgtggttatctacttgttgttttggtcctttgtggaagtgagtgctgggtgcctgtagttagccatcttgatgatgcttcctccttctttatgtttattattgtatctgcataaaaataataaatcacggccgggtgcggtggctcacgcctgtaatcccagcactttgggaggccgaggcgggcggatcacgaggtcaggagatcgagaccgtcctggctaacacggtgaaaccctatctctactaaaaatacagaacattagctgggagtggtggcgggcacctgtagtcccagctactcgggagggtgaggcaggagaatggcgtgaacccaggaggtggagcttgcagtgagccgagatcgcgccactgcactccagcctgggcgacagagcgagactccgtctcaaaaaaaaaaaaaaaaaaaaaaaacaataacaacaaaaaatcataagcataatttactctagggatgactggggaacttgtagagaagtatagaaggaaatattacattgttgtactctagtttttgatcatttgcgaggtatttatgttctgttctggaaaaaattattaaggcagaaaaaggatcaataccaccttctcatttaaaaaactctaatatttatattaaatacaaagatacccaaaccttttatgcttctttctctgatctgtgtcttttttctttgacagcatctccattttttttctgctgcttcatcgctgtagccatgggaatccgtttcattattatggtaacaatatggagtgctgtattcctaaactgtaagtgacaacagagaagtagattgcaacattgtcaatttaacaatgctaatgtattatttttgttagtattcataaacacagacacataaactagaaatattaaatgtatctttgtcacatttttgctattagtccagaaatttgtaaactatatttgcttatactataagttactaacaatacaaacttttaatacttatggttattttaatagcattattcaaccaagaagttcaaattcccttgaccggtaagtgaatttttaaaatattttagatcatatattatatgtatctacctacattattgtgtagacatgtattccatgattaaaaaaggaaaaagtaattaattctagtctgtaatacactatggcttctgttttccttttaacaatgagggaatacttgtaaaaagtagaggctacttaggtttgacatcatctttctctctctctctctcttttttttttttttttttttgagatggggtctcactctgtcacccaggctggagtgcagtggggtgatctcagcacaatgcaaccttcgcctcccagtttcaagcaattctcatgcctcagcctcccaagtacctgggactgcaacctctacctcctaggttcaagcaattctcctgcctcagcttccaagtagctgggactgcaggcgtgagccaccacacccggctaatttttgtatttttagtagaggcagggtttcaccatgttggccaggctggtatcaaacttctaacctcaagtgagtcacctgccttggcctcccaaagtgctaggattacaggcatgagacaccacacccagcctggcttctctctatgaatatgtagagatatgcctttggttatgactgtaataatttaataatctgaaattttagagttggagtgaaaaaggcatttaatttgtctagacaaaatctgctataatggttcagatgtgtagaattaataatatattctccttttccagaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccaggttgagtatttattttaatttcccatcctgtatttaatcctaacatctgagacaactcactggaatatgaacctagaacatataagggacactgtgacttggttattctaataccaaccctaaatctttcttcattgaaaataacaaagcacagaaattgtaggtatcatgtatgtgtgctcggatgagaattatgccagttagtggacagaatgcatttttttacaagtgtgagaacagatgaaatggttatggtcttgcgtttactaaaattatcaacactgattttacttatagtttatttgtggtttcaaacaggatttacttaaactggtgaagtcatatcattggatgggactagtacacattccaacaaatggatcttggcagtgggaagatggctccattctctcacccaacctgtaagtctctgacccaatgagtctcttctttttaatttttttcctaagttttccctgtaataattctaatcactcatctcacataatcccaggacatttgcacattctaatagatttagtaaaaagtgcttaggccctaaatttgggagaaagttgtattagttgtagagcagccaacacaaatactagtaagtaatacaaattgtttactatatggtaagtactgtggaaggcaggtctaatatgttcgttttacagataaagagacagaaacagagaggttaaatattacatacatttctttttgaatttattaccagacatgttgagatataattaacatataataaattgcacatatataaagtatacaatttgataagtctcgagaactatatgagcccatgaaaacataaagaacatcaagatagttaacatataaattacctggaaaacattctctaagcatgcacctttgtgatttctcctctgtgtccctatgtccttacctctttctctttccagtcaatcagttttctgtcactttagattagtttgcaattcatagaatttaatataaatgaagtcctacaatatatatcatttgcaatgtcttattttcacttagaaaagttatcttgagattcagccatctcattgcatgagtaaagagttaatttccttttatctcttcatttattgatgtatatttaggtaattcccagttattgatcattacaaataatgctacttgctaataatatttgtgtacaagtatttgtatcatattaacgaaatctttctttcccttaacataaacacctagaaacaaaatggctgaatcatataagtatatacttaactttttttaaagtgccacactgttatccaaagtggtgatgatattttacaaattttactttctacctagcagtatgtaagagaaaatctgacagagaagttgcttcacatcctagtcaacacttgttttgatcagcctcttaaattttatactggctgggtgcagtggtttatgcctataatcccagcactttgggaggccgaggcaggcagatcacttgaggtcatgagttcaagaccaacctggccaatgcagtgaaaccctgtctctactaaaaatacaaaaattagctggacggggtggcaggtgtctgtaatcccagctactcgggaggctgaggcaggggaatggcttgaacccgggagacggaggttgcagtgagccgagattgcgccgctgcactccagcctgagtgacagagcaagaccctgtctcataaataaataaataaataaataagtaaatttcagacacactaaatgatgtgttttggtatatgaatgtagttttaacttgcattttactaatgcaatgatgttaagtagcatttttttgtgtgtgcttatttgccatttaggtaaaaattttcttctcactgatttctgctttgatctttattatttactgtcttcttatagtaggttaaatttgcttttttagtttcttatattgaaagctgatatgttgatttgaaacctttttttctaataaaagttatactattaatatgtgagatgatttggcaacatcccgtcatattttgagatactactttttgtttccattcagttaaaaatagtttctaaattgtcttttgcattctttgattcattgattatttacatgtgtcatttagttttcaacatttgtgaatttttcagacatttttattattgatttctaatttaatttcattttcattagcgaattattttgtataatttaaaacttaaatttattgacatcagtgttatggactagactatagtgtgtttttaaaaatgttttaggtgtatttgatcagaaatgtttattctgctgttttctatgtattctatgtgataacctttgaaatacaaagttttgtaatatggctggtagaaacaggcaaaatactagaccctatgttagcactaagtattgtttaccctaaatcttttcagacagttctttctccatcctggagtagttttttacatacatgcattagtaagtactctgctgaatattcaaaggtgaccttctgcatatctttacatttctttatttcttcaaatctcttatctccatttctgtgtccggtgaactacagcttggtctttctggattctgaagtgtcccatgtctgtagtttttatagcctgctcttttacccacttgattgcacagagcaattcagcacacccagactaagtgacaacatcttaatgttcactgatcttatgaatatagttgtaattctccagattaatgctagagtattcaagaaaggtcatttctaccatttgaaagatctgacctgtcactacactgttcagtaatttcttcattcagctacaacgatcaggaatgaaacctaagcattttgtcactactgcttttccttttttcagtctcataatatcacaaatattgcagaagtcctctagattgtaaatattataattctttatttcaaggggactttagatatttgaatttccaattcttcaatgtaataaaaagtcacaacaatatcaatgttaaaattaggttaattaggtgcttcctgtctgtcagacacagatttaagcacttaaatgtatcctttcattaaatatacttaacaatcctgtatacaggtgttattttaacctaattctaatggtatacaacagaatcttaacatgttaaataactcacttaagttacaaaatgaataattgttgcaatgaggactcaaatatatatatttctggctctggagccagacttactattaaatgactaaaaaagtgctcttttcgctgatttttaaatttactttgctactttaatgattaattggcaatgatcaatgcacaaccttttactctcatgtgttattttcaattttccccttgtgtttattgtagcaagaactccctaccttccttccttattatctatttgtaatttggaagccccagtataccttagaattgatccaggatggcctcatttatgtatggcttgagagtttttttaacagaaaaaacattgattctctaaaaaataagagtttatatcatagtttctcaatattttcctatctacaaggacaaaattttttttcagaagcaaaacaactagcatactaactttctgtttatgcatgtagtaaatattggttgattactgcacaatttccaggaattatgcagagataactacagagatgagtagaataaaactcattttagagcttcaaactctagtcagagatgtagttacaaacaaataatccagtgtagttagttaggtactctggcagaagtgtaatgaaagtagtatgaaaaaacagagaaagaaatcgaaggaacacatggacaaagtgatattaaaaagaatgaggccgggtgcagtggctcacgcctgtgatcccagcactttgggaggacctgaggtcaggagttcaagtccagcttggccaacatggtgaaagctcatctttactaaaaatacaaaaattagccagatgtggtggcaagtgcctgtaaccccagctactcctgaggctgaggggcagcagaattgcttgaacccaggaggtggaggttgcagtgagccgagattgcgccactgcactccagcctggctgacaagagcaaaacactgtcaaaaaaaaaaaaaagagagagaggaaagaaagaaaaaaagaacgagactctaatgtagactgaacctagtaagagcagttattaaaaaatctcagctggggccgggtgcagtggctcacacctgtaatcccagcactttgggaggccgaggtgggtgtattgctttaggtcaggagtttataaccagcctggcaacgtagtgaaacaccatctctactaaaaataaaaaaattagccggatgtggtggcacatgcctgtaatcccagctacttacgaaactgacacaggagaatcacttgaacttgggaggcagagtttgcagtgagccgagattgaaccagtgcactccagccttggcagcggagcaagattctgtctaaaaacaaacaaacaacaaaacaaaaactctttaagaatagttttctccctacagtggccgattgttcagttacagaacagagatcattacatcgtctttttaaatagggatagcatcagaccataatctttttatttttttgtcaattttacattgaagtgacatcctcactctttcttgagctttctatttcccatctcttatgaaagaaaacaaagtatcattattaatcatataactccaaaagattaaagatgccagagtaaaacacatatatagatatagaaatctccacatggaatgcctaaacatatgcacacacacacacacacacacttatacacacttgtgaatgtgtgtatgtatgtattagatttgaaattttattttcatttccttaccaagtaaaattgcatatatctgaagaaaatgttttatttttccacaaaacacagtatcaaattctaaattgaacactgaatttatttctcacttaaatatttgttttaaaataaacattctaaagttttcatttaacttgggtatacatatgaagagattttagacttcagaattggctagtttctgatgtatgataaaaagagtggcgcattatttataatttttatttttattatctgagttggctatattttgtttatgaattaggaccaggcatggtccataatctcctaaaatggtattaagttcctgtatttgaagttcaataggtatgattcatttttattttcccgcgttaataaaatcatgtatgtaatttgtaattgtctctcctctagactaacaataattgaaatgcagaagggagactgtgcactctatgcctcgagctttaaaggctatatagaaaactgttcaactccaaatacgtacatctgcatgcaaaggactgtgtaaagatgatcaaccatctcaataaaagccaggaacagagaagagattacaccagcggtaacactgccaactgagactaaaggaaacaaacaaaaacaggacaaaatgaccaaagactgtcagatttcttagactccacaggaccaaaccatagaacaatttcactgcaaacatgcatgattctccaagacaaaagaagagagatcctaaaggcaattcagatatccccaaggctgcctctcccaccacaagcccagagtggatgggctgggggaggggtgctgttttaatttctaaaggtaggaccaacacccaggggatcagtgaaggaagagaaggccagcagatcactgagagtgcaaccccaccctccacaggaaattgcctcatgggcagggccacagcagagagacacagcatgggcagtgccttccctgcctgtgggggtcatgctgccacttttaatgggtcctccacccaacggggtcagggaggtggtgctgccccagtgggccatgattatcttaaaggcattattctccagccttaagtaagatcttaggacgtttcctttgctatgatttgtacttgcttgagtcccatgactgtttctcttcctctctttcttccttttggaatagtaatatccatcctatgtttgtcccactattgtattttggaagcacataacttgtttggtttcacaggttcacagttaagaaggaattttgcctctgaataaatagaatcttgagtctcatgc

SEQ ID NO: 126 - DNA, 277915 bp, Homo sapiens
gcggcacagctgctcggcgcctgcagctccggctcgggggctggaaccgaagcgggggcggcgggagcgcggagaccacagcccccggggagaggcggagggggtccctggcctgggcggagaggctgagctgagtgcgcgtgagaaagagggctgcaccgctgctcggcgcggactctgccagccccagcttcagccccggctcaggtcgccgcagcccgggagcctccccgcttgcgccccaaggcacgcgcggcacagccatgaacaccaacgatgccaaggagtatctggcccggagggaaatccctcagctttttgaggtagggctagagctggccgacgggcggtagcatccggggactgcatctcaggggttcgggttgaggcagccgcgccccgtcccaccttccccacacggggcatgtaatgaaggggcttgtagaagcgcactcgcccgctcccccgagggtagtcgcctttcccgcgggttgccagggtccttgtcagaaggctgggcttagaagcctgcatctcacagatcaagtttcagtcttccagcagggttctgaaagcagcctgctcccatcgcgcccctcggatgtggacacccagggtgggctgcagaccgcggccgggccgcactctctgggggcgagggccaggtcaggtggctgcactgtcgcccagcagcgagtaaagactcgaaactgagggagccagagccctagtcactctgctggtcgagggtcggaacccctgggggaaagaggaaatgtggacgaaggcagcccttcctggagacagcttggaagagagggatgaagatgcaaaaagcaaaacccaacctatcaagtgccacctccccggtgacaggcccccagccttgctctgcgctttcgctgaatgaactcctgagcacgtttttcccgttgcctaggaagggttgggccgcaggtttcgccagtgctcgacaacccacctggagatagcgggtcggggagggagctgcgaggggggcggactcctgttgctcagtcttcagaccgcagcacagcatcatctgcaccgggacccgggaatggggggacacttggagactgagagagaggaggctcgaggaatgaaccttggtctgttctaagccacaacccctgtctcaggtcgtttggcttcctttccttctctttgtatttgaatttaaaaacattcctgaatctcaagtgcttttgcttgaagtaggggggaggaggagaaaagaatagaagcaagccaggcttcctaagcgagctctgaaaggagaaatccattcactgcaaacctcgttccccatttctgaaaacggatagactgatatcgtaaactaaaggtcatgagggtttttccccccggtttgggggatttgttctgttaaaaggaattttaaagcaccacttgagaaaataattttgcctcagtttccctaaactatctttaaaatgggttgccataattacaggtcttcttttctctcacctctataagccaccgttttcaggtcatctgaagtcaagatttccaggtaaaccactcactgaactcaagcgtggtatgtgaagcccaaatctagcaaatgtgttactcctgcgtgaaaataattaggtggtgttgcataaggacaggtcttgagaatatgtgggaatcttaagagttgttttttttgtttgtttttattttcaaaaagtaaatatggaaattaagaggcgaaggtttttctcacaaagattactactgagatatatttcatttctacgcttctaaaagaatcattaaaaacatctgtaggaggaccacgtgattgcaaaaattcctacatagtacatctttttttctttgtaaatgtgggtactgtttttcctccttggtggaaggtaaccacagagaagtttgatagtttattaaaatctacactgtgcatgcaaataagttatggcaggcctttttgttaaggttttatgtttcttatttacttttctgcatatgaatgggataaataatgcacacccagaaaaggaagtcaacttgcttgggtgaaatacagtaatggacttagattcacttgtggacaatgagaagatggaagtagactgctggtgacctcaaaggctacatccttcagtaagacgaatctgtgctatgcgcagctcaagagggaaggaaaatctggcagttctccatgtgattagtgtagactgtaaaactaaaaactttaggtttttaaaatggattttgcccaccacaatattttaggtgtacaaagtttaacaattagctgtctactaaacaccaagacattggccccagctgtggattttagacgctattacagacaaactgactgattattgtattgacgtattgtcagacaagtaaatatatctaactgaccttttcagattttttcctaatttgagacatcatgtaagctaaatggaatatgggatatctctggtacgttcatgtttgaaatgtgtttccagttttagacttttttaaacccactttcttattattttgtcatgagttcttaattctggctaaccttatggtgtgtatattgatcttgtagcttacagcagagatttggcaatcaatttgaatactgtggaaagtcagattattcaaggtctcaaagggttcactcagagactgagcaataatatgtgctggttgtcttcaatccctgatagtggctggctattagaagaaaagatttgaattatccgtgaaggaatggagctcattgtcccattttaaaatcaatgccctttggtgaaccagtattgtttaaggacgctggaaatgtatattttcagaaaagagtcattgagagtgttcacccatttcaggcaatagtagggataaaaagagggcattttgcagagggcacagagaatctcatgttttcttttatctcatatcacgtttctgcaacaggtacagagaagaacatatgggttttggaattggaaacattgaattgaaatcctgggcctaggagtttctagttgagtaaactagagccatcactaatatctctgagccatgatttcctaatctataaaatggggataataaagtcacacagggctgagaatgcactgggtatgcaaataaatatatgacacagaggcttttatttattaatgaggctaatactggcttggcgtatgggaagaatgtgagaagctcaactgcaatgtgtgtgtatatgggacagattttgacaaacaaactgaattggatgcccgggtaattttttctgctccctctgcaattgaacttggctgatggaggtgcacactctagcttactctatttaggatttcagaaaacaaatgtacctagtgagaattgcctaccattctgaggaaattacacaggaaataattgaaaataaaatactgtatttaaacagatgtcagcccttcaaagggtgttttgtatactaacaatgtatattggtaagaataatcctttatgcattttccatgaaatactctaaaggaaaatattttgcacatcagtccagcttccaggaatcagcatttccaaactggtagcatttttagaatctagtgccagtgacacatcagacaccatgaaccaaaaaagtaatagcaggatcatgctttgtttcttttcccctctggaatctcagtggatatcgtagtgacttactctatgtcaaatagtaatttttttttttagtctcagacctaaatttttttgagtctcagttagacttgagctttgagggattttttttttccaattggaaaacagttaaatatgcacctaccaaatgccagggaaagcatcagtatctggggattgaaaaatgaattagactcactctgtgttgttgaagagcttatagtttagaagaaagactattgcataaccgaatggtttcagtataaatgacaagtatgatgttttatgctggataccatgggaacacagaagaaggggttcacagacaaacctagggattcagagaagacttcctgatagtaataataactaaaaccaacaaagtttattgggcacttactatgtgccaagcatttaatatgcactgtacaaatatgaaattatttaattcttaaaaaactctatgaggtatttattattacccccattttctaaaagaagaaactgaggtttagagacataaagggtgggtaggagtgagataaataatgaccaggggcattttcacatgctgcattttatctcactgtgatgaagtgaatggctcttccattttaaactatctagttgcctgaattgcttaagaggcagagaatgctgaactgaaaactaattaggcaagaatttaagggattatcttaatgactccatcagatcgtaatttcaactctaattgtttattaaaagacaaatgcaaaggacaaaaacaatcagaattcaaagatgagccataatactattttaacaaaggtgggtggggtcacgtgcagtggctcatgcctgtaatcccaacactttggaaggcggaggtaggtggatcgcttgagttaaggagttcgaaaccaacctggccaacatggtgaaaccctgtctctactaaaaatacaaaaagtagctgggcataatggtgtgcacctgtaatcccagctactcgggaggctgaggcaggagaatcacttgaaccaaggaggtagaagttgcagtgagccaagattgtgccactgcactccagcctgggcagcagagtgagactctatttcaaaaaaattaattaattaaattaaattaaattaaagaaaaaacaaaggtgggtttaaaagatattttatttgtacatattttgttatatttcagagccttttgaatggactgatgtgttctaagcccgaagatccagtagaatacttggaaagttgtttacaaaaagtaaaggaactgggtggctgtgacaaggtgaaatgggatacatttgtaagccaggaaaagaagaccttacctccactaaatggaggacagtcacggagatcctttctaagaaatggtaatgtatatggagaataatagacagttttatagttatagcaattctctttaaaacatgccatatagactatacacagtgatttcattttttgagtttataaatgcctgaagtcattggatcacgattaatttttctctgctactaattctaatcacttccataaaaagacaaacaaaattatctaccattgtccaacaattcactagaggcttaatgaaattttttattactgactttattattttgcaaaataaattacattagcaagccatacatacattttccttaaaattgcaaacaagatttctccaaataaatgaatagaatacgggtataattgatagttattacatagcagttcagcattttttattagctagaaagagatttggcttactaatatttccaagttcagagttcatattaatgcatctgcataaatgcatgtaaagtttatactagtgataaaagaaaaacttcagccaagttaaatctaaaggagtttaagtgagcaatgaacaattcatgaattgggcaacccccagaaacacagcagattcacagagaagccagcgcagccacgtggtggaagaagatttatagacaaaaaaagggaaatgatgtatagatatcggaagtgaggtacagaatggctggattggttacggttcagcatttgccttattgaacacagtttgaacactcagcagtgtatgaatggttgaagtacagctgctgggatcagccaagactcagctattgttacaggcgcatactcctaagttaggttttcaatcttgtctacctattaagctaggttgcagtttgtccacaaggactcaaatatagaggtacagagtccttctcaggccatatttagttcactttaacactagttaattcaataaaagtgtattaagcatctactgaatgcaatgtattaatctaacacattaatctaatctaggcatttgggtgctataaaggaagttggagaagtaaacttgtttaaattttaggagttgtttagaactaaaaaccgcagttcattagagaagatttgtggtgttttgatctctttctgaaatatgtgcttatcagaattaggggttcaacatgagccaaccagcctttcaggctctagatgaatttgagacgtataatagtatgtgcaaattagaatcagttcaaatcagggggaactaaattctgttctagtggccaaaatcattatattttcaaaactgaaaccattctcaaaaattgtacaacaaaaggtttatgctatacagacagaacctgaaatggagacaattctatctgcaatgaatatcagcaggaagcaatcttagttgcttaaccttattagtcatgacctacatagattttatttgaatgcagtgtgggaaaaagccatagtgtgctaattttcaaggaacacaagcaaaagaaggcaaacagaaatagcttttcctcagaaacatctctaaagaaaagagtccttcaccattcatgcagaagtcaatgatatgactctgaccaaacttcccactgctgctgagaagtaatgagatgtctgaaactgctatttaaaactaattttagaaactttcaaatgttataacggaccaaaaaacagagaaatagaaaatttttgatgtgactataaggtaataagattagcattctgagtcttagagagcaattaatcccattaacctacacggtctctcaccactgtccatcttacataggcaggaggtaaaataacactcagcacaaaatagccatgtggttacattctatgggaagtcctaaggtaaggttgtgtctttatatacttactaaatcaaatttgcaccaaatatttttatttgacccttagaaaccttacaataccaaagagatttttctcttaccatacaatctattcatagacccactttctggtttgataaccaagatgagtcccaggtataaagttcacgctttgtaaatcagcaggatttctggttcactgagaacagcctggtacacgagtagcaaatgagcagaattggagtttaggactccaaactgtgcagacacagcttagatgtgccctctttgtgggcagcaggtactcatggttgtatctttagccagttgctgctgcagcacaccacttaatacattactgctttagtgaataaatgatatttttgtgggcttgaacagttcatacacatccccagcatatgggaagcttacttcccagggtgtcgtcatacttaatgtctggctccctgttaaatacataccccatacttttgttacatcaaggggggtaaatatggggatctactttctaaaccttaaagtactaataaacctcaggtatacattttaaaaattaaatctaagaagttatgacatctacttagtcggaaagctgctctgactgggtgtaaaagtgactgcaacaaaatgaaatcttgatgcttctatttgatactatgattgtacacagaagataggcatgtgtcaatagagaatggtaaggactgtggtcaaactagagagaagaactagagagaacagtcattgtttaaaaacagtcaagtacacctgtagtcccagctactcgggaggctgaggcaggagaatggggtgaacccgggaggcggagcttgcagtgagctgagatcccgccagtgcactccagcctgggcgacacagagagactccgtctcaaaaaaaaaaaaaaaaaaaaaaaaaagtcaattacaaattttgtaaaaatgtccagctgaacaaaacacatctgtggggctatattgggtacacaaattgtgagtttggaattcctgatctagcaggataagctaaaacaagaatggaaaatgtaggcttaattttcattaaaataagattgcatgttaattttaggttctccatacctactgatactttaccaaaattcccacacagggatcttttagttaatcatcaaatacaaacttttcgtatacctatggtggtaagaatgttgcatcacacggtcttgtatctgaaaggtatgctaaaaaacggaaaatgatttctaaactggttggtcctgtaataatacaattctgtttcatgaaatgctttcttcatttgtgctttgaaggttttagctataatgtgtggaatagtttattacattcaacaaaattgctaactgcccagtatcttaaagcatactgattatttctagaaatgatttttgaaaaaatattgccatagctatgttaatgtgttattactatgaaaaattattctgtgaaatgaaacattttcatcatctaatcaagttactttcctaagttaaaatatgataaagcaaggattaaattattggctgactgtctttaaagcattaaatatgagataagcatccctttctttctgccacatgcatacaattgaataattatctgtgaataagagttctaatcccataaccccaaacattcatagagcccatcttccagaatatctcattatcttatattcaacatgtccaaaaccaaacacactatatttacttcaaaaccagcacttacttcttttcctgtttccatgaagtcagccagtaagtcagttgggcaataaattaaccatttattgagtactactatgtgtcagacattcttttaggactgaaaatacaaccaccaggaaagaacagacatggcaccttcctttggggaccttacagtccagcagtgaaatcaagcagtagaaatataagcaggagcacaatggcactataggaaaatcataggttaaggaattaaccatgttaacaaagggctgaatctaacctagcttggggttcagggtcggcttcctggaagaggtgatgtgcttatacttggagcagaaagctaagtgtgtgttagctagagaaggatgaaagagattgtaccagggaacagagaagagaatttcctgaggcagacaaagaggctgtaatttggtcaggaatgagagaagtccaatattgctggagcagaaaagagagagcagaaagatactatatgaaatgcagtatggtccttatccttttagacttgaaacctggaaattgtttttgaactgtcacctcctttcatttctcatattccaaccctaatcatatccttcagatctggccatccatttccatttcccctgctgccactctagcctaagccttcatttctcatctgttgattactttaacagcctagctgctactttttctgctcttagtctttccctgctccaattcattctaactagcagattaaccttcctaaaacctatatttcatttcattgtttcctttctcttaccaaccctcccctgcaaatcctccactggctttctactagattaaagctaaaccctttaccatggtaaaggattcagggacctccatattgaaccacgctctacccacccattttatcttctgagttttctctatgggaaactatttcagtaagatgttctttttattactaattcaacaaatatttattggacactgaccatctgccaagcacagttctagatcccagggatacagagctccagaccgtaggtaaggcccctgctctcatgaaacttataatccaataggagaagacaaacaatgaatgaatggataaatgaaaaaactctcagatggtgaagtagatgctgtgcagagcattagagtgatgtccctgagactcactaggaggctgcactggattaggaagtcagcaaagtcctcttgcaggaggtggcctttaaggtaaagtgtcaatgacaagaagcagtcagccatgggagcaacaggggaagaacatttcaggcagttgattgtggtggcaagcatggaagcaggtagatcagtaaatagtctattgtgatattccaggtaaaatatgatgatggcttgggaagagttgtgatagtagagatggagagaagcatatgcatttggtatatgttttgcaaataaagtcttgtgagtagatgtgcagagagaggaaaagaaagtaatcaaggataatgttttgaattttgtctaatgttggatgaactgattaaatttcaaggcagaataggatactgttgttggtgcttttcctgatgtagcccttcccagctctttctaaaagagatctactgtcatctgcagactacccagtgcttttcatgaagctaaaatgaatctagtgggtctgtggtcaatggccttatttattgtatcaacagagaatggaaagttctaacagatcaacatccctgggaggagatgtgagccttatgccatgctaagatacagtagtcatcttagcagaattcctcatggaagggcaggtggcctcctgtttgctttgtgcaagtgccttttgggtagttagtgcttctctgtgcctcctggaatactgacccctgaggtaaagaagagggagccataaactatatatcgacaacaggttgagaccatctccctggtttggacttgccagccctgtcttccggtccttttgagtatgtcatttgaatttctgactcagagtctttgtactgttcccaccaactgtgttatatttcctgcatttcatcacctgtgcttgtctttcaaagttcaggtcctgcctcctttgcaagtcctttcttaccactgcagcccaaatgtaattcattaaattaccgtggtgcttatcagagagatactcattttaacacttatcgtggctggtgttcatacagctataagatataaacatataagctctagtttataagcactgaagggacaggtctacatcttattcttatgccaaattactcttaacacactaacgtattggcatgttataaacggcaacaaatagcaaatatttgttgccattgtagatacaaacttaaacttttacatcttttaatcaagtagattaaaaataataagtaaattgataaagtaaaattagatgatgttacaagatattccaattgtaggaattgtttgcaccctcctactgaccgtgacagtaccttaattttttattcattatgccaccaagccattccattggaccacagtagcatttctgggtcgtagaaagcagcttatctatatttgttgaatgaatgaaatacacaatatataagcattagctttatggacaggctgctgcatatgcttgtgaaggttatgtactacataactccagagagcaccatttgcagaggccacgatgtatacaacctaccaaacaagactaggcagtatctgagaaggttcctcttagggcagagggcggcaaagtttcatgagccaagttcatctcactgcctgtttttataaatgaagttttattggaacacaggcacactcgtttgtttattatgttgtttatgaccactttcatactaccatggccaagttgaatagaaactgcacggctctcaaagcccaaaatattgactatctgaccctttacaataaagcctgctgaccacttagggagacttcttccagttaagaaaaaaacaaacccatttaattttaaaattgcttttactaactgtttaagtgtgaagagtgttttattatggtgttttttccttttcaaagttatcttactcttttgcagtaatgcctgaaaactcaaactttccatatcggcggtatgaccggctccctccaatccatcaattctccatagaaagtgacacggatctctctgagactgcagagttgattgaggagtatgaggtttttgatcctaccagacctcgaccaaaaatcattcttgttataggtatgaggacagaaagcaaaaattctcataccgttgctgcctttgtttatatatttacatttcaaaaaagtaaatcatatatgtgcaaatagttggataatgacaagcaatagaaacaaaagctcaagggacaataaatggaaatattcttagtataagtttcaataaaatagaaattgttataattatataatctaatgcctattgcattttcatagattcccaataaaaggtcatagaaattctctataatgaatcgaaagtaataccttcaagatttattgtcctgtggttttatttatttaatcttgatcacagataactgagccaattgaagttttctgagagctgaatgtggtggtagtcccagctagtaggcaggctgagccaggaggatcccttgaacccaggagtccagcctgggcaacctagtgagactatttctagaagaaaaaaagaaagttttctaaacatgatgtgatttttccccctttaaatcaacaaattaaatttttactcactattaactttagagggaaaaataaataataatatattggtaaagattcatataaatgaatcttctttatggcaaattggcacctataataaatccaaagtttcactgttaaaagacaaacaaatctaatagaatagtgttttacatagcacataacatctgagtattaaccaaaataacaatgataatagttcattttaaaagttgccactatgaatcttatgttaaatatggaattatcggccccatgacatttcacaaggaatataaaatgaaaatgttttaaatatttttgaaaaattcctttttggtcaaggagggaggatcacttgagcccaggagtttcagaccagcctggtcaacatagtgagaccctgtctctacaaaaaatttttaaaattagctgggcgtggtgacacacacctgttgtcccaactatttgggaggctgaggtgggaagatagcttgagcccaggagttcaaggttgcagtgaactccactgcactccagtctgggtgacagagagacctcatctcaaaaaaagaaaaaaaaattgtggctatttttgcaaagtctttctcaaaatctataacaatcatgaagagacctgtgaacatgcaacatgtagtcattgttttcacattccagttagaatcacctttcacagagatgaccaaaagcaaaactctggcatgaaatattcaaagctgttctagccagttgcattaacagagtgtcaaatttatggagaccccatgcaaggaagtagtgcttcagaggacatagcaatgttgacaactaggacaaaagcatgcaaataaacacaccaagctataacaagaatttaagctcaccagactagaaggaatgacatttgtacattttaaagtgaaatgaaaatgaaattgtaaatatatctaccttgaattgttaaaaacaaaattacagaaagagagtttaaagtcagtttttgaagagttaaaatatttttatggctttatggtagccgctgttacgccataaacctctattcttgcaagtggaatacattctttttatgcttaaaactttcaagtccttacatagaagacaaggaaacacttaaataaatgatagaactacagatgaaaaataatcgggaagtatctcatcattttatgatgagatttgtacgtggacagaacacattctttctattttgttgttcttgctgctagtaataaagtattggtcattattaacaggatgaacaaatggaagctcgattgttcatgaaaatggtttgatagcaaattaatcttgtataaaagagcacaaatattttttgtgtgtactatgaattttatatgaaaatgattaaaatatttcaataaactaagatcttcggagaatatgtaaatactcaaatctctcccacttcacatttctttctattcagtgaaatcaacttgtttcccaaagttatgattcttgttataggcttacatgctgtgttgtaacattttatatattacaagaatgatgaagaaccaataagtgtaaataatttcaagaggattgaaacaagggaagaaagaagagggtggatcttaggttgtctgagagaattgggacaattttatgacttttatggaattataaaataattgtacctgaaccttacaaatttgtattagttccaacctaaaaatgtgagagtgaggtatagatgcccacatggtttctcttccagcactgcagaatttttttaaagctggctctcttggaacagatacgaatctctctcatgttaacgtaatcataaaatttcagtgagatggaccctaatatttataagttttagagataagtgaacagaacaaaattaagcccattctggctttagacagaagtaaaattaatttgatagaaacattcagtaattaagctcatccaacaaattaatggcagagaatatctctgtcaattgtgccaatcatattttttgttgtctactattgcctccattagttgacaaaaaattttttttcttgaaagtacaataacattctcaatgtgtctgaattttttaaattaatggagtgtataatctcttagtttggtggttgtgattaagtgtggaaatatagtttctgaaagatacctgattcttcaaggaataaatcagtttgaatttgccaatggaattggtcagataatttttttatttcaagccaattcatgatttgcccatatattagtaggttaaagcagctatttaaaaccaaaacttacttttgatttaaaaaataatctcatagaagtctttaatccattttaattttattttgcatatgacaaagagatagagatctagtttatttcctctgtatatggatatgtagtttttccagcatcatttattgaagagactgctttttacacagtgtgtgttcttggcatctttgtggaaaatgagttcactgtaggtgtgtggatttgtttctaagttctctattctgttccattggtctatatgtctatgtttacattgcataaaactctagaattcaaaggatataaggcaaggacaggcatgagcaaacatttcaaaaaagatttaaataagctgtgtaaatactggtaggcgtttgtctaaaaataatggttacgtttcaccgaattacacattaactctgttggcatggaatctattattgttattttgatcattgttttttatattccacagatttttctttgattacagagggaaaaatgttagattttacatagaaaaaagtcaagatttctttcaactacactgttcaaaaatttttttaattagctatttgctcaaataggtagaggaaaaacctgtatctctcatttaatacagttggtcaagacaattctttccttgacaaagtctctacttgctttacattcaaaggcagcactgagaatgccacaaatggaactgttaaccaccctgtcttggtgacacagaatttgcatcccagatgaagtagtagttgtataaaagggaggtccttattgtatcagaagatcacagttttgcctgttttaaatactaggtggtccaggaagtggaaagggtactcagagtttgaaaattgcagaacgatatggattccaatacatttctgtgggagaattattaagaaagaagatccacagtaccagcagcaataggaaatggagtcttattgccaagataattacaactggagaattggccccacaggtactgctgtataattatcttttattctgcaaaatgttttcataccgattgagtatactaagtttaactgtggggtttttttgtcatcctttctgtttataaaaggaaacaacaattacagagataaagcaaaaattgatgcaaatacctgatgaagagggcattgttattgatggatttccaagagatgttgcccaggctctatcttttgaggaccaagtaagaatatctccttatattttaaatgaactactttttgcttaaaattttgggaataaaaacaaaaagacttcttggaagacttgcgatgcttttgaatgaattctggtctgaaaacaggcaaatacatcagtatgggttggcagaaggtcatttctttggcaaacacttaaaaattaaagacagtctctgccaaaaggaaagataactaataatagaattcattttattgaaaaatgcaaatctctctaaaatttatttcaaaatacttttcatacaatttttttttattttgaattactaagaataagccttattcagtactgtccagggatgcaaaacattaccctgtacttatattcatgccaactaaggaaactttcttcaggttgtgaaatactgaaccacctacgtagattaagatagggttcagttgccaaaatttgagtaggctatgcctgctcaacccccaatacatctgttttaaaggaaaataaatcaattaaaatattttatatatctatttaagctttgaaaagcttatgttaattgatttttcattaaaaaaaattaaggctggactcagtggctcacgcctgtaatcccaacacttcggaaggctgaggcggatggatggcttgagcccaggagttccagaccagcctgggcaatatgacgaaaccccatctctacaaaaaaaaaaaaccacacacacacacacacaaaattaaccgggtatagtggcgcacacctataggcccagctactcaggaggctaagagagactgagaggcaggagaatcacctgagcccaggacatcaaggctgcagtgagccaagatggcaccactgcacttcagcctgggtgacacagcaagaccctgcttcaaaaaaattttcttttaattacagaagtaatatatgctcatacaaattttaagtctatctgtaaaacgtgaaagtccatcaataccctcccattccgctgctcctcctttcctgagaaataggagtactgttaggtttgttatatattcttccagacctttttctatacttacatgcatacatacatgtatggacacatgtgcacatgctcatatacaaatgcattctaaatttttataatgacttttccaagttatatcaatgttgaatgacagtatctttttctacagaccctttccaaccagatacgattcatgtttaaaatttttgcaaacctgatgagtaaatggcattttgtgttttaaatttgcatttcatgggttactattaaggttaagtatattttcatacactcattggccatgtgtatttcttccttatgtgaattgcttgttctcctttgcccatttttctacagactttttaatctttttcttatttatttcaaggagcatttaacatattacagatatcgtattaaacagtattaagtaaaatatgatgtcagtttatgcatcacatgaaagaagcctggagttgggcagttcacggccaggggtagctttacaaaacatttttttgaatgttcccattaacggttttggatcacctattgtgctagaatgtctgcctccccttcttaggtttcctctcccaccataagtccagaaactctggtgctcagtcagcttaaaggcttggttctaattgttctggctttgaagagagaaaaactggaaaatatctgatgaagttttgttattgctgttgctaccacattatattgctgttgaaagcgggtgctatggcagccattccatgtgattcttgattattggtagaagtgtgataggcagggaggcaggcattgccacccaaacctggttctcccacccacatattgaatgtgctaaacttggtaggtacaagcagatgaagctacttgatttttttttaattgctttttaaacatgctatgttgaatatctttcttttttgttgaattataactcaggaagagtccctggcttttctggtgacttaaaaaacattaacaaaatatctcattttcagctcttaaaaagtccagtccaatctaaatcaaaactttaatttcgtattcactttaacatatatctgctgtccccagcttggaccagattcagactcagaaagctaaggtggtgtatcagaatcctgaaattcctactcatgtgacttgcagtaggtgggagagggagggaagagaggattccctccgaaaagcataaccctctggtaactctctggatacctgatcaatctacatcttctcttatatagcctagtcacgggtaacagtaccgatttggggtctgttagcaaattctataggatggtctgttatctctatgtagaatgagcagtaacttacatttattgttttcaaccacacttctgaggctgaaaagttccaatttaacatcttcttaggttgacattccagcagcctagaggttctttgccactgtgggcagtacagaggtgtctgaggtcaatgtcatctttgctcatcctgcgggagttaagcgggtgtggaggcaaagctgaaatgtttatgtaaagcagtgtcagggtcagccctgattattctacaccctgtgtaggcttaagcttctggggtgtctttttttctgctaccacttctgagaccaaatgtgtggggtcttccacaccagttctccaattctccaacaccaactgggtgcctaagaattcagttcaacttggacactatccagagttagttcagaccccacaggttaagagcttagttccacaagtctgttcctgcttcagacatcagttgcaagtcccagcaaccacctgtacttctgattgacagtctataaattcaaggtttccataacactctccacaggttgtataattcactgcagtgactcagaacccagaaaaacacatttagtggtttatcataaaggatacaactatattttttttattatactgcatctcctcaaggttttgcgttaacttagtttttgtttgtttgtttgttagtgcaaatgtaggcacatacacacatgccaacattttccccaagatttcctcacagatctggggtgtgagaagaggtgaatttctggtatcagccatatatgggtgatggtcagaccactgtaacaaaagggcctaacacttaaatggcttttaggatgaagaagtgtatttttcttcttttggaatagtctccatatgaacagtccagcttgactgggcagcttttttccttgagatcatttagggaccatggttcctcccaggtttttctgccatctcctaggacactgtcactggccgcgtggttgaaaaagtgttgtcatcacatatgggttccagctggaatggacggggaagagaatgtgaaggtctgaagtctcagatctggaagtgacatccatcgcttctgctcacaaggcattgctgagaatttagtcctgttggaactgagaggaaggccgggaagtagagtccagctgggcagccaggtgcctggcagcaatgctattactatggaagtctgggagaactaactagcatcttctcccacagtttgcctctctggccatgcaaatgctcgcctgctcccttcttcccacacatacaatgtactcactcactccccaagtaaaacaaccagagtcccatcatttagttcaaaagtggagaatctctactctatatatagttttcttcatcaggtctagctttgacttctcatactcagccacctggaaactgaacttcatgttatcttccttgtctaccactaataaagagtggaggagcaagcccaggacaatgaaataaaggctcctattcaaaaaaggaaagtttgagaatatacacagtactcactgaaccacagtgaatcctgttaggcagggattgcaaaggtccttgccctggcagttcctctgagaagttcttccttgtccattatctgcatgacacattgaagtagtatattggagactaatatgctatcctctcctttttttttttttcctaagtgacaagatccttctctgtcagccagggtggagtgcaggggcaccactgtagctcactgcagcctcgaactcctggaccacactcagctagttttttaaaaactttttgtggagacaggggctccctgtgttacccaggctggtttcaaactcctggcctcaagtgatcatcctctctcagcctcctaagtgctgggattacaggtgtgagccactgcaactggctgagacctattttaagttaaaaaaaaaatgcctttttttggctagaattatgtttattttggtaaaaactgtttctttccaaatttggtagatttcctctcaaaaagaggaaaaagcaaaaagcttccagtccgtgctagtaactatatcataagtccttttccagagatagttattaagctgctttcttttttatcttcccgtttttcctttttctgttcatttttatagattgagggtacaagtgcagtttcattacgcagatatattgcatagtggtgatttctttgctttctcattttaatgacaattagcttcaggccatctaaaacagcaggcttgggtagaaaggcagcatccttagtctaggttttgcttcagggctaggtgccctgttttttggtggtagtggtgggtaaatgggaattctttttgcaatagcctaatctcctgctgtttggaggtatacaggcagttggcttttttaaccttgtgcggtcttaaattagtggatactttcttttttcttatatctgctcgcaaagcagtcaattctttcttgagttaatctatttcttgtaatatgttgctaaacgcagcaaagagcagtcagtgtacacagacactctagctctttccagccatttctttagctatgggctccattggaacatgacctgcctcccaagttatcacagtaataatgatgttatgcaatgacataacaggggttatcaattttccatcctaaaatgtctgtgcccttactacccaagcaaatcaatgtcgcatgttttagtttttttgatatagtagcatgcccccacttatgtaactattggctgtattatttagagtaaatcccaggtgctataatagaaagacacaatgacacagtagcataatacagaaacttatttcccttttatataatggatggcctcactgtgaatgaggggaggacagttttagtcctcacattcatgcagagatgcggggttttttccagctcattgtctttccaactctagagcaacagctctaaaatttttggtcacaggacctctttacactttttaaaaattgttaaggacctcaaaaagctttcatttatatgtgctatatctattgatattcaccatatgagaaatcaaaacaaattttaaaatatttgttaagtccttcaaaataacaataaatccacacaagttaacttgaataacatatttttagaaaagtaatcatattttccaaaacttaaaaagtgttgagagagatattgctttatatatttgcaaatctctttaacttctagctaatagaagagagttgtattctcatatctgcttttgtattcaaactgctgtgacatcacacttcctgtcgccactgcgaaactccactgtacctttgtgagaaagtgagagtaaaaaaggcacataatgtcatagtgttagtaggaaaatagttttgacctatgaccttctggaaggggtcttgacgatcctcagaggtttaagagcacaatttcagaacaactgccctgggacattgtagacatctgcatgttgaaagctaggtcactgccatggccaggttccagctgattggaaggggaagagagtgcagaggatctatgctcaaattcttttttaaactttttttattttaacttttgtgggtacatagtaggtatatatatttaaggggcacatgagatatttggatacaggtgtgcagtgtgaaataagcacatcatgaagaatgggatatccatcccctcaagcatttatccattgagttgcaaacaatccaattacactctttaagttattttaaaatgtacagttattattgactatagtctccctgttttgctatcaaatagtaggtcttattcattctttctaacattttttgtacccattaaccatctctgcctccaccccccgacacatccgcaaccccttattaccgacccttcctggcctctgataaccatccttttactgtctatctccatgacttcaattgttttgatttttagatcccacaaataagtgagaacatgtgatgtttgtctttctatgcctgtcttattttacttaacataatcacctccatccatgttgttgcgtatgacaggatctcattcttttttatggccaaacagtactccgttgtatatatgtaccatattttcttttcttttcttttttttttttgacatggagtttcattcttgttgcccaggctggaatgcaatggcacaatctcggctcaccgcagcgtctgtctcctgggttcaagcaattctcctgcctcagcctcctgaatagctcagtttacaggcatgcaccaccacgcccaactaattttgtatttttagtagacacggggtttctccatgttggtcaggctggtctcgaactccagacctcgggtgatccacccgcctctgcctcccaaagtgctgggattacaggcataagccaccatgcccggccttatgtaccacatttgctttatccattcatctgtggatgaacacttagtttgcttgcaaatcttagctattgtaaacagtcctgcaacaaacataggaatgcagatatctcttcgatatactgatttcctttcttttggctatatacccagcagtgggattgcagaatcatatgggagcttcatttttagttttttgaggaacctccaaactgttcttcctagtggttggactatttacattcccataaacagtgtacgaggattcccttttctccacatcctcgtcagcatttgttgttgcctgtcttttgtatataaaccatttaactggggtgagatgatatcttattgtagttttgatttgcatttatttgataatcagtgatgttgaacactttttcacatgcccgtttgccatttgtatattgtcttttgagaatgtctattcaaatcttttgcctgtcttttgattagatttttttctgtagagttgtttgcgctccttgtatattctggttattaatccattgtcagaggggtagtttgcaaattttttttgcaacccaccattctgtgggttgtctttttactttgttgcttgtatcctttgctgtgcaaaagcttttaaatttgatgtgatcccatttgtccatcttttctttggttgcctgtgcttatgggatattgctcaagacatttttgcccagaccaatgtcctggagatttcccccagtgttttcttttagtagtttcatagtttgaggtcttggatttaagtctttaatccatttttattttatttttgtatatggtgagagataagggtctagttttatttttctgcatatggacatccagttttcccagaaccatttattaaggcagaaagagactgtcttttcccaatggatgttcttgatacctttgttgaaaatgagttcactgtagatgtgtggatttatttctgggttctctattgtgtttgattggtctatgtgtctgttttcatgccagtaccacgctgttttggttactacagctctgtagtataatttgaagtcaggtaatgtgattcttccagttgtgttctttttgctcaggatggctttggctattctgggtcttttgtggttctatatacattttagagttgtttttttctatttctgtgaagaatgtcattggtattttgttagggattagattgaatctatagattgcttgggtagtatggatattttgacaatattgattcttccaatccatgaaaatggatttttttttcattttttggtgtcttcagtttctttcatcagtgttttatagttttcattacagagattgtttggttaattcctaggtatttaattttatgtgtagctattgctctagctaggacttctagtactatgttgaataatgatggtgacagtaggcatccttgtcatgtttccaatcttagaggaaaggcttcagtttttccccattcagtatgatactagctgtgggtctgtcctatatggcttttgttatgttgaggtatcctccttctgtctccatttttttgagggcttttgtaatgaagggatgtttaattttatcaaatgcttttcagcatcaattgaaatgatcatgtgatttttacccatcattctattcatatgatgtatcatgttgattgatttatgtatgttgaaccatctttgcatcccagagataaatctcacttggttatgatgaatgatctttctaatgcattgttgaattcaatttgctaggtttttttttgtttttttttttttttttgaggatttttgcatcagtattcatcagagacattggctcttagttttcttttttttgatacgtctttctctggttttggtatcaaggtaatactggcttcataaaatgactttggaattatttcctcctcctctattttttggaatggtttgaatatgattggtagtagttcttctttaaatgtttggtagaattcaacagtgaagccatctggtcccaggctttttcttaactgggagattttttattgcagttttgatcttgttacttgttactggtctgttcaggtttgggatttcttcttgataagtggcatgcatctcagaatttgttcatttcttctagatttcccaatttattggcgtatagctgctcatatcagccactaatgatccttgaatttctacagtatcagttgtaatgtcttcattttcatttccaattttatttatttggatcttgtctcttttttttcctagcctggctaaaagctgcaaatattttctttgtcaatttcattttacttttcaaaaaaccaaatttttgtttccttaaccttttattgttttttcatttcagtttcatttatttctgctctgatctttatttcttttcttctactaattttttttgtttgatttgcttttgcttttttaaaattcaggatgcatctttagattatttatttgaagtctttcctgttttttgatgtaggcacttatagctataaacttccttcttaatactgcttttgctgtatcccatagattttggtatgttttgttttcattatcatttgtttgaaaatttttttcagtttccttcttaatttcttgattgacccactggtcaatcaagaaattatatttgtataattatatatcacatatatttgtattttttccagaattcctcttattattaatttctatttttattccgttttggttagagaagatgcttgatcttatttcaattttttaatgttttaagacttattttgtgacctaaaatattgtctgtccttgagaatgatccatgtgctgaggaaaagaatgtgtattctgcagctcttagatgaaatgctctgtaaatatctattagatacatttggtccataggtgcagattaagtatgaagtttctttgttgattttctgtctggaagatctttccaatgctgaaagtgaggtgttgaagtctccaatgcttcttctgtgttctccctcccctggcacccagagaggctctcagaactacaccgccacttccagggatgagggaggagtggcatctgcaatttaggactgttttttctatcttgtcagtacttctttcagcaatatgaagttaaaaccaggtactgttagtgctcacctggttttcggttttcatgaaggtgttttttctatatagatagtcgtcaacttggtgtctttacaagagggacgatggtggagctgtctattctgacatcttgctccgcctcaggtgatgctcaatttcttaagtcccagacacatcatttctcatgctccattgatgagaatttaagtcacatggctttatctcgactgtaaaggaggtgggaaatgtgatcaagtggtcagtcatgggtctctacagagctgttatcatggaagaaaggaaaacaggttttgatagacaactaggagtctaccacaagccgcttgcagtgcatagcgccatttttccttacttctcagcccaagagctggactctcccagtccccaggcctgtcattttaaaagaagaggaggagataagactgtacttatctgccatagtagccacctggccctacttcttggctttgtatagtagtttctccaggagatggagcttgcagtgagctgagatagcgccacggcactccagcctgggcgacagcgagactctgtctcaaaaaaaaaaaaaaaaaaaaaatctttttctcatcttttggcctgattgtttaaaggttagtgaggggaaaggaatcaagatgggcaagcatgggaagtctaagatcttttcactgccaactaaacatgctgctagccaagatttcactagatagcccagagtccacagtgacaacctaagcgatgtgtttttaaaaggttatagaatttcgtatttcatggaatgggagtggggcgaaaaggtggatttccatagggaggttttattaaccaagcagtaaagctgaaactaataagagctccatgacgttattattgaaaatggagttcaaggccagcctgggcaacatggcaaaactccatctctgcaaaaaatacaaaaattagctgggtgtgatgacgtgtgcctacagtcccagctactcggaaggctgaggtgggaaaattgcttgagcctgggaggctgaggctgcagtgagctgacatggtgccactgtactccagcctagctgacagagtgagacactgtcttaaaaaaaaaaagacaaccgagcaccacatgttctcacttataagtgggagcagaacaatgagaacacatagacacaggaagaggaccagcatacactggggcctgcagggtggtggggtcgggggagggagaacattaggaaaaatagctaatgcatgtggggcttaatacctaggtgatgagttgacaggtgtgcaaagtactgtggcacacttttacctatgtacctgtgtaacaaacctgcacatcctgcacgtgtcctggaacttaaaataaaaataaaaattgaaaaaaagaaagaaaatgaaggagggaagtctatagcaaatctataaacacacacgaacactcaaattgatcgtgattaacaatatattcaactatctggtcccaactaattttccagttttatatacctgtctacacgttcgacatgctgtaccacttcctgtttttcacagtgatctgctcctgctctttcctcagtgctatttatataattctataacttgcttttatcactgtgcattctgtttttgagcttatctgtgttgatacatatagacctagctcatccttataacgatttcatgttacactctataaatacattatattttattagtgaactttcatgttgctttaaaatttgttttatcatcagtacttacctttttattttatttatctgatggattagaagtgtttctgtatcactattttaatttgcattcttcaaattactagtgaactgaaacatttagaaatgtgttttttggccacttgtatttcattttttgagaatttctaaaacataaccctgcccccactcttttcttgttagattgtttgagtttttaaaatcgatttggatgttctagatactaatcctttgctacatatcttataatattttctttcatttatattttttctcagtcatgttcgagatatgttttgtcctgcagaaattttaaattggaattggtgtatttttcattattttccctttggcttttgcatttggatcttaagaaagtgttccccataatctcataaaaatcttctatagttttctagttatttttagttttgttttaaaggtccaggtatttattctatgtgcactaattcttttgtatagtgtgaggtagcaatataactttattgcatgttttgaatggaaatgaaaaatgtattcagtggtccaaagaacgtttgttgacttgcgcatcttttccttcattgaaatgacttattcctgtatagacactggtctgtatatggtttctctattcagttctttcttctgtttatatatttctgcaccaatatcatggttccagttgaagaaatctaaattatatcctgatatccaaagaacaatcccaccccttctgtttttttggtttttatttttttttcttttgagacagagtcttactcagtagcccaggctggagtgcagtgatgcgatctcggctcactgcaagctccgccttccgggttcacgccactctcccgcctcagcctcccgagtagctgggactacaggcactcgcaaccacgcccggctaattttttttgtatttttagtagagacggggtttcaccgtgttagccaggatggtctcaatctcctgacctggtgatccacccgcctcggcctcccaaagtgctgggattacaggcatgagccaccgcacccggccctattcttttttaagttaggtatgcctatacatttattcttctttataaattttagtatcagtttgtcagattctgctgagattttgatttgaatttcaatatagattatattatgtatatagattaattttaagagaactcacatattcccatccatgaacattgtcatgtcactctgtttattcaagtctagctttatgttcttcattaaataaggttttataatttttcatataaatatcttgtatggttttgttagttttgttcctaaatataatcgtttataggtttgctactattgtgaatgagctacttttttctaaccaattcttaacgctccatctttatagaattattgtttgtgtttgtgggtatgtctgtttgtctccctagacagccttcttttctgttctctttacggcacagctgactcattcatgttgtaaacttccttcttttcttcttcccttcttaccactgccaccttcaggaccctcacacctgcctgccaacttagaacattcctttactacactgagttctattaaatgtatgttgatttgaagtggcaaataaatatttgtgtcatggatattcagaaaaaggaaagattcaagtggctgcataaaaagtgatcttgagtttaatttctgagattcttatttctcagctcctcatataaatcaatagagttaattatagcatcagcgaagtatagtagtttgactctcattcaatgtgtactactggctaatttatggaccctcttgaagcctcggtgtttgcctttcaagaatgagaataataatgtctcacaagattattgtgaagattaaatgatataaaatatctatagttctagtacagtttgtggctcatggtaaacactcaataaaagaaagtcgttattgtcgttagaccatattaaagataaacactccatagatttataaggagaagagccaactcttccctttcttttgtcagagctttttccccctgatactgaatccattactcattgtcagaggctttgaaggcagaagaaccaggttccttctagggactgtttttcaaattggttgatgaaacccttagaggccactttgaggtgttaaaggctgcccagaacagttctgattttgttctgttctgaggttccatgtaagactttgaagaaggttttcaactgctaagaatggctggaaaccactctagtgatctgtcagctggagtcctgggacattcacaccactgggcaagaagcatttagaagcccactaatgagcacaacccatttccctcatcccttcctcccctacagctcctgaagcaaaaaagaaataataattcgttattttcggccagaagggatgataatccagagttccaaaataagtccatggtagcagaagtaatatttaggaagtacgtgccaagtgccaggcacctagctgtggtttaaatacatgattacaattcacgtcaattctatgaggaagttgttgacaatcccgtctctaaattagcattgggtggtctcacttcttctaggtacatggatatgggttgagttgtatagtcgctgtgcccttcaccataatcttctatcaactctgccttctaagaattggttcctaaagcaatctaaggctggacatggtggctcatgcctgttatcccagcactttgggaggccgaggcaggtggatgacttgaggtcaggagttcaagaccaggctggccaatatggcaaaaccctgtctctactaaaaatacaaaaatcagccaggcgtggtggcacatgcctgtaatcccaactacttgagaggctgaggcaggagaatcacttgaagccaggaggcggaggttgcagtgaggcaagattgcatcaccacactccagcctgggtgacagagcgagtctgtctaaaaaaaaaaaaaaaaaacaaaaagtcccttaagcaatctggttcattcacatcaccacggatgcaatcagcacagacaaccacagagctgaggtgttcttaaatatgcatcttggttttatatatttagtgtaacccaaagtccctccattacacgtactgtctttttttccatccagtttttcttccagtttttccctctgaggggttgatcccacagtgctgccttcttccctgtcctaattaggcttgtatattcacttccatgtgattttcatgtgaggagtggtttcgtgtccccagctgccttttaagaacctatgcagaccttccttcataatgatgctggctagttctcttccaaatgtgtaccaaaaaaattatttctgtgaccccaaatgttgcaaagatccagacttcttctttctattgtatttatagacactgattgatgttaaactgatctggtttttccaccatttctgtatttattttctgtttttggtacaagcaaagtatattgtttctacaatagtatttatatttgaatgtatacattttattcctgatttttatcatgttatcactttactccccaagattagctgtcattattccactttacaggtaaggaaaccaaggctcagatgataacttgcttaaagccaccagcaggcaagaacagagctaggcttccaatcttggagggcatacagactctagaccactagctttctctaaccttgaggtcacaaacaggcagccctgaggctgaatgtgggctgcagacaattttttaggtgtgcaccaaattttaaaattgggaggttaccaattcaaaagcagacttttgcttttcttgaaaattttggagatttggcagctttgagtctacattcctacatgtgtgtagtgtctgttgttaggcaaggtaggtgctccccagttcacagcagcttccctccctccctagcccggccctctctctcctttccatcaccaacctggtccttataaggcgatggagtccatactctacagcacaccctgtcctcccctgtctcagttatggccctctgctggcagaactgggtttgtgggtttgctttccgtaccctgtggtaccatggcagctgctgccgtgattcttaggatcctgttacttcttttacttctttttcagtacagcctacgccctcagacaaagatgcctgtgcagtcagatcctctcccttacgctgctccctgcggggtatgtccagtccgtcaagattctccctaaagacacagcctgtaagaaagcagaagtctttgcctctgcctgccacatatcttccttgaggcaatgaagtacagagctggctatttgcttgatggacaaaggggaagagggggagaaataataaaataattgtagtcatagtaatgacaatattgaacatatattgagaatttgctatgtgccattgttctgaacccatatatgttaatatattgatgttaatcctcaaaacaatcttatgatatgaattgaagagtcgttctaattttatatgtgaggagatggaggctacgttttcaaggaggctggagaatctgctccaagtcacatgtatcaagaggcagaggtggtatttgaaccaggctaagcaggtcctgaggcttcagtcttaactaccacctacttttttagaaacatagattaatatgccggaatattctctagctacaattgttgggcttttataacctaaaatcaactcatactaaatgaatcaaacaaacgacaaccaaaaaaataaaaaaaaaaaagaccaggagaatggaccaagaaatacagatgatataaacacaatacatttaaagatattattttttgtactttttaatgtagcttaattttttaattgatacacaatcatatatttatggagtacagaatgatgtttcaatacatatagtgtatggtgatcagatcagggtgattagcatatccatcatctcaaacatttatcatttctttatgttgggaacattcaatatcctccatcctccttttagctatttgaaactatatatttattgttaagtatagtcatcctacagtggcatagaacactagaacttatttattcaatctagctataattttgtaaaggtactgtttaattctagcaggagaataaagtgaatgggagagaggcgaacacctgtaaggtccatagtattccagattatgaaatgacacagatatctcaggagaagatgagagcttttcacataatcattccaagaagtttcatttaacaacagatatttattgagatgctatcatgttctaggctattgtactttgtcctggaaacacaaagatgaatgaataatgtacccttacggtaaaatacgtgtacatataatcatgcataatagagtataaatacatacaatgattagcatatggtctctcatttttttaaactttaatttcaaatagacaacacatttaggtagctgaatattttaaggatataaaattacatacactggaaactctctcttattcttgtctccaggtaccttcccagaaagcagacaccttatccttccagagatattttatacaaggaaggatgtgtatagattcttgctctcacatttttgtttttttcacttaacacatttggatattattcgccatacttttttggtcatgcatactaccagtaagttatttgagcccttagtatacattagaaagtgaattataaaacatagagaatatttaagaaggagaaatgaaggtgaaataaccaataattttagcaatttatattctattttagtataaaaatgattttatctcactaacattttaagcacaatgtgatttaaaatgaaactactttgaagaaacttggttaaaactttatgaaataggattcaaagatttgattaaaaactttatgagacaggattcaaaggtttgattaaaactaaactgattggatagtgatacttgattttatttgttgttttgtcacaaaaaataaaatgtatcacaaaatatgtagctcctatgtaggcgacaggtgactgatacagtgggcgccacaatgtcagtctttatgccaaagactggtgaagcttaatttattctgcttgttaaatttaaaaagtcaatttgaacagaagatataatatttctttttgcaccccaatttatcatctcgagccatcctcctggatgtgtgcaccctacttaaggaatcccgggctagggaatcaaacatgtctgataccaaactctcagcaatcttgtggggaatgactgaaggaatggtttctttaacacaaattcaaactcctgtcgaaagcagcagttcatggtggtgcttttgttttctaaggtgtgaagtatgctgtttataaaagtactgatgcttggtgctagcagacacaaagcatttttaccacgatcatagtggagtggtcatgatgggaagggactttaaagcccccatgacctcctaaatgccactcttactcagttgcattccttctggcttcttgagtaagacagaaaggactccaggaattgtgcttaggaaggttgtggccctggagcaaacacagcccttgtgaactccatttgtcatgcatgcattgtgggatgagagagtgaggcctgctgaagcatgtagaatgactatctgttcattttttttttctttttctatttgtgatttcctctaggatctgtaatttagcctcagcattgccatttaaggagtctaaaatagagtaagttctgagtttgagtgagtgagagtggatatatgaaaaattctcaactagataaatatggttttttaaaaaacgttagagataaaagaaaattaaccctcagagggctatcatcctacttgcatagtgaattgatttgacaaactcataatttgatttgctgtgcctaagggagacaaatttgatttcctcctaagggagagtgatttaattttaattatgcaatatgttttctaagcattagcactttcatgaaaatattaaaagaaaatgttgatgctttctcctggaactaatgacttagcttgtttataattatttaataattaggttttgaaattgataatatgttagtagaagatgattattcatttatttttattgcaatttgctgtgatgctacaaaagaccattaaagttaaaaggctgatgagatatttataattgccttatgccaagtggagagtcaatatccaaactttgtgtaaagataaaattagagtcatctttgattttgccatgtatatcaaggcatggttgctgcataacgaatcaacccaaaaacttactggcttaaaacaacaatatttataatttcacgtgctttatatgggtcaggaaatcaagaactgctcagctgattggtttcaactcagcatcgcttttgaggttgcatttaaatggtgattggggttgcagtaatctcaaagtcttctcaatctgtatacctcatgcttggtttgggaagactccaactgttgagtgctggaacagctgaggctcctcaggcatctcttctcatctctctgcatggaagtctcagggtagctggactccatagcagctcagggctctaaaggcattaacttgagagagccagaaggaagccctatcaccttttgtaacctagcttcaggagtcatacagtgtcgcttctatcactttctatttgttaagaatgagccactgagactggcctatattcaaggggaagggaattagaatccactttttttttaaataggaagagtgtaaaaaaacacttgttgacatgttttaaacccccacaccataaagctcaataaataataaatacctgcccatttttcactttgctgatatgtgtcccttcccttcattttgtttcttgctcatcttttcatgccaggtgttcagtcccatctatttgaacttttagagtcttctcttaactaccttccctgtcctcattctttccacatctagtctgtctgtgtcctgtggccagactaatctttctgaaagaccactgccattagttcacccctttgattgaaaacctttcatgacaattattgtccacaaatatgtttctccttctatggtttgattcagaatcaagtacatgtcttgttaaaaaatgtgtattgtccagtctccctgagagaattactgaattagaatttctggtgagcggaacccaagaatctgcaagtttacaaatcagcaacttttagtaacgtttattcttaaacacattagcatgcaaactttagtctataatggcacacagcaaagattctcagccatagcatgttgtcatagttatgaaacaagtggtctgttgcgaataatagtgaagcactgaaattggagcacatccatcattatcccaattgtattagttcattctcacactgctataaagaaatacctgagactgggtaatttatatagaaaagaagtttaagtggctcacagttccacaggctgtacaggaagcatggcagcatctgcttggtgtcaatcatggcggaatcttaaaggggtagatggcacttcacatggctggagcaggaggaagaaagagaggcggggagatgctacacacttgtaaacaactagatcttgtgagaacttactcattatacaggagcaagggaggatgctgctaaaccattcatgagaactttgcccccatgatctaatcacctctcaccaggccccttctccaacattggagattaaaatttgacatgagatttgggtggggacatgattcaaatcataacatcagtaatgtcaccttcactagtcttcacactttctgactggaagagaaattccttagactatgaggaatttcaagtaagatgtgttcccagtattaatgtcattaggtgcatgagtctccatggaatcactaccctaaacaatctgatttgaacaatccgatttgagcaggacccggcttgttttaccagtgtgccttcaatacactttgttcttgctccctcactgcttgtctctcttcagtgggtctttttttttttctgcttgtccagtctccccttctcttggacatcttcctttaggaccctaagagttggagatttctgtctactctccacttcttcagcaaattatgttacaatttacaatatttatatgatccttatcgtataatgctttatattgctaattattagttcatcatattgctgtgtcaggttccagcaggaaagcaatggcatactcaaataggctgaacagaagagtgtttaataaaggtgtgcataggacatgaggaaaaaatggaaaggtatgtgtgggacaaacaacaaaagatagttcaatactacagggctgctggaagtgggttctgtttccatcccaaggcctataggttcaaggaggaggagtagttacttcaacctagaaaaagacagatgtatgaagaaaggttccttataggggccttgacctttagtagagagaggtagccagctcatgatgattccacaggatgagagccaagggaataaatttcaagactttcctttcctcccttcctctgatctcctactgatgcttaccgttggtcaaaaacagctgcaagccagagatcaagagaactgatttatacatttcagaagagtcatcagggcacagaattggggagagaatggtagagtagagctagaggggcaaagggaaaatggataacacaatcagatttattaagggctgaaactcttttatctactttttgtatttctcatggctctgcaaggcactgcccacagcagttgttcaatgactgtgtcttcattcttttatgccagcacacactggtttgattcctccagaatgcctcataaggatgagtgacaaaaggctgcccagtggtaacattttgtattttctgcaccaagattcactcaaacataaactattgtatttccttaatttccaggcccaatttccttaatgtctttaatagaaaagaccagtttcttgagaaaatgcagagacagttataatttggatatcttaagtaattgccaaaaatataaattcaaattaaactggctgtcatatatgttggaagtccaagatactattctcagatcctactgatttagtctcactgactataagcacattgcattctgtgaagaatgattatgtgtacaagtgtgccccacgttatgagaaaaatgttagagatgctgaatttctaaaatgaataaacagggtaattgtttattctacagaaggtgtattagtccattctcatgctactatgcagaaatacccaagactggtaatttacaaagaaaagaggtttaattgactcacagttttgcatggttggggaagcctcaggaaacttaaaatcatggcagaagacaaagggaaagaaaggcacctttttcacagggcggcaggaagaagtgctgagcaaagtggggaaagccccttagaaaaccatcgggtctcatgagaactcagtatcatgagaacagcatgggggtaaatgcccccatgattcaattaccttgcatctggtccctaccttgacacgtggagattttgggaactacaattcaagatgagatttgggtggggactcagccaaaccgtattggaaggatttctaccataacggaaagattaaaatgggattttcattatgtgggtagaaataagcatacttcatttttacaagagacactttttaaacaattaaaacgcagattgaaagtaaaggattaaaaaggtataaccaagccaggtgcggtggctcatgcctgtaatctcaccactttgggaggctgaggcaggtgggtcacctgaggtcaggagtttgggaccagcctggtcaatatggtgaaaccccatctctactaaaaatacaaaaattagccaggtatggtggtgcatgcctgtaataccagctactcaggaagctgagacaggagaattgcttgaatccgagaagcagagattgcagtgagctgagatcacgccattgcactccagcctgggtgttgacaagcaagactctgtctaaaaaaaaggtataccatgaaaacactacacataagaaagctggagtgatgttactgacattaaagtagacttcagacagagtatcaccagagacagaggaatactccatagtggtgaatgcatcaattcatcagaaagacatacaatttataaatgtgtatatacctaataaaaagtttcaatatccatgactcaaaaattgatagaaataaaggaagaaatagacaaatgcaaactcataattggaaatgttaacaatcttctctcagtatttaatattaacaactaggcaaaataccagtacagacatagaaaatctaaagaacaatagacatgtctagaacactgtatcaaacaactgaataatgcacagtgattttgagtgtgtatggtacattcaccaagataaaccatttactaagccattaatacaagtctcggccgggcgtggtggctcactcctataatcccagcattttgggaggctgaggtgggcggatcacctgaggtcaggagtttgacagcagtctggccaacacggtgaaaccccatctctactaaaaatacaaaacagccaggtgcggtggtgccgcctgtagtcccagctactcaggaagctaaggcaagagaatcacttgaacccgagaggcgtaggttgcagtgagctgaggtctcgccactgcactgcagcatgggcaatagatagagcgagactccgtctcaaaaaaaaaaaaagtctcagtacattttaaaagcttgatgttctttttgatcatagtagcagaaaaagcatttgacaacattgaacataagttcattaaaaaaccagcaaattgggattggaagggaattctcctctaatagggagcatctacaaaaacctatatagctaacgtcatacttaatggtaaaatgttgagtgctgccccctaatattgggaattgtgagggtgtcggcttttaccatttctatttaacgttgttaaatagaagtagtaaaaattctaaatagtggtctgagaagttctaaatagtgctctgagacaagaaaaagaaacaaaaggcataatacaggaaaggaaggactaatattgtctatattgttgaaatacatgattgtttacaaagaaaatcctaaggaatctacaaaatgtgtaccaaaactattagttaaatttagcaaggtcatggaatacaaggtcaatttactaatcaattgtatttctatatattagcagcaaatttttatgtactatgaaaacagggtgagccgtgtctagcttattatttaactttccatgatgattatttcctaaaatattgactgagaagaataatatctttatttttaaaatagcattgtttgaatacatagtcatgggtatttgtccaaatacgtggatgggatagagggtgatatgcttgtgtttgcatcagaagaatgaatagtgactaatttactaatgtggtgagtagcccttgattataggatttaatctgtttgtagtccttggttctttttttcttctttttttttctgtgagtcatggcctaaagaaattctttctcttcattctttaactaatggtctccatgagtacattgattcatagaagagtaactcaagcacaaattttaccggctactttatctggcttcaggtgactggtggttcctccctctgggggttgctgagtcattgcagaggaaagcaaacctaggcaaacagaagcattttctcaatcaactgatgccaaaagtacagctttaccatgtggagattcttgggattttaaaaaaagcaaaaacaaagacaaaaaaactttaaaaacggtctttgaactaaaaaagattggtagctactgatctcattttgtaaatgagaaaattgagtcccagagagattaaatgactggctggaattcacacatctagttaacgtgagagctaaattacgcaccttactgtcttttctccagtgctctctccacccaactatactatctccctaagcaataaaaaaggtcgatctagtctcaaaggactgctgtttagattcagaagatcctgtctgaagttagatcccaaaatgctctgagcagtggacaacatattaaagtgaatttttaattttccaaatgccctattttgtaagagagaatgcatttagtttcacagagaatgcatttagtttcacaagttctgcgctgtttatttcaaaatctttgtttttcttttctttttttttttcttttgagacagaatttcgctctgtcacccaggctggagtccagtggcacaatctcggctcattgccacctccacctcccaggttcaagcagttctcctgcctcagcctcctcaagtagctgcgactacaggcatgcaccaccacgcccggctaattttttttgtatttttagtagagacagagtttcgccatgttggccggactggtctcaaatgcctgacctcaggggatctgcctaccttggcctcccaaagtgctgggattataggtgtgaaccaacgcacccagcctgtttttctttatagtcatctccttataactgtttcccatgcatgtaaaagagtttttaaatagcatgttgtctgcttcttttctgctgagtaaataaatttgcatttaagaaaacaattttgaatttatataggagaaacatctccttaaaagtaccataaacattagagcaaattattagagccaatcattgattcttcttgtctgaaaagttttaggaattctttaatattatttttgtacatataaacactcaatatttactgaatgaatgatcgaaatgaacgagcaaatgaataattagaatgaataatggtttaaaatccctagcaggcctttccatatctgaacttctttgctttctattataatttaataataagccttttggaaattaactcaaatatattccacttgaactaccaaatattctaataaatatcattctttagtcagtgtgtgtttatgtatgtgtatgtgtgtgcatacatacacgtgtgtgtagatagatataacacacacacagagaaagaaatagaggagagaaatatttggaaagggtttccagttcagattagtttctgtccaaatcactcatacatttccaaaaataaggaaacaataaagcaccaaatcaataatctaaaaatatcctgtgagaatgattacatttcagtgctctggctccctgctggagcagaagaccagggtgaaagcagctgctgctgctgctgcagccaacagagactcaaaagtctgggttcaactcaaggcaccagcacaatttgaaaagacccgttcttataatagctattgccttgtagagccttggcaatctacccatttactaatgagaaagtagggtgaagattagcctgctgaaaatgccgaacattaagaaatggcatgaacaatgttaggaaataacttctctgattttaatgaaaatgtctcttctgtccaccactgctttaaaaattcaattaattaagtgtggaacatattaaaaaaaagttcaccatttgcgtgtgtgtgtgtgtgtgtgtgtgtgtgtgtgtgtgtcttactcatggctatagaataagactaaaactaattttcgtgtatgcctatagagccacctcatttatgtgtataaaccaatggtggcaaaaagatttcatcttgtgtaccacattcaaattgcaacgactgcctaacccagtatgctgagaaggattctgaagctgtatctaaagtgcagtgataattagtaatgatgattctctgctcatcccagatataaacccacctgaatggggccacaccccccaggatgtagaccgcagagttaaaccatttgaattctcatctcagatgttctagaaactctgaatctaccaagacatttattagatctttatagggaaaaaaaaaaaacctctaccctcctcctggaagtagggttgtagttaaaggggcatgaggcgagatggggaaattgttgaacagagactgttcctgattgtctgaaggagacttgatttcatgtattctgcagatcgtttcattgggtagtctctcggcttagcttcctcttctggatgtgatggtggctaccaggccatcagcctctaacttgaagcttgaattcatcattctctattacatcagagcaatttagagctggatgtcagattacgagctacttttttttttgagacggaggcttgttctgtcatccaggctggagtgcagtggtgcaatctcggctcactacactgcaacctctgcttcctgggttcaagcaattctcctgcctcaacctcctgagtagctgggattacaggcacatgccaccatgcctggctaatttttgtaggttttttgtttttttttttttttgtattttgtattttttgacggggtttcaccacgttggtcaggctggtctcaagctcctgacctggtgatccgcccacctcggcctcccaaagtgttgggattacaggcataagccaatgcacctgaccaccactttttaaatacaaaatgcaactattatatttctggtagtagtagaataaaatctcactaatgactgatagaaaggtaatttgattatatcatcagggtttctcacagacccatttttgcctgccaggacacaaccttggatgtaactccttattttcttcctctccctacacacttttacgggaaaagcagagtcctaaaaagttgctggggaaagacaacatgccatatgatcatgtgctgctcacgtcgaccacaagtttccagacctcaaggccctcttctctacctctgttacaccctgtgctggtctccattttgggactatattccaatatagtgaaacttccatacaattccactgtattgaaataatattttatgtgtctgcttctacaatggattgggagaaccttgtggggagggactatatcttgcccattttgcatctctttcatctagtgtggtatttggctcatagcaaatgcttagtaaatgtttgttgaactgaagtggacacctatcagtgcatttccaggtggttttagaaccatacttgtcagaaaatgtttaaaaagaaaaagaaatgaatgaagaatagtgagctagtttaacctgttaaaggtacatattaaacaattaataaatgtttatggattggagtggaaaaatgagtgattcttccttaatgtttcttatatgtaggatgtgcaagaaaaatttgagaacaagatgcactaaagatatattatcaaattatggctggactttaggtgttacttaatgcctcaaatattggctgatgatatgtttaaattattttttcattaccaatatgaaagaggagagttattctgagataactctctgagataagcggagagatctggttaagacctaatgaatagagtgcaataccatcactcctccatccattaataacttaatagccttatgaatttctttggagacagtctttgtgtttgagtggtaagaaataaatgtggataagtgtgaaataggactatattaagcatgaatcttcttttgaagtgttagcttctttcagctacgtaaatcaaagtaacttattcctaaaaaaaagataccagtttgcctttggaataacaccaaagttttttttttttaaagtactttcatgtaagtttcaaatggaaatctttaataatgacattttgtgtcaagtttttagtctattttccattcagtaggtttgtgcatgaagtattaatggtgctatcacataatttctcactcttttgtattctcccattatcagttcacatttaatatactctggagttttattttcctccaagaaatgcttttaaaagatttgaaaatgtgcttcttcctttaagaatgtctaaatcacttttctaatacttcctttgaatagatgcaatatgtgtgaaagtataaaatccagttgtccaaagtaggtagatcaaggagaaataacactgttatttcttttttaaatgaatacaatgaaactaaagatacatatttttagttagctccaaattttttttgaagattaattgctatgcagattaaataggaatttggaccacatgatctttaaggattcttctcaatctttgcttccatgaattcatgaacatagtagtcaatatacgtcaggattgtgttcacataccaataacagaatctcatgggcaatcattcctatagtcaatatcatgaatttaaatgttaaatgtttgtaagaaggcaggtagagagagctggcttagaagtttgctaaatggggcagggtgcaatgcctcatgtctgtaatcccagcactttgaaaggccaaggtggcaggattgtttgaggccaggagttcaagaccagcctgggcaaaccaggaagaccctatctctacaaatacataagtaaataaataaactgggcatggtggcatgcaccagtagtcccagctattcaagagctgaggtgggagaatcacctgagccaaagagtttgagactgcagtgagctatgattgtgccactgcattccagcctgggcaacagagcaagatcctgtctcaaaaaaaaaaaaaaaaaacacatacacacaaagaagtttgctaaatggtgacattaacaacatgctgaagaaaatctctgcagtgatttttcctggctgagtctggcaacatcggccaacattatcgtccagtcatttgactgcttcttaatagacactgtttgcagtttattcaatcatgcattacatgcactagtaatgaggaatccataaactgatcaccatgaaccaggcaggcatagctcaccccacaggtgtagaaacagctgatgtattttttaactttactcatttgccttcgtttctccctcccctccaatttcagaaagttattttgtctaatctcagtgctgtttgcctagtgttagcacttatggtcataaagatcatgttttacattatatgttatttgccctctattcataaagggcacataattatagacagttcaggctcattagctcttccagatgatctgtttgcctctagtctctccccatccagtctgctgcctgcactgccattagcactctaaaggacaaaataaaatatattactcccatgtatatgaaacaaaaccccagctgcttagcatggaagacaatgccagcccatctagtctcagtctacctttccagaacttcacttctagctcataataggatcctagtaaatactagctgaataaatgtataaataaatgaaatagatgcctgaataatcaagttagcagtgaggaaaagacatcttggggaaaagaaatagctttgtaactttacattcatttccttattgtcaacctggtatatactattcattaaaacttcaggccaggtgcagtggctcacgcctgtaattgcagcactttgggatgctgaggtgggcagatcacgaggtcaggagttcaagaccagcctgaccaacatagtgaaaccctgtgtctactaaaaatacaaaaaattagccgggcgtggtggcgggagcctgtaatcccagctactcaggaggctgaggcaggagaattgcctgaacccaggaggcggaggttgcagtgagccgagatcgcaccgttgcactcccaggtgacagtgtgagactccatctcaaaaaaaaagaaaaaaaaaaacttcaactttttcctctttattaaagtcctatatcttgagagcctaatgtaccccaatcactcttattgaaatgaagatttgagccataaaaatgaagccacagaaatgtatgtttcataaactaattttaatgatatatttttgaatccactaacgatatactctgttcagcagatatgattaattaggcttctgaaaggacagagtaacttagtaactaacttatttactaaagtagtagaacaatatgcatttggggctgtaagagattaccacaggatcatggaaatggatagtgtcttagttccttttatgctgttataacaataccacagcctgggtaatttataaagaacggaagtgaatatggcttatggttcttgaggctgggaagcctaagaggctgttgccagcgtctggcaagagtcatcccatggccgaagggtggatgagagaacacaagacagcaaagggggctgaactcccactgtaatggtattaacccaattgcctcccaaaggccccacctcttaataccaatagaatggcaactaaattgccaacacgtgaacttttggtggacatactcaaacaataacagatggagcgcagcttttcaacaggaaatggctaaaccaccaaaataaagattcatatactagttgtctccctcagtgaaaaaaaaaaaaaaagcttttttttttcattttcatggttaatcatattgatacactttggatttttattgttgttattattttacttttaaataccctacaacttcactgaggtcccatcttgaccactcatttctgtgtagaaagtttcttataatataaagaagaggttaaaacacactttcatgggtcccatttccagagattctggttcaataaagcagaatggagcccataaatttgcattttttaaatggggtgtttctgtgttgcccaggctggtctcaaactcctgggctgaactgatcattccacctcatcctcctgagtagctggaattacaggtgtgccactgtgcctggccatatgaatttgcatttctaacaggcttctagaggatgcctgaacaagggcaactagtgcaaggactaccttttcagaaacaaaaccattcctttgctgtgaaactttgttatcaaatccaaggggagtcccaaaatgctatctgaaccacatgaagaattccttttatctgggctggggatagcctggagcctgggaccaaagctgaccaaagcctcctccaatcctaatttcacccccagtctcaggttgccgtgctattgtcacaaaaatgttgattcaggcaatgctagtggagaagaagccaggaactggagccagagaaccataaactctgtcagctcttagctgcccaacagaggtcttctgagaattaagtcaggcagatctcactagctgcatagaaaaagcaagttcaaaatagaaagatgagcagcagacagaaagaaagatggatattctccagcctcttggagataaaagagaggcaaaccatacctctgctcagaattgtagcagagtgaaaagtctttctgaccaactgtagacaactattttctcctcaaaaatgaagagagggaatgaggttggttatacgtgtggcaaacatctcctgtgtagctgacattttcttactcttaatggagtattttaataataagtgtgtttttctctattttaaagcaatctattttatcaaacttttcttttatggttagagttttctaggttctgtttgagaaatccttaccaaccctaagatatagaaactattttcttatgtattatcttctagactatttatcattttgtctttcacatttagatctgaaaatccatctagaatgaattgtttgcatatcatataatgtagggagtccagagtcattgttttccatatggacatccactttacccagtaccatttgttgaaaagactgtccttttccctactgcattgcagagccacctttgccataaatcagactcccatatatttgggcagtgaatctgtctctaggttctctcttctgttccagtgttctactagttttccttacagcaataccacactatctattgctttattctttttcctcaagattggcttgaagatcaccttggttattcttgatcttctgcatttccaaataaatttgaatcagctttccaatttctgtatccctccccagaaaacctgttggaatttagggattacatttaatctacagatcaatttgggaaaaaatgacatattttatgatattaagtgttccatccatgaatatggcacatgcctcattttaagtcttctttaatgtctaccaagattagtatagtgtttttgtaccatccttcattagattttccccctaggtaattaaatgactttttaaaatttaatatttttatttccattttaagttatttgttgctagtacatagaaataaagttgatttttgtatattagccttatgctaatatacaaaaatataatatgctaatatacaaaaatataatataattatgcagaccatgctaaatttgcatattctaatagttttaaatttttcatttttatatatacaatcatatcatatgcaaataatggcaattgtatttctttctttccaaacttgtgttttatttcttttttgtgtcttattgaactgtctaaaatctctattacaatgttaactagaagtgatgataatgagcatctttgtttcagtcctgatcttgaagggaaaggtttcaacatttcccaattaagtatgatgcttgctattcattttgtatatttgttctttatcacatgaaagaagacctcttgaattcctagtttgataagagtatcatgaatgaatgttaaatattaccaaagctttttccgtatttattaatttattaagattatcaaatgattttcccctttattctattcatttcataaactacagtgcttggtttttgaaaggtaaatcaatttttcacccacaggttaaatccaaattggtcatgatatgtataatcctttttatatattgacagattcatttgctatattattagaatttttgtgtctatgttcatgagtgagatcggcctaaaatttttttttcttctaatgttgttctcaggctttggattatggtagcctcataaaatgaattggaaaatattccctttttttggtattttacagaaggcttttgttagattggtttctagtacatttcaccagtgaagccacctaggtctatggttttgtttttgtgagagttttgaattatggatttaatatctttcataaatataggactatttagactttctgttcattcttttgtcagtatggagaagttgagtttttctagaaatctgttctttctttttgagacagggtctcattctgtcacccaggctggagtgcagtggcaccatcatggctcactgcagccttgacttccccaggctcaggggatcctcccaccttagcctcttgagtaggtaggactacagacatgcactatcatgtcccactgaaatctgttcattttatataacatttccaaattgttttcataaagttattcttaatatcctcttttagtatcttaaactttatagaatatttagagattcatttatttttatttgcaatattattcgtgcctttcctctttttcttcattagttttaccagggattatcaattttattagtcttttcaaaaaaccaaccccttagctataatatgcttattttatattttattactttctactctttatcttttcttctttctactttttagtagaccttaaaaggtctaaatttttctttttttttttaccattttgacacagatagatcactgatttcaaccttgcaaatgttttagaatgtcacaattttgttataatttaatataaaatattattttttgccatggtgatttttcaacccaggaaatatattattagtgtgtcatttaatttctatacatggggattttctagttatatttttattatttatttgattatttatttatttatttatttatttatttttattatttatgccgagcttatttctactacagccattgatgattatatgatttcaatcatttcaaacttgctgaggcttcctttatggctcagaatatattcaacttttatgacaacttctctgtgtgtttttaaagactttatcctcaactggatggttgcagcattataaataaatgttggtttgttaattgtgttgaaatattctgtactctgagttttttgctacttattctatcagttgctcagaaagatatattaaaatttgctactataattgtggatttgtgactttctccttttagttctgttcaagttcagctttaaatactttgagctagcttactagatcatgcaaattaaaagttattgtttcttcctggataattaaaccttttatcataatgacatggcactctttagctctaggtaatacttttctccctacagtctactgctgtgtttgatatttgtatagttttacgagctttctgttgtttagtgtcttcatggtatgttttctcatccttttacctttagctttttcacatctttaaagtgtactctgtatcaaacacctctgaggccccacctcataacctctgagtccaccttttacttagccgtttttgctgtgactagctttgtgccggtgtggcacacatgcacaggagaacccagcctaagacactcttatgaacagcaagtacttgagttttgtttttgtttttatccagttcatatttttttaattaaaatatttattctgttcaaatctaatgtaattacttatatacttaggtttaaatccagtattttacaatttaccttctatttgttccacttgttttgtgtttctttcctcctttcttactttttttgaattaagcaatttttatttttaaatctcccccccaccatgctagttgattgtatcttatgtgacaactttttttgtgattattctagagcaggggtcagcaaactatggcccatgtgccaagtcctactggctgcctgtccttgtaaataagttttattggaacacagccatgcccattattttgcttattgtctgtgctacttgcacgctacaagaccatatggccggcaaagcctgaaatatttgccatctggtcctttacagaaagagtttacccactcctcttctagaaattatggcatattatcattaactaacttattaatgtctcatagaaatcagtacttttacagtggtaaaggtacaattcctgaacaagtaaaagattttagaacagttgaacttcatttactgcctcatgatttatgtactgtctttatttgtaaataccacaagatacttttactattcttttatatggttaatatttatttaggtttacctacatatttaccattttcattgcccttcgttcattcttctgggccaactttctatcctggatcatttttcttctacctaaagaatactctttgatgttttaattactatagaatttctgatgacaaattctctcagtttttgtttgtttggaaatgctgtatttagtcttcagttttgaaagatttttttgctggatataaaaatgtaggttggcagttattatatatcaacactttaaaaaaatagtgtcattgttttctgactttcattgtttcttttgaaaatttagctgtcagtctaattgttgcttctctgaaagtaatctctcatttcttttttggctgctttaaagatattttttggtctgtctaggttttcagttttactatgatgtgcttagatctgagttttctgcttattattgttggtttttgtattgcttcttggatctgggacttgatggcttttgtcagtttggaaaattcttaggtattatattttcaaatattgcttcttcattttctctccgtttctagagccttctaaccatgtctcaggtgtctcttttgctcctttccatattttttctacctttttcttcttttgcttcattctggattattttcttctgacctgtcctttttgttctcttttcatttgtctctgttaaacacattcaatcaccttaacacaataagagtttgagagtatcctaaatgaaatttagttatctaagggtggttcacacatactctgatggtataccattttggagtccaacaaaagcctgggggtggggtttggtgtggttactttctagagcctcttcccctgggtgggccccatatatcactttttgtcccctaaccctgtgatctgttgaaagctctgtccagaaattacctccatgttaaatgatagcaaagtccagttgtctgtcttttttcctttttttagaaagtttttgtttcaactgtgattttctcttttctttagtactttactttctgttttctgacagtttagcttatctgaattatggagtctagaccttctaacacttcttcataaagaatagggcagtcaaaagtactgacagttaagaacaaggagcattaaaatgagctcactttgcagtctgacacaatgaatatgtctttgcttatacaaaggcagtcacaggttcttttaacagaacagtcattcaagtaaaggctttaaaaatggacagaggaagattgagttgtctgtgtaatgaaagaagaaaaaaagactgaatttgttgattccgcaggagaaacaatatcaataatttgaaagtttacttccatgtagacaaaagtgatgcctcagttttttgggtttttttttttttttgtaacttatttattcactcattcaatcagcacatattttttgagaacatacgctaaggaaaaggatgcaaaggatcttatgaccactgttttgtttgctgatacttctcaacatttcacagtgaatttcttaaaaactttctggggtcttcacatcttttaaaatagaatgatgtctgctactaaagttttgggaaaacataaacaatttaagtatattttccctttaaaatggagcactattggagaacatcaggccataatgtatgcaggggttacaaggaatcccatgagcatccttatggctggggtggagcagtcagctgattacgcctacctgctgtggtgatcttggctattttgtattttaatcttttttactcccagtcatatgttatttatctatttatccaggcttaaaaacagtggaaatttacttctcacagttctggaggctaagaagtgcaagatcaaggcactggcatatttggtgtctagtgagggcctgcttcctggttcatagcggtcttttctctgtgcactcacatggtgaaagggacagggaatctctggtttctatcttatgagggcaccaatctcattcatgctttttatttatttgtgtattcattgtatgttttttggtttgaggttaccatgaggcttgcacatactatcttataaccctttttttttttttttgagatggagtctcactctgttgccaggctggagtgcagtggcgcgatctcatctcactgcaacctccgcctcccgggttcaagtgattctcctgcctcagcctcccgaatagctgggactacaggcatgcgccaccacgcccagctactttttgtatttttagtggagacagggtttcaccatgttggtcaggatggtctcgatctcttaacctcatgatctgcccacctcagcctcccaaagtgctaggattacaggcatgagccactgtacctggccataacccatattttaatctgataacaacactgtttgcataaacaagcaagcaaaaagacaactaataaaaactctatgccttaacttcatcccctcatttttaaacttttttgttgtttttatttatatcttatgtcttgtaaagttatcatcgttattatttttgactggtgcatcatttagtctttctacttaggataaaagtagcttacacactacagctacagtattataatattctgtggttttttttgtgtgtgtgtacttactattgccagtgagttttctaccttcatatgatttcttattgctcattaactaacttttctttctggttgaagtactccctttagcatttcttgtaggacaggtctggtgttgatgaaatctctcagcttttgtttgtctgggaaagtctttatttctccttcatgtttgaaggatatttttgctggatatgctattccagggtaatggtatttttttccttcagcattttaaatatgtcatgctactctctcctggcctgtaaggtttccactgaactagtcatatggcattaatttataccaaggaaagacagcaaattaatcacagttataacattaaatagcttagcagattcatttcaaggtcatctttttcaggcctgaagttgcatttattgatcaaaaatcttatgtattccactcaatttttctgtaaacctaaaactgcttggaaaaagtctaactaaaaacatacataaacaaaatgcaattttattcaaagtattaaaaaaccacataaatttcaagctgtcgctagtgtttcaaaagccaatacctgtagtaaaagacaaaatatagtgatgattgtaattgttgtagtaatcccacataggtagaaggctatccatggccttactgtgtcaagcaaagagaagcacttacattaacagactaaaataaacacaaaatgtattaaagtaaaacatttcagtgcaaaatgcaaaaatttaaaaatgcaagtttttatctgcattcaatgctgagttagaagttttttcttatattttaatatgcgttatctccaaaccaagcacaatatatcattttatttgtcaaaaaaatttcttatgtaatttatttaaagtaaattttaaattatatcttttattatagtggctgaagctggatgttactggtaattatgttaactatgaattttataacataatatttgataaaaataaaagctttaacttcaggtaatctctttatcatatatcatacaaatactacaagtgattctctaattttttaaggtttctcaaaaatgatttgcatgttgtttaaaaattgggaaatactaacttctgagttgggagtttattccttactttgcagcggggaaaactgaggttcaaagggattgaacaatttgcacaaggacaaacaacgaatagaaggcagattctagattcaaactcagtattgtctgattctacaatccatgctcctaatcacctttcctagcatacgcctgtgcttacacagtggcaatgagaattgaagacgagacatctgaacaatgttttctttttattttttttttttttttgagacagagtcttgctcttgtcacccaggctggagtgcaatggcacgatctcagctcactgcaacctccgcttcccgggttcaagtgattctcctgtctctgtgtcctgagtagctgggactacaggcacacgccatcgcacccggctattttttttatttttagtagagacggggttttgccattttggccagactggtctcgaactcctgacctcatgatctgcctgcctcagcttcccaaagtgctgggattacaggcatgagccaatgcacctggccatttgaacaatgttttaaagacaaaatcaataggcaacagtgataacttggatagatagaagtttagatgggtaagggttagaatagatactaagtcttctagctaagagatttaggaaaggagtgttgctacaataaaaataaataagttgagattttatttaggtgggaagttgctgagattaatttttggtcttgctgagtcacaggtaacattcagatgtaaatagagctgtcacatagacatttgaaaacatagaactgggtactattgaaagtcagtgctgacagtgtagatttgaactttatcagcaaaaggtagtggttgaaaccaaaacagtggaagggcactgaaagagtgagaacctggagagggaagagtatgatctaagccttggaaaacacccccacttcagggatctgaggaggaacaaatgtgagcagaggacaaaacaacaaaataaaaaataagaagttaaaggagaaccaggaccacatagaatcatgaaaactaagagatagtaaatgtggctaaaatgtattgagcacctgccatgaaacatacatgctatgtattttatattatttaatcttcataataactcaaggaggtaagttcctgtatctctattgacagataaggacatagaggtttagcaagattaaattatgtgcctgttgttcagctagtaagtcctggggcaaaaaaactggaatccatgtcttccagcctcccaagtccattttttaactagtggtctccagagtgcacaaagcaaaccactgtgatatgggaaaaaaatcattaaaattacaataatagaatcccatcctttaaaaattgtattttcatatatatattttacaatgtgcattctgcactagtatagtaatacatgcatatcatatgtacatgcataatttgtaaattaataagtaattgcggcatatgcttaaaacatttactaatgtgaagaggcagtaaaacactttggagattattgcttcaaaccactatgcaaactgtctttttgcctcgtcccattctcagttgtaagctgcattcacttcatatagtcgtgctatgttttaaatgcaatgctagttctaatttagttaaatagaaactttttacttcataggttcttttcatcctacttcttagtattttctgaaatttatgaagacctttgggccttttagtgctttgtgatagtgaaaggaacagaggccttagaccagacagacttgagttcaaacattaacttttactttactgaccatgtgatctcagacaagtacttaatttctcagagcctcagctcatctatgaaatggagataacatttaccttgcagattgttgtaaaatttagcaatatctttttttttttttttttttgagatggagtcttgctctgtcacccaggctggagtgcaatggcacaatctcagctcactgcaacctccacctcccaggttcaagcaattctcttgccttagactcctgagtagctgggattacaggtgcgtgccaccacctgtagagacggtttcaccatgttggtcaggctggtattgaacttctgacctcatgattctcccgcctcagcctcccaaagtgctgaaattacaggtgtgagccaccacgcccagccagcaatatcttaaggaaacagcattgggcctggcatacagtagataatttttaaatggcaccaaatagtaataataacaatagtacttgtttgctgtagagaacatctgtggcccagtagttcctcccatctaaaatcaagttgcatatataatatttttagcaaagtttggctgagactgttcttaattcaacttggaaacttatttgagcatatataaaaagtgttggctactgcatatggccacatgagttagagaatgctatttacatggactacagtgggaatggctgctcctggccttgggtagagcagcagccctggaaatacactgtcaaaaacatagagggccaaatatatggcagcctccacagaacaaaaggaaatgaatgcagctgcccacacatgcattagttggtatgttgaatgcctctctatttgttgatgctctccacagatctgtacccccgatttggtggtattcctggcttgtgctaatcagagactcaaagaaagattactgaagcgtgcagaacagcagggccgaccagacgacaatgtaaaagctacccaaaggagactaatgaacttcaagcagaatgctgctccattggttaaatacttccaggaaaaggggctcatcatgacagtaagttagctcgacttttacaagtccaatacaagagcgctctttcagatttctcattagcccatgttctcatgtagaaatcctctttaccttaaaaagtggcttttggggggtacagaaccaatggaaaaaaatgtatcattttgacctgatttgcctttttaagccatcatgtttttttaaaaaaactttctttttaatttaattgatttttatgaaagaagataaattttaaccttggccaaaattctgtagtcctcaagtaaaaaagtgttttaaagtaactgtctgggtgattgtaagcaatatttgtccagtctctccactcttttgtctgtctttggaagcctaacaaaattgatagacttataaccacacagttgatgtggggttataatagatttaagcgttgtttgtcatgatctactacataaagaaatgaggttctgacttcacagaaaaagtttcctaagggtttgacttgtcataaagaagtgataatgtatcaaaatgggaggtagtcacccttctgctcctttgatacaatgcaaatattaatgttttcctaaatttttagtttgttttatggctaatgatattcaatgtgccaatgaaagatgacactgaatcattagtttgtacagtttttagaatctagaacattagaggtgaaggttcagctaaatttatgataatcacagcatcagattccagcattaaagcgtagaggagacaaagaggataatgggtcatctgaagaaagcactttatgcaagaggacactaaaaccacagcagctgcttgacagctagatggtggcagaccttggcagaatcctcctctcagccctcgggcccgggccagtggaccaaagagttttgtgtagttgggttacaagcctctgtagagaatctaatcaaagcgatgcatgcccatcccaataaaaagcacataaagactttttttcacaaattttaggtaaatcagctgaagcccatccagagagctcctgtgatcttgacaattcctgggttaaaactctcttcattagactaggatgcccttagacctgaaagagacagacatgacatttgaagaataatttctttgcaatctttttagcaccataaagaaatatttaacgtgatttgctctttgagtcaaagttgtcatgtcgcagagttgtaagtctgatctggaaattgttcacaatgccagggttcatattttgatctaaagcaggcattgagtaattgaaaagatttgggaaaatcagggtggatgcttctgtggctatgttttgttggggttattgtttggtttttgttttgttttggtttggttttttgagttggagtcttgctctgtcacctgggctggagtgcaatggcgtgatctcagcttactgcaacctccatctcctgggttcaagcgattctcctacctcagcctcccaagtagctgggattacaggtgcacaccaccacgcccagctaaatttttgtatttttagtagagatggggtttcaccatgttggccaggctggtcttgaactcctgacctcatgatctgcccacctcggcctcccaaagtgctaggattacaggctgttgtttgtttttctcaccagttaccaacactaacttccacattgtatcataaaaaaagaaatttgccctacaaaccaaaccccaactgtaaggtgcagggccagatttaattgatgtttgtaaggctcaaaggtgttaccagagtgtctctgattactccctgcttgtcacattcgtcatcacaagcagagcagatttctcaaatgaatgcggagtggatattattaatttactaatattttgcatggaggtgaaatgccattgcctctaattgagggagtcaataacaatgtggatgacagcctgtaacctcactgctaaaaccaaatgagctttaagataaatgcttctaattactgacagaaaacttgcctagtaaagtcgccttttggaaagcaatgaacgcaaacacaggctaagctctggggaatataatttgaaaaaatttgacaaagaagcaaaacatgtgtcctcttttagaacctggatcatagtttattgctggaattaaaatatatttggtgacacttctgcttttaaagatgagttaaataataaaaatgatcatttgtattaataataagcatgttaagattttaataaaaatctgggggttaatagatcaaacccaaatatttccttttctctgtagttttttttttttccttttctcccacctgcccctcctgattcattcatttactcattcagtaaatatttactgaaaaccaggatactctgctaggggacaggggtgcagagctaaataaacaaagggtaaggatctttattttggcacagacatattgcagacacctagaacagtaccttctcactatatagtaagctccaggaaatgaacagagcttgcagtgtgtggagaaagagacattaaacaatcagttattaagtgtgatgactgttgagttatgtgttataattgtgatggattattaagtgtgaaaatgtgcagggtgtcctcacatatgtcatgcactgttttagggattgggattccctgtggtgaataaaatagactgtctccacactccaatagcattaatcacttatctctgcacaaagttcttaagggccacagagaccatgtccctgtttagtccagttgagaaacttcatgttagtacccctcttctctggcgctttggtgtctgaatcctgtcacttggaatctcagttccgttgccatttaataatttcatgatgccctacaaggtatagcctctaggacttgatctctctatctctaaattggagacagtgttacctacctcataatattgttgtgtgggtgaaatgagagaatatgtataacatggtagatgatagtaatgcagagagcgtgttttaagatgctccatgcagccgctttgcctgattcagattccagctgcaccacctaccacctgtgtgactttctgcaggttacttatctgctctgcaactcgtatgccttacctgtaaaataggtataataatcaatcctacctcagtgtgattatgaggagtaaatggatgtcaagagcttaaaacggtgtctagaatattgtaagggtaaatgacatgattgatattattgtacagtttttatatttctttgtctttcttccttccccagcaaatgctcatcttttagaatctacagtaaccactagcaattctgtgccctttgagggaactctgttgccttttctccaatacataggttattgaagaaatccaaaatgaataggttgtaaaaactttagacataattcatctttttctttaaaagtgtctattaatgagttgtaagtttgactcagtgtcttctttagattctatattgtccgtgtaatcaagctacatagtggctgtgtctgaatagtaacagacatcattccactcttttcttttttacctcattgactatatctgttggcatatttgactagagaacaaacccagtttgactgaaaagaaagcctaatcagattagccaagaaaaacatgctgttgcttgaatactgtatcttactgacatagtttccattacatggacttcttcatttttgttcttgtattatacatgtccatatgcagtcatgtgtgcaaatatgaatgaaaataatatgaaatcataaggctagtatattagaaacttcttcatagaactttctcagacatatttatatgttgtctttaacttaccctgaagttggatgtaatttctcaatacatcttttactgctttatgcttgtgattaaagattaggatgctgtgagttcccaatgtttggcagaagatttttcttgtagttagtttagatattgctggatctaggaaagctacttttactattgctgagtaagctgtgtctcttgacattttggagcacttggacttgaaactgtataactcttgaataataatttcccttttatagatttttacagttccaataaaatgtctgtttcatgataatttttaatctttcttgtaaaagtttttttcaactagtcttcatttcaatcagtctcaccaagttggaacactttttttcttttttttaatttatatttattgtacatgaataagttctttagcggtgatttctgagattttagtgtgcccatcacctgagcagtatttactgtacccaatgtgtagtctttgatccctcatccccctcaggaacccttttctaagaaacagaattaattaagacaagtcaagtttttgtaagttttatgaactttttaaaaaatatatgcaattttgtttatttttaaagaaaaaggtcttcttaaattgtgcaaaaaaaaaaaaagctcagatgcaatgtatatgttattttttccagaatgcattcaaaactttgtgccattagatgttctattcagccagaaaaacatggatttcaccagggaaatggatatacacttgtgtgcattgaaaaaatgctactgaatattggtaataatcattaaaatccacatttagctttagactgtgaagtaaacaaatagtcattttccttctggactttttgtaggagtataacttgaaatcagaggtaagctgtggtcacaggatgtatgaaaaggcctactaattcatacgcaggtttaccaactaaatctcttcagccaggaaaggcagaggctgaaaaaaggttaaaatcaggattatttattgttcaccaataccaggtttcctgggaagtggtcaaggaatgtgggaagggctacactgctatttagcaaggctgtatagaccaatgtttccctaattttagtacttactagaccagaaaaaatattttttaagtaggggtgagatgactttttaattttacgaagtgaaggcattagaaaaaaactcccaatacttgccttatttttctaattttgctgtggattgggaaacactcatcacaaaccagcatcagtgctgggaaacgattgacatagagagcacaggcctgtcaaactacaccattgtttattaccagacattgtccccaagtcccagataaccccattcacactacgattgcttcatttgccccatatcacttccttcaaatttgagaatccccgcattatgcatttcaaatttaccactgaaactatgcacagttgacccttgaataacgcaaggattggggtgccagctcccatgcaactgaaaatccatgtataactttgagtccccccaaacagaactactactaatagcctactgtcaaccagagccttatcaataacataaacagctgattaacacatattttgtatgttatatgtattatatactgattcttaccataaagtaagatagagaaaagaaaatattattaagaaagtcacaaggaaaagaaaatatatttattgttcgttaagtggaaatgcatcatcataaagttcttcattcttgttatcttcacactgagtagactgaggaggaggaggaagaagaggggttggtgcttctgtctcagagtggcagaggtggaccaaagtggaccatgcccttcaaacccctgtcgtgaaggatccactgtaattcccatcccatcagacactcctagccacaggaaaaataagtaggaatagtaaaagttaatttagagagaactgctgaataattatttgttaactgacttcacatttcataggaaccaacactaacatttaaagtataataatacatttatccctaaactctcaacgtacagccattggttaattatcaccaactccacttagcatcactgcacatatggtggaaatggaaagaaaaataacccaaaggagaaaagaatttttttgtgggggatagggtctggctgtgttgcccaggctgaagtgcagtggcgtgacctcagctcactgcaacctctgcctcccaggttcaagccatcctcccacctttgcctcccaagtagctggaactacaggtgtatgccaccatgcccacctaatttttcgtatgttttgtagagacagggtctcactttgtccctcaggctggtctcggactcctgagctaaagcaatccacccacctcagcctcccaaagtgctgggactacaggatgagccaccacacccagccaggagaaaagaaaactaaacagcatgaacacttatcagcaacccacctaaacataagaaaagcaaacaaacatttgataacaacttgccccaaaaaacccattctcctaaaattactaggaaaaaaattctgttacagcgtctcaataggtaaggggttgatgagtttgtaatgtgttacataatgaagctgtatttcctttgagtaccatcacttatatcctgtttgagcatccattgtcatgtaaccaaaagctcccactaattcctatttctggatttagtgactaagaaaatagtcgaggaagagtttttaaaggttaataggaaaggccatggaagtattctggaagatatttacttaggtaacaatgatatctatattcacatggatatatggtcccctaaattgcttttcagttgccagagtgtgtttaaattaagtaaacagtgccttctggcacaaaacctgatgctgatagaacctcagtgagagccctgaagcaacatgagaaataccgtatccatttttgactggaataaagagcagcttaaaaggaatcacatcctctgggcaacaagcacttatcaaatcttaactgtgtgtagagctgccaagatggtgccgttctcagaaaagtcctgttgcttccctaaggagcttgccatctctggggattactcagtgttgcccacttaatttacctatttacatacctatctgtaattttggttttaaaatatccagaactaaattgaaaagtgaatctgattactttcatatactgtcattattgtgggctctaaaacctaaaataccgtgatcacaatttctctttcaatcttttggatagaaaggaaaataaaagcacaaagataaagccatttgctcacaaaatggcaacccgcatatagcaaagtatatcatccactgtcctgggcagcaaattctgctagttcctgaacagcatcaaaacaacaggaagaacaagcagataccacatttatagctcatcctggcaatctgtctctgtcataagcaacgccctgactcacaacttttccatccccaaagctccctcacttccagtcgtcttcacaccccgtagacagaaagcaaaccaaatgactcagcaaatgcatctctctcgaggttggaaactgctgctgattatatggcagtcctactgtcagcatcggatgagaagagctcttgcaccaaaaatgcaatattttattgtgatgttttatacaggtattaacaggaaaaataaggaagaactttaaaaatgaacaacttcctcccccaacagaatgtaaaatatttttctgttgattttattattaccgacactcataaaacagagtctgaagagccccatgaacaattttttaatcatctgaagtagaaagcaaggctctcacatgataactataaaacaaataatgtggacaaaatcgagataattcaagtgaagacctttggaggttcacattaagaaaattctgtgtgttctcattgttcaattcccacctatgagtgagttttgtccttgcgatagtttgctgagaatgatggtttccagcttcatccgtgtccctacaaaggacatgaactcatcattttttatggctgcatagtaacatggcacatgtatacatatgtaacaaacctgcatgttgtgcacatgtaccctaaaacttaaagtataataaaaaaaaaattctgattccaagaactgttactgacaggtctatctacaaatactctagttaaggtctgtgctatttctatgggactgtcttcaacaatagcttgtctttttaatttttttaaagcaaaagaaaacaaattactaaatagttggtagctgaatgtcatgtcatactaacaacttcctataaactgctgtttcaaccctgcaggttctatatgtatacacacccacacacccacacacccacacacacacacaaacacatatttttagctggttattctccaggagacactctgtgatcagaacaataatgttgacaataatgtcaacaaatattccagacttcagagttaggtcttcatttgaaatgttttactaagacttactgagaacatgtgtaagaaaataatacttttggtaatgtccctagactaaatttttttcatgtttaaggccaaactaattggaattaatcaatatcttttaaagagacctggcactatagttaaattaaatgtcccccctccaaaaaaaagaagacaaaataaaagaaaaagaataagcatttaaggcttgcccgtcaggaaaatacaacaaaatattatgaatagatggtgccttaggaaacaatagctaacaattcctgaatgcttaatacgtgcctagtactattcggaatgtttctgttctcacttataagtgggagctaaacattgagtacaattacctatataacaaacttgcacatgtacctctgaacctaaaataaacattaaaaaaaactaaaaaacaaacagaaaatgtttcacatacgataactcattatttctcacctaatcttgttggggcagatactattattatctccattttgtaaatgagaaaaacgaaagcacatgaaagtgtagcctaccaggatcccacaagagcagtggagtctcaacccagatcacactgctggccccaaaggctgttttgtgatcattctgttgttcattcatcaaaatgctttctccaggcacttgtcatttgacaggcatctctatgcagctgtaatctcttcatttctgttttttagaaaagaataaatgggaaaattaattatattggtacattacattgagaagttttaaaagtaatttttgctaggtaatagatgtaaaataattaagataaatcataaaattgattaagcacacattagaagtgaagaaattatactacaaatggccaattgttggaccttgtatttttgtttatctatactactatctctttcttacctatctccttcttgctcagtcctacaaatcgaacgtaaaactgaggcttcagttctgggacaggcaaagcactgtccttgtctcccttaagtcttacgttccatttccccattatgatagtccttttatagtcattcattcaaaccattttattgagggcctatgtattcatggcacccttttcatcagacaacagtgatcctccttttactcaacagctatctgttgacatgcctgatcatgacattttcccatatccagggtaccacagcaggcactgcaaggaatacaaagatgatgtggagccagatcctgtcttcagggagtttgtgacgcaggcacagagatgatagaaagataaataacttgaactcagctggagaagtggtatgagccaccacactgaagtaatagaacaggccaggaagaataaagggcagggagtgacttcttcctggaaagattagggaaggctttcctggaaacattgacccttgagaggcaggaaggagttggaacccagaaataggaaagaaggtcatgataagcagacacgtgtagaacagagtagtgagaagtagaaaccaggggacagaggtgctgtcatcaaactgagcaaggcactgaagtgctaggctaaggaggaagggtttttctgttggcaagggccacattgaaaggcttggagcatgggagtgacacagctagaaatattaagctggtagctgtgtgtgaaacagtgaatggaggaagcatctggaagaggcgtgacaagggcctggactggaatagtgactgacacaaggttttacttctccatatggcagatcggcaaccatctggcacggatggcaaacatgggagtaattggaaaagttctctaagggaaaatagcactcaaaaatcacctgcatcataggcgtaacatacattttcccagtttaaccattttggtttaccctttggatagtgttcatggcaaggctgaaaggaaaggagatagggaaggaaagggaatgtaatcaggactctgacaagctaaagcattatcaagtgacattaaaatccaagcaaagggagagtagagtcagttgaatcacaaatttttctttccactaataactgtttcaaaatagttcattaagtaagttaatgaattaattcaatcgttatacatggaaccatttattttcatggcagacagccctgcacatcttgcagcagtgaggacataattccattaaagcactgtgcaataattggtcttcaccaaaaataaaaggtttgtttcattacaataaaagaataactgggccgggcgcggtggctcatgtctgtaatcccaacactttgggaggctgaaatgggtggattgcttgaggccaggaattgaagaccagcctgggcaacatggcgaaaccccatctctaccaaaaatacaaaaaattagttgggcatggtggtgcacacctgcagtcccggctacttgggaagctgaggtgggaggatcacttgagcccaggagatggaggttgcaatgagccatgattgcagcactgcactccagcctgggcaacagagcaagaccctgtctctaaataaataaataaatatatgaatagctatggcttaaattaacaggtttatttgatgtgtgtaaaaatatgttcagagatggacgatctaggagtagtacaatgactacatggtgtcatcaaggacccaggccccttctgtctttctgttccaacatctttaatgctttctcatagtgacaaaatcatccagtctaccttccacacagaaaaaaggtgagatagtaaagggctgggaagccacagctattgcctttctttaggaaagcaaaagctttcccataaaccccctctccctccctcattgactggcacctgtatctcattggtcagaagtggagcatgtgtttcccctaccttcaggggaggctgcaaaacggagtttttagctttacaacctctgatgtagaagaagacaaaggagaaaggagctggaataaatgagtgagccaacctacaataaccaccaaaaggttaaaaataatccttttttctgtttgaaaagatacgtaaaatacatctgcaagtaattcttttttttttttttttcttgagatggagtttcgctcttgttgcccaggctggagtgcagtggtgcaatctcggctcactgcaacctctgccttccggtttcaagcaattctcctgcctcagcctcccaagtagctggcattacaggtgcctgccaccatgcccggctaatttttgtatttttagtagagactgggtttcaccatgttggccagggtggtctcgaactcctgaccttgtgatccgcccaccttggcctcccaaagtgctggaattaaaggtgtgagccaccatgcccggcccatttgcaagtagttctatgaaaaatggttaaaatagaaaatgtgcttaataatattagctacttttcagtaagcactttcaatataccagactccttattcatcttatatctaattcttccaacagtgttttaaaattaatgaaagaaacagaggcccagagaaggtcaggaacatgccataaagcctgaagccagtaaacaagggagctgaggtttgaaatagattctatgttagaggatccctcagttaatgacagggaattcaaccagaacttatgtccaagtagagttaaacacccctctcaaaacagccagaaaatatattgataatgcctgttaatgtgaacctgcaggtttttgctgtttgagaagcaatgatacctgttaaaaggtgaactgaggcacaataaaatttgaaagagtttatttgcacaaacagcgactgataaattgaacaactccaagctggaagtggttcaggagatccaaccagggaacaccaggggaaggcttttctagggcaaacacagaaggaagtgaagaaaagaaaacatttgattggttactgttatacagttgccttatttgatctatcttgctggaaagtccttagttaaataagttatttggcagcttctgataggttagtcttaagtttcattttttctttaatacaggcatttacaagaagtagcacaagtttggtttatgtttgcaaattgagcaaagttaaggtcacttatgagacctaattggctttatcttctcagagattcttcaagtctggtctccattttaatttacctttacatacttaattatttttttaaaaaaaataagaaatttgtttctaagagatgtgaagaactaacatactgtatccagtgcagcgccaactgatttacacatttttaactattttaatcactcacctctgtcatgtaggtattaaaattatttagtgccagccaggcatggtggctcaagcctgtaatctcagcactttgggaggccaaggtgggcggattgcctgaggtcaggagttcaagaccagcctagccaacatggtaaaatcctgtctctactaaaaatacaaaaattaggcaggcatggtgttccatgcctgtaatcccagctactcaggaggctgaggcaggagaatcgcttgaacccaggaggcggatgttgcagtgagccaaaatcgtgccactgtactccagccagggcggtagagcaagactccatctcaaaaaaagaaaaaaaattatttagtgccttgtgtgtgccaggtgtttctatttagattatctcatttcaggtaaagatagggacttgctaccttttctcagataaactctaaactgcgcagtcttactcttgccttacccactctgcgtctcactctgacattactccttgatcccagtctgccctgtttcacccttcagactcaactgctgttgtcttcctcaatataatgggcttcccttgtctgtgtttttgcctcccactcagctggcctctggagggcccttccccaggcacaactgcaggatgcttccagctagtttaacccaacctggcaggtgggacacaggcaggtacacagacacgccactgctctgagggagcccatagagaaaagggaggaaaggagatcagtgagtggcctcattgcatctgaccattgtaatgataggaggaaggatgtacaaaaggctgcaggagggagtaaattgcacctgcctttccatgataactctggtgggactggatgaacttgacactctggaacagagattattccatgcattcaagaagaaatgagacatctgaaatttctaagtggagttacagccattaccaagttcaggattggaaatgggagtaagtggtgggaaagacagaatcaagagataagcagccagggaaggagtagggaataaaataaattttatctaaaccattctaatttcttgttgctctctccctgctcaacaaccccactgaggaatttaatttagcttagtataaaataatctacaaatatattcattcatcaatttctttttaggcaattattctgagatttctagctaatgggggggtactgaaagatgtatgaaaatgttgatttttggctttaagagctcctatatgaagtaagaaagccaactctgaatttaaagggatgtctgtggaagggaagcttgaatgtgtgtaagttgtaatgtgatgcaggctattcttttcagtagtccacttagtagggactgtgcagccagcgcagtgccagactgtagtgggtgctttgaattatttgttaacttaatgcatacattaatgaattgtactacatccgttcatcctaataagctgagagtgaacaagaacctctttagacttcattcactaggattgaataaacagcttttcagtaatgcttcaaatttgagctttcaaaaattcatgctttccactgtggcctagtctctaaccattgccaattcacaggttatttgaaggtgtcagcaaccatgagagatttctcagaaaataccacagagtgttgcttcaaagaatttccacaattgctgtcaagttcaggatcaaggaggaaaaatagaagtaatagatttttttgtaaagaaaaaatcttgtatcttacctgaaagtttaatttcaaaagataaatagtgctgtgtattataagatatgatttttcctctattctgaaatttatgcttaaaaatctgaatacagacatcacgatcacttgatatatacttgataatgtttattttttcgtttttttaccaaagctttatttagagttcatatgttcatgacaaatgaattctagcagaagcccaaaaagatgatatggtctcatacaactgaatgattaatgcagcagtaatttccaactaaattctgtctgtctcagaagattttgtaaagccttaggtgaaatccttttggctcagtgagcagttgctgcatgactgcagcgtacttgtgattgctggctcatttcatcggttcaatctgaattcttaaaacaatgaaatctgatattaaaaatatcaagtagtgcattttctaaaatcccatggataggtaattccacagttgtactgctccacttcatattctgtgaaatgatagccctactttaaaattgtaagagaagagacaaaacataggaaacttcagttatctcaaattttcctctgttacttgtagttgttcaaaatggcattctctgcagctaaggacttttccctctccctgcagtcctgatcaacctcatcaccctgtcttgacctggattcttctgggaagccaccctgatggggacagatgcccccactctgaggtcccataacaccccattttgagtccattcatggcaattatgttattttataattctacttctttatgattctaccatctttctactataactctgtctttataattccactgtctgctctcctttttataattctgctgtcatcatcaatattttatttccagcagctggcttggagcccataaattcaccttcaatatatatttactaaatgaatagacattactggactgtgaattttttgatgaccctcattaaatacacacacacacacacacacacacacacacacacacatatatatatacacacacttaatatatatagttaatatatatgggggaagaaagagcaaaaacaaagcctgaaaaaatgtttccacttgaaaaccatttttcaaatcttctctgcagttgatcataggtaacacctttcaagatctctagtctttaaattgctgtaaacatgctttgttttcattttaagacttagatctcttggttaaactgcacatcaaattttgacattttttgcttctacactcgcataaagtaaattgaaattcttcaaataatgcaaatttcagaaataatgtgtaatgtcactgaaacaaaagctctataagagaaagtattttgactgaattctttactattgtatctcaatctcctagaacacttggtacatagtaagtgctaaataaatatttgttgagcgaaacatagatttaaaccaacaccctaatcacaacctggatttggaaacataaagagaagaatatagaaaaaatgaacaggaccagacaagtgaaagcaactcttgtctatcaaaggacaaaaacagggctggtgattaaaaactcagaagtcaggggcaaacagatcacagttctaggccattcacgagttcttgaccttttgcacaagtttttgaaactcttagggcctcagttctaccatctgaaaactgaatctcataatgcctgcctcctaagtgggctgtgaggactgagtgagaaaaggtaattaaagaactaagcacagtgcccagcacagaaaaagcactaacaagacacagatattcttattattttgatgagattggccttggtactgtccagaagaattattagtgctatggtagccatatgtgctatgtactttcacatactgattctttcaatgtattggatttctgacaagagagaaattcccataatccagtggtatttttaaaatctcaggaaagtggctcccacagctcctatgaaatgatgagctgagaaaagtgaacacagcttaacagtcagaagaagtgttgccaagcctgtcaccaactataaaagcccttcagaagctatttgataagctcttgtgttgattttttctctcttcttctgtcttcttccgatttggcttccactgtctattgatttttttcccttctctctctttgagcatggtctcagtagacaccaaggacattgggtaggactgccaatttcatattttgttcatgcctatgttattcacaaaccttctcaatttttattatattcaaataaaccttatgctggtgaaatgttgcaaggaactcaatgataaatattacattaagcaaaatgtagtttggtatggtgatccaagggctgactttgaagtcacaaagacaagggtttgaattctggcaagtctcttaatctctctaagatgaaatgtcctcatctgtaaaatgggaatgaaggtaagtgacttgcaagattaattaaggattatagataatatatataaacctctcatatcacatgagtgttgaaataaattatatctgtggttattagtgtaatctataatagcatatactccaaaacataaatgatctaatcaaaatatgtgctaaataatgacaaataataccttacattcattgagcacttcactgagctggacaacatcatgcaaatatgttttaggaagatgataggtacctggtgatcaattctcttctactgcatgctcagttatatctaaggtatatctattcaaagtgatggattccatgagaaacctgaaatccagttctgagagctactcattacttttcaaaatgactaaatcagaagacaacaccaacagctacttattttaatgaagacatttttcagaagaaatgtcaaccacaaatctgtcttggcagttgcacgccatgttattttctatcattttacttttcaacattggcaagcgggagctgcctgaaggatgagcagctttcaagtttctatcaagagaaggaaaatggagtctgtttacttctgtttttagttctttctatctaaaaatcttacagttcctttttaaaacatgtaatatttatggagagtagtgtgtgtgtgtgtgtgtgtgtgtgtgagagagagagagagagagagacagagagatcaagcgtgtgctcatctatgggtgggtgctgctgagggtcaagaatgcagaagaatataagaagaaagtaaaaatcacccattattctgaagcccagaaataaccattgttatcattttgagtctttttctgtgcagtgtttttctatgatattttgacagtatgatggttgaaatcatattgtactctgctttaaaaattttttaacttaaaattattcacaagcatgtttacaaggcatcaattgggcaatttatttacccccaaaagcctcagtggtaatgacccagtgtttctacttcacagagttggcatgaggttcaaattagaaaacacgtgagaaccctttgtaagtcacttacagaacgcacaaatgaaattatttgttctcatctccatgtcttgaggagtcaaaaggtccccattgattaagcagctgcagaaccctctgcagatcactctgaggatctagaaaagaccaagacaactattggtctgagagtttacagaatgatcccagagataaagccaaaacatgaaaacattaaggaaaaaagtagaggcttaaactctccttttgacacaagtagaattttgtcttaattacttaaaaagattatccaatactgaattccttctatccttagctctttcaatttgaaaatgagtcatgcttcaaaaaattattttttcttacctcagacaaaattataattttacctgcaataatgtgatttgtcagttgaatagtaagtttcctatcccctgaaaaaaaaaagaggaaagaaaaagcctatttttgtaaattcagattatttataaggattggtttaaattaaaaccagtgtttttactgaggaaaaaaaatcttgaactaaaacaaaaaaaaaagaagaagaaaaggaaaagaataaaagaattacaggcggtgcatggtggctcacacctgtaatcccagcactttgagaggctgaggcgggcggatcacgaggtcaggagatcgagaccatcctggctaacgcggtgaaaccccgtctctattaaaaatacaaaaacttagccgggcatagtggtgggtgcctgtagtcccagctactcaggaggctgaggcagaagaatggcgtgaacctgggaggcagagcttacagtgagccgagattacgccactgcactccagcctggcgacagagcgagactctgtctcaaaaaaaaaaaaagaattataaaagagaacccattaagattctattaatttatgttatagaaaaaattaaaactatttgttttcaccacaagcatataaagaatattttttcataattaacatgttactatggaaaatccatatgtagcatgttaatgcctggaagttaaaatggtttttatattttttcttatccttttctacaaattttttatatgtattctgtaaacttttttgtaaaaacttttctgtaaatttttaacatgtatactgttgataatctgaaaaaaaaatggataaaaatggtttaaaacagcatatacttcaaagtaaaacataacagtaaaccagccagctgaaataaatgaggaatgggagaattcagctcaaacagacaaaacatagcaatatggtatctgcaggaaaccaatcaaatatttgccataagggaaagtgcatgcataacttattcgaactttttataaatcctctccctatgtaattcgctagctttacttcacattatttatttggtttcacagtatgtcaaacagctgtcaaatacaatggcagtgttttttcctgccttcatgaagtctaccaggaatataaaatatcagaagttgtccaaagttaaacaactttgtcagagccgggaattgaattaataggccaagggacgaaccttgagttagctggagctgagagatagattggtaagggaccaagtagagtttaccaatactcagaagaagatgaagaataacacaggaaaagaggtcaaatgaagcagtcagcacaaagagagggaaatggattttcttaggggccagcccatagaaagcactaggttgttttcccattcattaattcggtaagtatgcattaccattggtgaatagattagagttgaataacattgactagagagcaacaaaacatctgagccaaagcaacatcttaggactgatagaggaagaagagtcggggaggggaagagaaggtggtcaaagatgtgagagaaaatgagaattgggatatcatagatgctaaatttaaaatgttccagggagagaaatgtcaactgtccaaagttgcttctctgagaagtcaagcaagatgaggacagtaaaagcctgttcatttcaacagctggcaggaagtttgtgagttttatcatctattgcttgtttggtggattgacagagacagaaaccaggatagagtaggcagagaagttagggggggtggatgtcagaaaatggagttggatgagcagatgcagaagactaaagacatctgactgcaaaggaaagaaaaaaactaaggcagcagttagaaggggaaaggaggaatggagaaaagagtttttggtgtgtttgtgtgcttgtttggtttggttttgtattacattggttttgtttttgggaatgagagacttgagcatgcttcagtgctggatgaaggtacacatttgagagggagagactgacttttaatctgtgactgtaagcagccttgttgaaaagtctagaatagatcaaaaccagcaattcagctaacttcaacgaatatgtgttattcttatgggccagggatcaaacatgaacaagataaactccctgccttttagaagctatagtttggggaaaacttgctcataggaaggatattcaggcaacgggcaggaggccacataatgaaaatgtgacaaaatacagtccagaagaaaattaccagaaaaataaagaccaatgcaagcccacaagccaccacaaactctcccttctagcttggcctcctaatgctccctgtccagttttcccatccaagctttgctgctcacttgagatgctctggctcttctattctacctttcagatcctatattttactgtcattcattatttcacctattttccctgactactcaagcctctacagtctcctctgtttctaaattcctttactacttaatgttcgtaacagacattttggttcttaagtatttcctgagaggcaatgtggtattaagggaaggagctctaactttggtctcaaagcgacctggttcaaatccagcttctatcacttactacctataggacctgacaactactgtatttagtttctccatctctagaatggacagagaagtttacctctgatggttactattaagactaagtgaaataatatgtataaagcaactattaagactaagtgaaatactattaagactaagtgaaataatatgtataaagcaacttatacaaagtttgggcaacttatacaaagttgtgtgtatcatgagccctgtgtattagtccattttcatgctgctgttaaagacatactgagactgggcaatttataaaagaaagagtttaattagactcacagttccacgtggctggggaggcctcacgataatggcagaaggcaaagaggagcaagtcacatcttatgtggatgacagcaagcaaagagagcttgtgcagggtaatttccatttttaaacccatcagatctcatgagactcattcgctatgacaagaacagcgcaggaaagacatcctcacccccgccgtaattcagtcacctcctaccgggttcctcccaggacatgtgggaattgtgggagttacaattccaggtgagatttgggtggggacacagccaaatcatatcaccctactctgctgtggcatcttgggtaggtaacttaccatgactgtgccccagattcctccttataaaaaatgattcctaattggtatccatctcatagagttgttgagaagaatggggcaataagaagaatgagggaatacacatatggtgcttagaacaggaccaggttcttaggaaataaatgtttgttggattttttttctttactgccattatgttatcacagtaaaggatagtttacttaaaatgtttgcaactcaccctcaagcaatattgacattcttattttcagatcatttcacttcagtgagcacaatgttttaatttttaaaaacgtttttgcattcttttgatttttctcttacgtggtttaaaaagtgggctttattatatatgcttcctcaattgtagttcaatactttaatactttaaaaccgccattatctgtccaagcatatattaattaaatgacctggtcatttaaatatatgtcatttaatgtcacaactcatgagccaccggaaggatcactatggtatcaactaatctttcttcatagcctatacttccttattgtataccaaaaaacccaaaagattataaataattaagactcataaagttacacattatgcaaatcacaatcactttttaaaagcaccccaacagaaaactttctctaagcaggacatgaagcatgaatgcacagaagaaatagaaataatcatcaaacaaattataaaaacttgttttacaagtcatcagaaaaatcaaatcagtagtaagactccatgtttatatgtgtcaaattaaaagagattgctttaaagcataatgttcagtgttggctggtaatataaattgctgccactttgaaaagtaatttggtaatatgaatcaaaatccttagccatgtgcataccctttgacccaataatttcactcttagaaatctgtcctgatgcaatgaccatagataaggataagtgtttatgaagaagaatattcaaacacataatcacttccttggtgatctcatttaccctcatgtttatagacatccctatacaatgctgactctcaaatttatatttccaagcttgacctcttccttgaactctggagtcctatatgcaactgcccattgacacctccacttggatgtctaataggcgtctcaggtgtaacacatacagactgaccccctgccttctcagcccccaacacatacaaccctatgctactaccagtcttctccatttctgttggtggcacctctatccttctataggagtctgagccaaaagctttgtggtctttttcaataagtcctactggttcttccttcagaacatatccagaattccactgcttcccacagcctctaccactaccactcttgtccaagccacaccatctctctactggattcttgccgtggcctcttaactggtcttcctgcttttgaccttgccctcttgcagtctagtcacatagcagcccaaggaaacattttttaaagttaataagatgatgtcactttcctatttgaacccttcaatgacattcactctcactcagaattaaatccaaagtcattcccatgtcccaggaggccttctgtatgatgtagtatcctgttctctctatgaccttatcagctcctgctttcctctttgtttatcccacttctctcactgtccccccactgttgttagaggccccatgcacaattccacctcagggccttttgctgtttccctctgcttccatgctgtgccctgatagtcacatggcttgcttcttactctcttcaagtctttgttcaaatgttaccttctcattgagatcttccttgacccactattaaaaatgcaacaccccttaaccacactcctgatccttcctacctgctttatttttctccaggacatttattactttctagtataccatttcatttatgttattctttgtctacctcttctggttagattgtaagctccatgaaggccgggattttttttgtctgttttattcattgctgtgcaatgcctagagtggtgcatggtacgtggaaagtgttcaataaatatttgttgaatgagttaataaatttacaagagcaaaaaaaggaaataaagtccaacaatagaattgtcaattatatcatggtacattcaaacaatgatatgttaatggacattaagaattagttttcagagacttttaataccatagaaatgtatggaattaaagattatcttaacacattatactttttaagttttattttttaattgacatataataattgtacatatttatggggcacatagtgatatttcagtacatgtaaggtgcaatgatcagatcagggtaattgggttttctgtcatttcaaacattaatcatttctttgtgttgggaacattaactatcttccttctagctatttgaaattgtatgatatgctattgttaactatagtcatcctatagtagtatgtaactctagaacttattctttctatctagctgtaattttgtagcccttaacaaatctctgtatcatccccttccccctactcttcctggcctctagcatcctttgttctttttacttttgtgagatcaactttttcagcttccacctatgagtgagaccatgtagtgtttaattttctgttcctggcttattttacttaacataacgtccttcagttccatctgtattgctgcaaatgacaggatttcattattttttgtgactgaatagtattctgttggatgtgtataggacatttagtttatccattcgtctgttgatgaacataggttgattccatatcttggcttttgtgaatagagcttcaataaacatgggggtacagctgtctcttcagtatactgattgcttttcctttggataaatgcccagtagtgggactgctggaccatacagtacttctacttttattgtttttgaggagcctccatactgttctccatagtggctgtactagtttacattcccaacaacagtgtatggcctacccctgtttttgcaccttcaccaacatttgttgttttttttatcttttgataacattcatgctacctggtgagatgatacttcattgtattttgttttgcatttccttgatgattagtgatattgaacattttttcatatatttgttggccatttttcttcttttaaaaaatgcctgttcaggtcaatggctcattttttaattggattgtttgtgtttccgctgtggagatgtttgagttccttgtatattctggatcttaatctcctgttggatgaatagtttgcaagtatcttctcccattctgtaggttgtctttttactctgttaaaaaaaattttcctgtcacctgggctgaagtgcagtggcacgatcctagctcagtgcagcctcaaactcctgggtttgggcaatgttatactttgtttcatcttgaaggaaatatagcaaattattaactctggtgttctgtaggtcagcagtccccaacctctttggcacaagggaccagttttgtggaaaacaatttttccatggggttgggggattgtttcaggatgaaactgttccacctcagatggtcaggcattagttagattctcataagaagcacacaacctagatcccttgcatgtgcagtccacaatagggttcacgcttctatgagaatctaatggcactgctgatctgacaggagatggagctcaggcagtaatgctcccttgcccactgctcacttcctgctgtgcagcccagttccagcaggccatggacaggaccagtctgtggcctgggacttggggacctctgctctaggtgatgtttccaagaggtttcttttatctcttttgtaattctcttttatttctaaatatgcacattgcttttataatcagagttttctttcaaaagctatataattcatgtttcttttcaaaaaaacatgtaatggcactgcttgggcaatgggtgcaccagaatctcagaaatcaccactaaagaacttatccatgtgaccaaacaccacctgttccccgaaaacctattgaaataaaaataagaagactggaaaaaatgtaatggaaattaaatcataataataattatagctactattgataaagggtatcagagactttatgcacaagggctaggtcttctatgcccattatgaaagagacagaaaaaaacaagttttatagtcaggtcctacttagtttctttaagcctctatttgctcatctgtgaactagcctaacaatacccccagagaatttctctgcagattaaatgaggttaggcatataaaatatttggtccagtgcctagcacattataagcccttgataatttgtaggtgctattcctatttttgttttggttgccatcattatctcccatatgtttaacaacctttaattataatatggataagactattatatttatagagataaaataatttgtccaagttcacacagcaagtgagtgatagatccagaatttgtttcatccctgccaagatgcaaagcccatgcctggtctctctaccacaccattctacctctaccccaggaataagggttgcaaagctttattttcacagtgagcaccaaagtgtatggtatcaagttattcatactcagctgccttatttttgacattctcctctggatgaatgtgtgaacatgaaccatatgtcttagagttaaactttcaggaaagaacgtgtgattttcaacttgtggacaatttttagtttatagtatctctactcttcagtaaggtcaaatcataatgacaagaggttgtcaccgggctacaatgctggtaaattactcagtgacttaaaattcgcttttaacttatatataccttaagcagaagacttagtattttttccatctttaaaataaaggtttttatattagccttcacccatcattgttaaatgtcaacggtctacctgtgaatagtatcatcttcacttcagaaatgccaaggctctgaagctattttctgttggtctttggttccgaaattaatcattctcaggcaaacttgtgaggtgtattaaaggaggctctttatttcttccaattgaatcatgagttcattatttaatagttatacatgcatccttaaggattaatatagtatatgggttgagtatcctttatacaaaatgcttgggaccagaagtgtttcagatttggggttttttttggggggagggtgggattttggataatttgcatatacatagtgagatatcttgggcataggacccaagtctaaacatgaaatttatttatgctttttggatttctggtttttgttttttgagacaggatctcactctgtcacccaggctgcagtgcagtggagcaaccatggcccactgagacctcccaggctcaagccatcctcctacctcagtttcccaagtagctaggcgcatgcaccaccacacctggctagtttttttttgtttgttttgtttttttgtagagacaggttttccctatgttgcccagactcatttatgttatttttatatatatatatatatatataatatatatgttatatatgtaatatatatgtaatatatatgttatatatgtaatatatatgttatgttatatatgttatatatatgttatatataatatatatgttatatatacgttatatgttatatatatgttatatataatatatgttatatatacgttatatgttatatatgttatatataatatatgttatatataatatatgttatatatgttatatataatatatgttatatatattatatataatatatgttatatatattatatataatatataatatatgtgatatataatataaaatatatgtgatatatattatatataaaatatatgtgatatatattatatataatatatatgttatatatatatatatagcttcagagccttggcatttctgaagtgaagatgatactattcacaggtagaccgttgacttttaacaatgatgggtgaaggctaatatgagtcaaaaacctttattttaaagatggaaaaaatactaagtcttctgcttaaggtatatataagttaaaagcgaattttaagtcactgagtaatttaccagcattgtagcccggtgacaacctcttgtcattatgatttgaccttactgaagagtagagatactatatatatatatatatatatatatatatatatatataatatatatgttatatatatgttatatatgttatatatatgttatatataatatatatgttatatataatatatatgttatatatgttatatatatatgttgtgtatatatatacacacacacacaccttatacacatagcctgaaggtaattttatgcaatattttaaataatgttgtacatgaaacaaggtttgtgtacattgagccatgagaaagcaaagatgtcactatctcagccacccgtgtggacaatctgcggttgttggcatcaccatcattcctgactctgaattcatatgctaatgataagcaatcattttcttacacttactcacacataggacttaatggtaaaaaatatagcatatcattaatacagtgaaaaaataatgtgttccgtgtagctaagcagcacagtagcatcaccagaatccctgtacgggttgagccttcctaatctgagtatctgaaatctgaaatgtcaagtgtggaattttccacttgtggcatcatggcagcactcaaaaagtttcagattttgttcatttcagattttcagattagggatgttcaaccggaatatataatcttaattttatgatccagctccatttaacaattaaaggtggttatgtatcactccttagtcaacctataatatttgcagtttatgtcaagtctaccaaatgcttgatttatttaagtggtgctcattcatccttattaaaacccttattcaaagtgtttgagatgatggatatactgattaccctgatctattcaccataaattatatgtatcaaaacatcactatgtatgccatgaatatgtacaattattatttgtcagtaaaaaataaaattatattttaaaatgttttataaaaaattatattcaaaggagtttttgttatccactttacagatcagaaagctcaagttcagggaggctaaataacctttctaaaatcagacagtcagtgataaagccaggcttcaaaccaagatctgtctaattccaaagcctgtgctctccccagtccacaagctcaaaattattgagaagagtatacatttttatcaagatccagttttaaaatatagagaaatatcaaacattttagagaagtgttttattagaaaattgttttttcttatgaaagcagatgctcctattatttttccctaattttcttcttcaaataaataatacatacttctctcttggaatgttgtaggctttcccaaattattcatagtaatacagtcctctgttgtcatcttgatctgccatcacatgtattaatctttttgtctcctatatcaactgatcatgagagttatattaattatggcctctttatataatccgaagataaaaatgggaccatacttccttttgcattatatacagtatagaaaaatggtaaatgtgaattctttaaaataagaatgtacaatattagaattacttgtattataaagaaatagtattttactttagaggtaaccattgctttctaaaggtaggaaacatttgagtagtttcaaaaagtgttttgacaaaagcattaaggataaatttgtcataaattattaaaggaaaacaaacaagttttagagttaagagtgtagtcatgcccttccacaaaacgcactttaatgccgctgccaataaatggcatttgcaatatggcatttgctattaatgtgagatagcagttatatctgctttgagaaagtcatataatttctccatgttgctttccttcccaaagcagcatccagtgttgtagggaggaacttttccccgcagctcctgttctgtccttgcagaataagtccaaagtggcaggagctgcctgctgtgagcctgggagtagagactagacaggtgtcttctagagggttctgatcccaccctgctggtcctcacctgctcactcctgtcccaagccacgggtacacagcttttgttttcacacttcacctccagctccgtggagaactccagcagtgagcttggctgccctaacacttttccccgtaagtcactgaaaagctcaaatctcaaagctgaaaggaagcaactaacagacaaactctgtctcacaaactcacacgcaacctcaaagccctacaggctctctcaaagtaaactttcacaccatgcagaaaaaactacaaacagacttggggggacttggatcacaatttattttccaactttttgcatgattactagataatccaccacattttaatgaaaggggtttaaaaactttaaagatgaaaataaaaattaaaattaaaaaaaactttagagatggatcaggattctcaaaggggacagtggatagaatggaatggacatgacattcttcctcttggctgttctcccatttagtacagtctcttgtactggaaagtcacagagagtggaaggaaagaagtcttttaccgcactgtgggtaaaaagtgagtgccagactccaaccccagcccagtccagctgggcaaacctgccaagcagtgccaggccagcagcttaggaaccagattctgggatcctccatcccagctgcacatagcttccagacaggccagggcctcctgaatcattcaagtgctcctgaagttattctggctgtccattgctatcctaagttgacaatgagtgccatactttgttctacagcttcttttgaagtctttcttaccagttatgctttcttctttctaaatcatttatgtgtggctggatgtcacatttcattacctatgactccatcccatgctgacccagagaggatgtgggtatgaaaggaactataaatatttacactccctttccatttgcatgtcttcacacagttaaggcacatcccccttgcagtcagaattctgcttaggctctgattcatggtaatgtgcttttattcctaaccacagttctcacatgaccaggaccccttcttggcaccatttagcatcttccaaggatatatttatatgggttatttaaaggagcagtcccacgctgtccaggagctggttatctagtctgtctattctctatgcaagaggacgaaggggctcaatattataattttccctgaagccaggagatctccaggtggaaagagtactttacagcactggaggtgctatttggaaagggggtttcaacccaatgacactatcagtcctgctggtaagtccttccctatcttgagtaccttaatctggttaatttttttttctcatggccacccaccccacaggcatttaatcgttcacttgagagtatagtgcaaagaatgtaggcttccaagttgggaagatgtaagtgctgacctctgactcagctgacactggagcaatttactgtccatctgggtcagcttgcttctttacaggcagaaatgaataactcctcctctacaggttattagaaggacttaaaaagataaggagcttggcatttaataaatggaagtctctatgatttcactattccatagatagtatgcagactaaagaataatggagggaaaagaaattaatagttattaagttctgatacttattaacactccttggaaagatccatcatgggagaaggaagagggaaggaagtaacagaattaggtgatttgattggtcaaactgcttgacctctcagaagtgatcagtagaaagacttgcacttccccatgaaggtgtgagttcatctgaacttttgggtttcttttatctgcttctgattttgtttatcaatctttttcccaattcttactaatgcaacatgtgctgttagcatgtccttatctttgataaaccacttcaaataataccacatacttctcatacatttttaatcactgtcacttaccagaccttgaataataacactagatttaaaacaaaaaaaaaattccttggaaatgttacagtgaattttagaaaagtgcttaatgaaaatctaacaacaaaaattgcacaacaaatagaaatggatgccattttctctttcacagtaagttatgaaaatgcaaccattaacccaatcatgataataatttttatgagcccttgaacaccaaaatttagacatccaaagacttcccacacaccactctcacctttttaatggaaaaacagttattacatttcaacactccaggaaattaaaagaagaggcatcttcaacaaactaggcttgtggttaaatctctatgtttaatattctgaaaaagaagtatgactcttagtcattcttaatacatttaacttacagtgtcaaaatatcaatgtttcctaatgagcttctaaaccttgtgttttctttgatcaagaagaagtatctaccaaatcactttggatatataaggactcaaaattactcatgcaaaaagtagtattgggtaaaagagactgggaagtcttgtagtcacctgaatgtcacaattttcaaacattttggtgttctttctaaataaaatgtgtgtgtgtgtgcgtgtgtgtgtgtgtgtgtgtacatgtgagatgaaagcatcttgtatatatgagttagtgccaaatatttgttcttagaattttaatgtgagcattgaccagtgacaaatcccacataaacaccacttcagtggccgccttgtattctattatagggatctatgtcatttgtttcaccattcttttattctttgatgtttaggtttccaagtttttaaccattataaaaatgtgacaagcatctttgctttctttatgtccacacttttaattatttttttggaattgtgtctaagaaggaaatttcagattattttttatcctcttgatacatattgcaaaattactttccagaataagcttgtaaccgtttatactcccaccagttgtgtaggaagttcccacttcataacatccttgccagcatgggcactctcatttaaaaaaaaatattttacatttgaggcatagacttcaaagatgagagtcttagatgccatttagtgtaaccttttattcaataatttgtcctcccaatgctctaaccgtaaattccttgaagaggattccatgttatctattactataatccccaattgcttacatatattaatagtaatacagtaatatttgctgaggtagtgagtgaatatgtgaattaacatatgattgaggccagctgcgattgctcatgcctgtaatcccagcattttggaaggccgaggcgggtggatcacttgaggtcaggagtcgagaccagcctggccaacatggtgaaaccctgcctctgctaaaaatacaaaaattagccaggcatggtggcaggagcttgtaatcccagctactcgggaggctgaggcagaacaatcgcttgaacccgggaggtggaggttgcagtgagccgagatcgtgccattgcactccagctggggaggcagagcaagactccatctcaaaaaagaaaaaaaaaaaacaaaaaacatatgattgaatagatgtccttaacagatagtcatctaattgtgagatcattattcaaaatttaactgtgtactccctgaagtaaattgtaaatttacttttgcttttgaagttaccatattcttcattttttaaattattgcgaaatcttaagcattacactgtaataagtatatcagaaaagcctacttaaaatattatcctaacatcaaaaattgcccaagaaactatatgtatgcctttcagcccataaaatacatatatagagtaaatgtgtcatttctgagattttcatttagaacactgtcatttcccaacggaattaattctagctcatagtccgtaagaactcacctgaaattagattggtatctcagcttctttactgaggcatgtaccaaaaacatagaattaagttttagcctcttaatttgcaccattctcaatactgtctcataataattcaaagtgggtttttttgttctcttggccaagcaaaatgcccttgggcttgcttttactctttctcttttaccttacttgatagcaaagtgtccaattaattctccaagtagttatcatgaaatcctcccaaatagaatttccttcagattgaagttctcattgcatttcagttcagtccttttatgccaattgaggtaatgcttttttttttttttttttaagaaccaagagaaggaagcccaaaggtcaggtttagtaataccccttccaaatatgttttatattcctgggtctcttcttctataagtacgactttgttttaaagaaagagtatatagtagaaaaacttaaaagttgtcattgaggctgaggtggaaagatcacatcaggccagtagtgcgagactaacctgagaagcacaatgagaccctatctctacacaaaatgtaaaaatttagccagatgtggtggcacctatttgtagttctagctactcaggagaccaaggcagaatgttgcttgagcccaggagttcaaggttacagtgagctatgatctcaccactactctccagcctggacaacagagtgagaccctgtctcagaaaaaaaaaaaaagaagaagttattgaaaaatcagttaaatattcactacagttatctgattttctgatttgtccattttaattatattagtaaatgcattcttaccaaactcttaaaattaattattttccttttgacacgggcctatgtaccctcagtaacaaggtcaccatttattctgtgcttattacatgccaggcaatgagctaagtgactcatatttattatctcatttagtcctctcaataacgctgtactatagggtattattagtttcactttataaatgaggaaacaggctagagacacttgaagatacttggccaagtcactgagctgaagagcaagagtgttttaattgagtcaagccaggtcagaccttacgctcatgatacttggaggtaacacagagtagtgcagatcatcaacctaagcaggaattacaaaataattttatctggcatgccaaacttgatcagtagcccatttacgtgctgtgttgaggcaggtgaacaatttgagttctatcagaaagagtgtcacattctgcagtaaatgcaggaaaaggacatcggggcatgcatgctggggatctgccatcccaggcctaaaagaaacaatatcaagtggaaataagaacagcctcagagctgtacttccctaggtgctgatgctccatgccccatctcctaccttctccttgggctttgttaaatgtgccaagagattttctttttacaatctataggttacaaatgttttgatggactggatcttcagctattctgcaagtcttcctaggtccctgtctaggagtatttgcaatatgtcatctgtagagctgggaaactgaatcatcttagtgctgcacttggccctttcctcctacagccacacaatagaatgcagctctttagagacgctgtgataatcaaatagattcaaagcattggttgtgtatgggagatagtgtagtgcaaaggatcatggtttggaatttggaagcctgcgactgactcttcaccctgccacttgctacatgtgtaacctaatgactgaacatctgaacccctgttttctcatctgtgggaataaataaatcatgttaatatttatttccctaggccgctgtgatgcttaactgagagaatgaaggtacaaatgtattgtaaactatcaagacctcgttattagagattggtgtagtagctaatgctgatatttttaaaatgtttaacagtttcttatgcaaaatacagcagtaaaatttatactgcagtgtcgaacacattcagcacagcttcagactcctggctgtgcgtgaaaactccaagaggataccactggtttatgtcacttgagactccagacattgaacagtaattagggaacatgacagtaatttgatttaaagtctgcagccacagagttcaggctccatccctctctccatcattctccctgagtgcaaatccagagggagggcaagtaggtcgaagcagactctgatggtgtttacttacttgccagagattagagaaagtgtgcccactaggtctacagtagtgcaaaaccaagccaaaaagtgagcacttcagtgcactcaatgccaaaaaaaaaaaaaaaaacaaaaaaaaaaaacatgtcttactttttttgtcattactgacttcatgagtagtgcatgtaactatttctatgggtcttctctttgattttttttctctttgattttcaaaaagaaccattaacattttaatgttatatttactgagaggttgcatgatatcagccaaagtaaaagggatatggatgaaataagaaatacagaagtctggccaggcacagtggctcatgcctgtcatcccaacactttgggaagacgaggtgagaggatcacttgagttgaggagtttgagaccagctgggcagcatagtgagacctcctgtctacaaaaagataaaaaaaattagctgatcatcatggctccttgggaagctgaggtgagaggatcgcttgagtctgaaggttgaggctgcagtgagccaagatggtgccactgcactccagcctgggcaacagagtgaaactctgtctcaaagaaaagaaaggaaatatagaagtctcactttaatcattaagtcacaccattaaataacactggtccgtactaaagctgaaataagcaattatatgactctacttgaatacttaaataaatatgacaataatttgccccagcagtacgaagcagatcctctcccatcttttgtgggctgtttctcccctcagattctgtgttgtctttcttggtttctctcttgactcttgtcatactctttatggaagctcaaaacacatataccagactccctgtcagtggggtcctctctacttgggtgtcacacaaccaactgagtttaacacagtttatccaagactgaatttatagtttcttcccatccccaaacatgcttctttcctatgtcccttacctcaataaatgtcaacaccatctcctaagatgcttatgtcaaaaacctcagtcatgctagaccaccctctctcacttaggcccaagttctcatcaccccaacctcttgatgtctcttcaggtcagcccctcctcattagtcctgctgccactgttttgatttagtctcttcctccctcccatgccatcttttcttgctgacattactacaataactcactgctttccctttttctagcctagtcctttccaaccaatatccacatgcttcatgggcaatgtgtatgatcatgtcactcaactgcttaaaatcctttagtgctttcttattatctcttgggtaaaatgaggatctcttagcatgacacttagggctactctatcatgttatcttctgactgtatagaaatactaatggttccttaagcgggtgatatagttccatacttctgtgctttaagagatgttcctttacatgccttgtttctttttttatttaatttttcttgttatcctgttagcatcccagtatacctttgcatgccttttcccctaggagaatgcccaatgactctttaagccttaacttgaatatcacaatctctatgaaacttttctcctttgtgttcctatagcaacctgtaaatacttccttgatagcacttatcatgttgttttattatgaatgtttttttctaaacatcatgagacaattttattcaaatttcttatatgcatctctaacatcgggtatatgtcatcataaaagccactctttaagttctctcagttttccagaatgcatgaaactcacttccacgtaagctgtttgagacacagcgctttaaaaatccatgtagggtgttatgaaaattttatcccaagtcttgaatacccatttgaataacatttaatttttttcattcttcttatatgtgcatattgataatctctgcaatgtgatgacttacattgtaaggtccttacactacaggagaaacagtataatagtattttttttttagatggagtttcgcttttgttgcccaggctgtatgcaatggcacgatatcagctcactgcaacctccgcctctcgggttcaagtgattctcttgcctcagcctcccaagtagctgggattacaggcatgcaccaccacgcccagctaatttgtatttttagaagagatagggtttcacccatgttgatcaggctggtctcaaattcctgacctcaagtgatccacccaccttggcctcccaaagtgctgggattacaggcataagccatcgcaccaggccagtataatagtatttgaaggcagactctgattaactaaaaattcatattaaagcaagtttggattaataaaaaacctggagagagaatatgtgaaaaaaatatgcagatggaactgagagagctctccagggaagataaaggagctattaaggtaacaagaactaaggttgatgcaattaaaatgtcaggaatgcttacaatctctaggctgaggggagttttagataggcaggacagcaaactgccgtcagtctgaatagaaaagaggtaaaataaacagtattggaagtgggttgttattccagctgttatgtttgagatgggcctgctttcatagtcttggaggtctgggcagaaacacaccacagcaggcacaagagacaacatgctgggttgctgctctgtaaaaatcatgtttcctaatcctgctccccaggcccacagttttgtggccagaacctgtcatgtgttctttgatctttgtgggtctggggtgatccagcatgagaggaaccagcggttgaacaggaaggagcactgtgtggcaggggtcccttgctttgggtaagccctagcagaaagcttccgatggctgtcttccccatagataaatacctcccttgcgatggatgcagttggcatcttcagcaccccttctggagacttgcctactgtggttcacagagcacattaatcatcatcattatcgcagatcccagaaaggaagaggctttaggtttcttgcttcctttctctgctggcagcaggtgacagcagaattatttatcctttggacttaggagtcccatagattagcgtcagagatttggcctaggactctgcacagatttaaagggccactggttgttgtatttagtgtcctttgttcctagtaacccaggtaaccttcatggtggcagtatgatcccctgatactgcaggaaacgtaagggtgaaggagcatgttctgtgttataaatttatgacttaattagttactttcttaacatcttaggtaggaatttgggcttaagcagggcacatctatctttaaagaatacacaagttttccaagttgaaatttgaaagtaaaataaatgtaaggaacagaaacaagagagattatatacttcattactgctgtttgatctccatgctttcattgcatggtaatttttctcagattttaacttgtatattacatgaatctaacaaacataaataacgtatctgggtcagtatttaacatatacatttcgtaaaggtcttgaaagccaatggggtctaaaacatgtttgattatttattgtaagaaggctggattttaaatctgcttctgtagcatctcaacagcttgcagggttccaaggaactcataattattaatgataaatcctgaagtgtcccactgagcccacagagtaaagaatgcttgagtaaagaatactattaagaaggcagacactgaatgagccagctgaaatgcaaagacacgagagtgcaatttctctttggcatcctcctcggcaaggtgggatgccagaaacaactgctgagtacaccatcatgccagccctggaggttggaaggataatggggtgacaggcaaaacccaagcctagagcccccagagcagtaataatagctcacgtttatcaagcacttgctgagtaccagattctgtgctaagtactttatagccaatcctctcaaaataccctcatttttgagactagaaagggtaggtaactgcctcaagtcacacaactagttaagtgatagagccaggactctagagcctgcatttccaaccagttgcactctaccattccccacatttcatctggaggagtctcactcagttcctcaaatatttattgaccatttacaatgtacaacacatgtgctatgccccagtggaaaactgtgaacatatttactgatttaatcaacaatcatttattaagcatcttctctgtaccaggcactgtgctaaataagcactggggagtgcaaatatgactaagacatgatccctgacctcaaggaaagtataggctagtgttgggcacagacaagtcactcaacagtcctgggtaccatgtgctgtcaagatgtgtgccgcagagacaaggccatctaagaaggtcagagaaagtctccaaagaagagatggccctgagctgagtcatgaagggaagataggaattagctgggtgaagtgtggggaccaaggcatcctagccagagagagcatggaggtgaaagtgtggcatggtgaggaaactccattgtggctggagtttagagtgaggtaggactttgaagaagtgactctgaaaatcctaactccacttttcattttaatactgttaatgctttaagcttgagggtctctcggagcattaattctctctttcttaagcaaaagattcattttagcacatgctatagattgaatgtttgtgttcccccccgaatttgtacattggaacctagcatgtaatggaattaggaagttgcttccacatcaacaacctttggaaggggctagagagacctttgggaggtgatcaggtaatacccagatggctcactttacccttctaccctgtgaagttatagcaacaagaatgtttatgaactggaaagagggccctcaccagacactgaatcagtcagtgccttgattttggacttctcctccaccagaactgggaaaaataaatttctgttgtttgtaacggacctaatctatgatattttgttatacccaatgggctaagacagcccagattccagtcacttatttatttcttcaacagatatttaacacaggccagctatgtacaagacacatgtacaagacaccatgcttggcaccaaaagaacaaaacatggtcctgctttgaaagacattgtgtacaggagggcaagacagacatgcaaacaagcagtagcaaaatattactttactaagtgctcaatagtgggatatccttgacttcacaggggtttgcttaacaggtctgaacaaaggaaatctgaacaattttcttcagcttataaatatttggggttcccaggtaactctattttatcattaccactattctcctactattacccactagagcattcagagttctctattttgtatattcagctaaattatagagacacttatttaaaagtaactaacatcttactaggtgaaataaattccacattgacatggaagcaaccctaataaggatgctagatagcattaaaataaacaaagtagtagattaatgagaaaaaacttaaatgcattattgcttgccagacctcctccgccatgcacatgccacacccctccacccaccctctgcacagggagaggctgcccaggtcaaaggtggttgctgcattgcctggagatctcggacaaccattttcaccagttcctccatgaacttttataaaaaagattttcagacattcttttcattaagaaatctttttctgcattaaaaatgatattaagtcctttcaatcgttttcccataaaagaacccagatccttttacactttctcgtaagacccattttataatcttttaattttttttttttttttttgcttatttctgtttataaattatgctcaaaatgcaaaactggagcaaatgatagtaccagatttaaatattgccatttccactaaagatgtaaaacacttttttaaatttttcatttgttttagagacagggtctcactctgtcacctaggctggaatgcaatggtgtaatcacagctcactgcaacctcaaacttccaggctcaaataatcctcccatctcagctacctgagtaactaggaatacaggcacgcaccatcatgcctggctaatttttaattttttatagagagaggatctcactctgttgcccaagctgatctcaaactcttggcctcaagtgagtcacccgtctcagcttcccaaagtgttgatattacaggcataagccagtgcgcccagcctagaacacatttttgtatgtttttattctattttatcccaccaaccatctgtggattcttgggcaagtcattaacatcttggggctttggtttcctcaactgctaataaagagttaacatggatactaagcactgtctaacagatcttctagccttcaaaccctatagtgatggatgttattgttaataataatactctttcatccagaatcacagtattcttgagacacctttcatcttgagcctaaatcctgccaagttgattgctaaaagtaaagcttgttcagacaacccacttatggtcctaaataaaagaaatacaaagagaacaaatgaatatgttcacaaattcatttgttatacctaaataaagtgtatccctagaacatagtttagtaccatattagaaaaaccattattatgataaatgtcagcagaatgattcaaaaacatcataatgagtatttgaatagattgctttaaaagacatttgattaaagtcgtacatttttctggagtttttgaaaagtaaagtttaagcataaaattactcttaaagtaatatttactgaaaattaagagtcactatacttaacaaaaatatattacacacatttccaaacaaaacaagagtacactttagtgcactcaagttatctatattattaaggattcctgccactgtgagaagtcataaaaaatgggggattaacacaggaataaagaaagacaaagattaccatttgcaaaccatttatggttaggaaatccagggtaataaactgaaagctatgtgtgatgatctagaaaatctagtaaagtgatcataaaatgaacaataatgaaggaaaagagatgccattccccgtatcaaaaaaatgctaaatatctgctacttatgctaatatggcattctctagcactgaataaaaaatattatgaaaccttcatgggaaaagcaaaggactatttgagtaaaagccaatatatttcttgtttctgaccctaatgttgaagaaccgtcaaagttactacaattccaattaaaatatcaaaatgtaatatcaacatgtaaagaactttataaaatatgaaatatagagatatgttaaatcaagtgtttttaagtgataataatgccctatgaaatgagtagctatcaacattaagaaaaataagccacaatgaactctagttgaatgaaacagttaaatatatggggtttttcaatttaaaatgtaatataattgctccagttattaaggaaaatgtatttcccttcactattgagcaaatagaaaaagggtggatgaatttcattattaaaagattaaaaatgttatattagagatataataaaaccaccatgaatatgacagtttcttcatatctaaatttcacatttttaaaaaaagccataagcataatagcaggcccttattctacagatgggcacgaacagacattatttagaaaaaagttcatacttggctgttaatcagggaaatattaagtaactcaaacgtgcagtaccacctcacaactacttaaattatcaaaaataaagaaactctacagcgacagagctgtagagtatattcatacattgcaggcagcagtgttttacactatggttgtaaaagatagttgaaagaatgtaacaaaatctttcaaaatcctttttaagtgcaatatttctagaactatgtagtgatggtgataattatatctactacacttactggaaaactaaattaagccctgcactggacactttatagatattatttcatatccttactgaaatgctacaggtggacattactgactgtgttttaaagataaggaaattgagactcagaaagggactcagaaaagctacataagtcgatcagatcagagagattcaagtcttggtttacccaagctctttctaccaccccatgctgcctctgaaacagtgcaaaagaaaaacagaagagaaaataaggaaaaagaaagatgaaggaaaataaaagaaataggacacctttctgaactaatccacatgcctcataacagaaactagaaataattcaatgcccaacagtcactatggaagtgagttcaaagtatataatagcatctatcaaaatggacacacccctcgtatgcagcaatacttctaggattcggtaatgatgacactactactactacaagtgataaccaattagtgaatagcaggactgagggttgtttggtagtcgtggagtgagaggcagaatggtatagtggaagtacatcgcctgggtgcaagtcctagctctgccccttactagatgtagaacagtaagtttaactcttaaactctattcatcaacagccaaaatttgttgattaatatattgctattaagtgggtgagatgctcaggacagggcagttttcttcatgtatcagtgacattttgggtagtctgacttcatgaaggtaaattgagactttacaaagtgtttttttgtttttgttttgttttgttttgttttggagacagagtctcgctctgtcgcccaggctggagtgcagtggcacaatctcggctcactgcaagctccgcctcccgggttcacgccattctcctgcctcagcctcccgagtagctgggactacaggtgcccgccaccacgcccggctaattttttgtatttttagtagagagggggtttcaccgtgctggccaggatggtctcgatctcctgatctcatgatccacccaccttggcctcccaaagtggtgggattacaggcttgagccactgcgcccggccagactttacaaagtttttaagtgtgtgtttctgtttctgtcttctccctcttctctgcacccctctcaaaataataaatattttggctacattttactattaggcatcaaattcccactgttcataaatatgtgtggtcaacgaaaaggccttttgaggaaagctttcaatatgaatgcaggtgcaatatacacaacaaaaagcaatgaacctggaagaaatggaggtaacacaggaaatgcgagaaaacattagcagcagtctagttacatcttcagagaaatatgagaaagtagtgtcaccacagaacaggaacaggattccatgagagaatgaatcatgtagtagaaaagagtggcataatagtatttagagatcacaaccataggaggtgaaaagtggtataagagataaatcctaaaactgagaaatcaagaaatagcagtcaaatatattgtttataatggcaataacttccagcggaaacagctaaaataaaaataagtttgcctgcaagagagtagactgctatttttcatgaagccttttgatatcatattatctttcttttcaaactctgtgtatatattactttgatttaattatttttaaatttttaagaggcttggaatagtcataaccttgcttagtataatagttgtgttcctggcaatcacagagtaatttttaataaatcaatattagttttctttgagcccttagtaaatcaaatacattattttaggctgtgtgtgaaatttagagacttgcaagaagtccattccttccaagagtctatcatttattcaggatggcaatattataaggcaacatattccaaatattaaataagagtaacagactgacactgtctgtctctggacttaagggtggagatgatgtaggcttcagttcatggagaagggggctagagctgagtgtttaaaagaaccttgtgattacacagaggagtgtggaggactgtggggtgaaagggagcacacaggagcagaggcaggcagctcatatgacactgtgagatgagtagtaagccaggttggcagcagcataagatatgtattgaaagggtgggggaaaatcattatgaaagggcagcctgaagataccatgtcaggggaggattttatctcataggaaataataagtccctgaatgtcttgtatgtgtttgaaaatttctggagtgtatgataaaagctgttacatatgtataatgtgtagtgatcaagtcagaggtattcagggcatccatcacctgagtacaatacatttttgttaagtatagtcatcctactctgttatcaacatcatttaatttattccctttattttaacctatttctcttcatcctcccctctccctgcctgcgctcacccttcccagtctctattatctatttttttcacttcctacctctatgtgttcaaattttttctctctcacatgtaagtgagaacatgcaatatttgtctttttgtgtctggcttatttcactcaagataacgacctccagttctacccatgttgctgcaaatgacaggatttcattccttttatggctgaatagaattccattgtgtaaatgtgctacattttctttgtccgttcatctgttcatggatgcacaggttgatttcatttcttagctatggtgaatagtgctgcacctgaatgtttttgagcaagatataggcaagatcagcctgctggtaatatgtggcttgctgtgaccagaagactaagccagaagtcaagaaggagttaagcaattatagcaacctttcagctaggacatgagcatgactttaacttgaacaatggcattggcaatggaaaggaggaatattagaatgttaaagatacaaaaacttagggatacacaattttttcatctctgaggaacattaaatattattttaccctaattgtcactgtaaatttctagaatgtcattataatcaatcagagctttgaccagcatgagttaaccactattactactaagttgacaaggccaagcaaagaaactcaaggttttagcttacatttagagcatcttcgtgacataaatacaattcccattaggcattctgaaatgcaaaatattttttaaagtaacttgtggatgcttatcactgctttcctaaaccccaatcatactcccaggctggaaaccactgactggacctagaacgtcttcatttataggtgaagaagcttaatcacatgtgtctgaaaacatactccaagtgatgagcagcatggagtcaaaacaagcctcttgcatcttgcttaaagttagctacattctgctgggaattaacaggacttggtatctgattagtaacatttttagggaacaactgaatcatttgaaaagcaaataatcatcctttcatttatcttttgtttaagactggctttccattagtaaaggtttgctcagagcaatgtaaaccattatttctgtgttaaaattggctgctaaaaccaccacctggatacttttgtctaacattgatttctcagctgcttattttcttattatcctgccattttaaatgacaagcattactgtttcttgatccattatgacataatgccatattaacaatcatattgtttgaaagttccattgtcatgcacatatataaatgaggctttaagagactcaaggtttgaattcctcttattctactctgtaacattttttcttccataattctgcaaatacaatatcacaagtgttgggcattaattgcttattcagatcaatctcactggtctccgtagtgacatgcatattttatgatacaagtcaagctgctagattaacagatgtttgtctttaaaggaaaggaaaagtgaaacagcagtcacagcatctctgtccctgtatgcattcaatgttaaatgctacatttagagaacaaattaataggtgtattatctctgaattatcatcaccccaagcactgtcctctgtcagtaagttattttcagcattcaggtagtctttgccactaaatctttaacatctgagaaacccaaagccatgtaaaagaacctggtcgttcttttggttgttttgttgttgttgttgttgttgtttttgcattaagcattcctcatgtatgggaaactatgataattcagaatgaaaaacgtgggagaaatacctttaaaatgttatcagctacataaagcctgacatttaagaaaactattatgctctactgaaaacaatgtgggaagcataagctctatggaaaaaaaaaaaaaagattaattacagccttgaactttctccacttggccaaaaggagaataagagaatgtgaagtgtgaaagctcttttgacgtggtgactggaagggctgctgttgcaatggacagtctgaatcacagaccgcaaatgaaggaagcaaattcagaatatcagggaagtggaggaaagtagaagagaagaaccaggagactggatggaagcagagctagctccgaaatgagaactaccttgtctggaaaaaagaaggcttactgatagtcaagcagcataattaaggatcagtgaagcttacaacgttgagaatagtaactgacttctttgactagagagcagcctgaattggaggggactgtactgtgggaccctgtgaggtatgaaagtggatatcccaaggctgcctttctgatgtctccagagagagactgtagaattactttgatgtgatacactattggtaaaagccaagaccacatctgcctgagaaaagaaaatggtggaaatgagggaatagaaacattccattttcaaacgtgtagttaagatgtttgcaaattcttgtcccaaacgccaggaaagaaagtggatgaatcaatggctactgcaagaatagtttctgtgccttgctaatagggaagaaggaagtatcattatctgggccactgaggctgcctgaaacaggagaaatgctggattacataagttaaatacagaaaagtgacagaaggatgtagtgaggaggagaagatgactgcagaaaaaaggaagatggaggaaatgaatacaattttagcttttcatagaaactgatagtgtgattaataggaaatttgtgaaaatttgggaggttaaataattgcaaattattttatgcataatatgacaccacagtgtctctaaaatttgttttttaaggctgggcacgatggctcatgcctgtaatctcagtactttgggacgctgagacagacagattgcttgagcccaggagttcaagaccagtctgggcaacatggtgaaaccccatctctacaaaaaatacaagaatcagctggatgtggtggtgaatgcctgtagttccagatacttgggaggctaaggtgggaggttcacttgagcccaagaggtggaggctgcagtgagccatgatctcaccactgcactccaagttgggcaacagaatgagactctgtctcaaaaagaaaaaaaaaatcttttttaaaaaaagagtataatttcatggcaggcagacttcaagcctttggtctgtccaaattcaggagtgagaagagggtctcagctggacattcaaggtctattttaaccctgtaattctgtgatttggtgaaggatcaccagttatgaaggataattagccattcagtaagagacctgcagaatattaagaaattcattctgttcatttctgacattcctacccaggtaaaatcagttatgtttagtttctttaaaaagccacataagcacagttctaatggtgtgaaatccctgtaccaggcattcatctataattatttataattgcattatttgtcatggtttacaaaacacagatgcaaaagtttttactagagcacatatttcactatgtgaaaattatttccctagactactgcatatatgttggatggcctcattactcagtatcagtaaacagttaactgataaaaatgttattctggacactcaggtgagaggggagaagcccattttagctcagagttgatgatgctaacaacttactcttacacaaaaggacaagcccagaccacttgtaatgagtgaatgaaaaaaaggcaataggaataaacatggaaccagggagatcatcaaaatcaccaatctgttttaaaaagtagaaaggattttatttcaactttggaagaacataggaaataaaagcaaacacaaaatgtttaaaagttcttaaataatatttttgttcaacttaatttacatctttttatgtatataatactatatgtagaatagcatgatttttttatgtttaaagatgaaggagctctaaaaaagctaaagtaacaaagaaaggcagaggcaccttaataagaatacttaaaatgtttgtgtacaatcactttggaagaacaatagattatttgtgtctgtgtattttaaggaagctgtagaaagatttggttagccattatttatttacttgaaacctgtattgctgtcaaaattattatcaaaataatccacggacaaactttgtcttgggttagatctcctggcagcagaccctctgacaaggtctgttgagggagttctctcagaagacacctgtcattgagcgaagggaaaagcagaagggaggaaaaggagtcagacacaaataaatgggttcaggagaagtccagcctcagcctggttgcatgggcaggtaggatgattatggaaacagccccaggggttgagtcctgctcccagacagcacccattagctaagagcagtcctctagagaagggtgcagaagtgagctcttagctcttagctgccaacactcacagcagctgaggcataggcacatcaccctggtatacatttatttgtctgtctcagtactttatgcaaaaaaaaaaatatatatatatatacacacacatatatatgtatatatatacatatatacatatatgtgtgtgtatatatatatacacatatgtgtgtgtgtatgtgtgtgtgtgtatatatatatatatatatatatatatatatatctcctcaggctgttgttgcagtatctatccatcccaagtgttcaattaatagctaatgggtgaatgaacagatggataggtgctacaaaaaaaagacactgaagaaccagattctaagaaataaatcataataataaccagcatctagaaaacatttcccatgtgcagacacactgcttggattattttcatcaggtaggaattgttattatcttgattttatgcctgcagaaactgagatggatgttttccagagccacatggctggtgtgacatcagagctgacacatttaacttcttcgttacaccaaatgctcagaaattaggaaggtgaaataaatggggtgaaacaaatattgataactacttatcctgagtcatttatagcttcatagagtggctttgttttccttttaaaagatagaattaacagctgcattttcctcgttctacaacaaatggacaggtacgtagactccaacatactccttgaataaaaatgagaaattctagaatccttggatcatgcagagtacttgaaacatccagaagattctcagtatttttgtctccgctatattacagattaaccattgactgtgaagatatataattatacaatctaaattgattatgtttaggcctgcctgtagtttaaaatatactatgagtattattacaaggcatgagattaaaatggatgttaatttttcagtattcctcctaagcacaagtttccaagcccaaatctcatgaatggaatgtgaaagagcctctgatacatttgaggcctttttaatgagttgcttagctcttcttcagggtaattactgatttgttctgtgctgtatatgagataactgacttaaagtttaagccaaaatccctctgtaattcacttgacatattagagaaagaaataaaataacacattttaaacaaacactaatgttttcttaaagtgagataagtatctggctacttacaaatcattaaaaattatgtatctggattttagaaagagagaacctatattggtttctcttccgtgtgtgcccagggagttgtgttcaactctctcggctgtcattcagctgtgttaattgtgactggcaaacacagaatccaaatccgcacattcataataatagttctgactcttctgacaagaccgctaagtaggtcatgattttatgccaaaaggaaatggccttttggtggccaaaggaatgattgctgggttttttttttaatataattcatggaaatctattctgcaatctagtgttaatgtcattgttgtagtttctcattccaaattcatcactttgcccaccatgtcccattttgcccttccaaccaggacatagtagtgggatttcctttaaaatattttatttatttatttagatttatatttttgagacagggtcttgctctgtcacccaggctggagtgcggtgatgtgatcacagctcactgcagtctcgaccttctgggctcaatcagtcttccgacctcagccttccaagtagctgggactgcaggtatgccccaccacacgcagctacttatttttatttattaattaatttattttttgtacagacagggtctcactatgttgtccaggctagtaaaatcttttaaaactgaggaaagcattttgtgatactgtaactatagttattactacttcagagtaaacacatcaatctagctagttgtcagggcataatttttgtaataccttttacttcttttggaggaaaagccattgagacagcaattcatttattcacttgcagggcatctcctttaagttagtgtctgcttgattcaaaagcgattatggaaatgtgaaagctaggcacagattgggacaatttgttgctattgtggcttttcttttatcattgttataatggtatttatgaaataaatgtaaaacgggatttttaaaaagtagtgatcatgagagctaagaagttgtcagaaagatatgtaagtcattttggacttaaaagaatttatcccacctcaaatacttccagaaaacgtgattctacatagacaaccacttgccacttcccagtgtggtaattggcaacacttagatttactacatgcaaagttctgtactaataatggattttctacctttcagcattccatacccacatgacactattttctagacgaggaaagaagcttagagaatcagtaactcctccagagtcacatagctagtaaggtgtgcctgggatttgatccaggtggtctacctctccacctcatcacttcccttgagtgtgacctgtggtcaaagagaaacagtgcattattgttgatattattaagaaactgatttatcaagccagattttaaaataatgtaaatcttggccaggcacagtggctcatgcctgttcatcccagcactttgggaggttgaggtgggcctatcacttgaagtcaggagttcgagaccagcctggccaacatggtgaaaccctgtctctactaaaaatacaaaaattaactggctgtggtgacgtgtacctgtagttccagctactcgggaggctgaggcaggagaatggagtgaacccgggaggcagagcttgcagtgagctgagatcatgccactgcactccaacctgggtgacagagcgagactccatctcaaaaaaaaaaaaagaaaaagaaaaaatgtcgtaaatctgaatgtgtgctttgtgattcatgaattcttgtcagataaagagtatgtggtggggcagccacaaactcaaacaaggatcttcatgggcctggaatattgtgggctcaaattctctctctcctatgacactttctttaatcctcattcccacttactccacaaaaccttcttaatcctccttccctctctgggaccagttaatccttctttctcttttgatctcctactgtagttctctatacagctctgtgacagcccttattttgcattaatgttagggttaagtaaaagtctccctcattggattgtggactctttaaaggcaagagtcctattttactgaacaatgaactctagtgcatggcatatagtaggtgcacaacaagtttttgtaatgaattaattaatataaatggccacacagtaatgtcactttctcactcatctctaatggaagttcctacttggacagggagaggacattcttaaaaggtcaaaacataatctatattatatgatactagagaaaaacatcttttcatactatccgcaacaaatgtatgtactcaataaatattggttgagtcataatcaactgttaaaaacttccaatgagcttgcgaattcaagaatttactgggaagtttaccaaaaaattaattgtaactcacatagcttttaagagacacaggatctaagaatactcaggacaagagacctttaaatctgcactcccctcagtaattttaaaagtgaatatgagggccctcctctccctcatttgttcctgcagtgaaagaaggagatcactttgggagagttcaaacatgatattgatctcctacactgctgagagacataatggattcttttttttttaggataagaatggagctttgtttggaagaaaaggggtcctgcaaaatgtgataaactttccaaatatcctacaaagtctctttgtcattttgtaaaagtggacatactgcctttgtttttgtgtgatcaagtttgactcattctgcaaagcctgagggttgcatttaaaattggcattaattttgtttttcacaggcttagcttttttccctgaggcttctaacaaattctagttggcttctgtctctattattgaccatgtgtaccaagtggaatattgtctataaaaatttgaaggcatctgttgctttgcaaagactatgtgccttttatgccttaggtaagcttatcaattccagtcccctttaagaggaggctgaccatgcccatggttgcagaggtgaaaatataaagagaagcagatgtggcttgaggcagcagaaggctaagaggctcttcagagcctgtgctcactttgtctttgagtgaagctgcatctttgcagaacagcatctctcattgcaaatgtctttggaaggctcaagcatatttgaaaaaaataaaagaggcataactaaacaaaacataacctcaaacaaaagtgatagagaaggttgagccaggacacatataaacaggtttcgatgggatgagaagttattcgaaggcctccaaataactgtaggaagccagaaagagcatcgtctatttcttctcggataatcccaagattcttatctatatcccctgactcactcctcttcatcccctctatcagcccaactcaactactgcctgaaagatctatcaataccattcttactcaacaggatcaacattaggctatacatgattctgaacttgctgagttcatagttcattgatatgtggctaaaaaattatttttctgtatgatccacaattcagaaaataaaatataggtatggatggcaggtaatctctttttctacatgttgcttcctgtcaaagccaattcttctgccattttagtggaagaataagaagagtaactacccatagagttgagtcagctaaattcacataaagtcttagcatcaaaagcatttataaggatttttaaatctatttgcatattttcttcctctgcccatggaggtaaatgtcaattccattattgtaaatctgatttccagtctcataattttctttgtctctcctgcttcatttatacttttcctaaaacttggggaaaaattgttcaattacacaaagagcccagtagcccagtggctattaagttgttaaacaagcccccattctgttttcattctgtaattatttcttaaatcaagcctgtcatagccatcttgctaataagttaattatcctgaaacaaagatcaatttggtgttttgggaacttggtacaaacaatattaacacaaagttatagacctgggaatagtgagtaagggaaaaaatgaggatggttgtttaaacggctctgaatttggaaatgaccctcaagctaaaaataggaaggaaaaacaaatgaatgtgggataactaggaacataggatttgttcttgcagagctgaaatagcttaatgcttaagagcacaggcattgtagtaagacagacttgagttcttatccaagatgtgttcttccctaattgtatgaccttaagtaagtacttagccctttaaattctttccttgggaaagtgttacgttgtgattgttctgggatttaactgggatgtttgcaagatgctttgcctattacctagcatatatagtaaatgcttaataaatggtaactcgtgccatgcacatgagcccacctgtcacattcctgtgtgcccatcacagcacccactcactacagacacatgcccagggatttctggtagagaatagtcagctaccaggtgttaaaatcccaagaaagccttcagataactgtaagaaaaggacatctccccttctcagaataatcccaagattttaaggcagaggcaccctcatcttcttcaaagaagttacatctttcttaccttcatttcttctcacggcacttcctctccctggtatgcccttcctttcctttcttcacctgcttagtctcacttgttcagaacctccccgagccccacattgccacacgtacccaccgcctggcccccaggacctccaagcacacctccatcacagcccttcccacaatgaagtaatgattgtcttagcagtctcttggcgcttcctccgtcatgagggcagagacgttgccgtgtttgactgaattaaattatttcccccaagtcatccttactttgagtccacttctccaacagggggaaacattagcacaatttttctagcagctactttactatccagaatgattgtccactaatccaattaaatttttttaataaacattaagcttctcactactggcaacattaaatgtgtgtattaactaaaaagaaatttgggctgggagcactgactcacatctgtaattctagtactttgggaagccaaagcaggagaatcacttgaacccaagagttcgaaaccagcctgggaaacatagtgagaccttgtctctacaaaaaatttaaacataaaaaattagccaggtatggtgccacgtgcctgtagccccagctactcaggaggctgaggcaggagcatcacttgggcccagaagttagagactgcagtaagctataatcatcccactgcactctagtctaggcaacggaacaagacggtctctaaataaataaataaataaaattaaaatctaaaatccaaatgctttttctactttattagtggtatctctcatcataatgtcctgtcttcctactgcaagatgcattccccttagttttccatcttctaagctgttctttttgattccacttgatctccattgaatcttacaataattatgaactgaccatatttggccatggtagttaacgtcaaaattgcaggagataaatttttttaaaggatgaatcacatggacttaaacaagtaataataaaaggaaagagaaggaaaaataataaaagaaaatagaatgagcctgatcttcccagggcctaaattagcccctagtcacacatctgttgctcaggcagcacagcgggtttttttcaggctttcagggtaccacttagagctctgtagcagggagacactcgagcattaaagagaatggagcctgtaattaggagaggtaccaatgtcacatgaggctgaaatttgacttctgaggctttaacgaatttctttagtttggaagctttcttggcaaagctttaaatctcaatgccactactttgtagttttgcaaagcctcaaattgctggaatgctgggaggagagaagagaaaatagaaaggggaaaagggtatgttaattaatttaattttctggttaattcagcttgacgagtatttgtctaactgctgggctcagaatgctgtaggtgcagtagagaaaaaacgagaactgcacagtgtaattcttgtctaaaacgagcatatcatttttctcattttctccctttaacgctttctttaccaagtcatttcaaagtattttagtcctcactagtggtttaataagtacagaaaagccaatatgatttaatcttgcttccatgcatctccaatgatcagtctaatacctagaacaaagtaggtgttcaatatatctatattgaattgcatcctgtaggtggtatacgagattgggtccaatctatatggatctcaagagatattctaaaagtttatttatttgacgaaatctattaatcaccctattttctgggctacagatccctttcttaagcaacttttgattgagaagcaatgcattatctagtcagtatcatcttaatgaaatcttaaatcctcttggtatttactacattggggtttatttcagctacccccaatagaagtaagtgctttctgcagcaacttaattttagaagtgttctgtcatagtacccaaagattagcgagcagaatattgggcacttgatatctgctcatgatctggacattggtcaagctaaggatgtttgctctggggctgtacctgaatctataaaatttagacaatcggccactgcagccaccctcccttcagctaaagaattgttccgaaccccgattaccaccactgacttggattcttttctcttgggcccttttctctcaaccacaacctcctgcatggcctgaaaccgagcctctcccttcttattgttagtggtctggctttgaatcgactgtctcctaattagacagccagatcaaggggctctgggaaaggagtctggaatgctttctctcagtcaaaggggatagggggccaaagccctggttgggctgtgagggaggggcagctaagctgggcccatgtgtgtgggtgctggtggctggaactctgggacagaaccagagcagcttctttaggaagtgccagaccagacatggcccatatcagaaatccattctcccatctcagagaggctcttggaaggaggctaggcccactcttcctttgattcctgagggagaccgaatagtgatgagaggagaaaaacagaatccatgctagatgacctcaatcctctcagcaaactaaaaggcagggttatttgcaaagaggtttagaaggctgctgtggggtgcaactagagtcaacaatagacaaagaggattgctgggcagtagccagtttccctgtagctttaagctaccaacccacacagacccataggagttgggaagtcatctgcctcttgcagtcaactttgcctgcccttgctccttctgatttcctggccagtctgcaggaaggttcttctgccaacaaccacagccacccagcaaggtacatgcatcatgcagagaaacagaatcacctactaaggtccccaaatggggaagaagataaagaatatttcagtatattgcatctggacctggcttggcacagtttctgaggattcttgggggtccatcctaagactacttccaaaagccctgctttgttctgcaagtgcccagctaagatctgatcctgccagccttggcatctgcatctgtctgatgcagacagatgtggatttggatcctggctctgcaatgtagttacacaacctggacaagttatttaatctctttgaggctcagtttttgaatctttaaaatggagataatgttttataatgttattgtaggaatcgaataaatccatataaaatccaagtgataaattaaaattgataaaaaatgtataaagaaaacctctaatgcagtgtgtggcacatagtagttgttcagtaaatggcgttacctggtgctcctgttgttgagtgctgatgaagattccaaaaaatattctctgagctaatgtcgtaggaataatcaaagttatcttaagttaaccttctctgctaggtttctatagcagaataaatcaaagtcactattacagtgttaagcttcatgttcaaggagaagtttttcataaaacagttcataaatatcacaacaattttctctagtatctctttattgtgttgactttttccccacaaagttctctgggtgctgcctatatccagtgaaataaagattctgtacagaaggcttagaaaataagtgttttactcagatatacacagccttcaagtgttctgtactcatccctttgcataccaatcatgtctgtttttagatctgtcttctttcatgatttgtccttctttcattctgttaaaaaaaaaaaaaaaaaaaaaagtatgttccgccaagcttggttcagcagggctgtaccacaggaattctcatcaaaacatgggactgactctactttctcagagaattgttcccacccatctcactcaccacgtccacttaggtgtttctctttcaaattttgtagttaattatgaggctttagaaatatggttctgcaaagtagtctcaatggttgttactccattgctgataacttcactccaggagccatgagtttttaaagtttattactcttttagtgcaatcttcaatttttagttgaagaaaaacaaagtcactgcaaagagaacaccaatcaatcaatcttttggagggacatctccaaacatataaaagaaattttgaagggccagttatttgcatgttgaaggagcttcagtaacaaacaagaaatgccattggtggagagcctgcttaattgaaatctcttgcatgaatcaagggagaagtaaaaatttcaagaagctcatttggttcttagagaatgacacttatgggatatataacactgaaacaaaacagccaattgatttccccatcaagaaggagaggaaaaaaatgggagacagacctaagtttaatcaaaagcagaatcgcagaggaaagattgaactggtaccatcccttttcagtccatttagggtgtctcatagacataacattgctcattatgtggcaagccctatctctattgcagtttgaaaatcagagccaaaagaaaataaaaacaaaaactcatttccgccattaaaaatgcaaaccatgattatagttttctcctcagatggtgcataattctcctccctctgctataattccctttcctaatctagatatattttgtagacttttgaaagttgttactgcatttgttattcaaattaaaacatgtgttgtgaatgaactagggaatttggtgagcatttcattttgaaatttccaattgacctctctagccctcttatattaaatgacataaaacagattatgcagaccacatcctctgcaaattctgtccttaggaataagaaaaggattttcttaagattcctagacattaaataacaattacctaaaacatagcatccatctaatcacagaatttcagagctgtgagcaactttagacatcatctggtctattgtcctgcaattatatctccctggatccttttctgacccatgaaatgtaaataaatttttattcctagaaactcatcactctacctatgctaccgctgcagcactatcactcctgctaccctttgtattttgaagttaacatccaaggttcttgtagctgaaaactttttcattattattattattattattgtactttaagttttagggtacatgtgcacaacgtgcaggtttgttacatatgtatacatgtgccatgctggtgcgctgcacccattaactcatcatttagcattaggtatatctcctaatgctatccctcccccctccccccaccccacaacagtccccggtgtgtgatgttccccttcctgtgtccatgtgttctcattgttcaattcccacctatgagtgagaacatgcggtgtttggttttctgtccttgcgatagtttgctgagaatgatgatttccagcttcatccatgtccctacaaaggacacgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgtgtatatacccagtaatgggatggctgggtcaaatggtatttctagttctagatccctgaggaatcgccacactgtcttccacaatggttgagctagtttacagtcccaccaacactgtaaaagtgttcctatttctccacatcctctccagcacctgttgtttcctgactttttaatgattgccattctaactggtgtgagatggtatctcattgtggttttgattttcatttctctgatggccagtgatgatgagcattttttcatgtgttttttggctgcataaatgtcttcttctgagaagtgtctgttcatatccttcgcccactttttgatggggttgtttgtttttttcttgtaaatttgtttgagttcattgtagattctggatattagccctttgtcagatgagtaggttgcaaaaatgttctcccattctgtaggttgcctgttcactctgatggtagtttctttttctgtgcagaagctctttagtttaattagatcccatttgtcaattttggcttttgttgccattgcttttggtgttttagtcatgaagtccttgcccatgcctatgtcctgaatcgtattgcctaggttttcttctagggtttttatggttttaggtctaacatttaagtctttaatccatcttgaattaatttttgtataaggtgtaaggaagggatccagtttcagctttctacatatggctagccagtcttcccagcaccatttattaaatagggaatcctttccccattgcttgtttttctcaggtttgtcaaagatcagatagttgtagccatgcggcattatttctgagggctctgttctgttccactggtctatatctctgttttggtaccagtaccatgctgttttggtgactgtagccttgtagtatagtttgaagtcaggtagcgtgatgcctccagctttgttcttttggcttaggattgacttggcaatgcgggctcttttttgattccatatgaactttaaagtagctttttccaattctgtgaagaaagtcattggtagcttgatggggatggcattgaatctataaattaccttaggcagtatggccattttcatgatattgattcttcctacccatgagcatggaatgttcttccatttgttttgtatcctcttttatttcgttgagcagtggtttgtagttctccttgaagaggtccttcacatccctcgtaagttggattcctaggtattttattctctttgaagcaattgtgaatgggagttcactcatgatttggctctctgtttgtctgttattggtgtataagaatgcttgtgatttaaaacatcactatttcaatttcaaaacactgtttaaaaatcccaaagtcaagaaaacctaatgtatgtaagggcttcacaattttttcacgactgacattttatgagatgggacaaatctttgttgtgaggatggctgtcctgggtactgtaggatatttagcagcatccctggcaagtagccccctgaccccctgcaagtgtgacaaccaaaaatgtctcctgccattgccacgtttccttgggggagtggggatcgtttctgcttgttaagtatcaacatatgttgtttatgaaaaacaagtgagaaaaaaaggttgatgatctagaagccagttctcccttcaccatacacacaacctctccaacactgaatgtcatcattttgtaaaaatctttgccaattaagtggcaattatgataatattcaatcagaatgctcttcagggttcagtgccataatatttgctaaaagaattaaaagaaaagtcccatgccactctggagttgtagaagtgaaatgttgtagaaaatgaaatctgacttaattctgtggtcctgatataagagtaaattggcttcagcagcatctgcgccatcccatggctgagttgactatatgaatgttatcttcattcctcatggctctacgtttgtatgtccagagcttaagtggtcagttgaagaatccacatgtgaatagctagtacatagtagttattcaacaaatacttgttaaatgattttatgaattgtgctttatcttttcctcttgaattggacaatcagccattttagtctatgctggaaataaaaatattcttgttcaaattactcggaggatataagaccccctagaaagtctcaacgtttcttatattcctcactctacatccccaagttttaaaaaaatgtgtatgtgtttgagagagggagagatcatatgcatgtatgttacagaagcaatcaaaaatatatgggacatggtctctcagccgtagggtctcaaagagagaaatgaaagtgacaatttgtgtcaggctttatgctgggatattaaatagaccatctctgtagtcctcacaacaatcccttgaggtggatattatcaccactattgtatagatgctaagaaataagttgctcaaagtcagacagctgctacacgggagagcagaaactccagttaagcactagctgtgttttcagctgtctgaaccgggtttacaagcctcccatggctcacttggcctcatgtgcccccttggcctcggttgcttcttgaatggagagctctgtctgctactgccctgactgtcaccgcatatcctaaccttggtgatggccccagccagcctcttcaaggttgagggctggacctcatcattctcaccattgtgggatctcctgcagagccagtacctagaccccagcagaccagacttacagaggtgctggctctttcagcacttctagattcaggggctgtgctgctccctgagccctggcttcccagtggctgctcagagaggctgggcagtgtaaccaagaagtggagggatccaactccccctaggaaaacttggagcagtgaaagacaggagactggaggaaccagcagctgaagtcccctcactccctccccctaccagactggcctgagatagagtagctccatgtagcccttctggagaccatgttgccggctgtgtttattaatgaagctggggtgcagctcataacattgccctccttctttgccttactccccttttccacttcacgcttaatgcccacacacttaaaatgttaacttggaagttttgccttagtttccattttctagggaaccctggctaaaacataaatctttaatttataaaatgacagtgctgctgcccatccctcaaaagttcaaggaaaaatagaaacaaaacccctgttagtagatattgccccagactgatgataactaacagatatctgaaaagaaaaacagccagcatatgtagatgtgaaaagcagtgcattgagatggcactcactgtacctttgtggccaccttgtatctgccctaaactaccagttttcaagacactggacatcaagcaatgaagtggtccctggtagaagggaaacaaatgcagtgagccctgtgattgcttcagagcctggagatgtttccaggccacggtgcaggaaaaaggaaaccctttggaggctggtggactccatgagttgaggagatggaactgagagtccaagaaatcaaggtggctagagttgcaggacaaaagtatcagagatgagagagatacacagttgactctggaaatatgcagagggcctaatcagatattcagtggccaccttgtatctgtcctaatgatatcctgttttttcccccttgcttttagacagaagggctgtgtcaacacttactggagtagaatggctgcctttgtcttactataatgaccatatgccacctggtaagatggaaagtgtcagtcatcccaagttcaaatcttagctcttctgcatgcacatgaggaaattgcctgatgctgaggaaaaaaaaaaaacatacaaaaggattagagaaaacagtacctggtgctcacaccaggcttggaatagtgccagtgtccttcaggcagactggaaaacttcataattcacaaaacatggggagaggctttgctcaacagtggggaataattagccctaaacactgctctgatccaacctaacaaatcttaaaagcaagacctgaaagatgaaactgtttccaagtaactaaactgcattccagaacaaagctcaagaatatttatagaaatacaaaaatatccagcatccaacaaggtcaaattgtcaatgtctggcatccagtaaaaaattaccaggcatgcaaagaaacaggaaaatataccccataatgaggtaaaaaaaaaaaaaaaatcaactgaaactgactcagaactgacacaaatgttacaattaacagagaaagacattaaaagtaactgtaattttatttcagatgttcaaaagcttaaatggagacatggaaaatttttttaaaaggctcaaatcagacatttagagttgaaaactacaatgtctgagatgacagatatccaggatgggcttaatatatccacacaatggaatactaatgaataatgaaaaggaatgaactaaggatataacaacattgatgaatctcagaataatagtactgagtgaaagaacccagacaaaaatagttgcatacggtattattcattttatgtaaaaatctagaaaatgtaaaataatctgtggttacagaaagcagataaatggttacctggggagaggagaaggaaaagggattccaaaggggcatgaggagtctttggggggtgatgggtatgttaactatttttatttttatgatggtttcacgggtgtagacatatatcaaaacttataatttgtttttttaaatataatttcaatttttattttgatttggggtacatgtgcagatttgctacctgggtatgttgcatgctgctgaggtttagagtatgattgacgccatcacccgggtagtgaacacagtacccaatagatagtttttcaaactttgtcccccaccttccctcccctctctagtagtccccagagtctgttgttcccatctttatctccctgcataaccagtgtttagcttccacttataagtgagaacatgtggtatttggttttctgttcctttgctaattcacttagcataatggcttccagatgcttccatgttgctgcaaaggacatgatttcattcttttttatggctgtgtcttattccatgatgtatatgtaccacattttctttatccagtccaccattgttggggacccaggttaattccatgtctttgctattgtgaatagtgctgtaatgaacatatgagtgcatttgtctttttagtagaatgatttattttctttggatatatacccagtaatggaattcctgggtcaaatggtcaaagaacctgttttaagttctttgagaaatctccaaactgcattccacagtggctgaactaatttgtattcccaccaatagtaaaaacatttccttttctctgcagcctctgcagcatccatctttttttgtctctttaataatagccttctgactggtgtgagatggtatctcattgtagttttgatttgcatttctctgatgattaatgatgttgagcattttttcatgttttttggccacttgtaagtctttttttgagaagtgtttatgtcttttgcccactttttaatagggttatttgttttttgcttgttgaattgtttaagtttcttataaattctggatattagacctttgttggatgtgtagtttgtgaatattttctctcattctgtaggttgtgtgtttgctctgttggtagtttcttttgctgtgcaaaagctctttggtttaattaggtcccacttatcaatttttaaaacttataatctgcatattttaaatatgtgcagttcattgtgtatcacttagaactcagtaaagttatttttatttttgtttgtcatgttatctatttttttcttttttaatttttatttttggtttgggggcacatgtaaaggtttgttacataggtaaacatatgtcattggggtttgttatacatattatttcatcacccaggtattaagcccggtatctaatagttatattttctgcttctctgcctcctcctactctccccgctcaagtaaaccccagtgtctgttgtttccttctttgtgttcataagttcttatcgtttagctcccacttacaagtaaggacatgtggtatttggttttctgttcctgcattagttttgtaaggacaatgacctccagttccatctgtgttcccacagaagacatgacttcattcttttttatggctgcatagtattccatggtatatatgtaccacatttcctttttccaatctgtcattgatgggtatttaggttgattccatgtatttgctattgtgaataatgctgcaatgaagattcacgtgtatgtgtctttatgggagaatggtttatactccgccaggtatatgcccagtaatggggttgctgggtcaaatggtagttctgcttttactcttcgaggaattgccgtactgctttccacaatggtcaaactaatttacactcccaccaacacaacctcactaccatctgttattttttcactttttaataatagtcattctgattgctatgagatggtatctcattggggctttgatttgcatttctctaatgatcagtgatattgagcttttttttcatatgcttgatggctgcatgtatgtcttcttttgagacatgtctgttcatgtcctttgcccaatttttaatggaggtatttgttttactcttgtaaatttgtttaagttctttgtaagatgctggatagtagacctttgtcagatgcatagtttgcaaatattttctcccattctgtaggttgtctgtttactctgctggtagtttctttagcagtgcagaagctctcaagtttaattagatcccacttgtcaatttttgctgttgttgctattgcttttcatatctttgtcatgaaatctttgcccattcctgtgtccaggatggtattgcctaggttgtcttctaggaattttatagttttgggttttacatctaagactttaatctatcttaagttcattttcatatatggtgtaaggaaggggttcagcttcaatcttctgcatacggctagccagttatcccagcactatttattgaatagggagtcttttctgcattacttgtttttgtcatagtaaagctatttttaaaaactaaagggacaaaaatgtgttaacaaaccactgaaaaactcagaaaatagagaattcataaatataactatgtcattttaaaatatttaaaattttgtaaattttagagaattataaaataaatatttaaatctataatttttgttatatctaaatccatagaatccacagaccacatctataatattgtatctagtatagtatctgaaatttggtttggaggttttgttgttgttgttgttgtttttggagacagagtctcagtctgtcccccaggctggagtacagcagcgccatcttggctcactacaacctctgcctcccgggttcaagtgattctcgtgcctcagcctccctagtagctgggactacaggcacatgccaccatgcctggctaatttttttgtatttttagtagagacggggttttgccgtgttggccaggctggtctcaaactcctggcctcaagcaacctgcccacctcggcctcccaaagtgctaggattacaggagtgagccactgcacccagcctctttgtgtttttgtttttgtttttgtttttaacaataagtttagaacatctactgtttagaactatatattttcatgtttttcaaattagaaaaatgaagtcagaaagccacaagataaatttcagttagtttttccaaacgtgctccataaattaagaaaatattacacttttttttaaccataagtgactgtacatttattccctaatactcttctctgttcgataggaggtctgggcttaaaaccctctaaatgtctgattaaagactcaaatgctttaattcctgttgttctgcttcattagagatacagttgtgtgatggatgctcattatatttttgaattaactaatttgtgtattctcacattccaaacttgtctgtcctgatttcccccagtttgatgccgaccgcgatgaggatgaggtgttctatgacatcagcatggcagttgacaacaagttatttccaaacaaagaggctgcagcaggtaagtcactgtgtcctttagacaacagtacgccgtgatcacctgccaaatgtctggggctttgtattaatggttgaagttcaacaaactgctgcaagttttgaaggatgacaaagtcttatactttctggtataaaaataaaagtataaaacaaagtagagaggaaaggctataaatctgttccttatagttgctgcttttcttccagtcattgcacatgtaaattaccaggtagtcacaatgtaacatagggcctatgttactataatagaaaaatatctaacctaacccatactttgtacaattaaaatttacaatatctccaggaccccctaactcatacgataggtttctacctcattgcctggataaaagcatcccctccaatctggtagccactcccatcccaacccacagctcctgtgtgaccctacctcttctcttcctaagtgctcttgcctggaattttgactttggactctgatgtagagtaatcatacctcctaatgtaggcagtactcatggttctgtcctgacccccctctcattctctccgtactctgaccctgagccaactcattgtcacaggtggcttcaacatcaattctatgtggatgactctccaatcttagtctcagtcctgaccttctttcttctgagtaatgatctcaaagggtaaagaccaaaagcttggggccacaaagaaaaaaggctaaacacttaacattttaaatcactatttgaagccacctaagagtagcttcaaagaaagacagaattacaagggtaaggtggtagtctttctgggcagacccacagaacacagataaccgatgtaaactcatctgcctaactttctgatgagatttataaaaagttggcctattgcaagaaagatgaaatattgagaatcatttaagattatgaaaacatgactactgctgctctgaaaaatactatgactctgtgcttttcaagttaatattttatttagaagatgctttagaagtgactacctctaacgacaaatatctaactgctagatatcctcagtttgctaatacagtgggatggaggggctgatttaagccaccccttctttgggacacccagcacttcgtggctccctagcggtgtttctccactagggagccttgtgccctgcagtgatgcaactgtgctggtttctgtaccaataggaaaccgcctgaggacacgtgctgtgtcctcattctcttaaggtccccttggtaaagtgcatagtgcctgagccttaacagcagtttccaggtgtctactttctcctctctgtacctcagagctcataaacagaagactctgtgcttgcagcctcaactcccgctaactcttccactcctgagaccccctgaaagctggcttctgcttcagccttagaataagtttgttttctctaaaacagccctaggtgaataaagtgcagtaaactagaagtaaatggtgcctcccctgcaggaggcagatactgtgtagctccaggaaactgtcgctgttaaggaacaatggtgaaatctcctggcttataaatgttgatgactcacccaataaataagtcatatccatggcctctgctctatgaattgtcagcctccaggtttggtcccgccactgtttttttctctctcaactctctttctgcagaatctcagctgccccacagctcccatatcgcctcctatgaatggcatccaattctctttctctcaccttgacctttctccggggagccaggcagaagtgttcttgccctcacactccacactgatcatcaatccacgggggcaccttgggagtccaaacctttgtctttattcccactgcagtcaccaaacgctttgtcattcctcatccctggcctctcctgtctgtcatgaatgtcctgctgccatggagatcttcacagaatgcagctctaatcatcctgcctttctgaaaaaaaaacaaaacaaaaccttcaatgactcctgcaggctggccacgagtacccttagcacagaagaaagccccaaatcctttgctttcctgcagtggtcctgttactgccataacatcccctccccaacgtcactggcaccagcttcccccagttctctgaatacctcaagttccttcctgccttaggcattttccacctgctcttctctctgcttagaaaatgcctctcctcatttgcatccctctcactctcccaaccccatagagccccatcctgcacctggccagattctactttgcgcctcagagtaaacgtggtgattttctcaaggagactttctcagaccccaccccagactagattaggcccttgaatagcaccctgtgacccacaggtgtaccaggacttttcttagagactaccattgctctgatcgtctgcttcttcaaggcctgtctacagtgtctccccctcaatgaagccctccacccacacttctagcaaagccatctggctgcgtcactcaactgctctgggcctccatctccttatctataaagaggggataataatagcagctaccccagaggattgttctgaaaaataaatggtttctgtatgcaaagtatgtggttgtcacattgaaaaggctatctatgggttcctgtctttgcagcagatttgagggctcatggggagaaaccacatcttacacaatacaactttctccacttttcctggatctacttcttctctcttctccttctctgccctcctccctgccccaaccctgtcctggagtaactgaaaaactccccacttccccttctcacccagagcaacccatcaacacccagatccctcaaagagttctagtcccaaataccgtcagaatatttttccaagtaaatacagtgctcttcctacacattgtaatgaacactttccatgcctgtggaattcgagctggcctctcagtgcttaatgcaggtcaggcacttataggagacatttaatgtttgtagcatggatcaatgagagcaagacctgtacaggtaaagtggaagtgtcctttcatttttagtcatttggtacgtatgcattgaacacatgtaccttctaagttttgttcttagattcagaaatgaaacacaacccttacaggtttaattttcgttaaaattaaactgtaacgaaactgttaatgaaaataaaactgtaagctacgctgtaagggacaggacaagggagaaactgctttcctcagagggtgcagtttaagggttggaggagttttatttacggacacccttcactgcttaagaagccctgcaattgtaggagtgtctttatggggtactcaaagtgggaggaggattttcctaaaactttgagttaaagatccactaggaggaaaaacatctgtaacgttgacccagaaagtaatatggttagcctctggtacctctaaagctaatttgtatcaccttcccccttaaatttaaggagccaacctgaaaataatatttctgaaggccattctaaaactagcagcactgggtgcttcctctagggttctgtatttcagcgcatacctttctctgtcatctatagaaataatatttttaaatctggaaagaaattgaaaaattcaaaacggggaaaatgaaagctacactatcactttttcgtaacatcctaatttttctgtcttttttgagtaacaatatcattgcagttgttttatgtgttaaattatccaacgaaagaaggcagtaatgtgtacatttgtctatattttccctctattttttgtgtcaaaccttagagtattattaaaggtcccattttcagcaaaccaagaaaccaatgctaaaagaaaatgaaagccattcaatcattatccaagctgataatgatatcctttgtctgttgcctcctatgatatattaatcctgttgccaggagtaacaatgtttcaagaaatttcatccctaatgatacaatataattcctgttgaaagcatcttattgcaacagagggagactctgtcaaaaaaaaacaacatacattttattaggaaatccaatctcttcttacttataagcatgaagctttcttttaaacaaaggtattttcattctaccattgctgatgatagttttctaattatcttgctccgttttcaagtattaacgtgtaatatccgttaactgagttgtttaagagcctttcacattgtcgtttttgaaaacaacggaaagaacactttgtaattaaataaaataagtaggacacgggtactaaaagcagctatatgtttaaaaagatttcatgttcagatcacagtactcactccacatgaatcactctaagtacaggtgaagcaaaggtatcatttgaatccaatagctatcaccacttccaccagtcagtggcagataataatcatattgtggaagtaaagaaagccagataaaatttgtgttatctttaatgatgctttcaatagcagccacctagaagggagcattgattgttaccagcttgaatgagactccttaattccacttctgattcttccatttccacagccaccctatgacctgcgtcatcatcaaccattcactgttcctcattttctcagcacatggacttgacagcatgctcctccaggtcctttcctgcagagcactgtagcgaaagagggtctgtataaacccatttcgattgcccttgcttagaatttggagtcagcatggtgtgttataaagagaagtaggagctactggctctgcctttggtctcaggcactttctacatgacctaggccaagttttttaacttctctgcatctcattttcctcttttctaaaatgagaagtgggattctgtgaaacagacgttgaaagtagtggcaaaaaccacaatttcttttgcaccaacctgatagttctaaaatgtctattatcttataatgggaaaaatacatatatagattttttttttatttctgatacttactgcctcacaacataagtgcaaactgaccttcaaactgggctttacgacggctgagtattttggccccaaaatacaccttacaaaattatttatttgaaaaaaataccaaaagtacaaaggtagaaaaattatgtataatcccactaatgttaaaatacatatgtaaattaaagtttcccacctctaccttctaatctctgttaatagtatggtgggtagtcttgccaactccattctagcagccatcttatgaacagtggtctggcaagggctgtgctgacagcatgactagcatcacccagggttgttctgaacacacttatgcaactgcaactcttcatggcaacgctatgattacttttccaaaatggtttgatggtttagtatgtccattttgaaaaactttatcatcctgtaaaaaatgtaaagatataaacacagtaaacactggcattactgcttagaacttaatcaatttggtaatggctattactttgtcaagttggtagacagcagggacaatgataagagaagagaagggggaaaaaagagaagagatgagagaagactgtgtaaggacataccccgactcatttggaaagaaaatatgaaagcaacatcggggacaggtctatatctgagaagtgtatgagatgcttaacattttttacaaatttatattcattatgcattactcattggatattctgactaagaatgatttgccaaggccaagtttacagtgaaacaatgttttttcacaggatatataatattttatgggcagcactgaattcagtctttctgggtagttagatgatatatatttcctagcaggaaagagttattaaatgagaatgatgaatcagttgtgcttcagaagtcccattgtaaaaattaccagtttaagtctgagccttggggattaatgggtaactgatttaatgaaacctgtagtacctaagggaaataatctctctattcatacattaagttaacccgatttttcttaccttcagcaactaaggtgacccgaaggcttgaggaaaaactcgagttttcagggagtacgcaaacttagcccttcctgtttctggaaaccccttactctcctcccactctgtactttgctcatggtgttccttctacttccattattgttgcaaatcctgaaactgctccccctcctggacaacctgtattcaccctcaaaattcaggatcatagattagtacctcatgaagaatcttaactccaccatcacctctactactaatcagaattagtagctcactctcttgggttgctgaacctttaataataactcttgttgacaaattattcttcctcacagtattttcttcttcttaaggatgcagacagtgtccagagtctctgcattttgaatctccagcaaaacattgtacctggcagatgagaacagtctagaaatgtttgtgaatttaatgtgatataggaaaatatggaaacctagtgagagactgtttgctttagaaacatacatagacaacctccatccacttatcttttctttcctaatcttaggttcaagtgaccttgatccttcgatgatattggacactggagagatcattgatacaggatctgattatgaagatcaggtaattaaaatctgaaaatagttctctatttaaatgtttttaagttgaacctttgtaaatgttttatgaaaatttgaattataaaaactcattttgtgaaatatatacagataactaataacatattacatgataaattacagtagtctacagttttcattcactaagtttggctttttggcactcccttgtcctaagattcaaaacacagtgaattaaagaaaggtttatcatcaaacgttaacatgggatagaaatgaggttctcttgcccaagaatttgcctgtgtctctatcccttcccactaataaactaataatatttactgagcatcagctacaggttcagggctctgctattttatcgctaactgtattagtccattttcaagctgctgataaagacatacccaagactgggcaatttataaaagaaagaggtttaatggagaactcacagtttcacatgactggggagacctcacaatcatggcagaagacaaggaggagcaagtcacatcttacatggatggcagcaggcaaagggagaacttgtccagggaaactcctgattttaaaaccatcggatcttgtgagacccattcactatcacaacagcacagaaaagacccgcccctgtgattcagtcatctcccactggctccctctcacaacatgtgggaattatgggagctacaagatgagatttgggtggggacacagagccaaaccatatcactagtctgtggaagggaatgatgaacgaggaaagcatagccaagaagttaaatacattttctctttgaataaaactgaagacatttatctgggtcattttcctctcagcagaagaactctctctgctgctatattttaatgaaccaaaatagttggcaaatgagccaaccccctaattaggctttatttttaaaaaagaaaaatgtccaaaactttcttccgcctctcatcagtgctcctcagcaatggctaaaagccaagtgaacatgttcttgggggaggctttgttcccatctttaactaatattcatcacaaataaagcaaacagatcagaccagtgtccatgtgtaatggctggctgtatatttcatatacgtattcaggagctattttcttgagtataaagttctttccttatagcacaaagcaaggagatgatgttggcaagtgctataatagctacacatgtttatagtaatttttaacatctattaagcacttattacatgcaaaacgttgtgccgagtttcttatattaactcagcaattcttcacaacatctctaggaagtaagaattattatctctatatcacagacaaaaaaaaaaaggactagaagagtaatttacccaaggttacataaatagtttcacaataaggatgtgaacttagggcacattctctagcatacccaagactgggcaatttacaaaagaaagaggttgtgctgcctctgccacaatgtactgcctcccatcctaacctccaaagacaggtcattcaatgatatgtattgggagccttttcagttgctgacccataagactccagcagaggctaatgcaaaacaaccacttacaatctaaaattacagactgcacaaagaaatgattcacaacaaggaagccagctagttaaagaaatggaagactccacaccccccaagaactagaaagaacagaaaaatctgaaagaaatcataatataaggatattcaaaatattgaaagggaagattagaagccatgaaacaaatacatgaacaaatggaaaagaagaaagaaaaagggaagaaacaggcattgtaggcacacacaaaaatatcgtcaattgaaacagaaattcaattaacggttgaatagtaaactagatgcagctaaaaaggcacttgatagagtagaggaaattgccatagaataaaacacagagctaaatagttgtcaaatatgagaaagaacttaggagacattgaggatagaatgattggttcaacatattctaaaaggaattccagaaagagagaatggaggtgatggagccgaggttattttttaacagttaatagttgagaattttacagttattttttaacagataatagttgagaattttacagagatgaataagacaagtcccagtcccaagatggaaggaacatatccagtcctgagcaggatttttttttaatcctcatctactcttttttcatttaatcattcaacaagtattaattggacaccgactgtgtgccagtttctgtttaggcacttagaatataattacataaaagaagcaagggctcttgtggcaagaagcttacatcagagtgcagaagacagaaagtaaacaataaacatagtaaattagtcagttttctagattgtcagaggtgataaactctatgagaaaagaaagtagaaaaggtaagggggttaggaatgctgggggaggaacagattaccacattaatcaggatggtccatattaaatggtatgccctcattaaagaggtgagatttgagcagtgacttaaaatataatgtaaaccagcagaagatggaagagaaaactaaaatattaaaagtgaaaatatagtgttacagctcttttagaatttgtctagcaggctttctagtttttgctggaaagcccagaaaaaaaaattcttttaaaaaattaaaaagtgaaaatgcagttactataaaggaatgacaattttgtttgcagcagattaaatgaaacaagaacttgcatttatttagcacctactctaaaccaggaatgtgttttatggtttacatgcattattgctgatccttacaataactcaagaagtaagctctgttaatccctaatttgaagccaaggaaattgaagctcacaaaagttaactgacttcccaagaccataaagctagcaagctgtagagtcagaaatcaaactttgatttgcctggcaccaaaatctattctccactttccccactccaataaagccattaacaagctcactagtaatcttttgccaattccagttaaccctttttagttatctttcttgacctttgctgcatttgacaccgtaaactagggatcaccacactttttctgtaaaggaccaggcagtgtaaatattttaggctttgtgggcccgtatgttatctgttgcaactactcaaactctgccatcattgagcaaaacagccataacaatatgtaaacaatgaatgtggctttgttgcagtaaaacatcatatgtggatactgaaattcaaattccatataattttcatgtcatttatttccaccatttaaaaatgtaaaattcattcttgctgaaaggccatataaaaataggcagcagagtggatttgacctgcaggccatagtttgctgactcctgtcgtgaaccattcccccattcctgacattctttccattagctttcaacatttctagagcttttaatacttgtcggtgtgcttcatatttattacctcattttatcctcagacaactatattattattatcccaattttcctgatgagggatctgaggcacagagaaattaagaagtttactcaaggtcacatggttggcaagaggtaaagccaggattcaaaaggtagagctaggattcaaatccagctgtgtgactccagagccaggcgcaggaaagataggctaggttatgctggtataattaataaaactcaaaatctgagagctttccttccagagttccttttacatgtgatctccaaagggattatggatgggaaggagaagaacttgaggaagatgcacctgcatttaattgcacattacctcatctcacattcagtagcaaccctagtcactggctctacctagatgcaaggaggctgagaaatggagcttatttatatgcccaggaagggagagatgggtttgttgagcaccaagccagtctcagccacaaagcttctgctcctaaccacaggctgcagcacctgcctccatgtgatccctccctcttacttctcgcttcactcattcttggtttccttgctgaactcctctccatcagtctattatttaactgtgaacactccccagcatactgaccatggccccttctctcctaactgcacatgttctcctgtgagaggctcagtcacagccatggttttgacttcacttaaggcttcctggtgagctcctgttgcatatgtctgactactaagtaacaccagttggatttcccatgtgcatcttgaattcaacatgtccaaaaccacgctcaccatcttcccccacaaaatctgttcttccttctgttcttcctatttctgtgaatgataccaccattctccagctgcccaagccagacacaagggcgtcttcctagcctccttcctttctctctcttcctacatcagtttgatcaagaagctactcagttctcctgtgcaggaattgcttctcccactccactgcccatgctttggttcacaccctcagccttcctccctgggaccatagggccagcctcctaaccagtctccttccctcagtctgctcacccatcaaattatcttcctgaaagcacacacaatcatggcattccatggcttaaaacttttcttggctcttcatcgatttcagaattaaactggaagctcttagaagattcatagaaactttcaaatctgaatatgacccctacatttttctccaaactcatccattgccacttatcaaaacacactgactgctccagccacacaaagccattctcaggtccctcaaatgggtcatgtttgcacagtccctttcctctatatggaagtttcctcaaccctattgcttctgtcccgtgtgacctctactcatgcaccatcaggaccaagcttcccctctaggaaacccttctcttgtcacaggtttggttcaccttctcagggggcccgtgatactctgtgttgtaatattatcttgcatttcaggtactatgttctgctctctgtatccccagtgcctgccacggagcctggcatatggcatatgctcaataaatgcccatttgtttaaagccaagaacatgaattccagttcttctacttaatgtgtgatgtttttatgccttactgagccccttttgggcctcaattttcccttcgagaaaatggtggtgacaaccccacttagaagtactgttggctgggtgcggtggctcacgcctgtaatcccagcactttgggaggccaaggtgggtggatcacgaggtcaggagattgagaccatcctggctaacatggtgaaaccttgtctctactaaaaatacaaaaacaaaaaattagccgggcgtggtggtgggcacctgtagtcccagctacttgggaggctgaggcaggagaatggcgtgaacccgggaggtggagcttacagtgggccaagatagcaccactgcactcctgcctgggcaacagagcaagactccgtctaaaaaaaaaaataaaaaaaaaagaagaactactgttgtcagaggtagggagtgcagggtaccttgtacagaacaaatgctgcataaatgtgagttccctaccttccctctttcaaatatgactgaacttttcaagatagccttctatagctgacagaggccacctcttcttcaactaagtgaatgccagttgtctgagcacttctgattcctggactggcatgtgaggcacttagaagttgctgctctatcctaacaaccagtaaaaagctgaacaactgaaaataaacaatcactcttagatctgtcagagaagtgaggttacaggacaaacccttaccccaaagattggagagacaatcagagaatcacaacttacccaaacagaaaccctcaagcagaaacgtctgtagaagcctgtaccagggctggaaacactgaacagtgataatagctggaggttcagtgtggacaatatgagagttaaaaatcccagagagatccagtcatgggaccccacacttctgtaagttttacctccaggagctttgccaggtcctcacagtgaatatctggaaaaattcccctcagtcttctggccgtgggaggagaaaaaaaaaacactttgaaatatgctaaagcattctgctccttaacaaggcctgccctcagaagaaactactttaccagggcataacattcctagagcaagagaaaacccaactctagccacctctagccatcctgtcccacccaaagggagaaaagtatcgaaaaacactggcagagttcacagtccagggccacaggctcaccaaaagactgagacctaattataggactgtagaacaattccccggccccatactttatcacagcattactaaagattatttactgtggttccttttattcagtatatcaggtccatctgtcaaggaaaaattacaaggtatgtcaaaaggcaaaaaacatgatttgaatagactaagcatcagaaccagtcatatatagcaggaatgtgggtcatcagaccaggaacattttattttattttttagagacagacttttgctgtgttgcccaggttgaagtgcagtggcatgatcatagctcactgcagccttgagctcctcagctcaagcaatcctcttgcctcagcctcttgagtagctaggactacagatgtacaccaccatgcctggctaattttattttttgtgtagatgagtcatgctgtgttgcccaggctgggaattttttaaaactatgattaatatgccaaggactttaatgataataaatagacaacatgcaagaacaaatggataatgtaagcagagaaggaaattctaacacagaagcaaaaagaaattctagagatcaaaaacactgtaatagaggtgaagaatgcctttgatgggtacatttaatagactgcacatggctggggagagaatctctgagcttgagtatatgacaatagaaactttcaaggctgaaaaacaaagggaaaggctgaaaaaacagaactgaatatctgagaaacataggacagctacaaaagatgtaacatatgcataatgggaataccagaaggaaaagaaagagagtaatgaacagaagcaatatttgaagcaacattaactgagaatttcccctagattaatgaacaacaccaaaccacagatccaggaatctcagaaaatatcaagcaagataaacgccccaaaacaaaaggcctttatatacaaacttcagaaaatcaaaaatagagaaacaaatcttgaaagaagccagattttaaaaatgccttacctgtagtagagcgaagatcaaaatcatttttactttcttttcagaaactttgcatgcaggaagaaaatggagtaaaatatttaaagtgttgaaagaggggaataaagcaccaacctagaattctgtactcgacaaaattatccttcaaaaatgaaggagaaatagagactttctgagatcaacaaaaattgggggaatttgttgccagcagacctgcctggcaagaaatgttaaaagaacttctttaaagaagaaaaaatgacatagagccaggcatggtggctcacgcctgtaatcccagcactttgggaggccaaggcaggtggattgcttgaggtcaggagtttgagaccagcttggccaacatggtgaaaccccatctctactaaaaatccaaaaaattggccgggtatggtggcacacgcctgtagtcccagctactcaggaggctgaggcaggagaattgcttgaaaccaggaggcggaggttgcagtgagccaagatcatgccactgcactccggcctgggtgatagagcaagactctgtctcaaaaaaaagaaaagaaaagaaaaatgatgtagttcagaaactcaaatctatgtaaagaaaggaagagcatgagagaatgaataagtgaagataaaataaagaaatttttcttattcttaattgatctaacagatgagtatgttcaaaataatagcaacaatatatttaattatatatacttatgattctgtatacatgtttatgtgtaagtgaaataaatgagagcaatgatacaaagaacagaaaggaggaattaggaatgttttgttattacaaggtacttgcactacccatgaagcagtagagtgttatttgaaagtggacttgaaatagttgcaaatgtttattgcaaatttcaggacaaccaatttaaaaagtgagaaaagaagtatatgtggtatgctcataaaggagagaaaaagactcataatgctcaaataaaactacaaaaggcagaaaaagtttgccagacaaaaataggaacaaagaacaaaagcaacaaataggaaacagtaacaaatatggtatatattaatccaagtatatcaataatcactttaaatttcagtgatctaagcacacctatcaaatgacagagattgtcagagtggatcaaaaatcaagaccccactatatgttgtctacaagaaacccacttttaagtataaagacacatatagattaaaagtaaatagagaaagctctaccacgctaacgctaatcaaaagaaagcaggagttgctatattaatttcagacagagcagaatttagaggaaggaaagttatcagagattttttaaagcattacataatgataaagaggttaattctccaagaggacataataattcttaatgtgtatgtgcctaacaactaagcatcaaaacacgtaaggcaaaaactagtagaatagcaaggagaaataagtgaattcactattatagctggagacttcaacactcctctatcagaaatggacagatccaaccagaagaaaatcaataaggttgtagttgaactcaataataccaccaaacaccaccagtcaactggatataactggcatctatagactgctttatccaacaacaacagaatacacattcttctcaagctcacatggaatattcaccaagactacattctgggtcataaaacataccttaacaagtttaaaagaatataaatcatacagtgtctgctctcagaacacagtcaaattaaactagtattcaataacagaaagatagaaaatcctcaaatacctggtgattaaacagcacatttctaaataacacttgggtcaaataaaaaacctcaagagaaatgttaaaatattttgaactaaatgaaaatgaaaatttaacaaaatttgtgagatgcaccaaaagcagtgataatggggaaatttatacaattgaatggatatatttgtatatacattgaattcatatattagaacaaaagaaaaattaaaactaataaaagcctccactgtagaaaactagaaaaagaagaccaaattaagtccaaagtaagccaaagaaaaaaaactaataaaaattaaagcagaaatcaatgaaattataaataggaaatcaaaacagaaaactaacaaaaccaaaagctggatctttgaaaagatccataaaatcaatgagcctctagccaggctaaccaaggaaaaaatagagaaacacaaattattatcagaaatagaagatgggaaatcactacagatctcatggacattaaagggataataaagaaatattattaacaatgctatgcccacgaatttgatatgaaatggaccaattctttgaaagacacagccaaaactcatacaagaagaaacaaactatctgaataggtatatattattaaataaattgaatcaataactaataatctcccaaaacagaaagctctaggttcactggtgaattttaccaaacatttaaggaagaaatcataccaattctctatcagaagatagaagcagagggaatattttctaactcattctatgaaccattctctatataccaacactagacaaagacattacaaaaaaagaaaactgcagaccagtatctttataagtgcagatgtgaaaatcatcaacaacatatgtaaaaagcctacagctaacatcatacttaatgatgagaaacttgaagctttcctgcttttctgctaagaaaagaaataaggcaaggatgtctcctttcaccattgcttttcagcattatacatagaagcccaagctaatgcaataagacaagaaaataaaaagcatatagattaagaaggaataaataaaagtgtccttgttcacagatgaacacataaaatgggaactcacttattaccacaaggacagaaccaagctattcatgaaggatctgcctccatgacccaaacacctctcataggccacatctccaacaggggaggtcacatttcaacatgagatgagatgggacagaacctccaaatcgtattaatgacagtggctttttagatatagcaccaaaggtataatccacaaaagaaaaagtgcataatctggactccattaaaatgtaaaacttctgctaatggtctgagcagagtgtgtagagttgctgagcccacacactaaatctgaaaatgacaccagattgacaaaggtcacaccaaggaaaatgtgtgctgttcctcttctctgtgtacttttttgttcattgaaaatacctgctcaacacagagaaaactatcacttaggttctcaaaacctgaagccacacttctgcagcttcagctatccagaggaacaaatgccccatcaataaaagtactgactttttcccataggatgaaaaaccaaaaccaaaaacactgatgaaggtgatagcccaggccttccactccattattaggcttatttgtacctttgtccattcaaccagcttcaaaggaggaggtgtgcagcttgtcttcaggtttatgctctatccaagttcttttttttttaatttttttaattatactttaagttttagggtacatgtgcacaacgtgcaggttagttacgtatgtatacatgtgccatgttggtgtactgcgcccagtaacttgtcatttaacattaggtatatctccaaatgctacccctaccccctcccctcaccccacaacaggccccagtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcatcatttttatggctgcatagtattccacggtgtatatgtgccttttcttaatccagtctatcattgttggacatttgggttggttccaagtctttgctattgtgaatagtgccacaataaacatatgtgtgtgtgtgtgtctttatagctgcatgatttataatcctttgggtatatacccagtaatgggatggctgggtcaaatggtatttctagttctagatccctgaggaatcgccacactgacttccacaatggttgaactagtttacaatcccaccaacagtgtaaaagtgttcctatttctccacatcctctccagcacctgttgtttcctgactttttaatgatcgccattctaactggtgtgagatggtatctcattgtggttttgattttcatttctccaatggccagtgatgatgagcactttttcatgtgtcttttggctgcataaatgtcttcttttgagaagtgtctgttcatatcctttgcccactttttgatggggttgtttttttcttgtaaattcaatgtgccagactctatatgaggtgctggggatacattggtgggcaaaagatggcacagttcctgctatcatagagcttatagtagaactagacaagaatagaatagtcagagaaataaagttaaaactgtgaagtacttgggagaataagtgcatggtgctgtgtgtagatgtggttggtgaggtgaggaaagtcttctccaggatggtctagatctcctgacctcgtgatccgcccgcctcggcctccaaaagtgctgggattacaggcgtgagccactgcacctggcgggcaagagattcttgaattgagatctgtaagattggtcataggtaaccaagtatgtatgagaacaggaaagaactggggagaagagaaagggatgttcaaaaagaggaaatagcaggatgaagcaggaagaagcatggcatccaaaagaagaccaggatagctggagtgcagatgagcctggaaagtagggctttgtagagcaggttaggggttttgactttatcctaagagcaatggggaaccttgaagagttggggtttctgaggagggaggagagtgtgttgacataattatatttgtgtttattttttaaaacatttttctggctgcaatgtggaaaacacattggagaaaagcaatctatggagttcaaaaaaaaaaaacaaaaaaacaaggcatctatggagtccagagtgggaggctgcagtggtccaaacaagagttgatggtgacactggagtaaaaaaggggacagagagaaagaggtgtatttgagaagaacttgtgacgaaagtcaacaggacttcatgttggaatggatatgggagccaacagggggtgagctgttgaagatgacttctgggttttcaactggtacagctgggtagacagtggtggcattcactgagaaaagacgagttctgtaaagatagggcatgagtgtaattttagacatgctgagttcaaagtgccttaacatatccaagtagaaaatttcagtgagcaattaaatatataggtctggtgttcagaggaaatatctgagctggaaatacaaatttgtgagcctttttaatatagataggacttgaatttgtgagtggagatgagatagagaaagaaaacaaaattgagagaagaggctctatagctgaacaccgaggaaatttaaagtcttagtagagaaagatgaaagagcagaaagacgtagaagaagccattagagagatatgaggaaaatcagtagaatgtggtgttccaaaagccagagaaaacagtatttcaggaggcagggagtgccaaatgtggctgagaagataaggaagagagagactggaaaataatcattgaatatagaaacacggaggaaattgagaactttacaaagcgctataaagtgaagacacttaagcatgttttaactcacaggaaaggtctacttgtttgtgaaaaggagaatatacaagtataagagagaggaaagtctatctgaatgtggtaggactgggttctccagccctggtggagagactggcatgagaccaaaagagtctcgtgtgggttaagacagaaggaacattgataggataggaggatgggtttgtatatttaatggtgggaagtcaaagagttcctgtaagatgacttccagaggcaaagccatctgttgagatttcagggtttcaagagagtagaagcctgaactgttgtgaaatctagcaggcaatgtgctaaggaaacacaacaggattaccaagcatttcatttgatattagtgaattgagagcccatttgacattagtgactagaaatttattttgacgaatcaatcattttcatttttttcattcctttagcaaatgtttattgggtggccttaggtgccagacactcttataggcgctatactgagtgttgtggaattctagcaggacacagagaaggtcagtaatttggttcacacagtgatggaattttagcaaatatgtggttcagaaaggcagagagcaaagcattggcagagtataagtggtaatgagctgaggattctaagcagtttaggaaggaagtgggtagagaacaattaggagccaacgcccaaaagcactagaagcatatttgacttctttaaaaatataaccctatgtcactcttttaaatcaagagtgctatctcttggtttaaaagaatatttgatcctagcaaattgtgtcattctaaataacagagagggaaattctctaacagaaaatgatatttattcagaaatgggcattgcaataggaatatgggtgccattgtaaactatgtgtgtattcagggaggtaaaggaagacaaaggtcttgtaagaaaaaaatgaggaggattacataatagttttgagataattatccttggctacaaggataagtaacaaaggtggtgtcagtccaagtttggaaaggcaattgctgggcagatgtcctcaaagaagtgttttctgtgtaaggttgtgatggcctttgtgtgaagttgtagtttttgcagaattttttgtggtagttttgttatcaagaacttgtgcgtgagaatcctccctttatggccttcccaagcactgtttttcagctgtttttggttttgtttttttcttgttgacacaagtgactctattttgattctgataactttcacatttccccccttttgatcaagatctttttctgaaagtatcaccattcaatcatcctgtagttagattttcattgtcccttggtgccaggatgtgtcccagattgttggtctggtcccatatcagaagacgtgattggtgagtaggaatctgtgtcaaaagcgttctagccacatttgagcaacaagggaggcttggaggaaatggctctcaggctaagtctacctggaatttattgctatgttcagttttgtctattccatagtattttggccacaatctcaaagcactgggccagcattattctgttaggagttgtacttctgcagaaatttaacaagcaacaggtacaagttttaaaaacaaaaatataaaataaaattaatagtaatatggtaaatccaagtttgtataatggttttgagccatgaatccagtcttaaagacaaacaattgaataaagcaaatgaccattgagaattagatgacatctgttgttactgtgtgacccatttaaaaaattctgtggatatgggcctcaacttccccagaggaatttacccaagtataacatgtagtattagtggaagcgtagacttttttttatttaaacaatagatacctaagaggtcatgttcttttaagttatgagcagaagctgctgattgtgaaatctgaattacatcattatcttgccaaagaaaaaggtaagcataagaaaggaaaaattaagaggggcaagagtctcattttgatggagtgtcttgggaaacgctgcctatagcatgaagccatcaacttctcttggcttgcagtttgaattctctgctatggtatcaggtggattggtgaactttctgtgtggcacaagacttgtccttcttttttcgggtatgagacttgtctcttgaaatttatatcaagttgtctagcttcatcttctaaggcggcaagcacagagcagtttttgctcttagttggagagttgcagccaaatattgaagaaaattaggagaattcaggttctgatcagatctacaggtagaagagaagaacttgaaaacaatgcacaggggcacagcctaataataggtgtattatagtttttttctttagaaacataacattctctctatagtcatccttatttttaccaaagataatcacagtaagactaatttgtttgtaaaatatgtttagttttatcaaattttgccagcaagaatagtgatttgaccatacggtaatctcaaacttaaaaacttcttgagggtaggaagccaaaccaaagctgacttcagactttatctgtagtacctataaacaatttaaatatgacaatttagtcaaaacttttgtgataaaaccaatgtttccacttgtatcccataataaagagaacagattcttatcaaacttaagtaaacaatcatattgtcatgaatagttttcccattttggagggatcaggtaggaagaaaaagtaaatgctttcatttttgttcacaaatgtttactttaccaagcagctgtaaactatagatggcttaagacaaaaagttttcttcaatctggaaaacaaaacattgaggaaaagaaccagcaatgtttcaaataaataggctataaaattttttatcagttcatttaatttcatgtaattaattcttttcctgcttgagcttgattattagtttcataaatttattagtttcttcattagagttctgaaaatttttatttagtacataatttttatttattttattatctaataactttgatcttaaagttattagaaacttatatttaagactacttcttagagtcttttccatgaatctgattgagtatgtctttagaaaagaactcaaaccagtaaccgtggatgacaaaaagatagaaaacaaccgtggcttaaaatctgatgaaatcagaaaaatagagtgcaaagcataaataaataaataaataaataaataaataaataaataaataaaatttgatgaaagttcatgataaccagaaattgacaaggaaatttggttactttgcggcatacaacataataagaattctgactgatatattagatttctaagagttttatatgatcttggaacattcatatcaataacatactcataaatgtaactgaaaaaagatctagcatcacttatcgtttgacaatgcttcccatacaatttactaagtaaacctaatcatttaatatctctataagttgagagatacagtctttgaggctctccagggcccaactggaaaaatcacaaaattagttttaggtcagaaagattaaacttagaacttgaccctagggaaaactttcaaaaactgtcaagaggctgaaaacacttgatcaaaattagattacagaaagacttcaaaaacaatacagaaagttccatggatataaaacaaaccaacaaaaatccttaacctttccaaagctcagttttcctaaataatcaaaaaacataataaagacaatgtgaagcacaggaacttacaaaaatcttcatcttaggccaattaccaaaagggggaaagaaagaaaaagcttcctgcaatataattgcttcttactggaagcccgtttaaataacctggaagtctaacctgatgaaaaactacttgaatttaatcagacacaagaagagtgggtccagtggtatgagtttacatcatatcatagaagaagtaaacaagaaaactagtaccttgagcagaggaatacatggctctttaaaaaagtgaaaacatgaaattgcctggttagatggaacaattcaaacatatcaagaaaaaccaagattgcagaatcaagatatactggaggggaacattgcttttctagggcttcaagacaaacatttgagcatcaggtcataacagcagagcttgaagtagagaaaaaagtttcaggagctgacgaaaaagttgaaggagcgagttatcaacctagccaagcaaaaagatgtatcctctcaaggagggacaggaagagcagaaggcagtgttgtatgacctcaaatcctgtgctgcaagatacagcaaaaattgtacttctgagatatgaatctgaaaagcttcaagaggaaaactttacctcaagaaatgaaattaccatcctaaatgaagaacatagcacttttaatttgaaactagggaaagtaaatagactgtaaaacagaggctgggcatggtggctcacgcctgtaatcccagcactttgggaggctgaagccaggggatcacagggtgaagagaccgagaccatcgtggcctacatggtgaaaccccatctccattaaaaatataaaaattagcttggcatggtggcgtacacctgcagtcccagctactcaggaggctgaggcaggagaatcgtttgaacccggaaggcagaagttgcagtgagccaagatggcgccagcactccagcctggtgacagagcaagactctgtctcaaaaaaaaaaaaaaaagaagctgcagtttagaagatggctgaaattttacagaattaaaaatcaaagactttcacaaattttactaagagcagattagtacttcaagaaaactctgttgttctaatataagaaaccaaaatcttagttttatatcttagttgtaaattaagttttaacttataaactaagttatgtatataatccttaatccttagaaagatatacataattcccttttatttatagcaaacttgattacacacacaaaactccttttataaaattcatccctcaaaaacctttcacgatctgcacagacctttgatggcatgcttaagccgttagttttgtcctatacattcgctttttaaaataacaagtcaccttaggataaaaatttactttccttgttcccttgttattttgaaaaattattcacttctaacattccatgccaaaaatacatcttcacacttaaaactttcttcacatctctgtttcctacttactggttcctttctgtcttgtttctatttcctttctaaattcgtattttgaaacaatctttaaataacctctaaattagacaaatttttctttttctcaacaaagaacatatttttatccctttcttataacttctcctcccaaaacacattttacatttattggtatgctttgtatacagaattatatatgttaattaaaattcaaactcttagtaacattaatttctaatgaaagtgtaggaagcaagaaattttgaactgttccatatcagtattttatatataagaatgattttataattttggaaacatgtttcctcataattttaatgtgtattaatgaacccaaatatatttgtttttctataaaatttaagaagccaagaacaaacttatatttgtgttcagcaatttgtttcaatattttatcttattttgaaatgacccagatacttaatgagtatctgttacttaatttaacataactttaaaattttaagttatcaaaaagattttttgaaactaagaagaattaatttataaatgattataccatttacattcacctaatttgtttatttttaacaattataactatattacttatgaaaactaagatattagacaaggctagtaattatttcaggctaattccttgttagccgtttttacaggctgtgactattaagcattcctcacccaactaagaaccataaagttaaatacttcagtatcttgccaataactcagaaaatacagctgctttcattaaatcaacaatattaaattagtattacttatcaaggaattacataaacaaagatcgttctctttttaggatggattcatagttctatgacattcatgtcaaacactgactccttaaaatatatctaacaaagataaatgtaaaactgcctgaccagtaaactcaggcacaaatctttgctgacaattcttaagacatttctgtttttattttatcaacaattttaaaatcagtttacttatcaaacatttacccaagtcaggtgaacttaaaaactttgaggtggctattatgtttttgataacatacttgattgaagtgcttaatttttccctttaattaattaattaattagctctttgatatattttggtagaaaaatacatacatgcaacataaaaacatacagacaacatgaatacatcgaagcagattctttagctttcattttgaaatgttaatcatgagacagcaaaacatagtaatttaaacttaccagtttataaaaggacagttgaatccaaattatatttctgacaaaatgggacctgttcacatggctaaattttatttgccctgataggtgatcttatgaaggctgtggaccaaagctttgggtaaagcagtttccacagcagtttgatttttagaaacctctttttctccttcaagttttaaactggtacagaggttaaatattcaaacattttcattttagatagcaccaactaaattgtgtagaaaaacaaaataccccggtggccttgaattccggcaataaatttatctttttatttgtttgtctgatttacttgattagtcgatgcaggcaggaaagcattttagaaaaaggtatttaaagggtttttttttcccctcagcttttcctggctcacatacagcagacaaagcaaaatttttatgtcaaagataccttctattattcccctgagctcaagatttcgacctgtttgatctgagagcctaacttttgtaaaccttaatctagttctttccttcttagactatctagcttttaattaactaaagcaattgttaaatcaccctaagcaattgctagtcaatcaaaactaaattaacatttccaaaagggatgactcttaggtgtactggatagcttgttggctgtcatggaactactgtaatttgaaagccctctctttttttgttattttggctgaaatgctctttaaaaaacttgtaagtagctttggaaactagcaaaattaggttattttaatacaagtgaaaaagcagattcagagaagcagagatggggaaaaaaaggagaaaaaaagaagttgagagcctctacataccagcattttgttttaaccctatatttggtacaaaaaaaaaaaaaaaaaaaaaaaaaaaaaacaagcttggggagttcaaataacgcctaagatggccattggtttaaaaacatgcatgaggaaaaaccatgtagctggctggagtcccagaaaaactggcatgccttaatgtttgagaatctcgttttgtttcttattaatctcttgagagaaaagaaatctatgcattctatcagggaatgtcaggagtttggtattttagatagtggcttttaattggccatctcacacctaccactttgtatgtttatttttgctctgggaagatgttcaaaagcaagcaagaagagaaaaaaagtacaagattcaaattatttatagatgtgcataaccagaccaaaatgaaaccaaaattagagtgctcacaaaaatgttaagccaggcatgctaatcaaccaaaatatcaaactaggcatgcagaccaaaagtgaattcaccagaagagacatgcatcacaaacaaagtacacgttctataaaaaccagagtactcgaaccagaagaacattgtccttaaaccagaaagggcttgccagaaaagacaaaagtttttatcattccagggggaatgcaaggtccattattaaggtggccttacaatcaaatcagatcccaaataatgtccaaaaaactcaccaaagggagagagtcagaaaatctgagaagaaattctccaggaccaaaaaggcgactcgtagaaacgaagagcacaaagggctcaggtgatactgctctccatttcaggggctgataatctatctaaggtgagctgacttagatctcacttctgacaccatttatataatcctaaataagagagagagagactctctgaaagaaaataatatttatttgggaatgtacattgccatgggaatacatttgctgtagtaatctatgtgcatatttagggaggcaaaggaagcgaacattttctaaaggaaaaatgaggaagattacataatttttattgatacatattgtacatatggggaacaggtgatattttggtgcacgcatacaatgtgtaatgatcaggtaattaggatatctatcacctcaaacatttatcatttctttacattgggaacattacaaatctagccattttgaaatacacaatgaattattaactatagtcaccctactttgctatcaaaaactagaaattattctttttatctaactgcatttttatacccattaaccaacctctcttcacctcctctccctcatcactcttcctagcctctggtaaccaacatttaactctctgcctccatgatatttacttttttagcccttgcatatgagtcagaactgtgatatttatctttttgtgcctggcttatttcacttaacataatgtcctccagttccatccatattgctgcaaatgacagtatttatataaaatttggccataaaaaagaatatgtatgtatatacatatatatgtatgtatacatgtatatgtatatacatacatatatatgtatgtatgtatatctcattttccttattcattcatccattgatggacactcaggttgattccatatctttgttattgtaaacagtgctgcaataaacttggaagtgctatatctcttcagcatactgctttctggggttttgtatatcctttgttcttgctttcttatttattgttattgcagtttggtgggttttttgtagtgataagctttgattcttttctttctctttggtgtatctattccaccagtgagttttatactttcatgttttttcgtaatgatgatgatgatctttttgcttccaggtgtagggctcccttgagcatttcttgtgaagccagtctagtgctttcaaattttctcagtttttggttgtctgggaaagactttatttctccctcatttctgaagggtagttttgttggatatgctattcttgactgacaattttttgccattctttgaatatgtcatctcattttcttctggcctataaggtttctcctgagaaatctgctgttcctctaatagggattcccttataagtagctctatgcttttctcttactgtttttaaaattctctctttgcctttgatttttgataatttgactatagtgtactttggagaggactttttgggttgaatctgtttggggacttttgagcttcctggatttgaatgtccatatatcccctcagacttgggaagtttctagctattacatcattaaataggcttttttacaccctttacaacatcttctctttctgaaacttccaacttccagaataaaaatatttgttcacttaatggtgtcccataagtcttgtaggctgtcttcagtcttttgtctttttcattctttttttttctctaactgtataatttataatggcctatattcaagttcagaggctctttttttttttgttgttttgttttttgagacagtctcactctgtcacccaggctggagtgcaatggcatgcaatctcagctcactgcaacctccacctcccaggtttaagctattcttctgcctcagcctcccaagaagctgggattacaggagcccaccatgcccagctaatttttgtatttttagtagagacggggtttcgccatgttggccaggctggtctccaactcctgacctcaggtaattcacctgccttggcctcccaaagtgctgagattacaggcgtgagccaccgtgctcagccagaggttctttgttctgcttgataaagtctgctttttcagctctctattgcattttttatttcattaattgaattctttagctgcgggatttctgtttggttttttaaatgatatctctgttgtacttctcattcatatcatgaattgttttcttgattttattgaattgtccatctgtattttctagtacatcattgagtttccttaagataattattttttaattccttttccatcaattcattgatttactttttattggggtctcttactagagagttatgttcctttagtgatattaaacttccatgctcttttatgttttatgtgtccctgcattcatgtctgtgcatttagtggaacaatcacctcttccaaactttctagagtggctttcatagaaaaagactcatctacagttgggtcctggtgtgctcgttgggaaagatgtggtgactctgtttccaagtaggtgccattttatagtctctctgcagcttctctggctgtgttgaacatcagtaataactgtaggcacctcagtggtttaggctgtaggactttgtggtagctgtagtggcagtgtttattgttaatatcctcagtggcaagggcttccggggtcttcctattcttattttccccacaatggggacacttagctgagaggatccttcttgatgtcaggtctgacacagcctagaagcaattgcagtggcactggtcacagaggcaggtgcccagagtggctgtggggccagagttctgtgctcaagatctctcaaacctattgtgacacttgggtattggggtgcagatttgctctctgtggcagcgttggaggtaggttgttcacagagccaggatctgtgactctgaggtaccccctagcagcttgggtccaggaggttgggttgtagctgtgattctgccctgggaggcagggcacagccctggcctgactccaagaaataaaggatactctggaggttttagcccagggcacaggatatggctgcaatttggaagcctgaaccagtagggcttggtggcaactcgggtccctagacatgaggcactgtgtagtggtaacagatggggaaaggtatgacagtggctcaaaactcagcttagggatgtcaagccatgggcagggatgattcaaaagcagtttagactcagggatgaaagactgccatggctactcgcacccagagcaagatacactccagcagtaattccatttccaagatggtgtgtagggcagtagccatgtgggcacagagggtggggctccttctctagagggaagagagctatatggactccaggcagctccttcaactgggcttaagtgcttgtgagggctgcagaggaccccagtggtaaggactgtaggtatccaaggtgctgacaggagctgctgcgatcctcttgcttactttttccctatggagagaagttcctccaggttcccagcttatcctagctgggggatagggtggtggaagtcaggtgtttccttctgttctctgtgtgaccatcctgagtttctgtgctccccggagtttctgttattgtttggatgtacttcagtgccctccttcagttatttttattaaaatgtaattatttcttcattgttttatctgtctttgttgaggggacaagcgctaaggacttctagacagccatcttgctgatgtcaccatctgcataattgttttgagataattatccttggctgcaaggatcaataacaaggatggtgtcagtccaaggttggatgggcaattgcttggcagatgtcctcccagaagcattttttgtgtcaagtagcaatggcctttgtgtaaaattgtggggtttgcagaatttttttattgttttatcaggcatttgtgcatgagaacccttccttcatgaccttctctgtctccatttttcaaggttgtttttaacacaactgactccattttgattctgacaactttcacacctaccgggatttaaaattaaattctgcatcttctgacttgagatcttctgtaataattaaacattaatttcctgccactgaactcctaaagcattagaggctcataccttaagtcttagcacttgattatacatgttgagtatctcttactcaaaattattgagactagaagtgtttgggatttcagattttttctggtctggggtgctcaactggtatttaattttataattcattgtgtactgactcgtattactccctaactgtctcctgtatgctatatgcatccattacaaacaagagcatggagtcttaacccagatagacatggatcaaattgcaaggtgcaagatacttaacctcttcaagcctgcatttgtctgtaaaactgacataacttgcagactattttgattaaaagagataatctatgtaaaagcacctagcacagtagaccatccaggaagtatttcttcttctttctttccttcttgagagggagggcctatcagtacttcttttgtgtccactgcactgtgacagggacactgtagagatccaaatagatttaatgaataaaataataatgccgcattccatggccagaacagagtttactgtggggagtctgtgtgtgtgtgtgtgtgtgtgtgtgtgtgtgtgtgtgtgtgtgtgttcaactgaatttccatagtgatattgagcttctaaatcaagaaaaatatttttttctaatttattttttaaatattttaagtaaactttattgtatatgtgtaaggtatacaacatgatgttaagagatacatctatatagtaaaataattattatagtggaacagattgacacatatgtcatctcacatagttaccttttgtcctacccacccacccaagacatgagcagctataagatacttatttagaaaaaatcctgactgcagtacactattattaactatagtcctcatgttgtacattaaatcttttcacttattcatcctacatatttgctactttgtatcctttgacctatagctacccatttcctgtcctctccctgccactgcccaaccctgatcctagtaactgctattttattctctctctctctcactctctctctatatatatgtcagataagtggtatatatatatatatataccacttatgtatatatatatagtatatatatacacaacatatgtgtatatatatagtatatatacacaacatatgtgtatatatatagtatatatacacaatatatgtgtatatatatagtatatatacacaatatatgtgtatatatagtataaatatatactatatatagtatatatagtataaatatatactatatatagtatatacatagtataaatatatactatatatagtatatacatagtataaatatatactatatatagtatatacatagtataaatatatactatatatagtatatacatagtataaatatatactatatatagtatatacatagtataaatatatactatatatagtatatacatagtataaatatatactatatatagtatatacatagtataaatatatactatatatagtatatacatagtataaatatatactatatatagtatatacatagtataaatatttatatattgtataaatatatacaaatatatgtatatatttgacttttctgtagagattggggggagggtctcactttcttgaccccaggggtcttgaactcctgggctcaagcagtcctcccaccttggcctcccaaagtgctgggattatcaggtataaaacaccatcgctggccaatatctgatctttatttaaagattccacatataagtgagagatcatgcaatatttttctgtgtctggcttatttcacttagcagaatgtcctccagatccatccatgttgtgacaaatggcaggatctctttctcttttacagatgaatgatattctattggtatatctagattgtttccatatcttggctattgtgaaaaatgctgcaatgagcatggcagtacagacatctttatgcggtggtgattacatttcctttgggtatgaaaggaagagattgctgcatcatatggtagttctactttaaatttctttaggaacctccatgttgtttttcataatgactacagtattatacattcccacaaacagtatacaaaagtattcccttttcttcacaccctcaccaacacttgttatgttgtctgatagtagcaatcctaacaagtgtgaagtggtatctcatggtggttattatttgcattttcctcattattagggatgttgagtaccttttcatgtacctgttggccatttttaatatcatctttggagaaatgtctatccaagtcctttgcccattttgtaatcagcttatatattttcctgctaccagagtgtatgagttctttacaaatcttgaatattaaccacttatctgacatatggtttgcaaatactttttcctaatctgtaggttaacctttcatactttatttttttgagacagagtctcactttgtcacccaggctggagtgcagtggcatgatctcagctcactgcaacctctgcctcccaggttcaagcgattctcctgcctcagcctcctgagtagctgggattacaggcacctgccaccatacccggctaatttttgtatttttagtagagatggggtttcaccatgttggccaggctggtcttgaactcctgacctcaagtgatccaccttcctcggcctccctaagtgctgggattgcagccctgagccaccacgcctggtcagcctttcctattttttattgtttcgttcactgtgcagctttttagtttgatgtagttccatgtatttatttttgcttttgtagcctgagcttttggtgtaatacacaataaatcattgccaaggccaatgtcaagatcttttctcctgtgttttcttttaggagttttattatttcagtcttacttttgggtctcttatccattttgagttgagttttgtatctggtataaaataagagtccaatttcactcttttgcaagtggaaatctagcttccctagcaccatttattgcagagactatcctttccccattgtgtctttttggtgcccttgctgaaaattggttgaccatatatgtttgcaattatttctggactctattctgttccactggtctatatttctgtttttatgccagtatcctactgttttgattactatagctttgtaatataatttcaaatcaggaagtgtgatgccaccaactttgtttttcctctcagaattgctttgggtattcaggatcttttgtggataaatacaaattttagaattgctttttctatttctgagaaaaatatctttgggatttttatagggattgtattgaatatatatattgctttaggttgtatggccattttcacaatattaattactctgatccatgagcacttatttgtatccttttaatttccttcatcaatattttatagctttcagtatacaggtctttcacttccttcgttaaatttattcctaaatattttacttctttgatgctatcataaatgggattgttttcttgtttgttgttattgttgttgttgttgttattgttcaggtcattggtcaataaatattacatttagatgaagcatgtgttagcttatatttgtaaagccgatttaaaattaaaatgtgccattcccaaggcagtatatttcagtaacacagtgctgattataatttgaggacttagcaagttgtagctgacacactgagtcctgttccaataggtaagtcgagggtttggggcaagtcctatgaggatcagctggagccgggaagctggaatggccgggtttgcctcccggctctgcaggaaacacttgtgcttgatgttgaaagtcattggtggtctactgcaaaaataagaacagggatattgaagaggaacagaggtcaaaaggatgtaagtccagctttccccaaagactgaaataaaaatacttgccacagttggttcaggcagccagcaattcctggctatctccattggccctggggccttagggctaattgattctgtaagaagaaagacaagttccacttttaaacctcataaattcatatggataaattttcaccattcttgactaaaaagtcagaaatgtccttcatagcttcagtataaatattaaacagtgtcagtatatcacttaggttgccaattctgagcaaggaattcaatagatttccactctgaagacataaaagtgaatgcctcatcactatgcatagctggcatgctctgtcacaggaatataggagaaacctttgcagaaggaaatgaaaactcatagaattatttatttcaaagcaacaggatatactctagggttagaaaacatatgaaggactgatcagtagagactgttttcttttaaaaaaaaccctgttattcttgtcagacaggtattataattaatttcgtggcttctctaacatcttattaaccagatgaccttgaatgccaagtaattctgaaggcaagatgaaatcatttgtgataacacaatagtatcactgcctaataaagaaaaggaattagaactcaggtgtaacccataatctggtatgtcttggagccttaaaagacaggaaactgttgttaatgagaaaccaaataacctcctgggattattgtgtatttacaaaaggattgggtagtatgcaaaaacctggaaacccagtctaaaagcaaacataggcttataggcttatgcaaacttaaatgtgggtggtaggagagagatgtgatgaggttgccctttgttcctcataggtagttgccaaggagcagaagttaccattgtctaaccattgtccatccaggcttagggcaccgacgagcatggaagggaggctgacagggggcttagggctgctcagctgaggcctacaggtcccccttgacatgaacagcctgggcactgtggacagcgggttgatggcagtaggaaaaagacatgcccttgggtggaaaggggcgggtcctggtgaagccccaccttcacaccagggatggcctgaagcatgggggccaggctgccagttcacagactggagtaagaacttgtggtgctcttttcaggcccatccatggcttcccatgggccaatcagcatgcccttcttcccctccaaagcccataaaaatctcagactctgccaaacttgggcagacgatgggacaacctgcctgcagataggaaatacccactctgggtctcctctccgctgagggctgcagagacattgggatgacctgcctgtggacagcagctacccactccagtctcctctccactgagggatacagaaacatcaggacaacctgcctgtggataggaactacccacttcaggtctcctgagagtggtattgttgcttaataaagcacctctttgccttgctcaccctccagttttctgcatacctcattcttcctggttgcaggacaagcacttggaacccatggcaggactgaaagagctataacacaaacaggactgaaacatgcccttcactcaccacattgcagacaacaagaaggagggaagaaagagagaagagctgtggccctctggggaacccagacttaggaactccctgagccagggctgtaacaccctctttgaggctctgtggttccagtgtctccgagcttccaggtgccaccatgttccctggtgctcacagtggaagccacttgcagtatgcctggtccagccacagcagagagctggcaacaagaattgaggtttgggaacctccgcctatatttcagaggatatatggaaatgcctggatgtccagggagaagtttgctgcaggggcgggctctcatagagaacctctgctagggaagtacaaaagggaaatgtggggtcagagcccctacacagagtccctactggggcaccacctaatggagctatgagaagaggtccactgtcctccagaccccagaattgtagatccacagacagttagcaccatgcacctggaaaagccacagacactcaacaccagcccatgaaagcagccagaagaggggggtataccctgcaaagccacaggggcagagctgcccaagaccatgggaatccacttcttgcatcagtgtggcctggatgtgagacacagagtcaaaggagatcattctggagctttaatatttgactaccctgctggatttcagagttgcatggagcctgtagccccttcattttggccaatttctcccatttggaatggctgtattcacctagtgcctatacctccattgtgtctgggaagtaactaacttgcttttgattttacaggctcataggcagaagggacttgccttgtctcagatgagactttggactgtggacttttgagttaatgctgaaattagttaagactttaggggactgttgagaaggcatgattggttttgaaatgtgaggacatgagatttgggaggggccaagagtgtaatgataaggtttggctatgtccccacccaaatcttatcttgaattgtaactcccacaattcctgccttttatgggaggaacccagtgggaggtaattgagtcatgggaggggttgacatgccctggagacattttccccattgtcttggggattaacattcggctcctcattacttacgcaaatttctgcagccagcttgagtttctccttagaaaatgggattttcttttctattgcaatgtcatgctacaaattttccacacttttatgctgtttcccttttaaaactaaatgtctttaacaacacccaagtcacatcttgaatgctttgctgcttagaaatttcttccaccagataccctaagtcatctctctcaagttcaaagttccacaaatctctagggcaggggcaaaatgcttccagtctctgctaaaacagcaagagtcacctttgctgcagttcccaacaagttcctcatctccatctgagcccacctcagcctgcaccttgttgttcgtatcactatcagcatttttgttaaagccattcaacaagtctctaggaagttccaaactttcccacattttcctgtcttcttctgagccctccaaactattccaacctctgcctgttacccagttccaaagtcgcttccatattttcaggtatctcttcagcaatgccccactctactggtaccaaattactgtattagtctgttttcacactgctcataaagacaaaccccttctaaccaaatgagaacacacttaaaatgtccagtttttcactgaatattcatactctttaagaaatatcagagtcaacagtttttattaagtgcctatcctgtgccaagagttctcatgatctggtttaatcttcacaacagtaaaaaaattatcattatccccaaggtcacacaactaataacgtcctcactctaagttcatcactttccaataaggcatgctgctgccccagaatctataataactatcctcaacaaccttctgctaaccccctcaaaaaactagcttgatcttaacatcatatttgcaatcatgtaagttaatttcttcacgggtttgtaaaatgagcaagttatataaacatatgcctaagattgtaagaaatgtcaagtttgtgtttgcttgtctttcaagcataatactctttgatttccttattttgttaaatttaataacttttttattatttataaaagcaaaactaagctggtgcagtggttcacacctgtaatcccagcacttttggaggtcgaagcaggagtatcatttgagcccaggagttcaagaccagcctgggcaacatagtgagccctcatctctaaaaaactttttttaattagccaggcatgatggtatgtgcctgtagccctagctattcaggaagctgagctgggaggatcacttgagcctgggaggttgaggctgcagtgagccatgattctaccactgcactacagcctaggcaacagagagaccctgtctcgaaaaaaaaataaatacataaagacataaaagcaaaactacatgctatggaaaatttgaaaaaaaatacaaaaagtataaagaagaaaattaacattgacattatgaagcatttccttgattgatagacatttaataatgttataatcagattttgcatttaataatatagaatttcccatgtcatcaaataatttttgtaaacacattttaatggcactataaaatataattctataggaacaccatatttattttcatcattcccttattgcagaacgcctgtttttcctttcatcttttcactgttataaataatgctgccctggcacatcatggcacataaacttttcctaaatctctgaatattactctaggagtaaataaggaccaaagcgtataacggatagcattttcaaaccctctgaatctcaatttgcacatgtaagtacttgggtacataggagctgcttaataaataatcttgaatgaataaacatgacagtaacgtcagtctctcagggttgtacttgcagttttccaaatcattctcttcctctcaaccatgcttttgtatattctatattctgtcggcgattgcctttgcaccatttcacctggttaactggtgcctgtccagagaaatctctcctgacaagaccctcctaccccagggacctgaaatctgtaaggtacccatttgaagcagtctgtgcttactgaattaatcatgtggaacaatcacatgtttctacctatgtctgcccgccagattgtgagttccttgaggacaaggactatgttttatttctttatttatgtacttttctcaggtgcagaggcccaagttaaacatatctttcggttcagggaaaattgccattatttctgtgaaaatccacttcgtattttccccctttgatatattactttttaatttattcttttttatatccccgtaatcatcttccatttttctctcctgcacaagcatccattataatgcaattatatgtatctttttgtttgtatgtattttcaaaatgagctatgttgttctatatatgtatgtcttacttaattttaatgaatcgacatacttctgtatcaacacttgttcatgactggcatatctttaattttcaataaatgcctgtggaattatgaagaaaaaaggatagcattgcaatattctccttctttcttatcagatatactttaataataaatcaaggattattgattgggcaaaggactccaaaaaggaagatttttagataaggctgtttatttaaatgtttggagtaagagctgtcagattggatccaatttagtcccacatgactcatgatgcagagtatattaaatgctaaaatatctgcagtctgttgatcaataaggtagttctccaaaatgccagtcacctatgcggccaggctagattaaacggtgccacaacaacatgcattagagcctctcatgcttttccatggaacaagttcactccacattcagtccttcattcagccaagcatagatagaacaaacaagtttcactgggcctggctgtctgctagtgcttccatgagcttctagaaacaacaatattattcaaaacatccaagagttcttgtaatttccaagcacacatgctttcttaaatacctacagccagagtccagaacatatccatttatcttcctatgtttcatttgatctcattttatctgtggaggcaaatgtgtttttattaaaaagaaaagaaatttgtggacactaaactaggaagcaaaattaaatagattgtataaaatatttcatacagactaaaagctatagagaatgatataacaaacatcatttatccactgccaagcttaagaaataaaacattgcaaataactgaaaacctctgtgcatcccctctttagtcacattcctctggcctgtccccagagatgtccccgttctgaattcagtgtttgtcaatcccatatttgtctttctatttctgctgcatgtgtaggtatatctgtagaatgtgagttcccagaaagcaagtacttttctctgttcactgatacatcaccagcacctagagcaacacatggcacatggcaggttttcaaaaagtatttattgactgttgaataaataatgtatttgtaataatgtcaggattttttcatattttaaccccttataaagtgtttcatattgtatatatccttctgcaacttaatttgtttgttcaatctatgctgataatgtaacttggctccattcatttcactgcagtatagtattccaatgtaagattagaagactatttatttatctgttccaatcatgggcatctaggttgtttccgatttctaatattgtaaatttgttgcagtgaatgtcctgatactgtttttttgctccattgtgtaagagtttttctataataaacagcaggggagaaagtgagaagggactgactcttgcctctactatatttcttcctcttccaaatctctaggtgaatgggaagttgggaaatcagctcagccctctgggcatcagcttcctcacaaagaagatgaggccagttggtcagccaatcttttaatgggtttatgtatcttcgactttattattagcaacaacggtataagtagttaggaaaggactaatttcctccatgtaaactttctgtatttttctgaatcagtttcattccatagccctattcttattggtaaaggaactttcattctcagtcattgtacggggagcccctttttcctcttctccagggtcttaatagggtctggaaagactcacctggtccaaaaagtttgaggaagaagcttctagtcttcagctctgtagggtcaacatgagatgcttattgttcaagcctgtgtgatccacccaaaagtaggctgctctactacggcatccatgctgctgtgaccggatggaccacaggacagttgagaccccagctagatatctgccaaacccaggactgtcagcaagggaatagggttcaggtcttctccatttataaactaccaacccctctttactctggaatattctcactctcctggctgggatagacagtgttggctcattccactcccctcaaatcctactcctaattgtatgccatcttggtcagtattactccatccaccccaggagcccagagcctagccattctctctctctctctttcatgaaccaacagcaggaaaagaaaaagatatggttactttctcatcacatatctagctagctttatttctagatattttaattatttgtattttcatctgctttatttactctgaaaatgattgcattctaacaaaatatatttaaattctgtagaccagaccatagctattttgtttaatttatactttccaaagagaattaatagatttaccaaaataggaaattaatgtttatcaccaaaacaaatcattatcaggcaaagtcaagttgaatatataacacttatacccgcagctcttcacaatggaaaagttttaactgatttcatctcgcacacaaataatttgatgacattagtcttacacattttcttgagtgggtctaagttgccatttaaatggatatgttctctctcaagtttttttttttcttttgtggagtttagttcataaattacaatccttatcaagagttaaaacttcaagtgtcatcttctctctggacaaagatgttgagcaagatagttaatcatgttgcctttccttttttgctctatgataagaagctttttccactatccaagcaatgatgattaacagctcacttttgctgagcactcaatttgggtcaagtattaaactgagtgtttcacatacttctttatccataccagagccctatctagcgggcattagtaagcccgtttcatagatgagaaaactgagactctgagtgtgaaattacttggccaaaaacatctagtatatcgctaacgcaggaattgaaccaaatctccctgacttcaaaactgctgtaatctgaatgattgttttcccccacaattcacctgttgaaacctaatcaccaatatgaccgtgttgggaagtaaggcctttgggaggtgattaggtcgtgagggcagagccatcatgaagacatgagtgccttataaaagaggccccagcttgccccagcaagctgccttgcccatcccaccatgagaaggaattccaccatggcaggcaatgtttgctggagaaaatgaagaggggaagcccctaaaacagcaagtaattcctcaatataagttttgagatttaatagtgagggcacagccagaaggcatcatctatgaacaaaaaaacaggccctcaccagacactgaatctgccagagccttgaacttctacttcccagcatccagaacggtgagctataaatttccattgcttgtaactcacctagtctatgatgttttattatagcagcccaaacagatgaaggcaaaaactactgctctgtacccaatagtcattaccctagctgcacattagaatcaccgggtgagctgtaaaacctccccacgttcacgccccacccccagagattctgagaatgaaggctgagcaaagttaggttttgaaatctccccaggtgattgtaatgtgtgtctggcatgagacccactgtaactagctaggaaggctgacagctgaaagggatcaagtcttccagaatagagcagatcaaaagcaccaggagtggtggtctccaaaatgtaagaaagtatgatttttaaaattcatttaaatgtgaaggaaatgtgctaattcatgaaagtaacccataaaatcagagaagagtacctgaagtgcctaggattgtgcagtttccatgcagttattcagctcggactttgtccactctaaggcaatgtctgtttggagaaaatgaacagtggaagcccctaaaacagcaagtaattcctcaatactaagagtgaggtttcatagaatttagagaactgtaatgataagactctactaccgcagttgtttcctcagctgattgagccctgtggcagattttatctttgtttttccacctgcttaaggacactagtttctgatctcccaggaaactgggagtaaaccccaacctgactgcagctctcacctcagcatggagaggtttcacttggcatctgcctgaatacagatgtctccgaaggttaacagcctgttctggtgttacaccttgctagagaagagagccatcttgacctggatacatttctccatctccaagcttgggctggggctcagggggagagtaagaaatgactgggcagagagcatgtgccagggagcaagaacagcaccttcgaaggcacagacttaaaagaacgaggatgggcctcagttccaagtatggagaccagctgtcccagcttacctggtaaaatgccccatcttaggaaacctcttcatcctgagaaaatgggatggttggtcaccctagttccaaagaaccatgcagaatggggaaggagtgacgtgcagggcatcactgaagcctaaagcctgctcttctcacctgccccatgcagccttttctgaaaaccaattaactcctctgtgtgggcctggttgagcctcattctagtatctggggtctgttgtcttcctctctatgcatcacttcacttttctggagcacatcctgtagtagtttccttaaaaaaaaaaaaaaagtcaatgggaggtacattttctaaaagtcttccattgcaaatggctttattctttcctcataattttctgacagtttgcctgggtttttaatccttgtgttcgcaaatcagttttcctccaacattttgagccactgtcttctgccttgccatattgtggtcaggcgttgttctgattttcagtcccctatccttgtgacctgtgccctcctctctcctcacattcctggaagttttaaagatcctgtctgtgttcctggtgttctgaagtatcccactgatgtaccttggtgcagatcttctttcattcactgggctgcacacctggtgtgatctctcaatgtggagacgcaggtccctcgggcttgggacattttacagttggtttttattctttgctcattttctaccctctgctctttctgttcttgctttttagaattggatataaggctttcagaattgattctctccttctctacctaaattttctctcattttctacctaaattttctactaccttctgcttgctgcagacttccttaacttcaccttccatctgttctattgagtttatttcagctatcatagttttaattttcaagagctctttctttctttaactgttcctttttcaaaccatatgtttttagttttgtgggtgtaatatcttcttgtatctttctgagaataatgtttaaattgctttctaaattttctttgtctgttgcattatttttgtttcctttggattttgtttattgggacctctttcctttatatttaaaagttttctcctaagttttgagattcctggctgcccatttgtattcgtgtgtgcctgggggccactggagtaggaggctcagccagtggtgggctttagtccagcatatttaggccgtctattagcttcctatttgctataacaaattaccacaaacttagtgacttaacacaaatttatcatcttatagttctggagactggaagtcctaaagtcaagatgtcaacagaagccaggcatggtgcccagcccctgtggtcccagctactcaagaggctgaggcaagaggatcactggagcctaggagttagaggctgcagtgagatatgattgtgccacttcactccagcttgagaggcaagatgaggccccatttcttaaaaaaaaaaaaaaaaaaagggcaaaacaaaacaaatgtcaggggtggttccttctggaggctctaggggaaaatccatttccttgcccttttcagcttctagaggctacacactccctactttatggctccttctgtcatctttaaggccagccttttcaaatctctcactcctctattgtcccctctcttccttgctttctcgcactgcttctttcattatgtctcctctctgacagtgaccctcctgtgcaccaaacctgagtagtcagtatcatctccccatcttaagatccttaactcaatcacctctgcaaattcccttttgtaatgtaaagtgtattcgtccattttcatgctgctgataaagacatacctgagactgatcaatttacaaaggaaagaggtttaatggagaactcacagctccacattactggggaaacttcacaatcatgacggaaggcaaggaggagcaagtcacgtcttatgtggatggcagcaggcaaagagagagcttgtgcagagaaactcctgtttttaaaaccatcagatcttgtgagactcattcactatcaggagaacagcatgggaagacccacccccaggattcaattatctcccaccaggtcccaccatatgggaattatgggagctacaagatgagatttgagtggggacacagagacaaaccacatcataaagtaacatattcacagcttctggggattaatacatgaacttctctgggaaggggagtggcattatttagcttaccacaggcagggaccagtcattcctagtagacctccaaagccagaagagagagaatttgctgtctttttctaaacagggaacttctggtgtcttgcccagggagcaggatcctggctgttggttcctcactgcacagggagttggtggtctggttgccacataagcacattttaatctcattttcagcctctggattccctcagaggtcctgggacctggggcctttgtcttccacatgtatcctatgtggaaaatgtccacatcacacttccacacttttctccgaaggactcagacatcttatttttaaatagatctaaatttattgctgtcttccttaaaacccttttaatggcttctcactgcccttaagatgaatttcaaactccttacatggattatacttttccaaatggttaggcccttgctcacctctccagcctgtaacagttttccaagcattctttacgtcccctgctgcagccagttttggggtttgtctttgccaatttatttctctgtgtgccccaccaccaccactaccccagtagactggaagatccacaaaggcagaaaccactgtcttcactcatctgcttaacccagtggttctcaagctttaaggagcatgagaatcatctagaacactgattagaacacagtctgctgggccccatccctacagtttctgattcaataggtctgaggtagcctaagaatttgcctttgtaatgagtcctcaggtaatgccgatggtccagggaccacactttgagaaccacagatttaacaaatacttattaagcattatcttgttcacctctataccccagcagctatcatagtatctggctcatagtagagcctcagtacatggtggctatcattattatcatgaccaataaaaggagttagaaaaggaagtgggaagaagagctactgtgtacatttttctagagtttcttgaactagaaaatagttgcttaactgtgacttctgaatcattaaaatacattttataatattttaaagaaatgcaatttataatctttaatctagtataatgcaagtaccaagaagaaacactgacattcattgaaacctgtcaaggctctagatcttatggtcttaatgagcagaacaatcacttcaggctcaaagtacatctggtatctcagagatatgacacacttcctgaacttgcacaagaatgcaaatttcattaataaaggagtcactgaggcatcaagacaaaaataaagagtattttaaaacacaagactgtgtccaatcaatgctgataaagtgattcagacctcacagaatgggtcaccatagtcacaaattaagcaaaggtgtagataagagattatattattgctagcttcattacaaaagatgaatcaaatgaagagcatttagaatagtagcaaacgtcacaggaaatatacaaagcaagacaaagaaggaatggatatttgtatataaacacattccttcctcattcaaacagatctgctattgaatccaaattaaaattagaacatacatttgtttgttcatagactttggctccagtaaaaatgaaagaaatataatctccactgtcttttagaagttaatttgccagtcctgagaatgctctatatttcaaattcgtttaaaatgattcagaaggacaatcaaaatgttgtatgcatacacaatgaaatactattcagccataaaaaagaactaaatcctgctatttgcaacaatatggctgaacatggaggacatgatcttaagtgaaataagccaggcacagaaagacaaacactgcatgatttcattttatgtggaattttttttttttctttttgagacagagtctcaccctgtcactcaggctggagtgcagtgatgcaatctcggctcactgcaacctctgcctcctgggttcaagctattctcatgcctcagcctcccaagtagctaggattacaggcacgtaccaccatgcctggctaatttttgtatttttagtagagacagggtttcactatattggccaggctagtcttgggcttctgacctcaagtgatccaccttactcagccttccaaagtgctggattacaggcgtgagccaccacacccagcctgtatgtgaaattttttttttttttttttgagacggagtctgggtctttcgcccaggctggactgcagtggtgctatctcggctcactgcaagctctgcctcctgggttcacaccattctcctgcctcagcctcccgagtagctgagactacaggtgcccaccaccgcgcctggctaattttttgtatttttagtagagatggggtttcaccgtgttagccaggatgatctcaatctcctgacctcgtgatccacccacctcgacctcccaaagtgctgggattacaggcgtgagccaccgcacccggccctgtatgtggaatttttaaaagttgatctcatagaaatagaaagtaaaatgtggttaccagaggctggggtggttagtggggaggggggaatggggagatgtcagtcaaagcatatataatgacaggtagaaagaatacattcaagaaatctattgtggccgggcacggtggcttacgcctgtaatcccagcactttgggaggcctaggtgggcagatcacgaggtcaagagatcaagaccaccctggccaacatggtgaaatcccgtctctactaaaattagaaaaattagcggggcatggtggtgcgcaactgtaatcccagctactcaggaggctgaggcaggagaattgcttgaacccgggaggtggaggttgcagtgagcagagatcgcgccattccactccaacctgggcaacagggcaagactctgtctcaaaaaaaaaaaaaaagaaagaaatctattgtacagcatagtgactatagttagcaaagatatattgtattcttgaaaaatgcaaagaaagtggatgttagtgttctcaccacaaaaatgataactatgtgagatgatatatttgttaattagctaggtttagccatttcacaatgtatatatactgcaaaacgtgtgtgatgaatacatacaattttatctgtcaatttaaagtgttctaggaacattatttgaagaatgaaaagttttctttatagaaagataaatagtagtctttagaaaaacatttctgactttatgctttctaaaaagatttcctattttttcacaagctcttatcctactcgaaattcatacacaggagagccaatggtgtatattatacacaccataaacttttagcattacaacttccacacaagaaagtgatcaagccaaggaaccctctcactgccttgatccagcgaggctggacctggcatgttgtagatgcttaacaaatatttgttggatagatggatggatggatggatggatggatggatggatggatggataggtgaataggcagatgaatggatgatttatatgtgagtcctgaattttccatttaaatttttttacttgagcaatacatattcattttataaatattataaaatatagatacttaaaaggaaaagcatctataaccatgcactcacatttaagctatttaatatgctaacatctttttattataaattcttgtgaatatatatatacagttttataaaaatgggatcacagtatatccactatttagttacctgtctattcacataatatgttatgaatctctttcagtattaatacacatgctttctcactatcatttttaatagctgcataaaagtaggaaaaatacaataatttgggtattttctgggcttcctaagcctcaatttcaaaattataatcaataaatatggtggtactgttccctatactttaaaacaataaaaccgagtttgttgaaaataccattgagatagctaagaagacaattattactgataacttgaaccctgctttactggagaaaataatttgtctcaattcttcataaagtggaagctctgcaatccttaaagttatcttaaaattcattctagcttattgtgactagcttgattatacccctgctgccttatttgcaatttagtaccaaatctttctttttatgatgtgcaaagaatctagattctaatgggattctcataaacatggattacttgggtatggattaatgaaccattacaaataaattatagaatttatagacgttggaggggggaacttcttctctcctaatgtttaagaagggcccaataacaagcaccccaactcctccctgactgacttctgaacaactgagaagtctccaaataatctctccttctctggggaggagtaagtgagggatcagagcacagcacagttagtctgatcatgatcagcttggttcacattgatttagagctttatggtttttgtacatctcacttaattcaagaaaatgtcaacgtgtcaattcaacaagcacatactgaacatctactaaatgtcaggcactatgccagattctggggttacaaaacttaatcaagatttacctagtccttgctttcaaaaatctcagtctcttgggaaagacaggcaatttaaaaacattccttcactatgtgagtgtcttggttaagattctttaggttgtaagacacaaaaacctgtttagctttaaaaaaaaaaaaaaggtaaatttattgtaaacctatggagtcctctcaaaaatccaagaaagaatgcatctgaaccctaggaacagtgtggaactgggtgtggaaaggtcattaagaatttccctccgttgtgtgtctgtttccctctatttttcccttattataggcctgtttcttcccttagttacatagtaaaagcatctaccaactggtacagcccccagcagggaggccagtctctttcagtctgaattcctagagaaggatgctcattgtccaagcttggttcaggtacactcctcatccaatcacctgtggtcaggcttacatgataggggtaggaggggtgcttaagcagagtccaataggtatccagtatattgagaattataaaagtgctatgggttaatgaggagggagccacttactctgccttctatgttcaaggcactatgaaagatgaaaagttgaataaaatacacaactaattctgacataggacagagtattgttgtagcacttttgcttagttcagctgaagacagggtcctttgtcccacagccatgaaaattcaggcttgcagacaatttgaatggtaagacagttttaatgggtgaaaaggaagaaaagggggaaacagggactctctcaaggccagagtcccctgctagaatgcttcccacctggcagattgaatgccaggttccacacaggaagaggaggggccaggctccttcctgctgcaaagggtgccaacttccccgaggctccaccccagtgcgcaggccggttggagtttttccggagacctcctcccacctggctgtttcagtacgatgtgatgtgcacagttacagagatgtaacatgctcagtgaacacattggagaggagattggttccagtgggggaagaagagtgacttgagttcagtcttaaaatgagtcttttaatgagatgagttgggtaggtagctaggcagatcattctaggtgaagatgataggctgaacagaagacagggcatattgagggacagccgggaggatgtctgggctcatcagtggcaaagataagcctacgggataggctggcccagatcagaaagagttttgcatactacagtagtgtaaagtccctggcagccttggagcagagcgataacatggaaacatgacattgccactcatgtggagaatggactgaagtggagagactggtttcagggatgctagtcagagggcattttaattattaggccaaaagagatgatggaggtgcagccaggggagaagcagggggaataatgagaggagagagagatttaggagaacaagggagagcgaatatccagtaccttttatctaattccagaattaaattctgatggcagactttgggaactctttgccaagaaccagggtgctaactttgtggttgctcttggaaagagggagcagcgtcttccctttgcttctctgcttctcactgtgcttgccctcctgctctgcacactgcttaaatattgttagctggtgcaaggtttgaatcctgatgaaatttccaaaccctctcttcctgggatatagttttctcattcatgaaatggaagtgctgccacttcagggtcctgtaaagagataatgctgatgccaggccagggaaaaaagcagtactcaagatcacctttttttaaagttcactgcaacattcagtagatgaaaaatgtgtagctgtaattcattgaaggcaatgagtagtctgttcttgagttaccatggcaactgctcaattaagtgaaaaaaaatgaaaaaataaatatactacagtttctcttgagcttaacatcctttaaaaagaaacaaaagaaagtaatatgcttggtgagatattttccccaaagctttcctaggactttgcatttctttgctttacctcttaaccgggacgtcttattcacctgctgcatactgggctgaatgctagagttgttgttcatggttgggaacacacacaccttaaattttcccctcagaatgctctttggtaatgtttccttacaccgatgcttaaacagaattctgaggtggtggagtggagcctgtatcagaagggtaagtgggagtcgtggctgggttctagcactggatgtgaccccaaactttctttgtaactttaaacaagcaatatgacttctgaaactatgaacaatagctcctgccttgaccatactaagaaacaaatgatataatgataacatcttacatttgtacaagaatttacaaaattcttgcgatcatctcatttcctcttagtagccaccctctggagtgaacattgttcttcccacttgagacagaaggaaacctccaggccatgctttacacagaatctagagtgatcttttttaaaaagcacaaaactgatcatgccacttcccagcttccagccctctaatgtcttacttctcgttgctcctgggataaaacccgactccctcaccatggcccgtgaggctctgctggagtcctctgtgcagcgtcttcccagctctctgagccccagcctcactggcttgctttcagcttctctaaggcatgtgctgctcttcctgcagccctttgcatccgctggtgctcttcctgggacatgtttgtcactccccacccattcacccttccttttccttcccttctccacttgcccaactcagagtccactcctcagcccaatccagatcagagctcctgttttaatcatcctagaactctatactttatatacacccatgttcaacatacatttacttatatcgttacctaatatcagttagctagacattagacttcatgaggagagggaccatgtttgttaatctgccattgcacccccagcctgggcacaatacctggcagatcaggacagatcacgccctcaaagctgaataaagacctcattgatgttaacaagagtccaaagcagaatttgacccaaacctagtgacttagcccattttgtgctgctgtaacaaaataccacagactgggtgatttataaaaaacaaaaatttaatcctcacacttctggagtctggaaaccaagatcaaggtgccagcatctggtgagggcctgtttgctacgtcctcacatgttggaacacagaagggcggcagagaacccacatccacaagccctttttaagagggctctgccctcatgatctaaacacctcccagtggtccacaccttctaacatggttgcgctggggattaagttttcaacacatgagtcttggaggggaccaaaacattcaaaccatagcaaccatagcacccagggtagggatctagtgcttttgccaacatcccacactgcattgcaggtagcagaaatgaaaatattttccatgtataaagcaacatatacatgcaagacactgaaatttaaagaaaatacaatagcttctatgggaccacattaacttagatgtgaacatgcatcaaattgtaactctccctgaattgtaacatactcctgtatagaaagtaatatcaaattgcctcttttattcattcctggatagggaaaaatgcatggagtctttggagttcagtcccctgggtcaaggtatcagctctcttacataccaggtgtgagactttggtccttgtgtcattccctcacccaagcctcactttctttccttgtaaagtggaggctcctagtttctccttcatgggtttctgtgaacagactcacacaatgaatgcattcacaacaatgagaatttctccttccaccccacagacttctgttctgcgcagagcctgctgctcagtaataagtagaaaatgaataggaaaaacacttcggaaatccaaggctgatgatttggaaatgtgcctttgtgaagctgatgttcaaagataaaaactgttttgagcataaaatagttattttacagtccacttagttctcatatggtaatttcatacctgattttttttctaaaatatatactaatgtgtcaaatccatggcataatcttcttcgtatttactcctctttaaggcttttaattcttcgattttagtacacataaagaaaagccatgaagaggcattgatgacaagtattgattccagcctatgaaatattcccactgtcctttaaagttttaggtctttacaacctcaggggaaggaggagaggaggctgctctgaattcatacggtatatctgagaggaccagccctgtcctctctcaaggtggactggtttcagaagcagtgagcatgccctgcacttacatcatcccttcctcatcatccctcacccggtgctcatagcagtatcatcatgtaagcacaggaaaggaatggctgctctattaggagtcactgaaggctgagaccagcagcagcagcagctccagaatgtttacagaagaggggcttaagtgctggggtagggttaaagggggtcttagaggactggcctgaggccactttagtacaccaagcctcttggcttataaatggaggcatgtttatttgaactcttgagggggtgggagatgtggttgcagtgtctgactgataccattgaagcagcatttgcaaaagcagtaaaattctgctttgcttctttttccctgtactctctttccttaacatttaatatggaaaaaattgataaaccttcacctcaagtcaggccactgctagcccatatggtacttttgtgcagattagaaaaagatccccgtcttggcagacacatcagtgagacacacaggttggtaactggattcagtccctactcagctccttagccaggaatatttgtgaagtgcacaactgtagagctgtacctggcagccgtgcctcagaggcaggcctgtggcttcaggccccaggaaagggctgccttcactcagtggcaagggtccagccctggattttgaatttcccagcttttaagagttaactctcatgcttgcttttctgtcctgagcctctttcatttctgcttttggcagttttcttttttctataccacattatatatgatggactttcagaagtagaaaagagcaggccggtttccttggctcttccatctatttgtgtttggtacttggttgaatgtgtgcttttccagatgatgtcaccatgtctttaaatagtcctcaaatactctttgctaaaggcttttcaaaagacagtaaaatgtttctctttacctgctttggagcttagtactgtgattttaagacaaacaggagctataaaggctggcttttgagttcaacacgtttccaggaggcacagagctaggctaggtcactctagaaaccaacctggtagctgtcttctgcattgtcttggggaaattatagcagacagccaaaatagaaagggtaaaagtccttgggctaaaggattttcgaatattgtttcaaagtaagaagtgctgcatatgcagttaactgttgctgtgtcactgcctagatcttaatggcttaaaacaacatccatttattattcctcttggttactttggagggagggagggttggctgagcagttccactgatctaggctgggctctattgatctcagctcactcacacatctgcagtgggatggacagttttgtgtgtcaactttgctaagctattgtacccagttatttaatcaaatactaatctaagtgttgctgtgaaggtgttttgtagatttgattaacatctacaatcagttgactttgaggagagttcctcgataacctgggtgagcttcatccaattcattgagaagccttaagaacaaaattgaggtttcccagaggaagaaggaatttggcatatggcccgcagtgagagctcttgcccaacagtttccagcctgcccacctgccttatggatttcagacttacctaaccagcccctacaattgtgtaagccaatttcttgcaataaatctcataggcatagacagcaacataaataaacaacaggttctgtatctctgtggaaccctaactaatccatgtggtcagccgctgggtcagccagagccttgctgatctgggacggcctcagctgggatgacccaaactgtgctccatatggtccctcattttcatgtcctcatgacagtggcaggagcctaagggaggaaatggaagcatgcaggatacttgaagcatagccgtggaactagcatactgtaacctcttcctcattctattggctgaacagcaagtaacaagactggcacaggttaaagggtcgggggaaaataatcacctctggatgtgaggatctacaaagtgacactgtaggaggcaagaatgcaaggaaaagtgaacatctgaggctacagttgtcattgatctgccatagacagtttggtacaatggtgcaggaaaggacaaacatcggaatgttttgtaacttccaatatgcctttttcctctccttaagggagttaaaactatgaagtaaaatactcatagtcttaattttctcacttacaaataaaggataatgaagcttaccttgtggtgttagcatgagaataatgagatagctacaaaagcgtctgttgcactacctgtcaggagctcaataaataatgcatccctggccgggcgcagtggctcacacctgtagtcccagcacttagtgaagccaaggcgggaggatcacttgagctcaggagttcaagaccatcctgggcaacctagcaaaatcctgtctccacaaaaaatacaaaaattagccaggcatggtggtgtgtgcctgtaatcccagctactcggatggctgaggtgggaagatcacttgagcctgggaggcggaggttgcagtaagctgagatgatgccactgcactccagcctggatgacagagtgagaccctgactcaaataataataatattagtaacaacacatctctttaccagcaacacttgagcatgtactgcatgtaagaataaagaagacaaaatcaactggaggcacaggactggaaattttatttaagtgtctttgtagaatcaatattcataggtaaaaactctgttcaatagaaaatatttgtttgacaaatagttaagtcttatgtggtaattccaacaaagttttgaatttataggcaaaaaacaccttatgagcacaaacacaacccagtccccataatttgtcttcatgattttgaattttctcattttaatggcacatttagaatatatatatatatatatatatatatatatatatatatatatatatatatttttttttttttttttttttttgagacagagtctcattctgtggcccaggctggagtgcagtggcatgatcttggctcactgcaacctctgcctcctgggttcaagcaattctcctgcctcagcctcctgagtagctgggactaaaggcgtgtgccaccatgcctggctaattttttttttatttttagtagagacgtggtttcaccgtgttagccaagatggtatcaatctcctgacctcgtgatccacccgcctcagcctcccaaagtgctggaattacaggcgtgagccacagcgtttggcctagaagacatattttttaaagctggtgcccaggttttggaatcaagcagacctgaattcgaactctatctcacacactttctagctctatgattgaggcacatcccctaagccctaagacacagctttagatctgtcaaatggggataatacctccttcagttggctgctgtggtaagcaaattaaataatacaaagtaaatgtagttattgttattgtaaccatatagtatgatgacagaaacattcattcagggtttatagtgcactgacatgctttctaaattgtttccactgcccacttacttcacctgttcatgcttttccccactgcaatagtactgacctttattaaactagcactttggggctggttagagacctatcttctgcaactggagtagtatggagtttcatctagaaaccatagaacttgtgggtcttaaagcctatccccaaagatatccaatgcaaaggaagtatctgtcattggagtgccaaaggacatatggaatgccacataaggtggcattaacaccccacagcaaattaaattggtagtaatgaagataaagtcatcataattaataatgaaaaagcaagaatagcagcaaaatgcatccttcctgaaaactgttaagattgccagtttcagtatgtgtacacattctgtaggagcattgaacattgtcggccttgtacagcggccagattcttaagagaatgctgaactggagttctccaaagctctacaaacatgctgagttaagttatggattccaaatattcttaacccttaataacttatttattagattaatgataagtgccttttaaatgtaagccaaaaatgaaattgtatatactcataccagtattcacccaagaaaggattttgcaattgtgcataagttaagcagtattcagtgaacttgctgcctgccacctgcaagtaacctagctaaaattgtcataaacaattaaaaatgttattttcttccttacccacattttaaaggtagatgatcccagagttggtccagcagggacacaaggtcacatggggcccaggcagtttccctatttccatctgccctccttaacgcataggggatgcctccttttgtggtcgcagggtggcagtggtggatccaaacgtggcatctcacacaaccacttgtaaaaccagaatgggagagtgaggctgattctcccatgtgtgtctctcttttttaatagagaaaacctctttctcccaaagtcccccagaagattgctttttcacatcctcttggccctgatttggtcacagacccatacccataatgcaagggaggatggaaatgcaaggatctggcattttctgcatccaaaaagagaggtgggctctacctgcaagaaaagaagaggagggagggagggccgggcacagtggctcatgcctgtaatcccaggactttgggaggccaaggcaggtggatcgcttgagctcaggagttcgagaacagcctggacaacatggtaaaataccatctctactaaaaatgaatttttttaaaaaagactgggcgtggtggcacacacctgtggtcccagctactgatgaggcaattcttctggaggctctagggagaaatccatttccctgtctttttcagattctagttgcccacatcccttggcttgtggctccttccatcagtggcatcattctgacctctgcttctgttgccacctctcctctgactctgaccctcttgactctttcttagaaggacccttgtgattgcgttgagcccgcccagataatccaggatgatcttcccatctcaggatccttaacttatccacatctgcaaaatccctttggccatgtaaggtaacatattcacaagttccaagtattaggacatggacatctttgctgggggtgggaggattattctaccacagaactcagtaaatattggttgaattgttgcatgagcagtagaatctcagcattggaagcttcttggggtttttttttttttggtgttttgtttgttttgttttgtttgagacagggtctctgttgcccaggctggagtgcagtggtacgatcacaactcactgcagcctcaaactccttgtctcaagctatcctcccacctcagcctctcaaagtacttggattacaggcatgagacaccatgcccagcctcagaagcttctttagacagcacctaatctaacctcctacacggtctaagaatctcttgactgccagatagttaatctgcctccacctgaatacctctggtgctgggatcttccaaatctacacttccaggattggacagctacggacattaaacatttagacctttctaattgcctatgcactgatattacttctgcccttcttccttctggagaaatctactgattgtatcttctctatcactatttttactatattttgaaaaaagaagctgtcttcttatattcatcatttacaaatctttacttagcatgtctctgttagtcatttgggtgcaaaaagataaaagacagccccatctttgagaaggattttggaaaaacgaattctgcacatatgtagttaagtagcaatacaattaaatgagatcatctacgtaaagagcttagtgctgtccctggcatacagcaaatgctccaaaaatgctcttgttgctcttcttaccactcacacatgctctgagccaaatggatgattcatggggagtttggtgagggtaaagtgactggcaaaggctcagggaggaggggaggtgtaagaaggggcagaatgtaaacaagctcaaggcaaaggggaaggcattccaggctggacaaacaataagcaggggtccagaaggcagattaaacgggtcaagctctggggaaattaatggactcatttgtctcatgtggagtttatcttaactagcttgggcaaaccagccagtactttataaatattgtcaatagtagctatagatagcaactgctcagcagtctctcccgaatgtctcctcctgagcccttctcaggctggtagactcagagtaaagcctgtcacctcaggcccccatattgtttctaatgggaagaagacttcttttgacctgcctctttgattcccaactccgacctggatatcatctttcattcctccctggctctatgtcccactgccactaactagctctgtctcactttccactcaggcttaccctctagagccttggggattgaacacagacattcatgttgaggaataatgaaagcaggagaagtagggtccaggtcagactgtaggcttcggagtggttgatggaaaactgttgcttctatgacagtgatgatcaagaagtgcttcaggctgcagggaaagcattaattagggtacagtgtgaccaatggaggaactcagaaggaagaggactggagaaggagttgtcagtcccttaagctctccactggctcacctcatctggacccaccttcccccaatcttacttccttcttaaagaaaggtgatgtgacaaaggatgatgcctctgggtgatcctttttctccctgaaaacacacaaacacacatataatgtgttttattcttttatttatttatttttgagacagagtctctttctttcacccaggctagagcacagtggtgcaatcacagctcactgcagcctcaaacacttaaattcaagtgatcctcccacctcagtctcctgagtagctgaaactataggtgtgcaccatgtctagctatttttttaacttctttgtacagacggggtctcactatgtttaccaggctgatcttgaagtcctggcttcaaacaatcctcccacctcagcctcccaaagtgctgagattacaggtgtgagccactgtgctcaacctagtgtgttttattctaataataaatctgattttccattttgctaggagtatgtgtgtgtgcatgtatatatatatatatatatatatatatatgtgtgtgtgtgtgtgtgtattctatatactccatatatagatatataaaggctccatatatagatatagagagaaatatatatattactcagggaggtggggaggtagaaggggcagaatgtaaacaagctcagggcaaatgtatatatatacatatatattatatatatacaaatatatattatatatatgtatatatataatatatatgtatatatatactatatattatatatatgtatatatattatatatatacaaatatatattatatatgtatatatattatatatatacaaatatatattatatatatatgtatatatattatatatatacaaatatatattatatatatatatgtattactctctctgtatatctatatatggatcctgtatatatgtatggcacctaataaaagttaagagacaagccagtgtgctctgtaattcccagtgactgaagctcagctttgccattttatttctgttttacaaggaattagaaaacaaagaggtaaaggtcaaataattccttggcaagactagtcagatgtgactttatggccaacattaactttacatgaaattaaaatgggaactttgccccttcctttaaaccaccagcctgacaaagctcttcttaacaatggtgctacatttggcatctgaagacaagatcaaagtgtttcataatcttctagcagagagttgagttgaacacgtatttgagatgatgaaaaaaggaacttagagaaaaacagtgagaaaatttttttctttaaaatttcttattagagacactaatattgcaatttatatgtaagagaagaaaaataccatttctcctagagaactaggtctgttaaagcagtttatatagagaaactgcaatttaatacaactggaaaaagttagcctagcatctaccacatttttttcaactctgtttactcagttatacaagtactttacagcaagcagacctctaattgtgtagttcagtgaatgagaaatgggacttgctgcggaataaattctggggtgtaactaaattacacaccatttcccatactttttttctttcaaattgcccattactttaaatgaaaacatggtttagaaaagaactgtaaccactcaaaatttctgaaggaccagtctcccttctccctggtgataaaatgtacttatgtttgtatttttcaacattctcctgctgaagttccaagggatttcaaaacttcattcacagttttccagtaaaacctgtaaaattcattttcagatcattggtttagcatgatccagcttcagctccacttttagcaaatgaatccatcttcgtttctattcatatgacaccaggagcatttctaacgatgcccctccctgctcaccatactccgtcatcctgcacttatgtatcatctcacgccagccgggtcagccggaggaaggcagaacatgggcttggggaattgggaagcccgacccaccagggcatcctgcacaagttgcataagctttctgagcttcagtttcctcatctgaaaaatgggaaacatcaaacttgcctacttcctagtttttttctgagatcagatgagattgcacatgctgaaaacactctaagtactactgaaataatagttccagtaatcattttctaaaattgtttaatgtgtgaggtgttttgctgtttttttaaaaaaaaaaaacaggtataaggaaagtgcaaaaaaattcattttcaggtaaaaagatgaggaaatagcctgatctatttttgattgttctttttagtgtgtgtgtgtgtgtgtgtgtgtgtgcgtgtgtgtgtttctgagacagggtctcactctgtcatccaggctagagtgtactgatgcagtcatggcttactgcagcctcaacctcctaggcccaagccgtcctccagccttagcctcctgagtagctgggaccacaggtgcacaccaccatgcccagctaattttttaaattttttgtagagcagggtctcactatgttgcccaggctagtctcaaactcctgggctcaaatgatcctccctccttggccttccaaagtgctgggattatagacatgagccaccacatctggcctggttgttctttttaaattattattccatcctattaagattctgcccctcaatgaagtgaacccttccaagaacttacacgatatttttttgctccacctctatccccaccactctgctattacttcctgtaaccagagagaagtcactagaccaatttaaatagaaatctaggaaaatcctcatatgctagcatttcatggttcatgattcttccagaatttgagttattctgtttagtactcattgaggtaagaaaaaattagaaaagactgctccttacattatcttagagactaaggaatcacttttaaatccttttttcttttttctttttttttgcattttgaagttatctatgttcagtgtcagaaaaacaaagtctcctttttttgcagcattcatttgtgaattttagagcaagaaattaatcttagctgtaacattttaatgtcaagtaagcccctttctcataaccccatttgaagttacacattttgctaccatgaaacacacatgctggttaatacaaacaagttactctgaactgggaatacacccccaaaatgacctattacttctttctccttctcaggagaactttaattttgtggcctccaaaagcatttttaaaaaccaaaacggtttaaggaaggacggtgggcatatctgaatacatgattgtcatctccaagagcagtaagaggatgctgctgaggaagcagaggttagtgtcagagagctgacttcaaagttcagctcacctcttgtgccatgggaagcccaggcacatccccatcctgtgctccctcagaatctcaactacaagttcctcatccatgaggttgcagtgagggtccagtgagatcatatctgcaaacaggcttgcaagctgaattatttaaatgtcagcttcttatgatgaggtgatctgtgatatggtttggctctgtgtccccacccaaatctcatcttgtagctcccataattcccacatgttgtgggagggatctggtgggaaatgattgaatcatgggggcgggtctttcctatgctgttctcatgatagtgaatgggtctcaggagatctgatggttttaaaaattggagttctctacacaagctctccttgcctgctgccatccacataagatgtgacttgctcctccttctcttccgccataattgtgagggttcttcagccacgtgggaccatgagttctccattaaacctctttcctttggaaattgcccaatctcaggtatgtctttatcagctgtatgaaaacaaactaacacaatctactgtggcaatgccacagaaattggttctgtcaccaggagcagtcactatgctgtaatcaaacccagttgaagaagatagtttcttaaaattggtgaacccatctgtgagactaagttgttctattttgatctccctcatttaaaattcaataattcaaggaaatggaaatgactagacatgaatatcttaaggtggtgatgataggcaccctgatcctaaaggaaagcacatatataccccaattagccactcttcatacaaatgatagtaccagaacccagccttgcaaaagtagttttttttttttttgcatatacacctacacagggaaataaggttgaatgtgggttccttttgccctcctaatgggtcttgattgactggaagatgagggatagagaccaaagcaagtctctaatccaaatctgcagttttccatagccagtaatcccactttgaaattttaaatgtgtcccttcaatagaattctagatttctcctcatcaattaccaacatattacccaatctatagcatcaaaatgaggtagcaacctgaaattgtctttttttttttttttttttttttttgaggcggaatttcgctcttgttgcccaggctggagtgcagtggcatgatctcagctcactgcaacctccgcctcccaggtttcaagggagtctcctgcctaaacttcctgagtacctaggattacaggcatgcgccactatgcccggctaatttttgtatttttagtagagacggagtttctccatgttgatcagactggtctcaaactcccaacttcaggtgatccgtctgccttggcctcccaaagtgctgggattacaggcgtgagccaccgtacccggcctgaaattgtcttttggtgttagtgggtttgctgcagcttctcccaccttaacagtattaatcacagcattgcaggctgtgccttggcgccccatacatgtgagtcttaaaggtcacttaaatcaaatgtgtgactatatttatactctctctctctctctttgtcagttcagaagatttagtatcccacttcatgtacctcaaaacctagtttaatactatggaaagtcacctatgtcccgttgtgcacacaaagcctaactccataattcagacttaaggtgacaaagggtggactagatggagcctcaacacagaaaaaggccagaacacaaagaggcacccacagacactcagagtggtggctaatgggttgagtcttctcaagtgatgcctcattgaagaggaagctccaaggcgactgagcataaacacctgatcagacgtctcctgaataagcctacagcctttggttccttgtccaagtgacattctgaaattaatgcctttcatgcagaacacacccaacatttgaaaagtaacaagatttagtgcttacaggggctgtttggtatctttttcaccaaaaccagaagtgtttcccattcaccccgagtgtgtgtgtgtgtgtgtgtgtgtgtgtgtgtgtgtgtaagatgccagattaattttgtttacaaaatattcacattggaaccatgaggtttattgagagtccctggttacaccctccaatcaaacatctcattcacctgggctttcatgtcagtgcaccgcattcctggtgagagttgatgacagttgcatctatgtcccagcagcctgttcactattgatgaattaatgaaaataaagctggggctcatgtgaaacatttgagcaagtgtaatagaaggctgtgaataatagctgtggatacaaataggtcagactcaggaagcctggcagaggtcagatgggcccttttacagtgggatgcactgtttcaggaattcacattaaccacgatcagactccccaaacatgatagccatgtagaagaaagatctaatacagcctagcctataaggtgggtataagtctgataatctaacaataatattaaaaattgagggagaggactccatggtttcctctcaacattacctagatagattcaatagctgtttgacaaacaataagaagatttagattaaacaatccttttccaggaaatactcttgagcctgttctatgcagctgcaccttaggcaaacttattaattgcttcaaataggtccctgtcttaaatccaaaattccctgagaatttgggaactcctcaaggtccctgtcttgagcagtaattgatatttttcccctagaagcagagcctgagacaagaattctcatgcaagtgcattattagggagccctctgaggagaagcaggatagggcaggggtaagagctaagcaaagatgtggtcctggctccatcctaacttcagcctgagaccatggtgagctctggggctcagcttgcaccatggattcatcccagcttgaggcagggagccagactgtagtgggcccttagcagcagttcggtggctgggtgcctggccaggtgagcagaggagaggggatgcccctacactgatgagaccaaatgcatagcagccatgcaaagtggtaaaagaagtggttctcatcccatcctgacgtcactaaggacatgacggcatggccatgggcccttcgcatgacctctctgaacatcagtttcctcatctgtaaaatggaagagtgggtggcaggattggattaggtgatccctaaactccaagctctgaattgcggtaatttcaacaagggaagtggtggagaggcttgttgaggaataattgatgttttttctattcacagaagagaattcattaatgtaaatgtgtccctgaatgaccactctgttaatagctcttctcttacctggaatagcactgaatgcacaggcaactctaagaagatgagcagtaaaatttccctgaaggcatatattctaaacaggacagcaagaatctgtctttaaataaagtgttttgagggcggtttacctcaagggagtgttaatacaaccagacaacctcatttaactgactcaggcatcaaagtgaattagaggcaagaggccagcataaagcacaagccagaggctgtcccttcaaaatggtacaacctctgtggggagcagtttggcaaaattcgatcaaaattataaatacatttactctttgaccatgcagtcccctctctcgaaatttagcctgcagtatgaaatgatatttatgccaatttactcactgtgccactttttccaaaaaaagtttgagactggaaactactcactgatccatcaataaaggactaattaaacaacaacaattatggtaccacatatacaatagaatgctgtgcaactgatgatatttggtactgagaacattctgtacttatatggaaatttctccaggatacattgatcagagaaaaagcaagtggaggagcaatgtattatagaatagtattatatcgtaaacacatatgcatgtataataaaagtataatgcttttgtataagaagtggagatcataatatctatttatgttcacatgtatccctggatatctagaagtcatttttgtttgcctcaagaaaaatctgtataagtggttacctatgaggggtgacagagtggagaaatgatacaggtgaagacataggtgagagtgagagttctcacctagtgcctttttataaaatgtttttctgaatttttttccaaccaccatgggctactccataaggaatagagcatctgtttgattaaattattttttaatgaaaactttaaggtaggaatcaataaaaactgatcacccctacttcctttatttcatgctttggttcggggattggcaaattatggctaaatagttgccctgtaggggccgggcacggtggctcatgtctgtaatcccagcactttgaaaggccgaggtaggcagatcacttgaggtcaggagtttgagaccagcctggccaacatggtgaaactctgtctctactaaaaatacaaaaattagcgcagcacggtggtacatgcctgtattgccaggtactggggaggctgaggcccaagttgtttgaacccgggaggtggaggttgcagtgagccgagactgcaccactgcgctccagcctgggcaacagggcgagactatgtctcaaaaaaaaaaaaaaatggtagttgctacaggggacatgttgctcacaatgatgaaaatagttactatctggccctttacagaaaactgtttccaaccccagctttaaaatttggagttactcataaaaccgctgtgatcacacctaccactaagcttctgataccaaaggattttgtcttcttgaagtcagccttcctgtccacagatagtttttgcactttaaaaaaaaaaaaaaaaaaaaaaaaaaaaaaaaaaaaaaaaaaaaaaaagaggtgagatactgtactggttaagaagagagcatgtacttgggacagatgacccaggtttaattctgagctctgtccctcactaccctgtcacctttggaaagttaacttttagaattctcagtgtctttgtctgtaaaatattgtccctcataaaattgtttggaggtgcctccctcttacagttgttaggaagttcaagtaggccagtgttgccaaggagttcagcaaaatacctgctgttattattatctaatattgtgatttttttaacagggtgatgaccagttaaatgtatttggagaggacactatgggaggtgagttttccttactgatcagatcaaagttgtcattttagtaactttgaccatgcctttttaattaaacatcaacttgagagaaaaaatattaacagcatcactttttccttggccagggagcatgattaagagtagaactctttgggtctttcctgcctccatccatgtaaagaaccaaaggggtgcattgctaagtgatgcatttcttaactgcccagagaacatgattcccgagaggctcagcgaaaagaggatgctctactcaaatatctttgaaacatgcttaacaccaactccccactggaagatccaagtatataatagcatccaaagctcccacaagtcctgcagtaaaaagagttgttaaactttaattcaacattcattaaacataattgaaacacaaaaatatttttcctgcctggtagttactattccacgtgtacctttggaactcaacctaccctacaccaggattatactgctttgtaatttttgtcatattaaaagttttgcaaatggccaggtgcagtggctcacgcctgtaatcccagcactttgggaggccaaggcggccggatcacttgaggtcaggaattaaagaccctggccaatatggtgaaaccctgtctctactaaaaatacaaaaaaatttagaaaggcatggtggtgcacacctgtaatcccagctactcaggaggctgaggcaggagaattgcttgaacccaggacgatgaggtttcagtgagccaagtttgcgtcattgcactcttggcgacagagtgagactacgtctcaaaaaaaaaaaaaaaagtcttgcaaaaagtaaaaattccacccataactagctatgcatgtaactgaaaatagatatgattatgtgaatttgggactatccaaaaaagaaaaggttcataattgtcctaagtaaaaataccttctaacatatctaccctgtaataaaagttataatataagtcatggaaatatgtttatagtattgattctaaacacatataagtaagtgatttagctttttaaataaccccagctctaatcctgcacagatccatgagcacaaggtggtgggtaaagtgtcatttgatgataatggcaagagcagtatgtgaaaatcacagtcaccaaatgacatcttggtgattcatgaggagaggtacaaatatatgagccataacttagctgtcacttagctaagtgcaaataatcaacttggtctcaactggataggggatgactgattgcctaagaaattttctcttttattctagttataaaattaacacatactatagaaattttttaacgtataaaataagagccatttaaaaccttatgacataaattatcatggttaacattttggtacatttcattccaatgcattgcctatatatctatttttacatagttgagaatgcatgtgtatatataagtatctccaaatgttttgtatatatcacaacataaacatgttcccatgtcattaaaaactatatacttaatttgtaatgactacattagatgaatgtcatgtaccatcattcattttaaaacaactattttttaaaactgaaataggatacaatcataccaaaaaaaatcacaataataaccaggaccattttcctagattgcaaataggctcagagttcctcagcttcgtaaatgtaaactcacaggctagagaacctgagatgaccatctggttccacatgttaggaacaccagtgtatctgcctttaatagaaaactccaaacaatgtaaggtgtttcctgtcaccatgggttattctgtaaagagactggatttgatttaaaaattctctttgtttgtttgttttttgttgtggaaaccatatggtttcaacgatcccaaacttacttctatcctctgtttccagctctttctcctctctttgtccccaacccaattcatcatgccccatgctctctctttctctggtagagttggggcttcactcagctgattgtgaattcctacaaaatgtggtatcgtgcatataaatgaactaccccaatttcactaaaaaatgtttcctgtcagaataatgatctaactttcaaaagtagttatctacagaaaatatgaactgctgttactcagatacatttattttaaaaggaaattttatatcactaccttaaatgtaaaataacattatttgctctaagtgaaactattttttaaaatattatttcccagatactctacttgtgttttaaccatctgtatataaaggaagcttagcaaatgttttaaatgtgaaataacaccaaactgagatagttaggatgatttaaaagtaatttttaaaaatagctttctttgtgattcatgctattaaatgacgtaaatttttgccaccaaaagttgatcgtgcatgttaaaataaaaatacattaccggggtgggggaataagactgaaataagcagggcacggtggctcacacctgtaatcccaggactttgggaggccaaggcaggtggatcacttgaggccaggagttcaagaccagcctggccaacatggtgaaaccccctctttaataaaaatacaaaaagtagccaggtgtggtggcatgcctataatcccagctatccaggagcctgagacaggagaatggcttgaacctgagaggtggaggttgcagtgagacaagatcgagccactgcactccagcctgagcaacagggtgagaccatctcaaaaaacaaacaaacaaacaaaaacactgaaatggtcattggtgcctactaattgtagcctattcacacatttattcaacttcaagctttttatcaaataaaactacaaggtttgggtttttatataatatgagtaaaaccagggcttcagtacagtttttcttgccaataacttaagttattcttattttaaaggtttcatggaagatttgagaaagtgtaaaattattttcataattggtgagtaacagcccttgcattttctaacaatacaattgctaataataagaatttggtagtgggccaggtgcggtggcttacacctgtaatcccagcactgtgggaggccaaggcgggcagatcacgaggtcaggagatcgagaccatcctggctaacacagtgaaaccccatctctagtaaaaatacaaaaaaaaattagccgggcatggtggcgggcgcctgtagtcccagctactcgggaggctgaggcaggagaatggtgtgaacccgggaggcagagcttgcagtgagccgagatcgcgccactgcactccacctgggtgacagagcaagactctgtcaaaaaaaaaaaaaaaggaatttggtagtgaaagagactatttatttctcatcctgttttgaagtctttttggtcaaaatagtaccccaagttttccggttatttctttcacgtatgcagttgtatattgctttgggatttgtatcttttcagcatggaaaaagtagggcttgaaagaatgtcaaacttctgagtttagctctacaataacaaagtgcattaaaaaggtaagaggttgtcatgtattaaaatctaacacacatcttttcagtttaaacactgaccccctccttcctaaactgaatgcatcaattgcctcatgttcaaatatagctcaatagccagatcctgattctatacagcaaacagtaaaaactatctaatttgctctttgctctagtacagtgaaacttattgatggattaattgtgggagaaaatgtgtttgaggtttaccaacattttctgagcacccactatgctccaggttatctcaattaatccttatacaatcccattacctagtctattcctattacatatctattacatagacaagaaaaatgagactcacaaaggttaaggaatttgtccaagattatgaagctaatgagtgtgtgagggccagatttccagttttcctcatggaaataaagggaactagttgtgcagtagttaaaaatgcataaaaaaaggacaaatattatcctttcaaaacttagtactttttcctctaatcattcaagtgcctcaaaaaattagtacacctacctgtacattttccagaaaatgtctatttatattcagaaataatgaaaaggtccacacctcctcaatgagtgggaaaagaatggttgtcaacactacagaaatataatcagataaacttaagactcttgcaagttaagatcagagtgcctccttggaaatctctgggtaaagttctctcattgttagatgaggaaactgaggcccagagaagttaaggggtctgatcacagtcattcaattaactggtatcagggagaggaccagggtctctgactgtagttcctcactccaggcttctccctcctctgccactcagttgtgttggttgttaacctgaacgcaagctgtctcacacattcagccatctgacacatgcttattgactgttggacccctgctgggcagtgaggagtcacagagctgccatcttagatgaagagaataatggatatatcattaaccttgaaaagtattaggaaggaaccaaagagctgaaatagggaacaacctgggtcaagtgtttggagtaaaattaggtgattactttagagagggtgaccagggaaggcttccctaagaatgtaacatttaagcagagagataaaaggagagatgggcccagtgaagggatgaatgggaggtgagaggaggcaaagagaacagtatgtgtcaagcagtgggaattcttgagacctaccttagttccagttgtcatctgcttacctctagctgaccttaactgtggaaactggatggactcttcccacacttattttacgtttttttcagaaagtaaaactatatattgcttatatctcttattgaagagtaacccaatgtcataattgcaaaggaaaattagttgtgctatagattactaaaattcccttttccacataagttttaataatcaattttcctggcatccagaccatacagagtcttatattttctattcaatctttatattaggagccaagttaggaaaaggggagaccctttaaacttgacagctaggaattcacagtaggagcctgtattagtcagcgttctctagagggacagaactaatagaatacatatatacatataggaatttattaagtattaacttacgtgatcacaaggtcccacaacaggctgtctgcaagctcaggagcaaggagagccagtccgagtcgcaaaactgaagaacttggagtttgagggtaggaagcatccagcatgggggaaacatgcaggctgagagggtaggccagtctctccttttcacatgtttctgcctgctttatatttgctggcagctgattagattgtgcccaccagattaagagtggatctgccttcctcagaccactgactcaaatgttaatcccttttggcaacagcctcacagacacacccaggatcaatactttgtatccttcaatccaatcaagtccactcagtattaaccatcacagagccctttattatcacatagaaatctgtgtttttaataatgtggtccaaagaagcttccaaaaataatacagtatgttttgtggtggttgttactgtcttggcagtaatattacttcagatttatccattgtttaacactcacagttgaactgtgaaatgcgttgtcaaatgccacttccttctctctaggcataactaaagacctcacctgttactaagtcctgtgcccttcaaaaggtcaaacagcacagtagaagatctttggaattagacaaagctcgaaacctccaagggtccacagaccaccctctaagaattgctgcactgagcaaaagatttttcttctatctaacaaaactctcctgtatttcaatttactgatcagtcactcttctagtaaaagagatttcagcttgctgtttgggccatagaaggtacaaagccactgtgatacaagggaaaacgactgctcttcttctactgtacatactgaactctgagaattaaggccttagttctaaatatgtccttgacaggtggcagaatggtattttgggactgctttattgtaagtcaatttaaccttatgaaaatattccagatgtcatagacacacccatagctgttttgatgagttcactttcagtgaaacagagtggttttgtctatttgagaagatgactggattgtcacttttcaaattattgtcttggcatatacccgaaaaacattggggctgcagtattagccagagtctaggttgacatcctcactattcgccttaagacaaaattaatatgcctaaagcattcttcccctgttttaacatatccattagatcctttttgtccacagaaaggtccagacttcttagactggccttctggtctttcccatttcccgccacactcccatgtcaatctttggctccagccacacctgcatccttattatcgcttgagcttgtcgcactttgccagccctttcacttgaaatgtcttctcccctattaatcatgccccaaggtcagggttaagttctagctccctgagaactccgctgtaatcaccatccttcctcctctgcgctcctcctcccttgtgtctacatcattcatttgggtactacttaatgactagaacaacaaatatttgttggaataatgaattctttaagaagcagtgtggtctgtttccataacaaccaaaattgcaattggaattcctggcctagaactgacaagcagcttgttgctgctgtggctgtttcttgcaggatggttttcatgttaattaggagcctaatcagatgctcctttctccatgaagctgctaccctctcactgagagcaagcaaaagcaacttttcccctgagctggtgctgtttcttgctcatttgcagggcagtagtcacaggtgggagcaggtgatagccctgatggtcatctgagtggaaaaaatgttcagggcaagtgtaccatctgcaccaaaggggaaggtggcaaggacggacccagtccaccctttgaataatgtgtgactatatattcttgttcccgaagaaagcagctcagtagctgtttataaagaaatacttttcaaaaaacaaagaagggattcccacagggtaggaccagatgatccaaaggattgaaaaagattctatggacttcagttgttcacatacaagatataagaacctgcactgatatacaagacaggagctcaatcacttctgaaaactgaaaattatttggaaaatgtaaaaatagcctttaaagggcctcattatgtcccactaacaggttcctacagtttttcacaaccttttctggtacatttctttccttttttctttttttttttttttaaatctcttgatcattattttgctatgagcccatttattctggcgtctttttcccttctccatttttcattgcctgcctatgcccaaaatgtgacataatctaaattcctactaatttatatccaaagcttgggtagaagtgctccaatttgggaaacacatctgacttttcaggtgaggtatggtattaacaacataatgatcaagacatcattcaaaggccatagctttcaatgtgtctgggacacacgtggcctggtgtacattggcattgatgctgtgataaactgtttttaagtagtgaactttgggaggtattttggcaatattttatgttaatttgtgcatttttaaccactacaaaaatagtcctatctattttcctaaggaaaactggagtaataagaatttttgcttaaaactcaatattgcaatgcctggcactatttcattatagccatgttgccatttcattattgccttattattaaaaaaacatgaattgaattttttttttttttttttttgagatggagttttgctctttctcccaggctggagtgcagtggtgctatctcggctcactgcaacctccgccttctgttttcaagtgattctcctgcctcagcctcccgagtagctgggattacaggcgcctgccatggcgcccggctaatttttgtgtttttcgtagagacggggtttcaccatgttggccaggctggtctcgaactcctgacctcgtgatccaccggccttggcctcccaaagtgctgggattacaggcatgagtcaccgtgctcagccatgaattgattatttaaagtatctacctgctgcttaacatgagcacttttgatggaattgacccacgtatttggttaaattaaatatgaaagaactcggattattttaactcagtgtagctgtaatagcagtcaacatttattgagcagttaacacgtaccagacactacataaagcactttataatgttatcttattgaatgctcctatccatcttctggagtaagcactattactctcctgatttttcaagtaagacattagggagttcagttattagatactaagtggtggatctggaggttgaaagcatggatttttgcaaaaatcactgcctgttgtttttgttttttcttgaagtgacaggctttatttattttcaagaaaatttctgccagattctcaagtctgaaaaaaaccacagttcgtttgttagatgctctttcagaaagtagatacagtgttcacttttaaaagcaactgattcagctacttaaataatcacacaagtgcttttcccaaaacaaaagcaaaaaccataggtgtgctaaagggccttatgcgtatttcccattttgtcacacaaaatattaaaatgatgtgtgcttaagggtaaaaattaaataaaatgtgtcttttttactgcttcatcaagggcattcttatgtaacattggcattttctttcttttctctgttttttactgtgagtacatggtaatgaagcacacaactagtacagcaggactaataacactgctgccgtgcaccacaggtttacaaccattgcttctgcaccacctccgaaatgctaataacctcttagtgttataatgaatataggggacctctaatgtctgtggaccacactttgagaaccaccaccatggggttacttgggggttggggtgggtgtgttgagcacatacataggacagagagaaaccccagatttagcacttagggatctcaaagggaaaaagttccttgtgcctttccaagcaaataacctcaaaaatgtgaggaagatgtcagggggaaaatagcgcatctgctgaaagccctgtttctctgggctcctgtaggcctggaaaaagttctgagtgtttctctgtgcccagtagtgcaagggataactaaaaggaaagtctgtgcacttgtcagaagaagacaaagaggactgtagcaggaggtcccaaagcagggggctggatggaaggtggagggggtacagcctaggggagcaacagcaccaggaagaacgagaactgaagggagggcaaagaaaacctgcaaggtgggagaatggccctgacatggagactgaactttgaactggactatcaaggttatcagaaatcactggattggactaagaaaacccagactggatttgattgtgtttccactctgaagtgaaatcgggcagctcatgagctaggggcaggtgtgatggttaattttaggtgtcaacttgactgggttaagggatacacagctagctggtagagcattatttctggctgtgtctgtgaaagtatttccagaagagattggcatttgaatcagtggactgagtaaggaagatccaccctcaccagtgtgggtgggcaccatccaatctgttctggctcagctagaacaaaaaggccgaggaaagatgaatttgctctctctcttctggagctgggtcatccattttctcctgcccttggacaccagcagccccccccaggttctcaggcctttggactcagactgaactatactcccccaccttccctgttcctctgcttatagaaggcctattatggaactccttggcctctataatggagtgaaccaattctcataatgagcccatatgtatatatgggcttataatgggaataataagcaacaggatatatacgtccagtcgcttctgtttctctggagaaccctgacacatacagctgggatcacctacaaaataagttgccatctgactctccagcctttggcctggcccaactggagcactgttccagctccaaacacagacaccagatctccacagttctttctctcctgaagggatgcagacacaagggcctctttcacactcttccaggcccgacacctgtattttcaaagtccaggccattcaggatggtagagtaaagaaaaagagacattggactactttccaagagaccctcaaatgcatttaccaactaatgagatatctttctaatgttggagaaatgtgggcattttgtggtgacaatgaacctacttaatgatacaaaccttttcactgcaaaagggttccaagtaatgttgaactagaatgcaatgcattcttcatttaatcaaagcaaattaataagcctttatcaagggcttattatggtcaaagaaccgtgaaattcaaaaagacataaaacagtccttgcaacactgcatgacatggcaggaatttaggactcatctagaagggcaaattactgctaaacagaaaagagcccaagtacatgaggttaccagtaaagggaatggaggcctcatactcattgtgtccctacccattggttgaaatctttggaagcactattaattcaccagctgagtcacctgatgaagttttaggtatttggcctgttcactaaaggctaagtgtattcaaggaaatggccaatgttccttgtctgtgttatcctggttattgattagcaattgagttaagggacatctccaggctgactcactgagagcctcttttgcttgtttagagagccactctgaatgatcagggggcagtagcagatgctgcaggatctagcaggccccagcactggagaggagagaatacccaaagtcttgtgtttgtatccaagttctgtgtacccttgggccaaccccttatctcctctggatttcttttaaaataacaaaatctctgtcaactccaaatttgagcgactaacaagttaacacattgttaactgttctcttaattggaaacttgtacaacagagacatagcccaaggaagtgaagcatgaaggcaattaaataagtcaaaaaccccatcctctagcctaaaatattcatttttattacctaatagcaagattaaaactaacatatactggtgacttactgtgttccagatactgtgctgtcttcatatgcagtatcttttttttttttttgagacggagtcttgctctgttgcccaggctggagtgcagtggctctatctgaactcactacaagctccgcctcccaggttcacgccattctcctgcctcagcctcccgggtagctgggactacaggtgcccgtcaccacgctcggctaatttttttgtatttttaatagagacggggtttcaccatgttagccaggatggtctcaatatcctgacctcgtgatctgcctgcctcggcctcctgaaatgctgggattacaggtgtgagccaccgcacccggcccccatatgcagtatcttatttaatcctcacaccagtcatcagcactcatattcttccccattttacagggaagaaatggaagaaatcaaggctcaaaaaggttaaataactttcccaaggttacacagttaataagtgacagaattgagactcagacccaagtttctcagacatcaaagcccatgctctagaagtttctgtaaaagcaaggaaaccaaaatgtaggtgaagttgtgggaatatagtgggtgagagacgtttgccataattatttgaataagtactgcaattttctgttttactttgcgcctatgtatctagccattggtgtctgaaaacaaaggtcaaatacgatagcaagtgaatattaatgacaaagacctctgtctaccccagccatgtttctctcaagtatgtaaaattccattttaacttcaaaacaggaaacaatttgaacccataaaagtaccctaaaccatcactgaaagtacagtgattttagaatttatgctatgtcttttaccgtaaagaaatagcataggcacttgttttgtgagcactgccaaaactacttctgagggccattggcagcaatcagcaagtgtttgagcgtgtgatgctgagtgggtctgagggaacctggtcatgctgagattttctctgtgggtgggatggagaagctcccctgtatactgatctcaaacagtggcctagtatggaggtggagggggaaaatcctacacaagcagatatatagacttaaaggggggtgcttaaactccccacatgataaagatattctctctctgctatagtacattcatctgttaggtatatatggctttgggtgaattttgttagttcatttgacacatttattgagtttctactatatatcagcaaaatggcagcctaaggatacaaagatgaaaggcaagtcttcccagtctaaaggagctcatgttgtagggaggaagccaacaaatagcacagcttggcacacgcaatggcagaggcacaggcaatggggagcaagactgaagtagggatcagagttgagagaggaagtcagagctgagtccaaaagaagaaaaggaattggccaagtgctaactgggaagaaagtgggggtgagcctaaggcaaggactgagggaatggtgtgtgcaggaggcagcctcagagatgagatggatgggaagtggtaagagcagagctgaagacaaggcaaaatctgggtcatgagagactgtgatcccaggagagatagtatgaacttcatcctgtggcagtgaggtgccatgaaggcttttactcagtgacacatcatcagcttccaacttcagatggagcactctgccaaccaggacaggaagcctaggcttcagcaggaggtcagccaaggtcatcagaatggtcattcaggtaaggaaaaaggagacagttgaggtgaaaaaagaaaagcagatccaagagatttaggaggcagaatcaatggaccataaagatccattatgggaacaggtgaatgaaaggacctgagcatgtctcagaagcagctggtttagacagccacatggatggaagtgagaggtgaagccagctgggcttctgggttgggtggggacttggagaacttttgtgtctagctaaaggattgtaaatgcaccaatcagcactctgtgtctagctaaaggattgtaaacgcaccaatcagcactctgtaaaaatgcaccaatcggcattctgtaaaatggaccaatcagcactctgtaaaatggaccaatcagcactctgtaaaatggactaattggcacgctgtaaaatggaccaatcggcactctgtaaaatggaccaatcagcaggatgtgggcagggacaaataagggaataaaagctggccaccccagccagcagcagcaacccactggggtccccttccatgctgtggaagctttgttctttcgcttttcacaataaatcttgctgctgctgatcactttttgggtctgcactgcctttatgagctgtaacactcactggtggcttcactcctgaaggcagcaagaccacgaacccactgggaggaacaaacaactccggacgtgccacccttaagagctgtaacgctcactgcgaaggtctgcggcttcactcctgaagtccccgagaccatgaacccaccgggaggaacaaacaactctggatgtgccacctttaagagctgtaacactcactgcaaaggtctgcgtcttcactcctgaagtcaagcaagaccacaaacccaccggaaggaagaaactccggacacatccgaacatgtgaaggaacaaactccggacacaccatcttcatgaactgtaacagtcaccacgagggtccgtggcttcattcttgaagtcagtgagaccaagaacccactggaaggaaccaattccagagacagaagtgccatgcaaagagaaggaatttgcagaagaaatagagtttgagagacagatgagtttagttttaaacttttttgtttgttgttgtcagcctttctcacccaggctgaagtgcagtggtgcaatcatggctcactgcaaccccgacttcccaagttcaggtgatcctcccacctcggcccccggagtagctgagactacaggcacgcaccaccacgcccggcttatttggtagagtattttgtattttcaccatgttgcccaggctggttttgaactcttgggctcaagccatccacctgccttggcctcccaaagcactgggattacaggcatgagccactgcacctggccagttttaaacatcttaagattgagatgcttatgagatatccaagcagtgatgtacattaaacaagagatttttcacagctgacaccaaaaatacaagttctggctatagacacagatgtgaagccatgtgtgtgcaagaagtcacccagtgaacttagggagggtgaggctggaagagagctaagacctgaaaccttcccaagagccctgccagagccagaggagaagagcacagggaggaaagggggatatctagagcaaatggcatcacagcaggcaagggaggaaaattttcttctgggaaaggttcactaaagtataatgaaaattgtctgtggggtttggcaacaggtgagttattggtgactggtgacagcagttccagaggaatgggaaggggtaaagccagacggttacgggtgactaggaagtaagtaaatggggatctgtacagacaacactttcaagaaagttgactctgaaagagtctgaaagagactgtttaaagcaaagtgaatattcagggtggaatatttttaaaacgagagactcaaggtcatttttataaagagggaggcattacaggctctagtcaaaagcaacactacatgagttcgaatgtcggctcctacatgtacagctgtgtgaccttgggcatcatccttccactcactgttcctcagtttcttcacctgtcatgtggaagtattgattgtgtctaggtcatggggttgatgggagagtgaaatgagttagcacatgcagcagggctcctagtgaatacaaacattacctgtcactgtaggtactctatgcagagtgaagggagacatccaatgagagggagagagtcttgagaaaaggaggatgaggatgggttcagaagtgaattggaacaaggaaaggaacaagatgaggaaaccataacagaagtttagaggttaaattcctgtttgtttcctcaatgtttcttcctcaacatttcttgttaaaattaaacactccctaagggactgagctgttaagtggtgtttcacctacaaccagctgtagttggctgagatcaatcagttgaaatgagaatgtgtctctgaagccctgggcttaaacttgcctatatgctgccatttcctctagctgacacattcttgcagttgtcaacaacccagccctgtaggagaccattttaccataggagatcattttttgccttgaagaatgaagcagagtaacaagccagtgattaaggagtcagtgactattttggccctccaaatgtaacactcacaaagtatttcctttccaacttgctccaggctcctctgaaccaggagtctgagtgttttcttagctgcaaatgaaaacatatttaaaccaaccttcaggtggttaaggcaaaaaaggactctttcctcttgtaacagagtgtagctgttttgctttactgtgacatgttactgcgactcaggtgatattttttctcatatttgtctggggcactgactctgaagatgttcctcctggttctgccaggctgcagggaatcccttcaactaggaagtggatcacgcgttactgccacgcatccacccatcaccaccggcccagcgaccttggtgtaaagtgcattgaacctatttgggccagttgcgtatgaccctgtttggactattgtagtcaatgcagggaaagctggtggggaagagccacaagcagaacaccctggtttttttggaagtcctcagcatggtctgggtggagctgttgaggcaagcactgagactgcctctcattccaacatctgctgttgagaaaggaagagaatgttcagcagtgagaaacctggccgaggccagccatcagactcctagagagaccccttgggaacctcttcagaggacgatttgctagaaggccagtgatagccagttgattggaaggtgacctttactaaatctcctagatgacagagaccatgccctttttccatttttttttttttttttttttttttttttttggtttgcttctgcagcacctatcaggatgcctggcatttagtaggcattcagtatatgtctttagaatgaatgaatggaaaatgatgaaagctcagattaagttacttccccccaagttcctcaaactcaggtgtgactaatacagacccattatcagaagcaaatgtactaatctgtcttccagtaataaccatctcagagccataatgataagagcagaggcttgaggtaaaacaatgaggcatggctatttttaagaactaaccataactaagaaactcttcctctggtcctgaaggatcaatgcggagtctttataaagtctttatggccccttcccacaaaataaataaaaccaaaaaaagagatacagcttttggtaaatttggcttagtaaagtagcacacggtttccgtattagactcaggttttagtccaccattaggtagctggcaccatgaggaagcaaagtcaaaatacaaaacagataacagttatattgatgatacaggtcccaaatgtcaccatccttcaaagaatggagtgtgtactggagttgatgtgttgataaagtgtccattaaagacaaaagaaggcaaggcacggtggctcactcctgtaatcccagcactttaggaggccgaggcaggcagatcacctgaggtcaggagttcgagatcagcctgagtgagcaacatggtgaaaccccgtctctactaaaaatattaaaaaattagccaggtgtggtgggtgcctataatcccagctactcgggaggctgaggcaggagaaactcttgaacctaggaggcagaggttgcagtgagccgagattgcaccactgcactccagcctgggcaacagagcgagactccatctcacaaacaacaacaacagcaacaaaaaaacaagcaaaggctgaattatccatcgttgtgataagtacagtgaagttcgttttttgttttgttttgtttttttttatgttcctacccatcccagaacctataatctgttcagtgaagccagaattcatgcttatgaaaacttcagagcccatacagcgcagtgtagaattaactgaaaaagaaccattcggtgaaggttaccaggggtaagaggacaaagaaaccacaatggttggagtctcttcctagaaaagctgagaatcgaggggagtctcaaagaatggatgggattccctaagtttgagagagggctgaggagagagggattgcaagcagggagattccaagttaggagcaaatcacagcagtagggctatgcccctcgtagcccaggaacgggaaggagatgggccaaaccttgaaaggcctagatgcatgaatgtgatgttgactgaagaccagtccagagctggtgagcagggcaggcaaggaaacaccaggaggacaactgccctccacgaattctcccatatacagtcatgcatcacttaacaacaggggtgcattctgaggaatgcctcatcaggcaatttccttgttatgagagcatcctagtgtgtactcacacaaacctagacagtgtagcctactatgcgcctaggctacatggtatagcctattgctcccaggctgcaaacccatacagcatgttaccataacaaatagtataaatacataataacaccacggtaagtatttgtgtatttcagcatagaaaagacacagtaaaaatacagtgtattataatatcatgggaccatcctttatgcagttcatcattgagcgaaatgttgttatgcagcccttctccttttacttttttcttttaatactgtccatgaatgtaagggtggaaggatgcaaatatagaaaaaggtttacatttaaagtagggctcaggtcaaacaaaattagagcccttgtcttctagtcttctccaaagaagaaagaatcctgaactaaaatatcagccccagcactgcacaacatcactagatagtgtaaaatcagagactgtgcctatttcactcactcctgtttggcaggaggagcacagagctcaaagagaggttagtctagcttaattccctaatcaagtcaagaagtgagtcttgaacatcactgacagataactatctagtcttgacttcagtattttgagtgtcaggatattcactatcctattaataatagatgactaataacaattgccccacttggaactttgaatcagttaggattttgtttggctgaaagtttttaaaaaaataactgaagttaaacaaggtagaaatttattttatgtaaattttaggtacaagcagtcatagcagtggtatgacatgctatggcctcagagactcaggttccctatatttttctgctcctttgagtggcttctccagagttatctcatgtcccaaatggttgctgaagctccagcccttatgtcctaagcccattaaaaaggaaagaggaaatggggcagaagaacttgcttcttccctttaaggacctgcctggaagttgcattcaccagttccactaacatctcattggtcaggaggacactttcacctgcaagggaggctaataaatgtagtccgtatttcagagagccttgtgcccacaataaaaatcatgaggtttaattttttacaaagaaggagaaagtagataacatgtttctatgacagagtctaatgtaggcctcctcctggaaaatccaggaaaagtggatttggcttttaaaaaaaaagttttgatttttaatcttccctggtaggaccatgctcaccaaaacaataggaagaagatgctcatctgtggagtggctgttaccaactatgtccatggcagcagcagagtttagctgcacctcccagaggcctacagtttactctcaaagtgagaacatagcaagtaggcagaagctgcacccctgcttttgaagtccttcttttggagctgcccaacaatccctcttggactactcaccaaagccccaggaatgccaccccctctcacaccctgctgtggtataggtgaactcaggtggcactgtcctagccttgagccctagtagaagacgctggctgcatccacttggtctccccagcagaggagatggtgtgtttctattgggcatctgttgtccataggaaagtcttcctaagactgcgtcaaaacctgctctgtcagaaattccaatatttaggcatttctgtctggtgtcctaggctctatatctagtacataattaaaatcacctatcaggtttttcaccaaagataaaaattgctgagagttaacattgtaacatgtaattaagactactaaaaaccatcagtttcacatgccaggcctgtgaggaagtgaaatgtgcttttagtaaaagattataagaagatacgggaatgtacatttttgcctagtttagagggctaaaggattgttttaaattagatatgataaacctaaatgtttgagcaagttttggaaggtttgtgaaaaattaattgtaaaagagattctgtgtatgaacatattggctaaatttaaaggggtattattcagttttttccatgcttttggaataaagcacaacatggttttcttagagcatggatctgctctttaacaagaatttgtaaagggttataaaaggtttatgagaagctcaccttatggttaaactgattaagactggatagatttgtctataaggttttattaaaaattggggtggaggccgggcacagtggctcaaacctataatcccagcactttgggaggccgaggcagacggatcacctgaggtcaggagttcgagaccagcctagccaacatggtgaaaccctgtctctactaaatataccaaaaaaatgagccaggtgtggtggcgggcgcctgcaatcccagctactcagaaggctgaggcaggagaattgcttgaacccaggaggtggaggttgcagtgagccgagattgtgccactgtactccagcctgggtgacaagagactgtctcaaaaaaaaaagaaaaaaaaatggggttgaaaaaaatttttcactgtttagtctagtcctgccatacagagaaaattagctttctctccaccctgccgattcaaatatttgaagacatatacacttttcttgtgatttatgtcttcatccaattaaaaacatgcagctttttctgttgtaaattgcaggttcctcaagagcagagtgctatcttcttgtctctgtgtccccagtccttacactgcctagcgcatgtggattcctcacattttcttgtggaatgaatgaataaattctacttttattatttccccctaagtcatgtctctttagacacatgcagcccaaatctctcctaaaacagattggcgagaacatttttaaatttaaggatttcttttctttttacaaaaaataatacatcttcattctagaaaacgtgtatcaacaataacaaaatcacaaacagcccaatacctgggaatgaatactattagtattttgatttatattcctcttagtttttttctgtgtatatatatattttttttaatatacatttttcatcagaatgagatcatataatttaaaaacctactttttatacttaacaaaacctcatgggcatctttccaagatagtattcctgaatatgccatgtcattttttaaagttcttttgtaattcaaccgaaatacaaaaacagaaaagtgcacaagtcttaagtattctgtttgatgaaatttcactaattggacgcatgtgtcttaccaagatgaagatcagaaaattgaacgtgaccagaacctcagaaatctcccttgtgtctcctcctcatcactactccctgcaaggactaccataggcattttttaacttccatagatggaatcacactatataactgtatatattattttctagctgtcttctttcagcacatcattttaatgactgcatcctattcctttattttgctgtaatagaatttattcagtttatacctatgattgtgttgtcataatacattattttttcaacttttgcttttattaaaaattctgtaatgaatatctgtgtcctaaaacagtgatttttttctcttacggtaaaattcacagatatgaattaaacttttaagatttgtttacttatattgccaaattgcccttcaaaacagttgtgcccgttttatgttcccatcacaatgtgtaagacttccagtttccgtgatgtggtctagaattgaacataaaacctcagatgtaatccagctaacatttgccctgaatgtctcacttccctttactgtgcacaaatagactgcaagcacagataatctcgaagttctctgacaaagacaaaagttagggtgatagtgctggaaatgaccttggaacagtaagatacttattttccatcaacaagcttattttcagatgagaatccagaagcccaaagaggtgagatatcagagcagacagattcccaaagaaaaccaaactagaaaaccacatgtaggaaaaaagcagcagagaaacaaaacaaaatgtgtctttagcagttacctatggggagcgaaactatttttcttcttctttttacttttctgaattatctaaatcttcagtaaggagcatatatttctttcccagtggagaaaaaaagtatttctttaaaacaagagggccgacatggtggtgcacacctgtaatcccggcactttgagagaccgaggcaagtggataacttgaggccaggagttcaagactagcctggccaacatggtgaaaccctgtctctactaaaaataaaataaagtaaaaaaaaaaaaacaaaaattagctgagcatggtcttgcatgctgcatacctgtaatctcagctactcaggaggctgaggcacaagaatcacttgaacctgggaggtggaggtggagatggcagtgagccaagatcggcagcctgggcaacagagcaagactccatctcaaaaaataaaataaataaatagaaggaaaaatagaaaggaggaggtaaatttgtaatttcctattctatacacttaatatatgcctaagacctagtacaaagtaggctacaaagtaggaaaaatggtgtgtttaaaaatctggaagaggcagggcactctagaacaatgaattccaagaattcagaaacccaggcaagcagaacctgagtgaagtgacttttgaaaagcagctctggtctgtcaatttggaaaaataaatgtgcttgatgagctgggtctggaacaggcgctggagacctctgggtgaagaaacaaaggatcggtgtttggttggttggttggttggttggttggttggttggttgttttttttcattttttggggtttttttaattttttaatttttctgtagattcatattcagctgaaaggacaagtgatttaatggtgttttcttatgagcagtttggaaatcttgtctgtgtctctgttcagagatgggggtagggtgaagatggggttagggtgctgtgagctgtaggaggtcaccagcttcatggggtaaaaacatttcagaaccaccaccaacaggcaccaggaaaggtatctgccctttcctgtcacctgagacctgaaccttcctcattttctgtccatgtaagagctggagtcatggcatttggtttcagagtcttgattaatgagggatttcacatctcgctgtggctatggtgggtgttggctgaatgaattgtaaaatcatagagtgttagttagaacatagatgaaatcacatccctaaagtctactattcattgttaatggggccgggcacggtggctcacacctgtaatcctagcattctgggaggctgaagcgggcagatcacttgaggccaggagttcgaaaccagcctggccaagatggcgaaaccccatccctactaaaaatacaaaaattagttgggcgtggtggcacaagcctgtaatcccagctattctggatgctgagtcaggagaatcgcttgaagccagaaggcagaggctgcagtgagccaagatcacaccactgcactccagcctgggtaagaggttgagactcagtctcaaaaaaaaaaaccacatagttaataaataatggggcctgataaggttgccagatttaacaaatgaaaatacaagagccatagttagatttgaattttagataaacagtgacatggcctttagtctaagtctcatgcaggatttgactgggtgtcctgtattttatctggccacctgacggggccatgatgaaagcccagctcccagtgaccattccagtcaactgcaggctgtgcagtgcatttcccaaaggaggtctgtctgatttccagaaagacaggccagaagtgccccacatatgagaggctgtagagtttaatggtaccaggacacagttggcccttggcatggtttcttcatcttgttataggattacaaacagcacctgtttcaaatagctgttgtaagaattaaataattacaagtagaacacataaaacagatatttattagataaaatatcaagccaaaagtattgtgacttttatctgagtagtctgcaatgacttctcaaacatatttggtctctcaactataccactggtgtgaaataggccacagttcccctactattctctccagctttatgctgagaaaaccaaaaattcctctcatctgcaagagagaggtatggccctgattttgataaggcaataaggatttttattaaccatcataataattattcattcatgatagaaccattatcttagcattattacgttgtaaatataaaaagaaaaatcaacaaagacttcctgcagtgacattggagagttcacagcaaattgccttccttagattatctaatctagaagttccaaatcaggctaaccatcagaatcacctggggaattatccttttttattatgaaaatatttcaaacatacagcaagctgaaagaatattacagtgaacacttgtatacccaccacctagtcttcaatcaacatcttactacaagctgagtatccctactccaaaaatccaaaatccaaaatgttccaaagtcctaatctttttgcatgccaacgtaacgctcaaaggaactgctcattggagcatttgggattttgaattttaggatttgggatgctcaactagtaagtataatgcaagtatcccaaaataaaaaaaaattaaaatataaaacacttctgatcccaagcatttcagataaggagtgctccaacctgtatatcttgtcttgttatttatctgtccctctattcatccatcagtacatctctttttcctgtccacttccaagtaaattgcagatgtctgtacactttccctggggaattttctaaaactataagttcccaagcctcagcccagagatgtacagatctgctaattcaggaatttttccaaacaactccccagcttcactctggtaaccatgctgatggagcccttattagccgaaacattaccagtctcatggcaaagggaaaagacctggcataccatgtgctgggcgtaaaaacctctgctccaaaccagtacacatccacctctgcccacatttcattgaccaaaacaagtcccttggaactcttaacttcaagaagtttggggcaggctgggcacggtggctctcacctgtaataccagcactttgggaggctgaggtgggtggatcacctgaggtcaggagttcgagaccagcctggccaacgtggcaaaaccccgtctctactaaaaatacgaaaaacagccaggtgtggtggtgggtgcctgtaatcccagctactcgagaggctgaggcaggagaatcacttgaaccctggtggcggaggttgcagtgaaccaagatcatgccattgcactccagccttggcggcagagcgagactccatctcaaaaaaaaaaaaaagaagaaggtggggatgagtaatccttccacaggcatggggagaagcactatggaaggaaagctgggatatttaagaaagtaatacaatctaacacaggaagccactcatttaattcagcttcttcactttacagacagagaagctagcacccaaagaggcaaagtgactctcccagaatcactcgactagttcaaagcaggagtggtcaagagccaaggtcccctaattgactttcttgtcatgtacagggttgcctctgtgaagctcacagatagtccatcattcattcactgatatactatacacgggcactgataaataaggcatggtttctgctatcaagacattcccagtcccatttaaagtttttccatataaccttcagctgaccctggcatatttccacatattcaccaaataacctgaagcagtcagtgcttttcagaactaataaagatgttgtctttgaggataaagatctatttatctcaattgttttcggtccaagagtgtcagttcccagcaacagcctgctgaagcttggcacagtgatgcagctcttcccagatggagaaggtttcaactgacccatgggcccagaatggttgaggatcattcttagggcacggtcagttcatgatctgatggcataataatttttctcagaaaagagtcattcggtcacaaaaaccttaacccaacatagggacctattttcatttagggagaaagaaatatttcaacaggcagaaatatgatagatttctaaaatatgaagattagaaataagatagtttgatttgcaaaagatatttgatcctctcacaagctgtaactgggaaggctatgcacctttaaaggtgttaaaacagtaccaggatataaaactgctgtgtccaacctttgtaagctcatggaattttactgggagtaagttagaaagagttagaaagacttttaaacatcaccaacagtagctgcctcattttgcagataataattatgatgtttattgtgtgtttcactttgccagctaccaatccaagagattcacatgcattattttgtcctcacaaccaacaggtattgtgaccacccccattttgtaactgaagaggttgaagctcagagcagatatgtgacttgatcaaagtcatctaaccagatggagaatggcctgaggtgtgaacctggaactcaagcccttgggtccagtgatccttttatgtgaaaggagcagagttgtcatttttgtggggccacaggctcctggacactggctcttgttaacaattgtctatgacactgggccaggttctgtggggatgccagcctaagtgaagtggtttctgccctctgcgagcttcagcctggcaaagaaaggaagagaacgtgagcaaactgtgtgtgctagaggccagagaaagagagaattttgagatgttggtcgttggtgttacagagtcaaaggtatcaaagactagaagcaagccaaaaagtaatatgacaaatatgcaatcactgttgaactataaaagagcaatttcagaatgtgatgaggtatgagatagtttccaagaggatagggagtcaataaatgaagaagaaatggaaacaggcagttttccgctgctaaaaaaaagaaaaagaaagaaagaaaaagaatacaaagataactcagaggacacacgcaatggtagaaatattttcatttggactagggagaaccgagctgatgttatacagaagaaaagatgccaaccgagagaaatatatttcatatggacaaaaaagagagcgtcaagttcttggaacaggcaggagaggatccatttatcattaaattttttagtctttcagctgctattataaagtgtctattatatttcaggcactgtgtttgtgcaccatgacgagcaaagcagacccagatcccatactcagataccatagagcctaataaggaagacaaaattttaagtaaataatatatatcatacatataaactagatacatgtatctgtacatacatatgctttatctattaatatattttatatgtatataatttccctgctttgtctcctgtaaaatataatatatatatttacattatatatatttctattttatttatattcatatttatattttacggggccaaagcagggaaatcatatatatagtaccacaatagctggtaaaatagtaccacagtataaaaaaagctgcatccaacctttgtaagattatggaattttactaggaataagctagaaaggtttctaaccatcaccaacagtaactgcctcattttacagataataattctgatccttattgtgtggactggggaaaactgagcatgacattacacagaaaagaagctgccaaccaagagaaataaatttcatctggacaaaaaagagggtatcaagttatctgtaatatatgtatgtattttatgggagccaaagcagagaaattagccttaagctaaatggcataaagttttccaaacaggataaagaaggatggagggcaaaggatagaaacatcaatgttttgaaaatgctgaggaaatgagacagtcttcatcttagtgagtaagagggttaaaaatgttaagagtgagaggaatgaggatgtgttgaaggacagtgggaaatattagcatccattcatggacatccaattgatgtccaacttgataccaggagaaagaaggatatttgccaagaagcattaaaaactattatgaagttagatagcatgactcagttggctcagtttttggactctctcaagggaactcttagcagcccagagtagatgcaaataaagcctatggtggcctgggcagggagagcaggctgatggtgacacggcaggttccatagaactgaagtagggcaaaggattcaaagttgctagaaaggggctggcgtccagctagctagggaggtaagtggagctcaaagggaatgggccaaccctgtgaggtcataacgacagcaaggaacaagttgagaagtgaggtcaagggaaaagtgaaagggagagaaagatgctatcagagtgggagaatagatccaaataacgaacgctcagtttcagctagagctgcagggggctgaaattgggttagtgatgaaggtcattggtgctgaggaggcttaaatacctctcagactggggtggaataggaattaaagcctagaaagctttgttgatagcaattaaacccagacaatactgttctctctgctttgaaacttagagaaaataaacgttgagttctaaactagatacgtatatcttcacatacgctgtcacatatatacgtatgtgtgtgtgtgtgagagagagagagacagagagagagagagatcgtgcacacacgggtatatcttaagtacctgcaagtggcctggaagtctggaattaatggctagttcccaaattcattactgactttggattatgtttaatttaaaccttgatgtgccagacaacgtaactcaggaagagctatagaggtgtataaccccccttcattgtaaatagcttttgccaagcaccaatattttaacagagagatgggaataggaacatttttgttgacatttgggggaacgggacaaatttcagagactttttttttattatactttaagttttagggtacatgtgctagttcaaccattgtggaagtcagtgtggtgattcctcagggatctagaactagaaataccatttgacccagccatcccattactgggtatatacccaaaggactataaatcatgctgctataaagacacatgcacacgtatgtttattgcggcactattcacaatagcaaagacttggaaccaagccaaatgtccaacaatgatagactggattaagaaaatgtggcacatatacaccatggaatactatgcagccataaaaaatgatgagttcatgtcctttgtagggatatggatgaagctggagacttttcaaatgtagacttgacagagcttggcaactgatcaggtatgggagatgaggagggagaccctaaagtggaatgaggcagaaagttggtgattatttccccccattttacagataagaaactaagattcagagaaattaaaagattgctctataaccacgtgactagtaagtggtggaaccagtgttgattgtcagatcacccatcccgtgcccttcatgatacttcatactcctccacttccacccctgtgcagatgcagagccctttcatgctccaagttccattactgaagacaccaggctcagccttatgccatctttcccacactttccttgtgctggcaaaggtgattaattacccttccccttcctaaggagtcccagccagtgcttctgcgatggtgtttacagcccccactcatagaacctatcacactgctgtgatgatggttcccctgtccatcctccccactagattgtgacctctctgatggaaaagacccagttctgggtctttttatttctagtgcttagcagtgtcaaacccattctagctgtccaatagatgtttctttaaaaagagctgtgttaattaacttcatgcttaattccaggtaacatcctggagttagtaagatgcaataaaatgtcaacaaaagtcattttaggccaggcccagtgactcacacctgtaattccagcacttcgggaggccgaggtgggcggatcacttgaggtcaggagttcgagaccagcctggtcaacgtggtgaaaccttgcccctactaaaaatacaaaaattagccaggagtggtggcactcgcctgtagtcccagctactcgggaggctgaggcaggagaatcgcttgaacctgggaggcggaggctggtccttatcttaaggagtccagctcaggatgctgaatccaggagctatctcacaggagaggattgctcctgtcaatacaaagcaaactggaaaacgtgacccacgtgggcatgccgaggtgatgcagatggtttcagttctacttctcaaagaacaccaggtaccgaagagaaggcagacttagactccctgggctggcaattcccatacagtctctcccctcccttccttctgtggcaatgctgtcgagacctgtagggaaatgacttactcagatgcaaattgggcgttcacagtacatgcacttttcacaatatatagcacctttggcctcacagggaacgctttttacatttttccacctttttttgaggtattcacagacaacttcaaaatagaatctcatattccacaatctctttgtgaatcatatcacgtggtatggtgtatgggcttattcaggggttcgagccttgggtaatggtacactaaaaatgagtgagatgacagtaaatgtgacagctcctgtctgtcatcagtcgtcttgccaccagaggacacagcccactcattctgagatgcggttcctcaaaatatcttttgccgggtaacaaattatcctggagggatatcaaggccccattgtttttttatttaaaagtcataagttaagacctcaaagatatgtcggtggcagtatatgaaaatttatgtttctaccagcagtttttgtgctttcactgcagtgataaaatcactttgtttttcagtttggagccaagggaagaatcaagctattgtgtagattacttaaaattccacagtgcctgcgccatttggccaaagaatgctaaaaatttgcagctgttgctcccacgaaagtttctaactggggcagcggctgctgttcaacacacagctgttgttaatttgagctgaagatttttaattgcctttgtgtcgagatttattaaataacattttagaggaacaaaaactgtaatagtcatattagcaggatgctaaaggaagaaaataattggaacatggcatttttgccttgtaagccaagtctgaaaatatcttttccacatggagggctcccaaccatcccaggaaaagcatttccaggtaaatccagccacagaagccctgatggccttttcaggagctcagccacttgcaccccttagtcatttacctggaagcaccacttctccagagtggccaccttgttcccacactctccattcctattatactgagagacgggaggcatagtgcttacagtaaacatagcattagctggcagttggctgcttctttaagtggtctgcattattttggggagcctccataattgctgttttcctattacatccagcccatccctgactccctgacaatactatgaggggtctgacctcctccccatttggcttagagcagctgtatagatgagcagaagatagaaaactcagacctttcctggattttctggcaaggcaaagaagggggaaggaggggcccttctattagaaagggtcaacaactaatgttgtcccttaagagggaagttgccaaccgcacaaagaaaggagttttaagtatgaaaaaaggcaaaccaggaaaaccgcagaatgagttgtaaatcctcattaccatactaaaatttcaatcatgttttgcatgctgatggtaaatgtttccttttagcaagaaaactttgtcaggcatttatggtgcacttacgatgtgcaaagtgctgtgtgatgtgctcagggcacccagagaagcttgcagggccggcgaccagtgagggagctgcagcccaagagtaagacaggcagggagcacccggcgctgtttacagcattggctccaacagagctgagggtgagaggtctggctcctgccagaagggggaaacatgtgatctggacctaagggctgaggacgaccttgatcattaaaaaaaaggatgaatgtgaccgggcacagtggctcaggcctgtaatcccagaagtttggcaggctgaggtgagaggatcgcttgaggccaggagttcaagaccagcctgggcaacatagcaagagaccctgtctctacaaaaaatctgaaaattagctgggtgtggtgatgtgcacctgtgggacccgtagtcccagctaactcaagaggccaaggcaagaggattgcttcagcccgggagttttgagttcaaggatgcagtgaactgtgattgtgccactgtgctccagcctggggacagagcaagaccctatctcaaagaaaaaaaagaaagaaagaaaagatgaatgggtaaaaaaatgtgctagaatatagaatattattcagccataaaaagacagaaatcctgccatttgtgacaacatattggaagacattatgctaagtgaaataagccaggcacagaaagacaaatactgcatgatctcacgtgtacgtggaatcataaaaagtcaaattcatggaagcagattgtaagaatggtggttgccaggggctagggaagtgaggagatgtggttctggagacctcatgtacagcatgatggctacagttaacaacactgtattgtatacttgaaattagctagaatagatgtgaaatgtcttcagcaccagaaaaaaaaaagattatgtgaggtggaggtttattaacttgattgtggtaattatttcacaatatatatgtatatcaaacatcacattgtacatcttaaatttatagttttatcaatgatacctcaataaagctgggggagaaaacaaagagaagaggaggaaggaagggcctttcaagctgaggaccaagaagaacaaaagcgtggtagcctggaaaagtctgtgtgggcataggaggccattgaatgctatggaggtgggagtgccctcctttccaggcacatggaaagcattgaaagtccaagaattgtgttagttggacatgacagtgctggaggagggtaagaaatggggagaggggcccggcacagtggctcatgcctgtaatcccagcatttcaggaggctgaggcgggtgcatcacttgaagccaggagttcgacaccagcctggccaacgtagtgaaaccctgtctgtatcaaaaaatacaaaaattagccaggcatggtggtgcgcacctgtaatcccagctaattgggaggctgaggcaggagaatcacttgaacctggggggtggaggttgcagtgggctgagatcacaccactgcactccagcctggtcgataaagcaagaccatctcaaaaaaaaaaaaaaagaagaagaagaaatagcggggaaagatgctggagaggtaaagtcggactagattctggagagttggggtgctgctgtagggaatttgaattttactctgggagcataggaggccattgagtgctatggaggtgggagtgccctgctttccaggcacatcatcctgctagcaagtctgtggggctccaaagcccctccgattctgacatgcagaggtggagtgattgccatacgccaggcggagaagatgaggacctgaagtgtggccaggtcaatgtggccacaatggggaggagagaagggaacacctctgagagtcagagcccaggcttcaaatcctaggcttgctactcactagcagtgcagcctaggcaatggatttaacttctctgtgcctctgcttcctcgtctgtaaaatgggaataataacagtgcatgcctcttaaggttattttatataaccttgtacgtaatacctaaaatgtttagaataatggctggtacagtaagcgcttgataaaggtcagctattattattattttcagacataaaatcctatgacatactattatgaaagggatatggcagatactcagaattgataatagctaaggaaaaaaataaggtaataaaacatattgagggacattctacaaaataactattcataatcttcaaatgtgtcaaggaaacccacagaaactgttctatactgaaggaaagcagaaggacatggcaactaaaggcaatgtatgatcctgaacttgacccattgacttcagaggacattattgagtcaattgggacaattcagttgaaatttgtaggggtccaaggatatcattatgatggaggatatgcttgtttccttgtttgtaggaaatgacactaaaaggttctggagtaaagaggcatccaattagcaacttattcccaagtgtttctgaaagttctttgtcctcacaacccttctgtaagttggtgattgctgaaaataaaaacacttatttttttaaattaaaagctagcatttgttgagcattcactaagtatcaggaattgtggccagtgctttgcacatgagtgggttcggttctccaaggaaacttttctgactttgcatctctaccaaaacggagccaagtacccctcctctgtgccccgatagtaggctgtactcatcttcactaactgcctgtgaccatgggttacaagtggtctatgaaaagtaactgcttgtttttctgtaacacctgccccctcccgcttcatggataatctaagctctttaaaggcaagggctgcatcccattctccacttgcatccaccactctcagcacagctcctggtatagcaaatctcaagttcccaatacatgcttagtgactggaacactgaggcttgctcaccatggtgactaccattaaaaatgaggcaccagacttggaatgcatgtctgacacatgacttcttttcaaggtggtcctggctctggcaaaggcacacagtgtgaaaagctggtggaaaaatatggatttacacatctctcaactggcgagctcctgcgtgaggaactggcatcagaatctgaaagaagcaaattgatcagagacattatggaacgtggagacctggtgccctcagtaagcaacatggcctgacccacattactgcctttcctgtctggggagacctttggggtttttgtaatgaatctgagctgctggaactaagaaacccaaagaaacaatagctgtatattatttccctcctttgcagcaatccagatgcaggcaggtctacagcagacagaccttctactcaaccaggtcgagctggcccaggctccttccatcttgttgctctaccaggccctcaaatgttggcctaatttcacatttttcccctaaattcatcccactttagaattggaaaggcttcaaaatagaagtgagtgtggtgcagcagagcctagaattagaaacccccagaaaatataaaataatgctttggtttagttctgggaggtatgattatcttgaaatttggtatcttcttgtgtaatttaagaatatccccttttctatcttttttcttctaaagtcaccatccatctctaagaagctgaatggtagggatatcaagaaatattcatccctgccacactgggtcccatgataggctctgtaatgagggccgtatgatacagtctctgttagcaacagagctgtctgatttctctataaccagctgcactctgtttcccacctggaagccagaatggtcctcatgaaaggaaaacagaccattacagctgccacttagctggcctcctggagcccactcttttccctaaagtctcctcttttcacagcagctgttaccagaaaggggtcccaatccagaccccaagagagggttcttggatcttgtgcaagaaagaattcagggcaagttgtaaagtgaaaggaagttcattaagaaagtagaggaataaaagaatggctgctccatggacaaagcagccccaagggctactggttacccattttatgtgttatttcttgatgatatgctaaacaagggatggattattcatgcctccccttttttaccatatagggtaacttcctgacattgctgtggcatttgtaaactgtcatggcgctgatgggagtgtagcagtgatgacaaccagaggtcacccttgttgccatcttggttttggtgggttttacccagtttctctactgcaacctgctttatcagcaaggtctttatgacctgtgtcttgtactgacctcctatctcatcctgtgacttagaatgcttaacctggcagggcgcagtggctcatgcctgtaatcccagcactttgggaggccgaggcaggtgaatcacgaggtcaggagtttgagaccagcctggccaacatggtgaaaccccatctctactaaaactacaaaaaattagctgggcatggtggcgggcacctgtaatcccagctacctggaagactgaggcaggggaattgcttgaacctgggaggcagaggttgcagtgaaccaagatcacgcctctgcactccagcccaggcaacagcgtgaaactccatctcaaaaaaaaaaaaaaaaaaagagaataccttaaccttctgggaatgcagcccagtaggtcttagccttattttatccagcctttattcaagatggagttgctctggttcaaacacttctgacacagccagaatgatttctttgaaacatttatcaaagtgtgttattcccttcctcaaaaccttccaatggctgcccgccacacttaggatgaaatcagagtcctttctgtagctctggcctccagctccctctccagtgttatttctcaccactctcaccttgctcactcccacccaccactagcctccttgttcctcccacaagtcagcctgttcctgcctcagggcctttgcatttgctgtgtctgcagcctgatgctctcccttcatacagtcacatagtttggtccttgacttcatccagatctccacttcagtgttacactttatcagatgccttccctgaccaccctatagaaagtaacacctctagcattctgtacctctttgtcctgctttaattttgtacctatcagttatcttcgctgactcttcattatatatttatttgttcatctatggtctgtcttcttcattagaatataaacttcatgaggacttcattcacgattatctagggatagattctaaccacacttgcaatggccgcattccccaagcccctgccaaaagccagagagcccacgaaaagggaattcctccactggcagctgattgcgtttttcctctaccaatttccagactctggtgtatttctcctacttcatttaccatagcacttgctaaatacaaattttcaacaaagaaagtgatgttacttgaaaatgctactttacatctacctaaagtcttttaagtcagtagatgtcaaattttataaaatatttactggaaaaaaagttaacagtaagatacctttttttttttttgagacacagtctcgctcgtcacccaggctggagggctgtggcaggatcttgacttgctgcagtttccacctcccgagttcaagcgattctcctgcctcaacctcctgagtagctgggattacaggtgcccacggcaatgcccggccaatttttgtatttttaatagagatggggtttcaccatggtggccaggctggtcttgaactcctgacctcaggtgatccacgcacctcggcctctcaacatgctaggattacaggcatgagccaccgcacccggccagtaaaatactttttataccatgttttgtctagttttaaattgccattatgcctaattcatggagtgctaccatatgaaatgcagctaccttacctcatctaatctaagatgccaatattttaagacagataactggtaagaatataccagtaagaaaaaaacactaacaattaaactatgactcagaactgattataaatacctgccaatttcatagatattaaaatatggggtggaggtggaagagtgaaatgaaatatggtcaattgctgtctgctgttaaccttacctgaaccttcctccctccctcagtggatgactgaaggagacttggggtacttctagtgttctgtgaaagagctcaggtcctgaccactctcgctttgctccagggcatcgttttggagctcctgaaggaggccatggtggccagcctcggggacaccaggggcttcctgattgacggctatcctcgggaggtgaagcaaggggaagagttcggacgcagggtgagtggttgttacgggcatccttccagaagaaaaataggggacatccttgaggttgggtgataattcaaagtctatttctttcccaattacattaatgaaaactttaaggggcagaaacttgactcaaactagaaatttaaaaaaaggagatttattgacttaagtaactaaaacacccagcagtggtttagatttggttgactccagatatccaaatgtgttcatcaattgtctgactctctctctctctctctaattctctttcctttgtgttggtctcattttcttcctgatcaaggcttaccttctaccatctaagtggcttcatagaaaagtgtttctgtttcccagtgggtccagcaaaagacccagagttgtgtttcctatcctggatttggtcacagtcccatcatcactgaaccaattactgaggccgagagggaagaagagggaatacgctggctggcccagcctggaggaccaaggaaggatgggaagggaggagggagcaagggcaccacacctgaaccacacagggaaggaaaattacccccaggaaaagtagggctgcccttacaagaagacgggggaatgggtgctggacaggcagaatcagaactacacaccaccctcccactatcctcccaccatcccacctccctgcccaccctctcctagtgaggagggtgggtcagggatactcacaggggagcagcagtaagtaaaaaccattgtggctgccacgtattgaacccactctgggccagatcctgtgcccacactttatagagagtacctgtaatcttacaagtccaggcaagaagggtaaaactggcctcattgttaaacaaatactgacttgagaacttaaaagaaattcatatttatagagatatctcttcagactagttttgaaacatttttcatatacagttttctcgtttttttttaataacctttttagatagataggggaagtattgtcctcatgttaaaggtgatgagtgaagcccagaaagggttaatgacttccccatggccacacagctggtgacaacttactggtaagtgccaactgctagcaggactaagattttgcgggacccatcgccatccacttctagtaacattgattgaggtgaattatacttgtgtgtctctgggggtttactttgacctccttctgagcctgtttcatttaatttccttagtgtcaaaatacttcaaggtcaattgctcatcttcccctacacttcctacatgaaaccagagtcaaagaaaacatgtctaggtctagttggcatgggtggaccctggacccattctggctgtccctcgactccagagcttccatcagcaagatgggggtgggcagggagaagtggatttgcagagcagagccccattactgtggaagttttaggcagttcttgatgggggacactcacatgcccaagttctaatgagctttttcccatgaaaaaaatcacttcaagagcacaaacctcaatataaattaactagttttttacaagatggaattgggagcgttgttctactttttaaataattgtggtaaaatagacataacaaaatttgtcatcttaaccatttttaagtgtacagttcaaggatgttaagtacattcatattgttatgaaaccatcaccaccatcttgagaactctttttatctgctaaactgaaactctacctactatttattttatttatttttatttttggagacaaggttttgccctgttgccctggctggagtgcagtggtgcattcatagctcactgcatcctcaacctcaaggcccaagcaatcctctcacctcagcctcctgagcaactgggactgcaccaccacacccagctaaactttttgattttttgtagagatggggatctcactctgttacaagggctggacttgaactcctggggtcaggtgatcctctcacctcagcctcccaaagtgctgggattacaggtgtgagccaccgcacctgcctgaaactctaccctctccctcctttccccagctcctgacaaccaccatttttcttcctatctctgtgaatttcactattctaggtacctcttatttcacttaacaaaatgtccacaaggttcattaatgttgtagcatgtgtcagaatttccttccttttctgggtcaaataacattccattgtatgtatatgccacattatttttattcattcacctatcgatagagactggggttgctttcactttctggctattgtgaataatgttgccatgactacatgtgtacaatatctgttcaagttcctgcattagttcttttgggtatatacccacaagtggaattgctagatcatatggtaattctatttttaattttttgaggagccaccatactacacatatacatacatactgccagccatagtggccacaccactttacattcctaccgacaatgcgtgagaatttcaatttcttctcaccaacacttgttattttatgggtttttttgatagtggccatcctaatgggtgtgaggtggtatcttattgtggttttgatttgcagttctctaatgattagtgacattgagcatcttttcatgtgctttaaatgaagttgttttctttttgttgttgtctagttgtaggagttctttatatattttggatagtaactccttatcagatatatgacttacagatattttctttcatttgataggctgtcttttcactcttttggttgtgtcctttgatgcacaaaagcttttcattttggtgtagtccaatttatctatttttacttctgttgcctgtgctttttgtcctgtacaagaagttattacctaatccccatgaagccttccctccgtattttcttctaaaagctttgtagttttagcgcttatatatttaggtattttgatccagtttgtttgtttgtttctttgtttgtttgtgatggagtttcagtctgtcgcccaggctggagtacagtggtgaatcttggctcactgcaacctctacctaccaggttcaagcaattctcgtgcctcagcctcccaagtagctgggactacaggcacatgccaccacgcctggctaatttttttgtacttttagtagagacggagtttcaccatgttgcccaggcttgtgttgaactcctggcctcatgtgacccgcctgccttggcctcccaaagtgctgggattacaggcgtgagctaccatgcccagccttgatccattttcagctaattttttatatatggtgtcagattattttgcatacggatatctagttttcccaatgccatttgttggaagaatattttctcctacagaatgatcttgacatttatgttagtccgttcgcattgctatgaggaatacctgaggctgggtaatttataaagaaaagaggttattttggctcatggttctgcagcctgtacaggaagcatggcattgacatctgcttctggtgaggcctcaggaagcttccactcacagcggaaggtgagggagaagccagtgcatcacatgttgagagagagatggcagaggcccctgacgcttttctataatcacatcttccatgaacttagagaatgagaactcagtcattaccacgaggatagcaccaagctgttcatgagcaatctgcccccatgacccaaacacctccaactggccccacttccaacactggcggtcacatttcaacatgggatttggagggaacaaattccaaaccatactagcatcctcatgaaaaatcatttgaccatatatatgtgagagtttatttttggactgtctattctattggtctatatatctgtctttatgcctgtaccacattcttttgattactgtagcttagtaataagttttgaaatcaggaagtgtgagacctccagctttgttgttctttttggtgattgttttggcaattgagggcctcttgagattctatatggttttaaaatgatgtttctattcctggaaaaaaaaattaggattttgatagggattacattaaatctgtagatcactttgggtaatatcgacatcttagcaatattaagccttccatggattgttttagattttgtttattctaatcttctagccaacgtctaggctgtggataagtccctagggatacattctaagtaactgaggaacaggagtatttttcttacaccaccttagaatcaaggcctgtgcagggctggggggttggaggggaaaggaagaggaaggtgtggtacaaacgttgagaagcttcctgtctatgaggattggcagttgtgtaaacatgacactaacatacaattgtagatgtgtaataactgctgcagggtcaacagtgtttcaggcttttcccacttaccttgcccttgaacttaaggttagaagagctctgagagaccctccaggaaagtcaggacaggtcctgcgcatgtttggaagcgatgggaataaaagtcttttttttttttttttttttttttttttgagacggagtctcgctctgtcgcccaggctggagtgccgtggtgcgatcttggctcactgcaagctctgcctcccgggttcacgccattctcctgcctcagcctcccaagtagctgggactacaggcgcccgccaccacacctggctaattttttgtatttttagtagagatggggtttcaccgtgttagccaggatggtcttgatctcctgacctcgtgatctgccctctcagcctcccaaagtgctgggattacaggcttgagccacctcgcctggccaagtctttttttttttttaattgctctgagaggtggtagaacattctcttgaaaccctcaaatgatcgaggacaagatgtatagtaaataaataaggtctctctctctctctcggtcaacaacaacaaaattaaattataatccttattcttctttggggaattttaaaattgagtctgaaggcaaaccccagaacttaacgcctatggggttccacatcattttgagcaatgacaaccctggaccttcccaaggtggaatcattaaaagcatgtcactcgtgtactctggagtcagaaaatctaggttttcacctgtcatttattatggagataataatacctgttaacacctatttaaaaggttttgtaaacatcagatcatataacatgcataaatgtcttctaagctataaaagtttataaaatattatctagtttagcatcactcatttgttaatcacacctcatacaagcctctaaaattcctgctccatcaccacttcctcctttgcttaaaacccagttagggtgagctcagagctctatgcagcccattggtctgtcctctggcgtaagtatgaattcaaatggtccatgtgatcttccctaaagtaaagcaaaaaacttcctctcccactgtggtccccgttcagaccggttttagaatgtggcagagaagaagcctaactagaactaaggaacaagaaagtcatcaacatggtgactggacagttacactcaatgctaaaattcatgattccatttcaaacaacacacaggtaacacatttcattactgagcatacaaccgttaagtgagattttagacatctacaaagatgatttcttacatactgctaggaggaacttacagagaccaagagtgacattgatttgtccctgggtacagtaactttagaagattctagtatcaattaagcaggtgtgcaagagaacacatccagccctccagaatgagctcctgctttaaacctgaccagatggccgggcacggtggctcacgcctgtaatcccagcactttgggaggccgaggcgggcagatcacctgaggtcaggagtttgagacaagccagactaacatggcgaaaccccgtctctactaaaaatacaaaattagcgggacgtggtggcacatgcctgtaatcccagctacttgggaggctgaggcaggagaatcgcttgaacccaggaggcagaggttgcagtgagccaagatcgcaccactgcattccagcctgggcaacagagtgaaactccatctcaaataataataataataataaaacctgaccagatgaacaaagatgctacaaacacagaatgagctactgttgactccttaatgccctgcagggcccttcatttgtagctcccctccaaattacaagcaagaaattcatttgaaatttgacaaagacaaatgcagacatctgattttccccagagattcaaagtaatcagcttggttgaaagcatagtatttcccctagtgcatcaggcctgcaactatgtttgaggtccattcaagcctggagaggttttaaccagcccacaaaaatctcaccagcctttctgtgtcaccgagattgatgcgtccgatgcattggaccatcagttcctttaaaaattcagttagttaggctgacacttttgcatacctgtagctgagttctccgagatacaaggtcctttgaggatttccttggacactgcatatgacatcgctaaaaatcaaatgcaaactaatgtccacagcttaagggtaagtctatgtgtggtttctgttaccttcctatcttctattccccaagctggttttatccctgttgaattacaacctataccttcagtttacagaatgattactgggggaggggctgtgtatatgtacatgtatgtaatgcatgtatgcatgtagatgtgtgtaatgaggcagaaggaatatgagggaggagtcagggtttctgatcaccatcctcattccccactccagctgagaacccctggttatagtgactctggtgtgaacaggcctgtatttggagcctggctttgtaattcattggctggtaagcaagtcagctaactttgtagatctccttctcctcttctacaaaatgttggttggaaatacatacctcagtgattgttgggaagattggatgggatccttgacaagtgcctttacacacttataagcctacatatggtgttcaataagtctttacagtttttttaataatgtgtattttttctgactatagaaataaaaattatatagtatgaaacaatacacaaaaatataaaacaaagaataactaaccacccagtgataatacctattaatatttaatgtatgttctccccaagctttgttctgcctgtttttgcttagttaaaatcatacagaacataggaatagtaattattttttgagtacttacaatgcgccagaaactgaacttgatgctttacacatttcatttgattaatttttacagtcctacttaacaggtgttaggacccccgttttataggtttttttttttttttttgagacggagtcttgctctgtcccacaggctggagtgcaatggcgtgatctcagctcactgcaacctccgcctcctgggctcaagtgattctcctgcctcagcagcggggattacaggtgcccaccaccacgtccagctaatttttatatttttagtagagatggggtttcaccatgttggtcaggctagtcttgaactcctgacctcgtgatctgcccacctcggcctcccaaagtgcagggactataggcgtgagccattttatagattcttaccatcttgagaagggctctgtgcttagcctgactccctggtgtgaaattgaaatgctttcctgtattaagccaatctcatactcaacatcagccaaattaaccacatattaacagaagtcatattaacaaaagtcatattaatggaagtcatattaacagaagtcatattaatggaagtcatattaacagaaatcatattaatggaagtcatattaacagaagtcatattaatagaagtagaatgcatgggtttgctcttggcttttccctcccaaaagactcttagctgaaattctgcctttagccagaatatgtacataactctcgtggaggtgggaatgatggcttcacagtgatccctctgccttactactctcaactatctcatgacacttcattgacagaaccagtgtttctgtttataagtgtattctaatcttcagaatgagctcttaacacacacacacgtgcacatatgcacacatacacaaagtttgagtctggccaagggaatgtccagttggtgtgttctagttgtttagaattgtggggagccctggaggccacataggatttttcacttgagatgtttctgctctcttctgattcccggttcactgcagaacttagagctgcgtaatggtgtgtggggggagaagttatatatcaattgagtagtattactatcattagggttgtgtattcaggaatgctggaatgacccagatattcctcctctagtgaggttcccccaaggggacatacctcaaggtgagagcaaatgagaaataggcatgccactttcttttcagccagggccctttcctgccagcacagggagactctggtaaacatgctgtagcatgcgacttaggctaaaagcctgagtgaggccgctgactctttctagacctaaatctgaccagtgggatactttacaggtcaaaaggatgactatgttgcaaagcccaccttaaataacattagctcccatttatgtagtgtttgaagtgagtcaggcgctttacatgtacaaactcatttaaccctcacaatagtcctgtgagtcaaatactattattatcctcatttttaaatgaggaaactgaggcatacaccaagaataagatagttgttattctcaacaaagagttcctggatggcatggagagctcctgcccactggtaaacgtggcctaacccccattctgacttaatcagaagaaaactaaggtgggggtggagtcagagggcaggagggcaaacttctcctcccgctccacttgctggaatgaccaaagcaaaaccatgatcacagtccacaatgctcatgtccttgtgctggtgggctgccctcatgccctgaggggtgcaaggatgagtgtggtcctgtgtccggaaatggtgggttcttggtctcactgacttaaagaatgaagccgtggaccctcgcggtgagtgttaccattcttaaaggcagcgtgtccggagtttgttccttctgatgttcggatgtgttcggagtttattccttctggtgggttcgtggtctcgctggctcaggagtgaagctgcagaccttcgcagtgttacagctcataaaggcagtgtggacccaaagagtgagcagtagcaagatttaccgcaaagagcaaaagaacaaagcttccacagtgtggacggggaccccagcgggttgccactgcaggctaggatctggccccacccacatcctgctgattggtccattttacagagagctgattggtccgttttgacagggtgctgattggtgcgtttacaatccctgagctagacacaagttttccaagtccccaccagggtagctagatacagagtgtggacacaaaggttctccaagtccccaccagagtagctagatacagagtgttgattggtgcattcacaaaccctgagctatccacagggtgctgattggtgtgtttacaaaccttgagctagatacagagtgccgattggtgtatttacaatcccttagctagacataaaggttctccaagtccccaccagactcaggagcccagctggcttcacccagtggatcctgcactgggccacaggtggagctgcctgccagtcccgcgccctgcgcccgcactcctcagggtggatgggactgggcgccgtggagcagggggctgcgctcgtcggggaggctggtgccgcgcaggagaccagggggaggtgggggggaaggctcaggcatggcgggggctgcaggtcccgagccctgccccgcggggaggcagctaaggcccggcgagaaatcgagcacagcagctgctggcccaggtgctaagcccctcactgcctgcggccatccggccggccggccggccgctccgagtgcggggctcgcggaatccacgcccacctggagctctgcgcacgcgcctgcaagcgctgcgcacagtcccggttcccgcctgcgcctctccctccacacctccctgcaagctaaggaagccggctccggccttgggcagcccagaaaggggctcccacagtgcagcggcgggctgaagggctcctcaagcgcggccagagtgggcgccaaggcggaggaggcgctgacatcgagcgggggctgtgagggctgccagcatgctgtcacctctcagtcccactagatcccaagaggcagcagaggcagcttctgaaaaataaaataagtgagtaggcaccccaccccactcgctccctttcccacggccccacccccctctcctggttccatttggcccactcagcttcttgcccaaacttcattctgaaggcgttggctctctccatcagggtgaggtcaccaagctttggggttacatgtatctgcttcaggcctgtcactcactagtccctagtgaccttgggaaggttaacctctgagggcctccatttcctcatccttaaagtgggaataatcatacttcccggcaagagcgccagagggcttatgggatggctgtttgtaaagcccttagcacagtgaagcatagccagctgctgaaatgttgctgatggcatctcagcagcccttccaagggcacttgtgctctaactaaggtcccctgaaaaccaaaggccatggagaatccggtgaggctggtgccagagccccagggtgccagcagggtgatgttgggggcaggccaatgtccccaagtctctgattcattcagccaagggcagagttctctgctcgtctgcttacttgatgttgaagactaaccacagtccggtgaaaacaagagcagagctaggaaccagacagctactccaagggactttctaatgatacatagcgaagcattttgaaaaaaattagatggtatctcattgaaacatttcaaaaaattttaggtattaaaaacaaatggttcaggtcacttccaaatagaataactgatcgatagctttttatataggaagagagtgctgattccaggagagagaggttaggtcaaaccccctagttttggcacaggaaaatggcttgtcagagtagcttctcaaactatgatgctgtgaagactcacttagggatctggttaagatgcagactctaggctgggtgcggtggctcacacctgtaatcccagtactttgagaggctgaggtgggtggatcacttgaggtcaggagttcatgaccagcctggccaccatggtgaaaccccgtctctactaaaaatacaaaaattagccgggtgtggtggtgcacacctgtaatcccagctacttgggaggctaagacaggaggattgcttgaacctgggaggcagaggttgcagtgatcacatcactgcactccagcctaggctgcagagcaagactctgtcaccaaaaaaaaaaaaaaaaaaaaaaaaaacagattctgcttcagcaggtcgcgtgttgtgcctgagagtctatatttctaacaagcttccaaatgacatgctgctggtccgtgggccacactttgggaatcagtgtggaagaaaaagctacctctctgccccgtgcttattttggtctaaaaggtcatttgctgccggctcctgctcagtgacatataatctctgtttgtacctgtgtccctgaattatctttcctgtccccacaaatggcctgaaaataaccccacaattggaaaaatcgcctggctgtctcatgcaaccctaacccaaagttgtttcagggagaacattaagccgcctcccaagctcgccctctgctggtgaacaagggtcatttttttcctaaaccctcacccagcctttcttgctgcacaaatgctctttttttttttccttccaattaatacagacagaaaagtcgcatgacctattccagaggtttattgcactgttgtcgattttggagaatgtttccactctgttccttaaagtacacccctcagaggaggtagataaatgtttgaccaacactgtctggcaactcacgatattacgagttctccgtgttgcctaaacatcctcttcttgactgaactttgttctcatcccaccccacacactttctacagtggtggcaagccttcatttactcacagctcgaatgtggcaaggtcagggggagtaatggtttcctctgatccagggttggaggaggatgcaaagtaagcatgtcccagagacaaaagaacatttaagagaaggatatggagatggggagactcataacacagatcataccaccatcactcattcattaaaacatttcttcatcacctactgtgtgcaagacttgggactaggagcagagaattcttaatccctgcacacggggaacctaagcctcatagaggaaataagcgtaacagtgaatcgttagtgagtgtctgctgtatgccaaggagcatacgtatgttaccttatttaattttatttcatcctcacagcaatcctatgatcatcctcattgtatgaatgagaagactcagatgcagagaagttgagtcagacttctagttaatgaggaagtcagtttaaatgaacaatatgtaagtctggcacagtggcatgtgtgtgtagccccagctactccggaagctgaggcaagaggatcacttgagttcaggagttcaagactgtatagtgcactataattatgccatgaatagccattgcactccagcctgggcatcagagcgagaccccatctcttacaaaagaaaagaaaataaaaactttaaagaacaatttgttattatctctcgtggttctggaagttatggggctcagcgggctggttctcacttggggttccttatgcaattgcactcagacagtggctggggctgagatccatgtctggagccagggctgggatatctaaaacagttgggggctggtagggcatctccgtccacatggcctctccacatggctaacttgggcttcctctcagcctggcagtctcaggatagttggacatcttagatggcagcggactccccactgcagcaagtgttccacaaaaccagacagaaactgcaaactttcttgtgacctagactctaaaagcatggacattatttccgctacagtctgttggtcaaaatagttacaggtcagattcaaggtgtttctgtgtctcagtgggagagtagcttacaagtaaagtgagataacgaattgatgaagcccatcctggagacaagtcatgacaccagggtttgaccctaagcagcctgattccagcctctgtgtgctaaagcattatgccccactcacctgacacagtacaggcacagccacagaatgccacctgtggctgttatatcacggtggcttgaaggagaagtgattagctgtgcctcaggtggtcaggaaaggcttcacattagaggaaacaccccctcacacatacatactcctttcttctcagtgcagaagaagacagacagtggctgcagtgggtggcatatactcgtctgcatcacgtgaggtggcctaaaagctgagggcaagagacagctctgaggcagtgtgtagaagggaactgacctggaaggggggagctatggagtccagtcccagctgcaccatagtgtaatgctgggaccttgaagggaaccagaaggccaagaaaggaaaaaccagaggccctgggcctttccagaacatcagcagggtgaggtttctgactgtgttgtgctccactcccatctccagattggagacccacagttggtgatctgtatggactgctcggcagacaccatgaccaaccgccttctccaaaggagccggagcagcctgcctgtggacgacaccaccaagaccatcgccaagcgcctagaagcctactaccgagcgtccatccccgtgatcgcctactacgagacaaaaacacagctacacaaggcgagtcacttcactttctcctctgaaatgagccgcttaccttttttttttttttccaagaaaagagaaaaagctgagaacattttagttaagggatctgggaattagaactctgtgcagctgcagcactggggccaaaaggcccagcacagtggcttatgcctgtaatcccaacactgtgggaagtcaaggcgggtgtattgcttgagcccaggagttcaagaccagcctaagcaacatagtgagacccctgcctctgcaaaaaattagctgggtatggtggcacatgcctataatcccagctactcaagaggctgacgtgggaggattgcttgagccccagaggtggaggctgtagtgagctgagattgtgccactacactccagcctgggcaacagagcaagaccctgtctcaaagaaaacaacaacaagaatttggaccaaattatgaatcccttactcttcacttctatttcaatcaaaattaaatatctgtcgtcatatagaccataaaaaggtggtcatataattttcacagatccccttatagttgctgaaaacaactcctttttcccaaaaaagagagagagggagagaggaagggaagaaggcagggagggagggaggcatagatgagacgtaggctctgccactgactctggactgtgagattattcactagagctaagattcaatgactttgaatttctataattttacatcgttcacaattggctcttggctcctttgcctcaatttcttgtgataaccaacatttttagaagaagctgcatatggggccaggagagcaggtaattaagtaaaacaatgaagatagtgtgaggaaatgagtgtatcaacctagtgatcatgagctctctgctgagtcaccatcagttttatgaatttgggaaaactgcccagtcctcatccttccactcatcccataactatgtatcaggaacccatagtccatcaattgcactagtggtttggatgcaaataaataagattcttgaatccttgcaaagcttagggtttcagtaggagagagagacaaacgtgtgatcacacaatgagatcaaagcaagcacagaatgtgtggcaagggccctttcctccagtgtaaggggaaaggaaaggatccaggaaggtggcctgaggaggactcggctgagtctctgaagcgggggtgcacgccacaccagagaagccccaagtggagaaggtcaggaaaaccaagtaactccacgaggctgtgacataaagtgccaaggaaaagagggttaagagatggagatggagaggcaagcaaggactagatcaagatggatcatatgtaggagcaaataattgtcctctgagtgatgggaactaccaaaggggcaggaataatcaggatttcaatctagaaagctcaatccatcatccttatggggaatggatgcaagaaggtaaggctaggagaccactgagaggctagaacagtatccaggaacaaatccataaggatgacagagtgagcttttgtccaggaacaaaatcctgagtactcgaactggagaagggagagtgggatctcttgctgttcacaggataagagacatcatcaataaataacaaacttgtctctgaggaagctacattactgattccttgggggaaaaccattgataatgaattcttatcttctaactctgttaatggtccgctttccagaatcctaagaaacactgggtatagaagtctgaaagatgcctctgcatttaactgagtgtcaaatatgtggcatgagagacataatcccctacttccacatccatggccattgctagttgatcccagcactgtttctcagtcagcaggtgtggcctgagaatgtttgtcaacacagcactccaggcagctactgccaattaataggacttgatgtgcaacctgagacttatttgttgtgctttatataacctctggctgccacattttaaaaataaagacttcgatctttaataacagggccaagtgcaatggctcacacccgttatcccagttctttgggaggccaagacaggaggattacttgagtccaggagtttgaagaccagcctaggcaacatttcgagaccctgtctctccaaaaaatgcaaaaattaactggacttggtggtatatgcctgcagtcccagctacttgggagactgaaatgggaggatcacttgagcctgggaggtcaaggctgcagtttgccatgatcgcaccactgcactccagcctgggcaacagagcaagactgtctctcaaaaaaaaacaacaacaacaacaaaaaaaaaaaacataaacaaaagtgtttttgttatataagagcaatgtcttaagaattcagggctgcaaaggcctttccaaaattagattgtctagtgatttccaccttttgagcagcctggaacattaaaaaaaaaaaaaatcctggtgtggtggcgcgtgcctgtaatcccagctactcaggatgctaaggcagaagaattgcttgaacccaggagacagaggttgcagtgagctgaaatcacaccactgcactccagcctgggtgacagagagtccctgtctcaaaaaataaaaaaaaaaattaaaaaaaagaaaggtatttcttccacttttaagatttgtaaaggtgggaaaattcctaagtaattcaggatttaaccacttttagagttggaaaatccctcttagctctctgttgtattattccaacctgaattctacaaactcacaaatgactgctcgtgagtacagggttgagttctcagacaaatctgatttctggaatcttccttagagctttctaagttagtggtgtccaaaagaccagattacaacacatttaaagatcttcattggcttttattcatgattctagaattgggcagacctcaggaccagaaaaatgtttgaagaataagccacatggtcaagcaatatttatgtttagaaaacagaagtgaggaactgaggttaattagttacagccttatgtgaatcagctggctacctactattgacttaagctcagctgctggaactaccaaaactcagccatctgttacagtgtgtacatccaagttgtttgtttcatttagcacggatgactccacgttggttcggcctgttgggcccagaacgggagcctagtccaaaccaatggcctcctacaaattttatttaatggtggaaaagaggtttgcagtcccctggctcatctcttcaacttcccctgcattttggagatgctggctgctgggtgcgtggtgaggtaacattatgatccactgcacaaatatgtaaaacctctccagcccggactgcagagcagcgtgagcttcagccttcaggactcccagagagtctcagggaggctgcttcatcccactgcccctgcccagggccatcccctacccacacagctgcaaagatgaacagtcctccctacacacctagcatagaaacagtgtgtgctgggcccaggaagctgagatttgtctgcaggtacccgtggggtttgccagtagctagggtgacaagagcggggactgcaggagaagcaggggaggggacaggattgtttgccgctggagagggagaaagccactggcccactctgttgtctggcctctgggtttttgcccagtcctcctgcatcagcttaatctcccttggttcctaagtaacagcttgtggcctgctcctgtgatgctgtttggattgtttgcccctcctccctgttgttttactggacccaagacagggctgctcacccaagaggacctctgggtcacttaaggagctttcttaaaactaggtggggctggtgaatgcacttcaagaaagcaagtgagatgaatcagcagttctgtgagatttatttaggaattaaagccacagggggggccaacccatgcagcccacaaataggccacaagcaccgccctcaggcctctacccagcaatgctgacattgaacccatcatctgacaccctccatcccccactccatgacaagtcagccctttggccaccagctagctaaggaaagtgcagcaaaatttcaaacaaagataatttttaaagcaaagcagaatttatacagccactcccttattctttatgtcatcataatgccatccttgtacaataaagttagaacttcttgtaacgtgcacaccagagatggaagtacatgtgatacaggtgtatccctttctgcctgtttttctccctctcataaagcagaggtttgccctgcatctgagaaagaattagaacagaactttcctccatttcattccccacctcactacacttgggccaggcagcgttcgccagtcatggcacttcctaccaagtctgaatgctgtctcagaaacttgctcaacacagccgtatggaccatcacccccaactgactagaattagcctacaagaagaagttttctttcaccttagtgagataatttattatggccataagtaactgaaatgtagcatttggggatgaaaagcacagttaccagccaaagactccctgggggatggcggggggaatatgggcctgtgcatcagaaagccccaggcacactttcatcaacttcggtgagtcattttactgcttcacctctcagttcttcttcctaaagtggatagaacacgatctactagaattgaccaagtctattattataaaagtaacacatacttgctttataaaatatagaaaactggtcaggtgtggtggcacatgtctataatcacagcagtttgggaagccaaggagagtgtgggtcactggagcttaggagtttttttttgtttgtttcttttttttttagagatggagtctcgctctgtcacccaggctggaatgcaatggcgcaatcttggctcactgcaacctccacctcctgggttcaagccattcttctgcctcagcctcatgagtagctgggattacaggcacccaccaccacacccagctaatgttttgtatttttattagagatggggtttctcttatgttggccaggctggtctcgaactcctgaccttgtgatctgcctgccttggcctcccaaggtgctgggattacaggcgtgagctaccacgcccagccaggagcctaggagttcttgactatcttgggcaacatggcaaaacccatctctacaaaaaatacaaaagttagccaggcgtggtggaacacatctgtggtcacagccactcaggggactaaggtgggaggattatttgagcccaggaggttgaggctgcagtgaaccaagatagtgccactgcactcaactggcgagatcctgtttccaaaaaaagaaaaaagaaacaaagaaaatgtagaaaactaggtagtcccaccactcagaggcaaacattgtggggcgttttcaccacatctttttgctgtgaattttaaaaacatgattgtgattgtaggtaatactgagccagactctgtggttgtaggtagcaggtgccaactcccgctggcctaacctgaaacacagaacttcattataaggttagaagactcaaggctgaggcacagcaggccctagaaggcgtgtgggatcaggcctaaaaggctcacagtgctccctactgcttcacaaacaccgtttccttctctctaagctgggttttttttctttctctggcttataagccagaatatgcccacctgacagctttcgcatttgcacattaccacggcactctgattcccagctccagattcctgagagaaatgatgtggttggccttgctttgctcagggtctccttggctctcttagctgtggacaggcagctggggtcacagggggcttttttatttttttctgtactttattgagtgcatatggtatgtgtgggacacgacacttggtgctggggacacagcagtcaacgtgacaaagcccctcactgaaaagagaaaaacaggccaggcacggtggctcacacctgtaatcccagccctttgggaggccaaagcaggcagatcacaaggtcggcagttcgagaccagcctggccaacatggcaaatgtctctactaaaaatataaaaattcgctagacgtggtggtgcgcatatgtaatcccagctactgaggaggctgaggcacgagaattacttgaacctgggaggcggaggttgcggtaagccaagatcacaccactgcactctggcctggatgacaaaacgagactcggtctcaaaaaaaaagagcaaaaccgtatacaagaaaataaagcaaccactaacaagttctgtggataaaacaaaacagaatgcattgttgggagtgagcactgtgggcagctgtttggaaagtctgaggaggtagcatttgaattaggacctgactgatataaacatggttacctgggactcttccctgtgaagcagatggaggacaaggaatacccagagagaagggctcgttgtgagctgagagaaaccacagaaatagctatctcaagtggcataggcagaattgtatcaaatgatatttaaagcctctttttttcctaagtataagtaacaactacacattgtttaaaaaagaaacaaactagaaaatttaagactataaaggtaaacattaaaattattgagaattattccacccaaagataatcaccaatgaacattatgatatatttccgtacattttggtttttttccatttttatatacattttgttcatggcataattagcccagaaacaccccaggccatagatgaagagggcctggtaacagattatttctgtccctgcgttatttgctactcttaactgattaaaaaaataaaaagagagcccagtgactcattaaacatgagttttgcagacagacaatcaagttccttggcaactctgcttttgtagaggagataataagcttttttcctcagcaattctgctgctgcagtgtctcaactttgtaaatagtttgaccgtttccattaggtcctgaaatgcaatggtccacattgttctggtcaccatgctgtcaggagaagccctatgaattgaggcaagaagagtgagaagtttctgcagtttctggtattactgaggaaagtggaagcagaaggtaccataaggtcacatttcaccgcttggttgcaaaatctactgggtaattcataactgactggatccccaagtttggagtctaacacaagtaaaggaaaacccaaaattacttgtataccttgaattctctgtactaaattcttaattttgattcttctttcagttggctaaagtaactcaactaattttgagttcaatttctcattgaatatctgagaatgccattatagtggcttcacacacaaatgacagtttgactggacataatttaagtcataataattatttttctaccaaaagtcagtaaacattgctctattttttttttattgtttgttttgagacagggtctctctgtgttgcctagtcgggtttgcagtggtgcaattacggctcattgcagcctcaacttccctgggcccaagtaatactcccacttcagcctctcaagtagctgggaccatagacatgaaccactggcgatagggagcagtccaagttttcagaattcttgtgactattctcatttatgggggtcttcaggagtattttcgtaggaagctgggaagctgtattgggatgctggccagattccatgcgaggtaagagcagggacaatggagggaatattttccatctccggttagttgaatctgcaggtgcagaactttggatacagagagtagactgtatatatttatgtgtgtatgtgagagtacacacacacacacacacacacagtcatgcatcatttaacagtaaggatacgatctgagaaatgcatcattaagcaattttgtcattgtgcaaacatcagagagtgtactaacacaaacctagatggtatagcctactacacacgacagcctgtcactgtattgaatactgtgggaattgtaagacaatggtaaccatttgtgtatctaaacatatcaaaatatggcaaagatacagtaagaatacagaataaaaaatttcagtggtaaacttgctgtatagagtgtttaccatgaatccagctttcaggactggaaggtgctctggatgagtcactgagtgaatgtgaaggcctaggatgttactgtatactactgtaggctttataaatgctgtacagttaggctatgctacatttgtaaaatatttttctttcttcaataataactttggcttactataacctttttactttataagcttttaaaattttttcacttttgaccgtttcatagaacttagtttaaaacacaaacacattgtacagacgtacataaatattttttctttatatccttattctatgtttttttctattttaaaaaaagtctttttttttttactttttaagctttttttcttaaaaactgagatggagacacacacattcgcctaggcctgcctacacagggttagaatcatcatgccactgtctttacctccgtatcttgcccactggaaggtcttcaggggcagtaacatgcatggagctgtcgtctgctttgataacaaggcctttttctggaacattcctgaaggacctgcctgaggctgtttgacagttagctcttttttaacaagtagaaaaaatgcactctgaaataataattgaaagtataatataggaaatacataaaccagaaacatagtcatttattgtcattatcaagcattgcgtactttacgtgattgtacgtgctatacttttccaacaccggcagcacagtggatttctttacaccagcatcaccacaaacatgtgagtaatccattgcgctgtgacattgtgatggctaccacatcacaaggcgctggaaaattttcagcttcattataatcttatgagactgccattgtataagcagtctgtcattgaccaaaacattgttatcagtgcatgactatatatacccacacgcccgcaattaacaatgcccttcacaaccttgcctccctcaagtaaccaatgtgaacagcttattgtgtatccttccacctctcctcacttcctccttttcctcctccttctgttctctttctctctttcttttcttctttcctccagcccctcattctttctctctgaaatcaaactttttactacagacacacacacacaaccatggtgggggagggctgatttcatgcaaatactcccaagctgtacgcatttctgtgaaacacctccaggttaacacatcacaatattgttttctttttaatagctatataatatgccacaatatagatattctacagtttattcaactaggttgtttctagttcagtttggttgtttttacctactactaacaacgatgcagtggaaagacatgcttaattagatttttttctagtaggagcgactgctgagctattttaagcaaaggctgattttttttaactcattcatttctactcccctggctctccatgttgccctgggaagagttctttgaagtataacaagtaaaacaaggagctttggaatttcccagctccttgatgcttagcctcttttagcagtgccccaccttcactgggggtgcctatcagtttcaagtctgaagcgtccctgcatttcatctgggcctgccttggttgacaactagaaacctagatttagatacagccctccctcctgctggtgcagtgaagagaaaggtgtgcctgaaggagagagtgacttagaggaaccctaaggttctatcctctcacttgacaaatgaagcataagtcttccatctggctctgagagacttaagagactttttctttatgactctgcttaaaatagtcttctctccaccccctttccttcctgattgtcagaccttcaccagattcccgcaaagacgttttgattcgatgcaatactgtttgcacccctgcggtcctgctgaaatgagttgtgcttgctgcgtgtgtgtctcctccccaaacagcaagcagaagagaattccaggcccttttgactcatctgtacacactcttgatttcttcctctgtggttgctataatcacatagcagattttgcctttgcccatgttagggcacccccttcactgaggtccactttaactcagaacccctcccagagtcactgacatgaattctaccagcaaagaattggcaccattctatgtaaggtctttgacatgctcagcagacatttactgggcatctctaaggtccaaggcatgccacttaatgttgggaattcataggaaaaagacatgtgcttgtaatcccagcactttgggaggccgaggagggcagatctcttgaggtcaggagtttgagaccagtgtggccaacatggtgaaactccatctctactaacattacaaaaattagatgggtgtggtggtgtgcgtctgtaatcccagctactcgggaggctgaggcacaagaattgtttgaacccatgaggcagaggctgcagtgagctgagatcgcgccactgcactccagcctgagcgacagtgtgagactctgtctctacacaaaacaaaacaaaaaagacttgtgaaactctgtgacacatgaaaccccagcgaagtagtaggtgccataataggatctacagaatgctccaggcctttggggcacagagctcgggcctgggaaggcaagtaaatgcttcagagaaaagaggacatttgagctgggtcctaaaggatgaagagaaactcaagccagatgaaggagaaggaacaaagccactgacacgtgaaagcgccaggaatgctggcccagatgaagtgccaaatagatgaattaaagtcgtggcagatgagactaaagagcaagattgaagcaagtggtgaagggctttgaatccattcatttattcattcttcctgcattcagtaaatttgctagatcagcactgtcaaaagaaatagaatgtgggccacatgtataatttaaacttttatagtagtcacataaacaaaagtaaaaagaaacaggtgaaattaatttaacaatatattttatttaactatttaacctaatatatcctaagtatcatttcaacatgtaatcaatataaagttctctttttttttttttttttttttgagacagagtctcactctgtcaccaggctggagtgcagtggcacgatctcagctcactgcaacctccgcctcctgggttcaagtgattctcctgcctcagcctcccaggtagctggaagtacaggtgtgtgccaccatgtgtggctaatttttgtatttttagtagagacggggtttcgccatgttggccatgatggtctcaatctcttaacctcttgatctgcccgcctcggcctctcaaagtgctgggattacagacatgagccactgtacccagccataaaattcttaatgaaatatttttacattttttttatgaactatgtattcaaaatctggtacttagggctttacctcaaatttagttgctaagtttccataaaaaatactggaactatatttatatttcataaaatttacagttgaaaagtagatttcacatacccaagtcattccaaatatagttcttaattttccaaaaattggatcaaatgccaggtttaaattttagattaattttaattaaacagtattaaaaatcagttcctttcttgtgctagtcagatttcaagtgcccagaaaccacgtgtggctaggggctaccatattgcatagttctagactacccaaggatgtttggactgaatactgaaagtactcagttctaggagggaagcactgagtaactttaaacaggaaaatgattgagcaggtgttttagagaggtcatttttagaaaggatgattttttttcatatctgctaaaagatgttattcaaaactttaggcagaatggagaggaagagaaaaggaaaaacagttacttaaaacgtttaagtggacagactgcacgtactatgggaagtcctatttatagacaggccattaatgtgctgattataagtcatccttatatttttgctgaagtttgtccttaaatctctctacagtcaatgtatatatagtcctccttctttctatggctttgataacgaggagaactgtgtggcctgactggatatgtgaactggatgacccccatgagcagtcttttacataaccccaacttttgaaaactgcatttgatgattttccccagatcatgcccaggttctgcacactgaggtctaccttgctgagccgctgctgttatcctctggcagtgagggatccctgtggtgtgaggctgtgtcttgtttaacaggggacaagattagaaaaggaaggtgctggcacacagaccgtgatcctaaaccatgctgtaacagcttggctttgtcccagaggttccatggtgccaatacatgaaaaataaaatgaaactcaagcaatggtttcaactgtctgggaaaattcaggaaaaacacaactagacataggcaatgtttggaccagccaactgttttatgatttacaaatccatggaactaaagaggaagagtaaacaaaatgtgtaattcccaaagcagtgtaattgctttcctcatttagtcatatgttctgttgactgttgggtagaaatattatcactgactgctctacttttccttcaagaagtcaggtaaaagctcagaaatttactatttcctgttcacttgcttttagctttttttttttttttttttttgagactgagtttcattctgtcactctgctcactgcaacctccgcctctcggggtcaagcgattctcctgccttagcctcccgagtagcaggaattacaggtacctgccaccacacccgtctactttttgtatttttagtagagactgggtttcaccatgttggccaggctggtcttgaactcctgacctcaggtgatccgccctcctcggcctcccaaagtcctgggattacaggcatgagccaccgtgcctggcctgcttttagctttttaataaaataatattttgctacactggtcagaacatcacttactgtgggatttttatatcatgtctcagaccaaaaatggtaaattcttttttttatgtttatttcttccttaaaacttttaacttttgtgggtacatattgggtgtatatatttatggggtacgtaagctactttgatacaggcatgcagtatgttaggatcacgtcagggtaaatgaggtatctatcacctcaagcgtttgtcctttctttgtgttatagataatccgattatagtcttttagttatttttaagtgtacaataagttattgttgactagagttaccctcttgtgctatcaaatactagatcacattcattctatctacctaaatttttgtatccattagccattcccacttccccctctcccttcccagacactggtaactatcaatctactatctgtctccatgagttcaattgctttaatatttagctctcagaaataagtgagaacattcgaagtctgtctttctgtgcctggcttatttcacttaacatgacttccagttccatacatgttgttgcaaatgacaggatctcattctttcttatagctgaatagtactccatcatgtatgtgtaccacattttcttttttctttttttgagacaggatctcactctttcacccaggctggagtatagtggcacaatcatggctcactgcagcctcaacctcctaggctcaagtgaccctcccacctcagcctcttttatttatttattttttttttttaagggacaaggtcttaccctgttgcccaggctggagtgagtgcagtagctccatcacagctcattttagccttgaactcctggcctcaagccatcgttcacctcagcctctccagtagctaggactactggcatgtgcctagctaatttttttatttttgtagagacactgtatttcccaagctggtctcgagctcctgggctgaagcaatcctcctacctcagcctcctaaagcatgggcagtttacaggcgtgagccattccatccagctggtaaattcttgaagtcagaagcaaatctacttacctagtttctaactaaattaaatacattaagacctcatacattctgattttgctgactcagaattgcagatctttcggagaaaggtcacgatgaaacttacttttgactgttcatgataaaagagggttactataaattaatattataataattgattatagaggaaacacaccctatattgcaggacgtattacttttaagtttacacaattactgaggaagtctcattcacagaaaacagtcagtaagctgattgtgcaggattgttctctgtttgctaaggacattaaacaccagcacccttataagctaactggtttaaatttgctaaagctctaagcacgaagaaaagttcctgtaactttgaaagcatttagtaaattggttcttttccatttcttttgagttgcagttatatacaaaaagataaatgccacttattctcttaaaatactctccacatgggaattagatgagcaaagagaatctactttgagacttaggaagagtcgagctaacctgtagaatgaaaggagaaatttggagagtagataaaaggttttgttcccacccaattcaactgggctctcttttgctccttaaaaatacacttcaggccaggggcagtggctcccacctgtaattccagcactttgggaggccaaggcaggcagatcacctgaggtcaggagtttgagaccagcctggccaacatggtgaaaccccgtctctactaaaaatacaaaaattagctggacgtggtggcacatgcctgtaattccagctactcgggaggctgaggcagaagaattgcttgaacccgggaggtgggggttgcagtgaacttagatcataccattgcactccagcctgggagacaagagcgaaactccatctcaaaacaaaacaaaacaaaaatgcattcagaaatccaggcctttcccaacacacacacacacacacacacaccttctataagacaacagaaattgcctcactgactttattctcagaacttggcatcttggtcctaaggaggatcccagataacttcacagagttttctagtcacccaagtaaaagactgcttttcccatctagaaagccttatcatttgattttgtctttaaacctacccatatctttgggctccacaggggcaagcactacagtacatgactctgactggttggcaataagcaggtttttaatttcattaataaacccccatatttaagccacacaacaaaatgaggagggggattggggttggaaatagaggtgggcaatggtccactgagagctctgggacccttcccagctctccccaaaacattagctctggcctgattgacagaaagtaactagcactgcccttgaggtgctgcgtgctgagtcctctgtgctgaaaccaagtcgccttgtttttagaaggcagaatcccttctccttccataaagcctagactacagaaaatgggctctaagaacatgtttcctcccctacaacagttcatttctatgaggaaagaaagagcaaatgtgggaatagaggatacattcttttgtttaccttttttgttttttgcctttctacctagagccaggcacggggggatactacactgagtaatgacctcgtgctcatggagcttattgtctagctggatgttgacaaaggttctctgctgaccaaactttagtcaaactcttaaaccttctcctaggcccatctgtgcacttcctcgtaaaacccagttttagcaaagaactctgctaaatcactttagcaagatcccctactctgaatatctgattggggtgctcatcctccatcatccccaggtgctgtctgatcatattggtctgtcttcagcaagagtcctgttaggtcggtgtagccagaactttccttactcctgatgttattacctcttagtaattttccatccactgactcccagcctgctctttgactataaattcccacttgcccacgctgtattcagagttgaatcccatccctctcccccactgcaaaattctgttgccgtagtccctatacccatcgtaatggtccccaataaagcctcccttaccgtgctttaacaagaatcattgaacattttttttctttaacaatatacaaatacttgggttaagactgggttttatctggccaagaagtgaaaagttaaatgttgcagtgaattgcaacaagtaaatggccactgtgatagtcagtggggaaggtaatacagaaagagcctttagttcactgtgatagtaaaaggcagaaggtaatagagtgcattcaaaggttgttgtaatgagcaaatgtgtttttatcagagtctaaaagaaatcctggacaaggatcaacccaatttatgtgagtgtaacactggcattatgttgaatgaccaagttatccattatgaaacacagaggaaatagaacataatgcatgtgttcttggccaggcacagtggcttacacctaaaatttcagcactttgggaggctgaggtgggaggattgcttgaggtcaggacttcaagcccagcctgggcaacatagcaagaccccatctctacaaaaacatacaaaaaattagctgggcatgggggcacacgcctgtagtctcagctaatcaggaggctgaggcaggaggactgcttgagcccaggagttagaggttacagtgagctatgatctcactactgcactccagcctgggtgagagagcaaaaccttacctcttaaagaaaaagggggttctttaaaaaatttgtatattaatagtgttaaaagacacattacgagtatgagaaacataggtatggttttcttttggaaagaaggtaaatttggaaaatcatatataaagttgggaatgttaagtagtattggttgcagaagacagattggaggagagaaatgtttcagggccaaggagcagaaatagaccatgctaagtcagttaaatgcaagggactggtggaattcagcaagaggctggagaacagataaataatgaggaagatgctgcaaaatatctaccacttggtgaggacaagaacgggccctagaacacagttgggtttgtacagatgaagcagagggcgtaactgaggctgaaaagtcccactacacatgtgcctcaattaggtagtgatattgtagtgagaaaattcacatgcatttgaagtagatggtcacttgggatcattccgtaggctaattatattcctcttctggggaagatatggagctgatttggggcagtgtttgtgccaaagacaaaaaattggatcactagggtgaagaacttacattatgcacagaagagttgtatttgagtctgtcctcatggaacttcttggggaccagtgacagacctgatgcattttccactgatacgatcatggacagtgtaaataataaatcaagcgtttgtggatttacaccttcttacccgtccctgctacaggggaggaaacttgagaaggggcgggaatgtgagttagcaaccccttcctttcctccctcctcccagcgtttgataaggcgagctcaggtgactgtatagtgggctgtgggcagaaacagatttgctgaaaagagatgaggaaggcagacatcccaaggcatgtttggaacattcgggttaaatgcagcatagcattattcagcaataaaaaggaatacagtattgatatccactacaacataaacgaaccttgaaaacattatgccaagaaaccagtcacaaaagaccatatattgtgtgatttcattgatataaaatgtcctgagtaggcaaatctatggcgacacctcattccaacctatttttccagcttcctctttttatctgcctgcccccatcaccccatgcagcatttgctctgtcctcaacaaatgacccactgttcactgaaaaatctatgtgctttcagatctctacacctttgccacctttattatcttccagtacatgtctattcttctaggccgagcttaactggcaacaccaaactaaactgaacaatcctgacacctgctgagaggagctcatccccactaaaaagtgagctcagatttggaatagcatagaacatccaggctggaaccagacctggaggttatctagtcctagttcagtcccttcatatgatagaggaggaaactgaggccccaagaggatgaatggcctgtcaagtcctgaagcacactgagggcaatcccaggcacgcctcatacagggctctttgccttgcacttcaacctttctgcagtttttttgttttatttgggttttgtttttgtttttgtttttgtttgagacggagtctcactctgttgcccaggctggagtgcagtggcgcgatctcagctcactgtcagctccacctcccgggttcacgccattctcctgcctgagcctcccgagtagctgggactacaggcgcccgccaccatgcccggctattttttttttttttttttgtatttttagtagagacggggtttcgccatgttagccgggatggtctctatctcctgacctcgtgatccacccgccttggcctcccaaagtgctgggattacaggcgtgagccaccatgcccagcctctgcggttatttttgatggaacaaatatttatcaaatatttgctgtgtacccatattttatgatgtcagcccattccttaaaaactcttacatgggctgggcacctgtaatcccagcactttgggaggctgaggtaggcagattacttgaggccaggagttcaagatcagcctggccaacatggtgaaaccccatctctactaaaaagacaaatggccaggcatggtggcacacacctataatcccagctactcgggaggctgaggcaggagaatcgcctgaacttgggaggcagaggttgcagtgagctgagatcgtgccactgcactccagcctgggtgacagagcaagaccctgttttaaaaaacaaaaaacaaacaaaaaaacaattcttacgtggttcctcattatcgtcatgcaatagggtacataagcctcttcatagcctagcctgtccctacaattccagcttcactccttgctactccccctcatatctggccatccaccattttgaactggtcagcatagtgtaatgtagtcaacacgtgcaaagacttcagaatcaaaggcctgggtgtgaaccagttctctccacttacttaaccacattatcttgaaaaaatttaattcatctttcagagcccctgtttcatcatctgtaaaactgggataacaatacttctaagatcattgataggattactttggttatttaaaaagcattcctgtgccattactagtaatatttatcattttaaatgatgacaattattactttcctcagaaagcttctctgccctccccacattatggaaggtgcccttatagctcctgtgcttatctcctaacagtgtaaattcctgttgaatgttcatctctaccactgagcgtgagctcttggaaaacaggaccattgtttctcgttcaacttggttaactgcaaaacattgatgataaccaggaaatgcttgttggttgaaaggaaaagaagaaagaagtaaagcaataagcaaggtgctgtgggggccatgaacatggcaaaggcaaagcccctaccatccagatgtagaacctgtagctggacagacaaattgcagattgctatctttgagtctcctgtaaggatgaagtatatttatgagaggggaaaaagaactttaaaaaaacttattttttccttattgtgggctatatcatacatacaggaatgcataaaagtagtatgtagagtttgaggaataaaatgaacactcatgtaaccaccatgcaggaaaagaaatagaagagagttgcagaagctccaccctccccatatgtctcccctgtcacagcttccttcctctccccaagaagtaactcatgtcctggatttcgtgataatcatttccttgcttctctttatgactttattgcctatgtatggatccctaaccaatatagctttgtttttgaaccttatataaactgaaccatactgtattcatattcttgagactggcttgtgtctctcaagtttgtgaaattaatccatgttgttgaagatagctgtggttctttttcttttaattactatagtattccattatatgactatgtcacaatttatccatctattgctaatggacatacaggatttttccagttggggaacgacaaacagtgcttccgttaatattgttgtatccattttctccactatctgaacatgcagcattctttttgttgatattgttgagaattcactctacctctggaagcagtgaaagccctaggggaagaaaaattcaaactagtttgcacaaagaagatttaaataggtagacaagagtctcaaagtgtgcttgtaaatgtgtgtttgaaaactttgtgtttctcaaagtgtgctccaagatggcccacaacaaaatcatgtggagaatttgttaaatatacagattaaagacccagcccaaacccaccaaccaagaccctctgcagttatggcctggaaagctgtgttttagcaagcttaccaccgcccgccccccacatgactcatgtagatcaccaaccctctaccttttttttttccttttttcgtttgttagcatttagttaagctccctccttgtggcttgaagccaccagaacacagcctccctacctccccccacatatacacccttaatcttctcccagctctcctgccgaagaacttggccttcgtgacagcaggctactttgggagtttcccttcctcagaattctgcagtagcccatagcactccatcaatgatgggagcagctccagcctgttttatttattattatttttttttgtcagcgtgtgattactcatgtctcctgactgaccaaggtccacatttgtcaaggtcaagagttgggcagaagctctggtttctctttaagaggtaatgcctcataaccaactttaccaaagtaacctgggtgacactcatggaagttgatgcataccaccagcatttccctggcctcccaggtgcttcccgtgcttggccaggcctttactttctgtagatgatacaggtgtaatggaacaaatctcagcggtgggtgcgttaggagaggagaaggggcagtactttcgtgcccagaaaatcagcttcccttcatatgtcctccttgggctagcatgccaacagtctccaagcggactctaccttagcacacctacacactgcggtcctagtcttttgctttcttctccacatctctctccctcatccctcaatctctcccctattcccaaatgctgcagaacactcagaagtctcattttaagtaactccgaagtctttccatgacccctagcaatgttttacctaaataggcacttattgttttaaatagactttcctttttagagaagtcttagcttcactgcagaattgggcatagagttcccatatactagttacactgctctaaaaatcctgtgctctacctactcatcccaccccccaccgccctctgttcatcgatcattgatctttttaaacctgcctccagttttgacttttccagaatgtcatataattggaaccatacaatatgtaccctcttcagaggagcttgtatcactgagtaatatatatttaagtttagtgctgaataatattcccctgtccatctggatatatcagtttatccatccattaaaatactgaagatcatcctgggtgcttccaagttttgtcaattatgcatgaagttgctgtcaacatccatatgcaggtttttgggtagatgttcaggtttcagctcatttgggtaaacaccaagaagtgcaattgctaaaaagtatggtaagagtatgttcagtttaagaaactgcagtgtcttctgaagtgggtgtaccattttgtgttcccacaagcaatgagtgagagttcctattgctccatgtcctcaccagcatttggcggtgtcagtgctttggattttggctattctaatagatgtgtagtggtacttcattgtttttttaattgagacacctagttttaaaactactcttcacttttttctctgtgttttggggggggtcttgtgttttaaaattttgcagagcaaattatgagcaagtgatagtgttctttcattattaaacatgatttacagatatttcagactaactctctttttttccttttaaatatagataaatgcagagggaacaccagaggacgtttttcttcaactctgcacagctattgactctattttctgaaggcaaaaatgcatgtttgttagaatggaaacagaaaaacattaaaaagttcattccttaacacaatgtttcaagttaaaccttttgtgtcaccgcccccaccaaccaccacctcctaaatcctgacagcactgtttgcttcccagctagacctgtgtgagaggtgtctggaaatcatgcatggtgtatttgggactatatcaacctattctccacacttcagacaactgtctgcactcacggcacacacactttgtatcatgcaggccacactcagagctagtcagtacatgaacagtggtgcggtgccagtctgtgtccgttgtgatcacaggccttgctagaccctgatcatctggttctcctctcattaagcatccctaacccccagtcacaccttcctcttacatactgttccccaatggaggcccctggcataggggacagccctgggcatcttcctttggtgtctggctgttttgtcaactctcatccactggtggctcagagccataaggtgggttgattacacaatgccttgtacatgatatagaggcatcaagcaagtaaaatttgacagaaattttaaaatatgaagatgtatagctttcccaagatgatggtaaaacccaggttagtcatcagtaaccttctctattattattattttttagaaacttggaatactgtcgtcatggctaagagaacaaatctgataaattgtgtaacctagtctcttctctacatggtgatgcatttcagcaattataaattaatataaatgaccaaaagtaacttaaaagcatgagatatttgctatttcattcattgggcacatatcaaattataattttgattttaaatggtcacccatgtatttatttgttgccaagcaagtaaaaaaataccctaacaaacctgatgtgggtgggaggggcatgtcagtaagtggtgtgttcaatgtgtttgtttcatatgggccctttccaggagtttgcaaaccttgtcatacccatatgcaaaactgtgtttccttgcattaaaccagtgaagtttgggttctcttttgtgctatcaatcagttgtaaaatcagagctgcttatatattctactggaataactgcatcttccactcagtcactacaaaaaagcatagtttcagtttgcatgaatttttttttttttcttcaatggctgtgcagataaggatccatttctgggatagaattgtattttttaagtcatttttttttcttgaaatggatatgtacaaataaaataaatggaagacagg

SEQ ID NO: 127 - DNA, 144810 bp, Homo sapiens
tgctgctctccgcccgcgtccggctcgtggccccctacttcgggcaccatggacacctcccggctcggtgtgctcctgtccttgcctgtgctgctgcagctggcgaccgggggcagctctcccaggtctggtgtgttgctgaggggctgccccacacactgtcattgcgagcccgacggcaggatgttgctcagggtggactgctccgacctggggctctcggagctgccttccaacctcagcgtcttcacctcctacctgtaagtacttccccacgtcactccgggagagagactaagaggggaaggaaggttcgtccaaggcgaggctggaggctcctcggcgcccgcctgctcgtgggggaggggggcgagtttgtcaagggcatcctggccaggcctgttagggcccccagagaaatgcacgtgtctcggggagtagcgtgccggcactttctggacccgcagagaaatggcttcgagtgcaacccgggaaagcgctgctgcgccgcagcttcccagtccagcgctagaaacatcgcagggcgaattcctgcaaatgcaggcatttgcgtgcggagtggacatttgtgacccagagcctggtacccaaaggcaggctgccatctggtccccgccccaaccgcctctctgcgtctagtcgcattccacgaaaagatggtctgtagaaagtttccccaaaggagaaacaacttgcccagctccaaagggtttttagtctgcatcccttgcactgtgacgtgatgtaacctttttggggttttttcctcttttcctcccttccttcctcccttcttccttccttccctccctcctttctttttattttctttcttttttaacggcgtgattaaaatgtggcaaccacaaaccccgattagagctgccagaacgttatctttacctttggctgcccgcgccgccctttgaagtgcccgcggccgctgtgtaatctttaaccatctcttcccccggggaggaaaggggaagtgggctgaaggctgttgggctggtaaacagcggcaccgacacccaaagggagacctgaagctctctatcatccctgggggattctcccaccccttctctccccactgcaacttccaaagccctgaggcggcggctcattgcgtaattttttctgtggaaaacccaggcccgaaggtaacaggtagttgggtgaacgcggtgacccaggaggaaccctattctcggagaccaaggcgactactctctccacccccgtgcaaagcatctggggcttcattccttccagcagagaggccaggttctaggccactctgggaaacaggtgctccttaccacaaggtgaaacatttaggttttagatcaagacattgcagcgagcccaccccaagcccatgcagtcccagttttcggcttctctgatgtaccttggcaggagagagttgggatgtttgtgaaccagttcttccatctgtttagttgttttctggagggaagaaacatgaagaggcttgcacaacattttccactaggtagtgattctttttctggagacagagtgaggaagaaaaaaacatcttttacttgctttaatattgtctttaaagaaaggtaccattctgctagattttaggattggtagatggcaggtcgcctcctcctctaccataaagctattttgactgctttttcttttttacctgaaagaatgttaaaactgtttccccaccaggtttcccttcaattgcactcgtgcatgtggtagtgatatcgttccaggaatggaaatctctcctaaatgatcacgctctcagaattcacatttcctcctcctgaacagctatctctactacaaagcagaatactcatccccaaccactctagtttaactgctaaagtcagtgttgcaaggatcccgcgctctccaatgcagtgaatttctgagaccagtttggcaattttgcttggcagcctataactcctcttccccatcaccctgaagaagtttgactgtatgcaagggaggtgtgcagtacccccagacacttaacttactatttaaatcatacattcattataaaatatgtttaaggatacagaaaataagcttatgaatagttccagattgcttgcttctctcacttgaaagaacaaacatttgttaggcttccgttactaaaagttggcataaaattctgctttaaaccatttcccacatacctcaaatgcatttaactgtgtcctccatgtgctcaggggaacttactgccacctactgccaatgttccctatctatctatagatagaacaatctatctatctatattatagataacctcttgaagttaagatactattaggaaattaagtgccatattattctcatgtgatgacagcctgtaccctggcctaagaagacattttcccagtgccctgtgaaatattaaactcagagtatctgtaaaaagtgatacagtaaatgttaaatacttatttctaatgcaacacagttcagggaatatgagtgctgaatatagaagtcagtcctgaagtaaataagcaatgtggtgttctttataatgtgtgatttcataatttggtgtccctatatactaaaaaatgccagggcccatgggatgccctttgagcaggtattgagggtttgggggctttgttggtttcttacaaccagaggaacgctgtgcagacattaagggtagatgatgccctcttttggttacacctagtattctctgaccatttctgtcttcacttgtgcagccaaaacataaaagaggaattttgatttattcatattcaaataaatgagtatgtgttctactgattttcttatttgaaggaataacttccctttgatgttgaaagggaacacaaagttatagctccactccactggggcccagtagaaattaagccttgatgaaaaagttgcagtgtaccaagactgatgtggtaaaaagccagaactactatcttttattatttgtaagaggttatcatcatttatttagtcaaaatgttatcacccaatccccttcaaaaaaagaacaagcatttccttttcttcaaacagattgatgatggcaagttccagctgtacacatttggcaagtagctgtacacatttaccacaatctgagagctggctagtcagacttgtaggtaaagaaagtttcctacatctcttcacagaatgcaaacactatttatgtgccattttgtaatctttttttcccagaaaagcaaaattttaagccagtgcaaatattaatattgattctcttttcttactgagctgccttccacagtaggtctttaactggaccaataaaccgagtgaaaacgctggaaaaatctcagtcttcatctcttctctccccctgctgccccagcaagtggttatgggctctgattttactaacaggggctaataaagtttacttagcagaaaataaggaacgcaccaaggttgagatataaaagcagacaataatggtttacaacatttaataccagttgtgatctgtcctaaataaagtagttctaacatctaatcttagtataggtaagttattttaatgcatcaaatgtggacatttttattaatagggtcttaaaagtaaactcctctctgctactttgatgtgtctgtctagttagtgtgacattcagatagaaaactgaatcctaatgaagatcctaatataataaatatacttttctttattggtccagaacagctattttattttaaaaagaaaactgaatttttctttgctgttccttaaaggcattcacatttcatccacaagcaaatgtatgttatataaaccaaagggaccaagagaaaagatttttttttttaattatatgtagtttggttactttttcatatgtaactttgaaacaaaatttaattttacacataactcctaaaactaatgttaataagaatggaacaaaagccacaattagttaaatcaggcaccgccttaatatcataaatgtgttttaagtgtttaagatgcagtttcaagatgaaagatcctttttaggatcttctttgaaaatgagttaatatagttctgcttctcttatcttaaataaaagaaaatgtactttagaaatgattacaaaaatagtaactcttataacagccttaacatttagatcaattacaaacattatacagtttgctctaaaatgtacttttagaattgtttaaaatataatgatgccagtaaattttcttcattttaatgaagttctttctttttctccaggattcctggggattttttccatagtgtttttgttatagggtgaattattaaaactaactgataattagtctaagtaattttttaaagtagtgagctcattcaaacaattttgtggcataaatttaaaataaatatttactgaatatatttaacatatgcatggcagagttggtgtgacaagaatgaatttttacatataataaacatgatcttcagtttttttctttcttccttatgcattttcctcaaagtaaaggagttctgatgtagcaacaaaaggtagcaatcataaatgagttagaagatcggaatcaagaaatagcctgtgtagttaaacaacatcatgttttgataatagaccagtcacacttgggtgtgtttaaagaagtttagaaacacaaaactggtctatgatttctgagagttaagtattttatctgaactattttattgttttcagttttcaaaatatatatctatcaaaggcatagaaatttcagaccaaacaattaacccaataaagctatcaaaattaaagacattatagaatatttataattttataactgatacttaattttgacttaccttagcaaagcatttttttatatttcttctatcaaattcatggatttaagtcattttagctacaaatttaagtatgtttctgaatgatctaaatcacaggccataagacagaaatgaaaaacagtagtgggttgtccaatgagcaattttgtgaagtaatgtttttgtttggttcagttattatgcaaatttagaataaagctaaatggcacattttcttgtaaacacttcctcaatagatacttctggtaaactgaagtcttcatgagaagacaaattccttcctataagattcaaattcctcactccagttgcaatattttcctttatagagcctcattttgtagtagagagatgaatcagactggcactaaagccacaactggtatattacaaataaaacaaaatgagctgagtatctagtcctgttgctatttttgatgtatcttggtagaatttcacttgttaaatcggcccatgagttctagcccactgcaactctttcattcccagatctgtcagctttaatccacactttaatttaaccattgtaaataaccaactacatgcccaatttcacctatggaactctatgccaaaaggagacatttcatagtctataatgtggaatttttaattaaattctcataattcaaaactgattttgttatccataagttatatggtgggaagcaggtccgttcctaaaatctgtggcatttttctgtttaatggattaagcccaatgggaatgcctggcttgaaactggaacggagaaaaacgttagtcatttgatttcaagaaatggaataatgtatctagtggtaatgctaaaaggctcttaacaggatgttagcattagtggaaaactattcaaaagatgtttcataagcagaagtgcttccgtatatcctcatgtattacttctctttttaatgtttaagtctggaattggagacgctgagatttacttggagagtatgcaaaggaaccaactcctgaccgtgtaaacaacttcctgaaagtcagatggaataacaccctagggtttcatggtgggctctttccttcagggcttattcttcttctttggctgtgagctcctccagggtagggcattttccactttataccccaagtgcccataccaatgcctggctcttaagggagttcagtaaataccagtaatgttgaattgagtagaattggctgaaccagctgctgaaatcccagtggctaataggagtcagagaaagacaggtgagaactactagtccgcaagtacaaacaacacaaggccactggccacaattattgtccagccccatttgaaatacagctgaattgtgttcagtttaaatgatgcaatgagttgtttattttaacacatgccatgatttacatgtataaattactttattattgtaatagcaatagtcataataactgatagttgtattgtgtttcctaagtgttcggcactaaatacttcactcagtcataggccccacaaagatactaaatactttactcagtcaataccccccttgtggtggggcaacttgtgacgttaggaatgataatagtacctcttattaggtaagcttactgtaagcttatttcaagtatttccattgctcaaaatatttttggatttcctttgaagttatcttcagggccagtttacagcaacccaagaaaacaggctttccaatttatacttatgccttgtaatcattttaattggtgctgaaatgttttggcccatttttcttttcaggaacacaatttatgaagccctaataccagaaatattttttcagggaattccagagcaaaatgcagttttcaattttccaataatgtgagcattacattatatagtttagggccaatattacaaatttagtagacatctttttatatatccattttcttactaccacagaaacaatttttcttgtcttcaaatcagagataagttgcagtagctgccagagtattgtgaagagggatcaatagattagtaaccacctaggcaagaataaaacttttttcctataaccagatctatgtgtcaaattaagtagctgcattctttggaactatttctcagttcagacagacatgaactttcttaacaggcaaattctatttgagcttgtattcacctttaaaatggatgagatgcgatacattgttgtcacgaaggtatcagaatgttattcatttgattcacaatagaaaattgtttcaaagttttatcaaatcccccaacatatttttaaactttgcatgctttgacaattagtgatacagacttatgtgtcaattagaaatctgcataagtcatagaaaagtcccctccttcaaataatgaaaaaccttttctgaactatgcatttaatttcctcagtcccttgattcagcttattaacctgatatacattaatcatttattgtattacaaagtcaacagaaaaaacagtactgatgtttagaaaaattaggatatgtttggggtacagtctctagaatgttttaaaatagtactctcatactccagctttttactgacttaacaatttattcaacaatctctaattttcaaatgtcctattttttctatatgcacattttccacacactcattttatccttcttgccttcagaaggagtgtttgcttcttcttcaaacaaggactgtgatggccaagggggaagaaagtgtctcgtgcacactaatacacacaccaacaagaaacaattccctttgtgccacttgcttggcagaaatgatacaaacattggcagggcatagccgtgaagggccgaccctttacaagggagagactgtggaactggctgcttgaaggcaccttcagttcggttcagaaactgaaatgcagaagacaatcgtcctggcaaagggagcccaactccagctgagaacgcgtgcatggagctgacctccctcctcagcctgccaggcgaaattaagctttcctcaagtggtcccttgttagcctgtccttttttccgtgttgctcatctttcacaactagaagccaagtgtttcaaactgttcctcagtttgcagccaaattcctttatttcccccttcctcctcgtctccctcacacacacacaaacacacacacacacacacacacacacacaaactgtggtgactaaccttacatgcgtgccttcttttcaaagcctacactgagaaaataaccttagaatttttaagtttcactgaaacactggtaaatacttttgttctccttttttcttgaaaccttgattaagtggagcagagacctctacaaaagatgtcgatttgtaaaaataacctttctttaatcaaaaaagccacaaaagtgtacttctcaggaaagtagaaaaccacacatgatctcaagtggaaaaaatataaagaatttgctgaatttttaaccttagtacataacaaggatattattttaaagttggttggttaatgtgggctgtgttagaacttccaatgtgttgtgtttgggttgatgcaatgttattttaatgagtttattggttcgatgcacaaaacaccacatggtgcttgaaggttttaggttataaattttctcgtgaggcacttacttgaaggaactctgttacataatcaattggtctttaaatctatccgcacaaaatacaacctttcagttttttacatatatggttgttattatgtgattatgaaaaccaaataaaaatttccatagaagatgttatattccttaatgaactattttgtatatatattgaagttttcacaataaacatttatttcacagtatttgttgagtgaatctacaaagtgaatttggagtcttctagtaaagactgagaataaaggatcttcctctttattttgtctttgtacttcctgtcctgaagggacccttagcagacatgcctgcatttggcaataggcctactctatcattgttacagtgttaactgtacaatagagaaaagcctagaaaaagaatggcaagagaggtggaagggctaatggaagaaatttgcgacccaagggacagtgctgacggaactgagagactgtgagttactggactccactagacacctgttcccaggggatacgcttctcctgtgtctctctttgcctttctccatccctcgcttcaagatagtatcagagaactgaaaggatgccttttccttatctcagacacttttcccaccaagggcgtcaaactagaagatgaagggaagtttagaaaaaagagtccttgggatttaagtatcaactccagtcaccaaaattggggtctctgattttaatttggaaaagctacattactgttcctgtggtggaagatcttaactcatgcgcagcccctgttcttcagcagctgttgttctctgggactcagtgcaatatagtacaggaggaagttcaagatctttttttattgagtcttcaagcttgggtagcaaaaggaaatcctagttaaaccagattctcccaggatgtgagcatatctcatttgaagatcttaaaaggtctagcggcatgattaactgacagcaagtgtccaccttccacctcccagctgctggccttccaggaaaacatctacttccctagagtctgatagtcataagtgttaggtagatatgttctggtcctgaatgactactacatagtaatttgaagccctctttgccttagctgtatgaacatttcagaatataattagttgtatattacaaaggaaagcaaatttggggagatttatgttaattataataaacttaatttagagcttgagctaatacctaactacatttagagtaagttctgtgaagaactaaaaggacaatcttttatccacaaattaccagaatgactaagctgtatatctaaggtcacattacacaatgcaagactgaaatttaatcgtgattgctagagcattaccctaattgcccaaataaacagaattaaaatcacttagatgggttacaaaggatttcagtgcatcaaaagctatggctacccagggaatttagaatgggaagaaccttggaatttacctaatccaacgtctttatttcatagatgatgaaattttatattcataaggggttaatgacattctgaaaatcacgcagctagcaaagacagaattggactccagatctcctgaaaaccccagcccagtactacttcttggtcacctttatatttcaatgtcaaatactcgaatgaactcaaaaactcccagttacttttccagatgttgccaaatagcccgttgtttacacatgttgtgtatgtccatatctagatatatacctgaattttaacaatatcatcttattttgatccactgtaaatacagacacagtgtctctgtattacctaaaaatctgcagagcaaaaaggaacactcagatttagtttgaagaataattaagcataattaattccccaaatgtctgttcatagttgtcatttacttcttttttctttttttggtaaaaatgggagtatggctatgttgcccaggctggtctcgaactcctggcctcaagtaattatccacctcagccttccaaagtgctgggattataggcagtagccaccaggcccagcctctgttcatagtagttaaatatgtgattattgtaattaaaatttcatttatgactttatttgatcacattttggttgccttaatgtctcttctaactgttctctttctcttctagcagtgacattgcactagtccagggtctactcacttttttcctggatgactgtagcagtttcctgtcatggtctacgtagacctcgaacacatacgcacacactccctactatcctgctactctcttcaagatgcacctctggtcatgtcttacctatattcaatccttcaatggtgtcctgtgatttcataataactttgaacacctcagtttagcccacaaagccaactttttttacctcatccctaacctgcaacccctgctgccaatcccccctccctagctccctgttaaaagaaaaaccttaggcaaattaaacttaacagagtttaattgagcaaagaacaaattgggcagcccccaaaccagaataggttcagagagattctggcaatgccatgtggtttgaagatttatggacagaagagggaaagtgaagaacagtgaatggaagtggggtgcagatcagatgggttgattacagcttgatgtttgccttatttgaacagagtttgaatagttagccatctttgattggacaaaactcgatgcttgggacaagaggaggttacagtctcttttcacatccagttaggttgcagcttacaatgtatggaggaacttttaggccaaacttagaatatgtagagatagctttagtctgaatttaacaccccaagctctcttctctccagccatttcaaactgcatcttacaatttccctatttcatgcctccaggtgttcacatgtgttgccatctgctgggattgcctttcttcttttgctaacctctatgagtctttccatactcagctcaaatgtcacctcctctgggaagctttctgtaaccccacattttagaaacctgtctttgatgctcccacatcatgctgaacccactttgatcatagtgctcaccacacttgatcaccatatttcatctacttgtccgtttctactactggactatataccccttgaaaattggatcagaacacagaattcttgtatattgaccatgtttttcattttctctattttatggtgctttgacatcttggagccttgctgctcctagagagactgcccctcctagggctagggaattcctggagatagcaaatgattttcttgggagtgcacctttcatatgcaaaccaaccaatccaaaacccacaaccccacaaccactccctttcccaggctctttcagggctcttgactctaggtcaatattctcctgttctactcaccccaagctcagatttcaataaattgggatagcccctacatcccacagcacactgaaactattcaactagccaatcctaaacctgcttaccctgccttgtccattccttcccgtggaaaccacaataaaggaccttgcccatgcttttcttctgctccttctgtctccagactgagcccagagctttcctgtgtggctctgcatggaatggtgggccctctcctcttgggaactgtgagtaacaaactccctgtttaatggcagtcacctcctgatctgttggcctcatcacacctgaataatattaacacctacattttaaaacaccctgtgtccatgcatgtctgcatctgggcaacttcaaaagggcacatagcccaggcagacttgaaggacagtcagcacagttttctctctggagggcactcttctgttcccctaaactctacgtaaaactcaaactttgtccacatacctaagacataagatgccattttctagctacaaaatgtgcaacggagtgagactacttgatataatttctgatataatcttataatgtgatgacagagagattctttcctctaaatttggcagactgattgtttggaatatcccaagacagaaggaaaaaaattcaaaaagtgctgttgatgcttttacacgtagttcctcatttgaccctcctaacaaacagtaaaatagttgttactatcaacatgagaacatctcttgatgttagaaatgagaacatttcttgatgactatttcagccttatcttcagtgaccttgacaagttactcaatgcctcagttttctcatatgtaagatggcaataataatgacatctacctgactaagttgttgtgaagactggtgagataatgcacataaagcactttgcatggcaccttacttgtgtaggatgcattaaatgttaggtgtaattatttctgttgatgatggtgcagttattatcacactaaactcatgcttttcaagtatgccatgttgtctgttactgttattccctaaattagctaaattaattgccctgaatgtttaaaagtataagtgtaattttcattaaacaagatttcttaatgttaaaaacaagaaaagaacgaaaagaacagcagaaaggcacctactaggtaaagaactagaggagaaagaaggggcatcttcaaatgaatttggcatcacccaacaactgttataaataaaaatattctaacttttgtttctgatccttggtatcaaatagacaaaagattatgagttttaaatgaggtttcatatttgcacatgagtatgtagcattttgaagacactgcacaaatctccaggatagctgagggctgagtgaacactttgtcacagagagtaggctgatggcacaatgttaggagtctactcctcagatagaatttaatgaatgacccagaatttgtagtcctgggtttgaattgcttttatcctttcctttttttttttttttttaatctcatccaccctcatgactttttctgactgtgaaagaaaaattcaggttgatagcttcttgtgctcttagaagcaccagtatcagccgttgatttgctacagtggcaggcaagagatgatggatttcaggggactgagagaaggtcgggaattcaaccttccttcagagccaaaaatacattcaggaaaacccaagatttcaacacaacaaaaatgtgtttcttttttttttttatattaactgaaaaaatagttctactttaagaacaaaaactgatttaaagaatgggcttgtgtctacctgaaaatacatccaaaataatctaattttcatgaggcacctcagtactcatctttgataagaagcagttggttcaacataattgcaggaaggatctttcagtcagtgatggcgatgaggctaatatcattccctgagaatagtaggtatcaatgatgtgactctgtgtaggagaggggattcaaagttaaatagggggtcaaagtaccacttggacttgtgtttcaagcaggaagcctctggaattaggtccagtgatccacaggggagaagagagctaggtgagcagttcttggagcagacagtcttttaatcctattggatgagcctgtattattgtctctgcagatgttctgtacccttctgcaaaagaggcaagctggcttttcccataactgatgaaatcaagagagcaggtctggaaaaaacaagggaaatctccttatatcttactacgtgtaaaaagatgattctggaattcccgagtgcctactgaattaataaaccaggaagctgatttattttaccactctaaatccaacatggaagaaaccgtcagacatctactacatgtcatccagcagtacagattggagaagtaaactctgtcagcccacctttatcaaacagtgtaaataatcaccaaaccaagggaagcagaaggcagcaaaagtcgaataatttccaatgaagagtcagaggatctctctcagacaaagggaaatccttcaagtggagaggagatggtaggaggaaagtggcagcccagaggagatgagactgtggcaaattagaaagaaataaaacaatacccaaaggaactcaaaggagaggtgaagttcaagtcagggagaagagtaagtcaagaggactacctgccaagcatagcacagagcttggttactggctccactgtggagctggctcaccccatgggtagagtacaatccttcgagatccacaaggcacacacacacgtgcatagacacaaacacacacacacacacacacacacaaaccccacggccacatctctgcatatacacaaaagaacaagaaaaaaaaaacactcattgtggaaataccctcaaaatctcaaaatatatacctaacctataggataaagcaaccggaatactcctgggaactgggaaatgattatcactacggtgcaggggaaaaaaagcaaacaaaaaacaaaaccaaaaaaatgcaggagactagtacactagattagaagtccaggtctgtagttcttaaacttgccaacacattagttccaactgggagctaatttaactatcttaaagtccagatcccacatcaaaccaactaaatcacaatttctgagggaaggagctaggcatcagaatgtatttaaactccccaaggcaaattcaatatgcgaccgagtttgagaaccactgatctgggcccagctaccccactaatcagccacagaatctctggcaagatgcatatcctccctgcctcaatttttgtatctgtaaaataagagaggtaaatacatgttctgaagtctctcctaattcagtcattctaggagtctaccagcttgacattgtgtgtattgcaatagggcaggtgtagcaggattgtagaaaatgggaggtttccacacacccacacccactcccattttgggcaacaaatctggaaacattgtttactctcctgccttgagcattatttaaaatgactttatttgttttacagtttacagagcctctgtaggtagcctcaggagcccattcatttcattaacattaaatcaacaagcagaccttctttctgcctctctctagcaggattaatggattttggcatgatttgtgcacctagcagcaaaacctcgtgctgagaaagctagcaggcttgactaattcccagtagtgctaacttcataaacttactttaagcttttaactttgactaaagattaaaggtaatgactgcacgctgttgtttggatgtatgatactcaatatacacaaaaaattatacaaaaatgacaaactatttgataaattaacattgtatatatatgtgcatatagatatggtttttatgcttatgaaaatactcaattctgtatatataaaaagatcctctaaaacactgagagatttatgtaataaataaccatagtaaatagagtattgacaaatgtatttgtaaattgtaagcataaaaatttatggttagaatattataatatactgatagaagacccagtttcacatgatggaacattgactatgagaaattttctaagaagcaaaatttttctactctatgagaccagttatcacctataaagcattcccacacatgactatgcttatacttttttattccagtcttacattaaattcaaatttagataagtccacataaagacgggggagaaaaggaaaaaatacaatatttccagcccatctgacaagactacataaaaagcttttgatcaaagggtcttaagtacactttactggtgtgacaaacaacatttttatccctttattagatttatttttcttctgaaaactgcagtgaccagggtatggtttgtgaaagaaagctggcagggttgtgttctttgattcctaattaacaccttcagtctcaaaagagaaccaacagaaataccataaaatgttgcagctgcattgtgattccgcttggttggtttgttaaaagtcggctgggcattggcagctgcaataaagggaaagctcaatggatgttttgtattgtgcccactgaagtgaaagaaggcaaccattttatttttcaaatgggcagctgcagagggaggtttaaatggagctaaatgcaagatttactgttaatttatagtaaataaataaagaaaataaaacctagctttccagtttttacagtcacagaacagacattttagctagaaattattaaggacaatcatttcagagctttttagcaaccaatttggggaattcggcaacaaggaatagcattcatttaaaatcaaaataggctttttgaaagagctgagcaagccaaagctttagaagctgacatttccactttgaaaggtaaagatatatctttcctgtcttgggtaacgtaactccctcgtcccactttattgaaaccctaaaatttgttcagatggaaactgaataagattccatacacccccatctcactttttttttaagaccatggagttgaattttgcctatggtaggggaataaaggaggcatttaactttggtcagataaatctcactcacattcaaaaatgcaattaaggaaatatgtaaatctagatgtttcatcaaatgctagctaaggggttactagttcttttcgaacacaatgactgaactaaagaactttagtgtctgtgtaagaaccattgtccaagccgcagtccctgttggaaacagagtccggcctggccgtgggaaatacctacatatttgacacagaccctatttctgagagaaaggggatggaagagaaagtatggagattttactgttgcattctaatcaaccatgatctgcctaatttgctttgatcaggaagataaactaatttttctatgggctggttaaaagtaattagcaagccaaagctttcatgttatttcaaaagagctaaagtaaaggggatcagaaattgtaatgctgggagctaaatacatcttttctgctcatctaagagcactgttcattcaaaataggatactgacacagaagagaaactccagctaaagatagtttcatgggctgcataaccattgtaaatccagggatttacatagttagtgctatgtaactaaacaaggttaccaaaggtgacttataattggtgtctgtgtcatatagtcctgctgttttgtgggaacacctttaccttcatgtaaaaaggtgcaattattgtctggtcctaaagcattgttggtttttccctgaagctcagcctttcacatgtgagttgttggaggcagttgcctgtgtttatttgaaccccaagctgttgctgcttctctcatgtacacagacccagccagcttgggatcctacaatcctggacatactagaatgggatctaagatcaaattgaaaaagttagtcaggaacctgacgccacagatgcttcaatttcacagcctggttcatggtttttgtgccagttaccaacttcagtagtgccgcctcctcctttcttgtttttttctaagctcccaaacacatgtagtcattagatgagaaggaaagattttgaaatacgggattttgtttcttaaaaaaaatctactatttagtgttactttttttcttgttgatatgacctttgcattacttcccttttcaaactgttgtagtagatatggtatctgtaaccctactgtaaacttaattgcttttttggctactaatctcctgcgctagggttcttagataccaaagtgtgtatttcaagtcagatttaatgttccttataaaatgagaagatcttttaaaagggcctctgtgaggttggagctcaacaagcttcaaggttatagagaaattattactgtggaataattataaaggaaactagagaatatttaaagaccaatattctaccttacatttaaaattacttaaaataattggatttagttttctgatttttttctactattttttggaaagctgcagtcaacaaacattttaactcttctttcattgttttaaaagtccttaagcagtgttttaaaatgtaagtctgtttgtactttcttgctagtttttataaagtctagaaaagatggcgactattatgagtaagaagtcaatctatgactgtggaagagatctttcatagtgtcagcttcgtgttcctgcaaatttattcgttcatttatccgtttattcacacaattaatatttttatcaactgcccaccttgtgctagatgctgagggtatagcagtttacaagatgtacacaatccttgcctttgtatggcagcagaaattttttaaatgcatatttaaatgtaaattattaagatgaaagagctctgatggcaaacaggagtgcactaaaagagaacctgcctggtcttggtggtcagggaacacttcccttgggaaacgacatttaatctgaaacttggaggatgagttagagttagccaaggaaaggagagggaaggagtattctagactttcccatttaagtctgagcagtggctgaattctcctctgtgctttctgtacttctaatatatagcatgacctagtaagaccagtatgtaccttatacaaaaggaggccttaatgcagtccctaagaggcagaatcctcctgtgagatctgacctataattactaggagccctctcataaggcaaagcactctgcagttgtgttctgatttcataaatgtaccttctgccttactggcttatagttttactgggcatatctcattcattttcaattcttctgaaatacaattatgaattcatttatttgcacccctaataataacataaggagaaggtagcaatcatggcatatgagcctgtacatttttcctgcatttgatggggaagccagaagctgagggccaggtacatacgctgagccccactccccactggaagtagaaagcatgagtcccctctattcttctcacattcatggtaaactctcccaatttttgttcacaagggggagctggccaaacctaagtttattaattcaactattcaactgatatttgttcctcacctactatcaggccagttctagaccaggcccaagaaacaaagatgaattaaggaacagcctctgctccctggagttcacaatttaattgaggaagacaggcaagaaaacaaaagtagtgtagtggttaagagccttcctctgggataatcacttggtattggaatcctggtactgccccttatttgcttggacaaattatttgtactgataatttagaataattattactcctataaattataataatttataattattgatattgttataaataattattactcctctggggcttccatttttctcatctgtgaaatagaatgtttgggctagagctgtttccaaggtttatctgcagaccacttagaacagtgcctggcaggtagtaaagacaaggtaaggttagctattattactaacagaggttggtataatgtcctgtggaagcagagagaagaaaatcattcactccacttggagttgaaaatacttcacagagagggtcatgtttgccctgctcttgaagaatggggaggttttcacctagagggatggggcataccctctagaagtcaggacccacatcagtgcaggcacaagagtgtgaaagcatgtggaaggaaattttcagattggctgaacatgagacaacagtgactggaaatgaaaaaatgatgaagagagaaatacaaaaaggatcctaagagtcacaaggactcatgggaagacactaaaagtttagtgtggagaagttggctaaacttacttctcagttccaatcatgacttctgcctgccaaataaagcgtaaggtccttcttcaagttttccttcacagcacatcaagcttctgagtctcagggttttcatctcactctgttattgattaactatatgactggcaggtaccatttaactcttactgatctgttttgtcttctactatctgttatatcttctgctaaatgataattcatccggtgctcattttagtgaatgcatccccctggcttaactttatatacagtaagggatgcttaacttgcaaattaatgccatgtttaacccacagacattacgtgtccctgaaccggtggaaaagtggaggcagaatcagactgggattcctctataacttgtttattttctcaggaatcatccagccccattcttcctcctctcctacatagtgacttccatttcatcccgccttacacagcgcctccatttcctattgtaaaacagggctagttttcttacttctccacatctttgctcaacccttcccctgcaaaataagtgaatgaatgaatggtttctgcatagcactctcaactaggctgttatcttgaaactcaatcccacccacttcaaaaggctttcagaaatcattgctctgctgagaacagaaccatgacagatcttcccaggaattgttccttatccactctccttgccacagcatccacatttggaggttataatctgtcttgcaccttttctggtagtaagcacagcagccagaaaccacagtttagccttatctagatctccaggcttctgatgacctatgtgtctgccctgcccccttccctcatatctcagaagggacatgtttgccccttttccaaagttatcatgcatctatgatctgtcattccattcccttttatctcctgggaatgatagtttattcattcagcaaatttttattgagaatgagttatgtaaggtgctatggaggacacaaatgaaaatatcagttaattatcttccagacatatgaaatctaaaatgtcagtatcattccatactgtattaaatttgctaacttggcattttacttgataaagggatttccatttgaagatatcaccatagcatcctctatttccgccttttagtctatttattatcatgctccccactagcatagcacttggcacatctaagtgttatatacatattttctattgggggaatgatagattcctcacttcaaaaagcaaagggtctttcctgtgctcttcaatttcctcaaactgtttccattctgtctccttcccctctctaccaacattcttgaaagagaaggccatattcattgccaccatttcattaccacccagtcactctttcatcccttttgaaatcagcctgccacctccaccattcaacttaaatcactctgtcttaaatgccaccaatgacctcctactgtctagtccaaatggccttttcttagtcctcaatcatcctggaccactctccagcattgcactctgatgaccatccccttgtcccatctgaagtggggtaaatactccaagaatccagccttaaatgcacaggttttgtaatctgccgggtgtgaatttggccatggtccaaagctcagtttcattatctgtaaaatgggttaatagaccctgttatctgtgcttgacacatgcctgctcagcctcctaatgggtctccttatctccctctcatctcatgcatgtgccactgccaaatcagtctttctaaattgaatgctgatcgtgtcacttccctgctcagaaagctccagcaacacccagggatgggaaaactccaaatccatagtcctgcatgcaagatctctacaatcacctcaagtcatacccagctgtgctccaacagcaggactcatgcaggactgagagtctggagagagtttcctctgtcaactaggcctctgaatggctgtcatttaatatctccttatctagtgtcttcattagcagattgaaatcctaggttaatttaaagctaaagctcctcctagctataaaatgctaagatttgacctttctggccttatttttccatattctcttttcaacttttctattcaggaaaattggactgggatccatttttctaacctatttctgctttcctccccctgtctttgctctcaccagtttctcccatgggcaaaagtccttcctgcaagctcttctcaactacagtctcctcatcaatggctgggagtaatcgtctcacccaatagatgccagtcatcttttatggtgcattcatgccaggcaagtctcatttggaccactgcaattttctcctcactcttcccattgcccctctggtggaagctttgcactctgactaattccgtcttcctcttgccagttttggctgtgccacacctcacttaaggacccatcatgctgcaacattgtccagtgcttcaaatccaacatctttatccaagacttcaaaacacttcattaatacatcccagataatcttagttctctcatctgcccactgctcttcagggaaaactcacaccaaagtagtcatatcatatatggatagggcattaaggggcttgaatttttaatattaattgtgtcgctaactagacaaatgcccttacaagttagtataaaaacttcaactgtgattgtattttattaaaaatttagtattatggttttagcacatttagtcactttacaatagataaagtaaaattatataaatatttgagtgcatttatactccagcccagtagtttataactggggcaaaaatcagaatcattcatggggatttttttaaagttcacattcctgggtaccacctccagaaaaacctgagcatctgttcttgaacattgacacaggtgattaagactgctggcttgcacaactcaaggaattgtgcagtgcacagctccacagctttaggaagtggcccaaagtagactcagactgtatattctcttagcttcagtcgagaggtttacttaggctttagcattagaaacatttgggttgagatcttagctttgtcacttacttgatgtgtgactttgaacaaattactaagtctctctaaacctcagtgtccacatctataaaatgtgacagtgatagtactcactgtagaggataaaatgagactggttctacaaagtactcagtacagcacctagcagatagcaaacaatcagtaaatgtcaaccattatgatgacaatgatgattatttaagtccgtctctccaaatccctacttgactaagtagctttgagaccaatttacgatagtactacagaaaatattaacacaaggtaattgatcattctactgtatacttgtaaagattagtatctctgcaacaaacagctctcttgcctttattatttatctacaggttattggcatatattttagcatatataaattataatatacatatatgtatacatatatatgtgtgtgtatatatataatctctagtacatcaaatgaccatgtaaaaggtcttgatcctgcctgacttttaaaccaaaagtttaaaaggaggcctttgtcagtataggcaaaaaaagcactgtctcagaggttagctgataactctttgaagtgctaatttttggccaaaggaatatagaaacctctgcaaaaatatgttattgtagggtggacttaaatgtcagtttataaaagattctttaaatcatgtatgttgtattccttcacaatacttgcaaatgtaattaaataatcacttgtattattatcagcttaatgtttatttccatgaaaaatatctcaaaggaagactctaaagagacaggaactatatctgtcttgttcactgttgaatcccttgagcttaataccatgcctaccacataataagtgccaagtaatatttgttgaataagaggaagaaaggaggataggagggagggagggatgaatctttgtatgtccacatatttatcacagacccaggagccgtgcccagaatcaactttgaactacaagtgaaatatacaatctggttaggggtatctgacatattcagaagtacatgacatgaaatacacttaataagtgttttaggaaaatgatgactttccggaagggttaaacacaaatagaggagacacagggccacaggctgatctagaagatggattgaaagagacaaaaaaatgaactgagttaagaaaaatcagaattatatcacataagctacaattatggccctagagtagacagaagggaaataatcgtaagtctatattaaggagagtttcaaccggctacaggatacatctgttgtttgaataaatacattcaatatcataattgctttgattttaatagtgatatttaatttaaaatgtctttgaacattcaaagttggcatgagatttttatgttcagaaaacaggggtgtaggttaaaaaagttttcctgggaagcagacttggggttagagatttgagtaaagaatatcctggggtgtaccttcaggatcaaacctgcagagagatggaggactgaagaaggcaggattgggcagagggagaagttaaactgagatgaggtcataagatcctctgctaatactacagggagctctggcatggagtggcccttcagaaatgtcccttcataccttcagaccgaccagttattggaggcaggcgtccccctccctagtgcctcctcgaagtatgaccttgggcaaggagcctctctttaatcgttcaccaaggcagctcagctggagctccagctgcacgaatgagagattcaatcctgaagcagaggtaactgggcagcataccctaacatctcctaaaactggtctgaaatgatttagttgggaagaaggagtaaacaggtaagactgccattgttcttaggagaatcatgaaagtggactcaccacagtaaggcggtgctactctgaaaatggccaaccctcagtaggatccttaaattatttcgactttttcttttccattttcctgctcttctgtttcaaaggctcctttaactttctagttagttcctttcctgtctttatcatatgtgcgtgcatttctactgttccaaagaatgtttatgatccttggcttttctccccctgtgctttaaacaaaactcagtttcctagtactaggattcctcagggaattacagaacagcctcagaatactaccatgctagctcaactccatctcccatccagctgcataaacttcctttcttcctgcatttatagtttccatgtccatcaggtaaacgcctgctatttaacacctggcagaaggatgtttttcagtttcctctattagaaacttacctcaggattcctttttcaggtaacataaactgattaactggaaatgagaaaataagcagtgtctggtaatccaaagcacagaaattatcaaatggccacttcctaaccactcagaaaagtctaaataaaactaattcagtgaaacaacagcagccactgtattttgttggtcttcaactgtgaactcttaaaaggcagcaactgcacctcttccatactcctttccattgcacaatgtctagcacactgttagaactcaatagaatgagataattttttatccagcactgcacctgggaagactggcaaagtgccaccaactagatggctggtgtacttcagtgattcctgtgcctttatgtagacatagaaagtcatgaattacaccatctagacaaactgctatgaggattatccattgaataggacagtttttttgtttgtatttttagaataaggacaaaatatactagcataatccttctttctgaatcaagagtcaaatcgaaggagcaaggaggattatgaaattatgttacttctgtatcatcaactctgaaagggcttaacattccatcatttcattttagcaaagattttattttattaaatggagttcaaacatttaaggtgctcttactaaactgatagttctttaggattccttgcttggtaaaatattagatggtgtaaagttgtgagaatatcatgtaaagaagtcaccttgcattgacttctttaaattgaatgggaagaagatgaagaaatgaaaagtaaatgtagcagattaaataaaaaattcacttatttgggggataaaaagaatgttctgcatccatgattcttcacgatcatactattttgcagttagattccctgccaaaaaaaattgatcctataatacatgtgataataatttcctctgtcttccatgtttttttttttatgagtagtaggtaaggaagagctggaaaattataaagaattgaaaacttaaaaggttttctttggtatctaaggtctggttgtcattttcaggttttctaaatttaagaaaactgaggagataggaacataacgatggctcttttgggagctattgattttgtgaaattggtaacacgtcctccttggaaataggcagaatgcatctgactttaaagttgtagtgaatcttcagtgataatgagagttaccaagaagttatgtaaggtagggtatgaatgcttggaggatgaggaaggcaaaaaggcaaataatgtggaccaggttttttttttttaacaaaaatagtcatcatttataatctgccagacttcccatatgttaacttatttaatcctgacatcaaaccggtggggtttgtttctattccataaataaagaaatcagagaagttaaggaattttccaaggtcacaaaaccaataaatagtggagtgaggggatttgaaaagagatctgtctgattccaaagcctgtactttccccaggactctaagagaatttcagctatgatggccattctaatttgcttccagaaggctggagttttaaagttactttaaaaggtagtgaagataattgtacatttgagagagacttgttcaagatttcactgatgagaaagtgcctgtggaggggatttggcctgaagaactggggacataataaataccaggaacccagtactgaagatagtaggcactccctctttgctgtcatttttaacatctgcatcaggaatggctggttgtcatttcctctgtttctgattatcactatctttcttggggaaatcaaagttgtttcatttgtctgtttgtttgtttgccaggtagtgtttgctaaggaaagtattagctacatgtaacttcagtaataattagtaatatcaaaaaatatcttagaatgatggtagagatcaaaactaatattttcagtggacaaacaatgccgatttggcaggttgcatgcaacagtaattttagttgccataattctgaatattctgcctagaaagtacttgttcttttcatgtcatttccataggaatgctgtaagttctagagatgggtgtattttaacctcatgaaaatccaaagtattttattgtttaaacttgcaaagcacattccatctaagaatttcacagagccttatctgattccttattaattctcacaaagttgagagaaatgcttttaaaaatattacataggctaaggaacattatgtcatattaatgtgggataagcagattgattttcactaaacattgtgagagtttaaaagggtaattgaatatttttaatgctttagccttcatctatttaatttgtttctatatttattttgatggccagaagctgtgctgtaaatgacaaactggtaggcaagacagtacccagacaggtacatgtagttttagcaagactactgggacatttggaaaaataaaataaaatgttgtctgtttttaaaggcaacagttgtaaagttgtcagtctgagtctcctatttgcactgattgcacttgataaaaaataacaagctgtgacaaatagaagggcaaagtttcagtaattcactaaagaatgtctctacccaaagctttgtggcaaaaaaatgtcttgtttgaggcacaattgcagagttgaaataacagcccatgaataccctggagaaatgactatgtacccaaggtgaatgctaaagccttccctcttgaatgagccttttaatcaaggcattatctaggctctgaaaaagtcttcagtggtcctacctaaagattaatgggaaaagccgaaactctgagttggcctatttgcagaaacaattttaaagatttactgatggttgacaaatgccatttaagctttcaaagccagccatatgcttttgaaaaggatttaaaggaaatcctcccactacagaagacaactttgaaggatctctgtggtagcctcttttttttttttttttttttttttggtgcgtggacatgttgagttttctctttccttccttttttcccacatctttgctaaattcctaaaacgtggggctcagaaaaggaataatatatttctgtattcagaaggtactcataattttgtttgtcagtgagaattagataaactcttgccaaacaattgtgtatgttgagaatatctttctcaattacctttgtattaatataagagctgtaaatagccccccaaatattaaaagtgtaatgtcacattgttcgaaaagagaattgatgctttctaaatgtgtttagattttgttcaatttttgtattttcgtttagtttaaatttatgtttagttttaatgtggagattattttctacttccagaatgactatgggcaccattttccttctacattcattctctgagcattttgccattggtttttggccaggtgaatttattcagcctgaaaagtaaccgacttccaaagagattatatttaaaacatttcttcatagggtaaaaatctgaatgcaattttaaaatattacccagtcataatgtggattagaattgcctcacttcacactttgtcattgccttcttctactaacttcagtggaatctcgaggtgatttcataaacagggcaaactcctggcgtcctctggcctgatcctggaggctgagatgagtcactgtgtgctgggcgggcctgtcactccaattgcctgcctccgcgtgggcgctgggagtgggaatcagtgcggttcaggagcagcacgctctggccttgtttgcccatttccctgggccgctgacagtgatctgacagaaagcgacactgacacaaagaagccaagaggggcaggagatgggggtgaggtcaaagcggagaaactgagaaaatccagtgaagtggaagctgaaaggataaacgcatgaaggcttagagccgcttctcggcccacttcagtcggccacacctcccccaaaccctggaagaaatgcccccacttaactgccttggtaacaattaaaggcccagtgccatgaaggaaggaagggtttttacagaagtgccttaaatcccactgcctccccgccgccccacccgccaacacctagaaagtcttgtagtgagtttcctgctctttcttttaaaagcaggaacctaatgaaggctcacctctaggcagagtaccatcgcacaacacacattccagtgtgcagggccctttcttgtcctcccttctcacctggattattgaagtgacccgctgtgggctgactgtcctctaattcattcccaggccaccaccagggagacatttctacctctgctaaaaaaccttcagtgcctcctgggggtatccataccaccagcagtatccaaagtgatcttagttgatactgggtcatgaaatctaaaacatcttatcacctaaagggaaagttgctcccttttcaatttcccttcagcccttctggcttcatcaatgagaaagtcttagccagggttagtttgtcttccacacctctgttgctctcactaaactccctttttatcaaagggagaacaggcttcaggctcagtttgacttggcagcagctaactaggaatataactagaatttattaacattgtttggttttcattgtatgtactttaacagtttccttccatgtatgacagatgatactggttttctatttacaggtaatgatggatcttttccacttttatttaacttccctaggtaatttgagtccaataatatatatccataggtctatagatatgtctacatacacacatatatgtctttatgtatgtagatgtgtgtatacacatacgtaacacaaatgtgtatagaatcatatttaagttactgtccttatagcaaaataatgagtttgggaaacactagagtatgagataaaatccaaacgcagcctataaatcttgctataatcttactcccaccccatctctaggcaggctcaactttctgcactgcctcatggacaccttacaacaaaccatctctgacagaacatgtgctgtccctgcacgtgaggccaagattgtcttcctcactctactctacctagatgatccctcttcatccctagattaggcactaggccacccctcaatggagcttttctgccccatcttacccatgttccccttgtctgaagtatgctcccctccaatgagctcccgcagcatcttggttacatctttattagagcacttaccaaattcataactatttgtttgtctcccctccccatgaggacaggaatgttgttcagatccctgacacacctatctggtgtacagtatttgttcagtaaatgtttaatgaattaacaaattctttttatcaggaaggcaaattatcagagctacctaataatcaaaactttttaataataatatagtaaatgattaataaataatgaagtcaaccataatgggtaagaataagggctctatcaaaatgtggaaataacccaaatgtccaccaactgatgaatggataaatacagtgtggtatatctacacaatggaaaattattcagcaattaaaagaaattaagtactgatacatgatacaatatgaatgagccttgtgtgtgagtctgtttgtacaaaatgtccagaataggcaaatctattctgacagaactagagacagaaggcagattatgttgcttacagctgaggagtaggaggatgttggactggttagtgactgctaatggacatgggatttctgggtgatgaaaatgtctgaagttagattttggtaatggttggagaactatgtggatatactaaaaatcactgaattgtaatactttaggtgagttgtatggtatatgaattatagctcaataaagctgttttgtttttttttttttaagagtgagggctctaagaaaatttgttttgaatcctccgcaacttaccagctagtgatcatgggcaggatatttagcttctctgtgactcagtttccttcctataaaacaggagtaataacagcccccaccacaaaggatcattatggagactgaataggccaagcacagtgcctgtgacataatagcactcaataaatattagctatcattattactaaaagagtatgtagtatattctgaatcatgagggaaaaaaacaacatattctaacatacttgtaatagtctttgtgtcttagtgacatgccttcagaatgataaaataaactttggggactcagggaaaagggtagaagggcggtgagggataaaagacgacacattgggtacagtgttcactgcttgggtaatgggtgcaccaaaatctcagaaatcatcactaaagaatttattcatgtaaccacacaccacctgttcctcaaaaacctagtgaaatttttttaaacatagtgatgtgcctgcagcatatataacattcttagttaataagaatactttttacttactcatatactaattttatataccatgtacaattcatgacaaaatgcatgcatatacatacattataatgccatttaaaccttagaatagccctatgagataactattattatccccattttataaacaaggaaactgatgcaaaaggtaacttgctcaagtttccatgcctcatacatggcagaacagaagccgtctgacctccaggtcagtgttctttccaggacaccaggctctccccggagcaagtatgcccacagatacatacccagtaaacagggaaatcactccaagggagagctgccccaatagatataataggtttcacaaagctgtccttattcaaacatatctcccacatcaaacaaccacaacatgtcctcctatcttgtgtgagattttacaagaagaaatattcttttgaaatggaaaataggcaaagcctttgtttcaagaatgttgttaaacaaacataacctgagaaaggatagggctgggggatccataccacaagggtgtgatccttgtctctcaacactggcattgtaacactattaagaatactggctaaacaagagcttctaacatctgacttccatcactctagtcagtagcaaaatatgtgttacacatggcatatgaattccacagcacacgttgattgtataaagcacattctatgatcaaaaaggacaatgcaaacctaatcctaagtggatagtagaattcacttggaatatctgggagcaacctttatggctttaggttaaattctctctccccaagagtgagtattcaatgaatagagtgatagaagcttcagtgcacatatactatgctatcaataattcatatatgaacataatcgattttagtatttaattattgctaaatctccaccctcaaagagattacaatctagtctgaaagattttaacggtggccatgtcttacaggatcttacattcccagcacatcatggatctggcacacagaagattctaacaatcaacattcatagaaatgttggttgagtgaataaataagtgaatgaattatgatttgggaggaaattgtgtagtaggtttataaattatcatcttttcaacacttaaaaaaatattcattattaatttgttgaatgatgaatggcaggactttaaatgaattaatgtgacaagctgagttttcagaaagaaactgaaaaatgaatggcattttggttaatttccactgccctgtctgttttattcatttaaaaaaaattttaagtcggggcataatggctcatgcctctaatcccagcacttcaggaggctgaggtgggaggatcccttgaactcgggagttcaagaccaaccggggcaacatagtgagatcctgtaactacaaaatatttttattaaataaataaataaatataaatataaaaatttagaatttggtttaaaaagagggataaatttgcagtgataatttaagtcatccttaattttaagaatatgattattcaatttaccagattactagtgttttattattatatataaaacaaatgaaattacagaacaattatctatatatccttagatcctgaagtaatacactctgtattcatttgcaatcattaaaaatttagagtcagtttaccatcctaccaagtagctaagtaacaacacctcgctttcccagaggtcagtcttcttgcaacttcagcctcttaaaacaaatccaagagttgaaaaaggatgctgagtgtcgaatattactgtacaaatctcatgcactaaaatctcttcaaaaatgagccctgggatctctttcacatcctatttgttttcttttacatataatccagataagctttcttatttggcttttgaatgtacgttgaatatatatttcaattctataaaaactaaatacaaaaaaaaaaatccctttcacttttcattgataactgcaggacttatcaactaataacccaaaaaacagcaaaggataaacaattcagaaattagaaccaaaaaataaagcaaagctatctatcaccatttggtgtgttaacaaggaatcccacagttttcactcattagtttcaaaagttgctcccgagcaggtactggtgtttataagatggtgaccatgaatgataagaaaaattaaaattctttttaagacagtaaagtatagaataaattactaaaatattcctataccaatttttaacattgaaactgtcttggcactttaaaggataagcttcagtttaggtgggagacccacacctacagaaaaatctattttaaaatcgacccagtaagtggggagaagttattttggtatttaaagtttataaacggatggtttagttccccaatcttttaaaatactaccattagtaaatatattacaaagcaacatatgttaatactctctagattatgtccttgcctgtattcaatttcacatgacagtatgtggaaaaatcaatttacttaattttaagcttgtagggcttcttttagataatgttcaaaactataaacaatgtagcaactgatcgtcttctagaatgagtctgataaaaagtgaattatgtaattcttgaacttggaaaaggaggaaaaatacatcatagcatagagttactttaaagctttaatgttggccaagggagattaaattgcctttggggtgtacagatgcagaagattccgttggtgtgcttttcaaagcaaagacagatgatattaggaaataaagcatgagggcttctgctttaatctgtccacattaatgttttgatctgtgactaattggaattgcaagtagggttcaagaagattctcagccaatctgaggctagcagacatgtaagtctcccaaaaatgcatctaggaagattgcttgaccacaaatgaaagaacgtgtgaagaattgttctaatttaagcctgttagtgcatctaattcaaaattaatatggaataatgacacaaaaatgacaaaaaaaagttggctatcaagaaagaaggaaaataaactaaaatatactatacaatctccaaaattaaaacactgttccctttatacgtctttaatttaaaacaaaagaaaaagaactgccacccaagagatttactaaatccaaagatgatgtcatttccctgcttaaagtcctagagtggctcccagagcctccaggatagtctgaacttctcaacgtgacatatgaggccagcttgatctggccttggctgttgatgcttttcaggcctcctaatgggtcgtgttgcaacacaagcacttccattcaactatgccaatctattgtagtttctgcagaacagcctgctctcttatgctgcgacgctcttgtacatgctgttctcctaccagaaatgcttttccttctctcactcatcccccccttatcatagctgatatttcttttcaagactcagtttaagtgtcagggcctcttggaaccctaacaaaagaaaggttgtgattaacagtttaatataagtaaaaagaaaattctcagagagtttagtggaagaagagattaattcctaatcagctaagatctaggagagatttttatgggaatatagattttatattaaatctgagaggacaatgaaacttttaccatttttatcttacttagaaaatgaagatctttattctatacatcctttcctccttggacgaaccttgagagttagcttggagattctaacaggatagaaaaatcactgatatgttggggattgacacgcagggttcctctgttaaggaaggttgtcctctttgagcagaaggttaaatgggggctcacatatgagggaatattaggacactatccagccagccagattaataggtggacagtaaattcacccaaacccaccagttccagtggttcgctggaacaccaaccacttcgtctgaataccaacctgaccttactattcttcatttgatattgaaaaagggctactgaaatcccatctgcttcaagaagctcttcctaactaatggaaaatgtattgacagttttgttgacatgcagtagttaaggacatgttcttcataggcatacaaacttctaagtgagatcattctgagtaaattgcttaacttctccccaatgtgtgtctactctagggttcaagcctgactgaggaatgatccatctacttctaggaagtatctaaaaggaactgtgcctaactggagaagtctgggtcaagggcagtgggatttgccatggtggtagcatgggtgacagtggtaccagtggagccctgaatacttttttgtctcagatataaaacgccaaagttaagcatctaaaatagctgactggtggatcgttgatggcatcttgacacattaccacagccaaatcagggcaggagaagaggtaaacagcagacaccacactatggtcaaaagaactagttcttggcagggagatgagtcatcccagccaaggctggaactttcagcatgattttgggaaagaaatctgttgggaactaagttcctaagtgtgactacaagcaaagttatggagagaatatgttgtggctatttttaatcaggttggcatggattagaaaaataaaacgttatacctaaacaagcagatatttgcataactgctatgtggtcccagcttaagaaaaatatagccgattaaacaaatgtttatctcaagtgacagaaaaggaacttaaaaagcataaacctacaaagataaagaaaacaggaaagaaattatagtagacaggtacattaacaaatttgtgaaatgtcttaagagaaaatgacatggaataaggcaagaagcaagccaattcctgccataaaaccctaaaaagggaaggtcagagtactggcaaaaataggaagatccactgaaagtcttaataagaagcagttaaacacatcccttagctcacacagccaggcaactgtctcctcaccacccgttttctcaccacaaacaataaccctggtagaagactggtgatttacaatctgaagacagtgacccctgagactccacactaaacggtgcaaatggatgcctctgggaaatgggaatcaggagtggaaagggtgggacacggacctaatggcttttttgtttcttcattataaggtttgtagttctttaaaaaaacatgaaaatgtatacatttaataatataatatatattatatgtgataatgtaatatatatgaaatatactatgtattatatatgtgataataaaatatacattgtacatatatatcattttaacctagaataaaatttttaaaaagtaaaataaaagaataaaaagcttcatactcattaaacagatttaaaactacacccttttgtatgaattgataaaatccttatcttactgctgataatgtagtctactaactgccttggaaatttttctttttaataatggtctcctttcatgacactaacttccagggacatagtaagtagcactaacacagccacacaagctgtgcatgccccaactctagggcagctggagttggccatgtgtcaactagtggtaaatttccatgagtgttagctctccacttcttactgtttcacttatagtaatatttgcaaactcactctcatggtggatacaactccttgcctctgaggctcctttagcgtaatcatcaatatgcgcttcttgagttcccacccatacctcagttactttaacaggttcattataaagatataagcatgggtcttctcctttttgagatatcctcattttttttctcttgcatcttttcttagttaataattgattttacattggatataacttacactgacattttgaatttctgattatatatgtagtcagacttgttctaaaaagactttaaattttatacttatttttatattttcttacactttgtaacttattaaccaataacagtgaattattataccttcagtttttgaaagtgcatcagtgacttattggctcttgagaggcttgtcagcatataaatgaatgttctatggcagacgttaaggaaagacagatgaccaactttatgcttttggaaggcaaataaataagccatgttattgggagctaaaatgaagtcttacatatttctcaaattaattcagcatttggtcttttcactggtatctgagttttgaaaatctcccttctctaattgttgactctgctccctcttctggaaccttggttaaattgaatgggaaaactgtttacttgaaattgaataatgtcttttctgtgttggtcaataagtcccagattgaagtaaagacaaactttagctagaaaattattcccatagcataatttaaaagtgctaactatggcatggggaaatttttgtctctcatttttccaatgcacatcagtatgcataggattattttagtttaaagaaagggaatgtttaaaataaacacataggtcatcaaatacaattcaggggctatcttgtaatattttattcttttggagaattacatttctgtttttactcctttgttttgggtttaaaatgcttgaaagcattgcaaaaataacaagaactcgttaattatattctgggcacttcaaagaagctcagaatacactttaaaagcattacattcacattctccatatcactaaggtaagaaagtgaagattgttctatttcacgaaggacattttcactttaagaataagtttatgtgtctgtgcaggctcacatactattcaattgcgaatcagagtagaatctgtgtcctctcaatttgattttaaaatacaatcatatttctacatcttttacattcaacgggaaattaactaaaaaattaatacgttttattggcttccttttatttttttctatgagttgttcattaatgtctccttgataaatagataagcatttataatcatttttagaagtgcattttagctaactgtttaaaggaaacacaaggaagatacagtaatctttaacatccttaacctgcttgctgtactatcctcccaaacctacaaaaaacatgtttgttaaaaataagcctcctagaataagaaaggaagggaatagtgccagaggatgcagcatttattcagctggtcaatcaactggagtatttactgtgtttcaacaacgtgccaaatgctgttaaaagctggcgattcagcacccccttgcccttatggcattcaagaaagtaagtcagtaagtaatgaaagatgtgaccacaaacttttctaagtgaaaagaatggagaggagggaggcagggagaggcaggaagaagagcaaggaaaggacatattctttgagaggacatattctatattggaagatcaagaggacttatctgggggggtggggaaagatatttaagaatgaagaggagccagccattggaagggacggtggggtgcagatgagcattatgggcagaagttaatgtacagaaaaatccctgagaaaggaaagggcttggggtgtaggaggaacttcacagtggtgggtataacaaccaaggtaatggagggatggagggaccagtggctcaggatgaggatggagagttaggcactgttcaagcattcagggccctgtcaaccatgcttaggcatttgcattacatttaagaaagcacaggaatccattggagaattttaggtggtgccagggaattatctatttctgttttggaaatctaagtttggctgccatgtagaacaatctatagagcgggcaggagtggaagcagaaagtggccaaacacttaagaatgaggaaggaggctgggtgccgtagctaatgcctgtaatcccagcactttgggagaccaaggcgggcagatcacttgaggtcaggagttcgagaacagcctggccaacatgacgaaaccccgtctctactaaaaatacaaaaattacccggatgtggtggcttgtgcttgtaatcccagctgctcgggaggctgaggcagacacgcttgaacctgggaggtggagattgcagtgagccaagatcatgccactgcactccagcctagatgacagaatgagactctgtctcaaaaaaaaaaaaaaaaaaagagaatgaggaacaagtgggatgaagcaggcaggccgggaggtgtgactagagagagttggtgaacgcttcctctggacagaaccttgtaccagacacttgacctgtagtgtctcaagtctgcacaaccccagcaaagcctgggagcagaagcccataggacaagcattctccagatcccttctcttgaagaaaaattttactggaaatgtacttcttgtgtcaatccgaagggggaaaccttaggacccattgggagaataaaaggcagtctggtttgactggaatatagactctatggaaaggtttagagagaaataagcctaatccagtggattaggactggaccatggagacttcaaccaacagctgatgagatcctttcaagtatcagatgctgcactaagggcatttgcctacgttatctcatttaatcctcacatggtggcataaaataagtgttacagtacattagggcgttaaggccacaaaagcataaaagtgatcaaggtctaacaacaatagggtggcaaaactgtcatctgagaccctgttctctttcctaaatcagtaactcattttatctttcctcatacgatagctagataacaacatttaggctccattcttcagatcatgggcaaccagcaacggctttttgaacccatgaaatgggatgggatgacagataaaattgaccttttttctttttcatttattatactgtaagttccaggatacatgtgcagaacgtgcaggttacgtaggtatacatgtgccatggtggtttgctgcacctatcaaaccatcatataggttttaagccccacatgcattaggtatttgtcctgatgatatccctccccttacccccaaccccctgacaggccccagtgtgtgatgttcccctccctgtgtccatgtgttctcattgttcaattcccacttatgagtgagaacatgcagtgtttggttttctgatgttgtgatagtttgctgagaatgatggcttctagcttcatccatgtccctgcaaaagacatgaactcattcttttttatggctgcatagtattccatagtgtatatatgccacattttctttattcagtctatcattgatgggcatgtgggttggttccaagtctttgttattgtgaatagtgctgcattaaacatatgtgtgcgtgtgtctttatagtagaatgatttatactcagagcctttgcatgtgtttcaggatattcgatgaaatgtgggtggggaaaggaagatttcatcctgttggcatgaaagggtcccagggtcacacgatgttaactgcaagatatttcagtttattgattattgcacaaggtagggacaacaatgggagtttctgcctgagagaaatgaaatagacctcattattttaattaaaacttttagaagatttttttttgaaatgttgcctggggggtattttctgtataattattatggaaccattaggtgcagccacagctcagaattatttaacagacataacagacactcaatgacacaacaccagagtcacttcctagatgcagcgcatcactttagccttttggtctgctttttattttttcttttcattgtccaattataaagtaatgaaattatctgctaaaagagatttatggtataaaaggaaagtggggagggaaggtacttcagattccctcttttgaagggaaaaaaagtcattagaagtttactttttctttcatcaaaaaggcaaacctaatagttttctgtgtgaaattcatgtgtaccagtccagtgattctcaaccaactgtgatttgatcttaggggacatttatttggcaatgtatgtattagtttgctgggactgccataacaaagtaccacagactgggtggcttaaacaactaaaatttatttattttgtcacaattctggaggctggaattccaagattaaggtgttggcagggttagtttcctctgaaggctctctccttggcttgtagatggctctcttctctttgtgtctccacatggccttccctccacctgtctatgtccaaattttctccttataaggacaacagccatataaaattagagcccactctaatgaccttatttaaacttaaagacactatctacaaaaaaaaaagtcacattctgagttagtaggggttagaacttcaacatacaaattttgagggaacacaattcaccctataaaagcctagaaaagtatttattgtcacaactggaaggagggtgggtgttactggcacttagcgggtagagccagggaggctgctaaaccccccacaatctacaggacagcccccataacaaagagccatccatctcaaaatatcaatagtgtcaagactgggaaattctttcctacttccaaagccagtagtttgatattttttatgcataaagaagagcagaatatattattctagtgaatactcatatcatgaattatagcacagtcttcgttaggactctgcaaatatccatcttcatatatcacacacacaaacaatatttcttctccagatttcaaagcagcttcttgggaatatagtgtaaattgggttctgacattactgcacccctaagacaaatttgggaaaatttgtgggcatcaaagagccctgtaaactgtaaagttccaggcaaataagttactgttataagaaaaaaaaaggaaccaccatataaaatattagcacctttatccttaaagaaaaaaattaactccagatggattgcaaagagggaaagactgaggcgaagaagtccactaagatcccactgctattgcgtgtctactcccagaaaagtgggaaactcaggattccaactggagttgtggaatctggggctgggagagagatgaaccggtggagtcaagaaggacccaaaaactgagatccaaaggctaggtagaagcagagtagactgttcagagaaggggactgaataaggagtcactccaaagggactggcaaagaggaaagccagaaatgccacgaaggcatgagaaaccagaaaagtggagaggagactttttctggggtacctcctcatgtgtatggtacttcttaagagtgaaaatgatcacacaaagaacctgaattttaaactacagcagcaaaaaagtggaaattagaccatggatttcaatgtgcagcatagcagcaaaggggctggcctcacaagccttggagtcacacaactgggttcagactctgactctgctgcttactgccgtgtcaccttgggaaagctacttaagttctacatgcctctgtttctttacctttaaaatggactgttgtctgtagattaattaggttgcatgtgtgtgtttgtgtgtgtggtgtgtgtgtgtgtacgtgtatgtgaagtgcttagcataaataacatcagttatgactactgtggaaacatttcagagatataatcaataggactgatggccatttagatgagagtggggatgaatgataggatgatgtaaaccagaggtttctagcttgatcaatagagagtatggagatgtattaatcaaaatgagaaaacagaaagggaaaagctggtttggagaaaaaagagaaaataatgagtttaatttgagatgtgttaggtaactggtcagttaatcacctggagaagttccttcaggaacaggtaagaatctgtagctcagatgaaagttcaaggctagaaattgttcataatttcttgtgcttattgatgtcatgtggctaaataagatttcctaagaaaaacatgtagagagaaaaaacagaggcaggagaaatagaaccttagggtattcctggatgcttaagcttttctgatgattttaataatggtacagtcctttagagtttataaagcactacactatcttgggggaaagaaactggttgcccttgagagtttttgagatatgtagaactgttatgctaaacgatcaaacagctatatggttgatatcactattaatatttgagcttttaaatctgttttcccacattattgccagccctattgagtccacctcctactggtaattcactgctatggatttaaaaccgaaacaaacaccaagagcgcttaaataaggaatacttccctctgagtggggtcttttcctcttcaggaaagtgcataaacctttgtgcccgaggttacaggcttttgattctggatgttcacaaagggtttggtttgctgtcattattgttttctgtgtatgttttgctttggttttgttgtgttgactgcttgcttccttctctattttgggatgtgagctgagtacacacggttcctacgaaagtgacctctccacaaataactacatctacatctatcattttgttgttgacataatataaatagggcagaggaatgcccagtcacattaactatttctatctatggagattagaatgataatgtaaaaattttcaaacgagctttggtttaagtgtctcttcgaagttcccactaaaaaattaacatgctattaatataaccatttaatacgtgaccagtagaacctaagccagctagctctaaacattttttagaattatcctataatttaaaaacaaattttcaagataactataaacatcaatatgctagcattaccatactcttgatatatctgtataggcaagagttgtaatttgtaaaaacattaagggattctatgccagacagtaaatatctcaggtaaaaaagagaaagagagggaaagtctatgttattataatgataataatagcaaatatgtagtgtttataatgtactaggtattgttttaagtactttacatatattagctcaattatttctgttaaagaaaaatctgaaacacaataaaattttaaagagttcatttgtgtaagaagtaatttatgaattgaagaataccagaccaacagaaatttagtgttccaatgtcagaacatcagaagcaagcatttaatttaaaaaaatgaggaaataaaatgaagaaatttggggctaggtacagtggctcatgcctgtaatcccaggactttgggaggctgaggcaggaggatcacttgaggttacaagttcaagactagactgggcaacatattgagacgccatctctgcaaaaaataaaataaaatacaataaaaattagccaggtgtggtggcattcaccagtactcccagctactggagaggctgaggcagaaggattgctcaagcccaggagggtgaggctgctgtgaagcatgattgtgccactgcactccagcctgggcaacagagcaagaccctgtctcaaaaacaaaaaagaaatctgattggcttacacaattatcttttttttttttttttgagaggaagtctcactctgtctccaggctggactgcagtggtgcaatctcggctcactgcaacctctgcctcctgggttcaagtgattctcctgcctcagcctcccgagtagctgggattacaggtgtccgccaccacactcagctaattttttgtatttttagtagagacagggtttactatgttggctagggtggtctcgaactcctgaccttgtgatccgtccactttggcctcccaaagtgctgggattacaggcgtgagccagcacgccaggccaattaaggctgctttttaagatctagctggttttatttgttcaacaatttttcaggccttatctatattttaattttactttaataattccccctttttgctcatcctctcaacaagctgaaagtgtgaccaaatagcatactgttactctcagttgccgctgttgacacagttactgggatataaagtcaggtagatgttgttatcatcattagagtcatatcgctgccatcaggaagtacatagtcagtgtcctcgagttgtctgagcccgacagcaatcgtttgacatgtgagtggctgttaaaaaatattaaaaacctgtgagaggataaaatgcaccaggggagtcaacatcatgactataaagaaaataaaaatcaaaggttgaaaaattcctctgagcaaaatttccaggagccatgattttaccaactgcatagatcaatggaggaggcagtgcttatctgatgtaaaatctggatttatttgttaatattctttacattttgggcaacaatatctgattcgtcaacataaaaacaactttttttgtcttttttaccatgtagggcacaattgtgttgtgctgtgttgagcagctaaaaatatcaagaacccgtttattttggagtgccactgaggtcaaattatttatctcagattgtactccttgaagagaatttaaagtatcattaaaacttctttaaaaagttgttgaaatactaataagttattttttcaattcggagacttctagctgagaaaaaaaaaaagaggggctcttacaatagaatggaatttgaaaacgcctttgtatgctcaggtttggaagaccacagagggctcctttatgagggccacttcatgtacaaatgaccctaagttaaggatttcactagcatttaaagagtcatatctggtcatttcgggtaagagatagcccaaaccacagtatccagaccatttaggtggaaaacctttatatattttgttgtcacacaagatgaacaacccagcattattgagagaaaaagtcaaaggggatcccatgactcaccagttgggagtaatataaatgtcatggttattttttgtcatctctacatttgtacattaccaggttgaatggttatggtttaaattagaataggaacaaaaataattttataaatgtgataaagtaacccatgcataccatcactaaacaaggatgattggctttcttttcaaacatgtctcaaatattgctctattcaataaacaaaagtattaattttatacagtgaaaccatgggggaatttcatttgtcttcagtgttttcactgaacagtacttttagtgatttttgtctgttttgttttgtttagagacagggtctcactctgtcacttaggctggaatgtagtggcataatcatagctcactgcggcctcaaactcctgggctcaagcaatcctcccacctcagcctcccaggtagctggagctataggcccatgccaccacacccggctcattttaaaattatttctgtacgaggtctcactttgttgcccaggctcatctctaactcctggcctcaagcgatcctcccaccttagcctccgagggattgtgttagtcaccacacctggctgaattttctaatgatatgttcaaggatatcatggtcatgttttcatgtcgtatctgtgttattatacataggggtccagtcttcataatctgtgtcaaaccaaagggtttgattacagagggagtctagaatactccctagattgaacccaattctgtgaaggttttctatgcgtaaggataaattagcagtaataaaatcaacagtagttatacgccatccccttttctttaatagcttctttctaatgctagtctattataaataggaactgaactgccaagaggagggtaccaagcttttttagaaagccagtttcctgaattgctcacccaggtatgtgtgggagcaagttttaatattaactgtgttttttcctgttcatccagatgactatataggcagcaattgctttggttagtgagctatactttgaacagtagactttagaggatgttcagtttgaggagtgaaagtccccaactaagtaagagtacaagtttgaacattttgtattaaatgtaaaacaaaaacaagtctttagccaatggaaaatagtgacatgaagtcttgtttggtgatcttgggaaagctgtctactgtgtgatgccatctacttaagtcacctataggttgacaagcccaaaagtctaagggagctttctttagttgagagacatgacctaagtttcaagactctgaagttttgctgcagtgtgagtagtaagaagaaatagtatggtccctttcaatgaggctcaagggcagtttttctctggtgtcattttcaaaagacccagtttccacgttctaggccatggaaggtttgatcatcagcagatgggtcatgggaagctttcttcacctggtgaaaatatactttggcaaaatgcatcaatgttttgcagcattgatttatattagtaaataagtccaggagatacatgaggctctattttcaaagacacgggtctccttgttattattttataaggggccaatttgtaatttcccattggggttgatctaattgcaattaaggccagtggtaaaacttttggccaagttaatccaataaactttattaatttaggtaattttagtttcaagatgccattcatccttgtaacattttgaaaggactgaggatgataagggcaatggtaatgccattggatttgtaaaatcttatttaattgtttcataacctgtctagtaaagtgagttcccctatctttggaaatctgtccagggatgcccacagaggaaaaatgattttaaataaaattattattactgttgtgacatcagcttttctacaagggaaagccttaatccattctaaaaacagacacactatcacaataatatattgttatcccactaagggtggcaatcaaatgaaatccatttgtagatgtttaaatggcccagcaggtgatggaaatataccacttgaatctttaagggtctttctgggattactggtttgacaagccacacaatggttataaaacatttttgttgttttagaataaccatcccaccagtactttttaacaatttgaaccattttatccatacaatgatgagtaatggcgtacaggacttttaagagtggcattttcagggcctcaggaaggattaggcagctatccaagctcttggtgagtccttatttagcattaaatttgcatccttttagacaacatttttgttgttccaattcaggtgcacagcattgtttattgaacaaatgatcataagtaatttgatttgaattgattttatagagttcatacagattgcatattttaacaatttcagtggtagtcaacttggcatgaaagtcttctaatcccttccattaatatttaggtttagttttatgaatatgagcttcagttttagtaatagcaacccatcagggcagtagaagagccaaaagaaattaatctacctgtgacccttcttgatgggatttccactagaaatgagaaatactttttgtttcaataacactccaaaatcatggaccactccaaaagtgtatctattgtctgtgtaaatgttaacttaggccaggcatggtggctcacacctgcagtcccagcactttgggagactgaggtgggagtatcccttgagcccaggactttgagatcagcctgggcaacatagtgagaagccatctctgcagaaaaaagaagaagaagaagaagaaaattagacaggtcatggaatggtcgtcatcctcccaccacagcctccgaagtagctgggactataggaatggtggcacatgcctgttgtcccagctacttaggctgaggtgggagcatcacttgagctcaggatattgaggctttggtgagccatgatcacaccactatcctccagcctgggcaacagattgagacccagcctcaaaaaaaaaaaaaaacccataaaaatcaaatagtaactatttggttttggctatatgacaaggcctagttaagagaatataatgttgcaggttgtgctaacttaaactgtgaaagagttcccttttctgttagttcatactgagtggttacagcatattctgtttcgtatctcctttgtatattttttggcataagacccattaacaaaaagtattaattcaggactatctaatagaatctcccataaatcagtgtgaggggtcaatagttgtgataccacactcacacatttatggttttctccatcattaggcagagtgacagggctaatcagagattacaatattcgagatggagatttggagtttacaggagaaagatgtcataagatgttagtctgcttgggtctgactggaatctaataaatgtataacggtatgttgaactcgtaggtaaagtttcatttcctaacactaggtcagatgaggtttcttctaatttagctgctgctgcaactattttcagacaacttgaatatgctctggccactagatctaactggagactctaataagcaatcagtcgctttctttccctgtgttcctgagccaggactcccaaggcctaaccatcatgtttgtaaacaaacaatgtaaaacattttgtataattcagaaggcttaaagctgaaggctgttgtaaggccagttttatttgatgggaagtttgttcatgattaccttcccatagcaaagactttgatatggtttggctgtgtccccacccaaatctcatcttgaattgtagctcccataaaacccacatgtcatgagagggacctggtgggaggtaattgaatgatgggggtgggtttttccaatgctgttctcctgatagcgaataagagatctgatcgttttataaagggcagttcccctgcacatgctctcttgcctgccaccatgtaagacatgcctttgctcctcctttgccttctgctatgattatgaggcctccccagccatatggaactgtgtgagctcattaaacctctttttctttataaattacccagtcttgggtatttcttcatagcagtgtgaaaatgaactaatacagactttaagacagattttttgtaagtttatataagggggatgccaacagaaaaatgttgaagacccaagttttatagtatccccaaagtccaaggaatccttttaattatctcttagtcatgagtctagggaaaccttagattgactttttttttgttcaggtgagagggaaattctctttccagtcaaatcatgtcttaagtaatagaccttttctttagagaataaagtttttccatggaggctttatgtcccttgtaaggtaatggttataagaaagaagttgaatctatgacagagttttatctggtagaagaacataactataaattatttacatattaaatagtagtagaatttctaggaaattgtgagattgacaggtcttggtgtaatgcctgagaaaaataacatgaggcatcagtggacccctgtggcattacagtccaggtgtattgctgttttttccaaataaaggcaaacaagtattggctcttcttatcaagtgaaatgctaaagaagacagagcagacatctatcactgtgaatcatttggcagctgtaggcacactagataacaaagtgttaggatttggaaccacaggaaattttggaattataattgaatttgttgcacataagtcttgaacaaatctccaacctcatccattagctcttttagctaatagaattggagtattatagtgactagtacaagtaattacaaatatttgttttattaactcctctacaattggtgaaagtccttggattgcctctaactttaggggtaaatggggaaatttaggcaatggcttagaatggtctagttggatatttataggttcaggacttatcattttttctgtcagttgaggaggaagcccacagatattggggtactccagaaaggttggggttggtataagtttggctttcaacgttatcaactcccactcgtaagaacaaagcagtttaggttcaggaggatcagagacctctagggttacttttccttctgaagagagttttatgtgtcttcttaggttagaaagcaaatctcattccagtatctttactggagtggtgtcacatagtaagaaggcatgcttctctgaaactagttcagcatttcaactggtttagacataggaattctctgaatttgatttgaaacccccaccacagaaatattttttcactccaagagatgtgttggtttattagggtggggtttaaagtggataaggtggttccagtatccaccaacactgtgtatacatgactccccattgatcttgatctgagtttccttataaacataagggtattataggaagtaacttaccagagaatccctcagaaccccattcatgttaattattgtcttgagagtcaaaccgatgggaattttctctaacagaggaagttagggactgatactagagtggacaatcttttttccaatggcctgactgtttctaatgatggcagacatcttaaggtacaggtttctttgttcaggacctcttgattttgagttatgatatgcatgaagaggccctcttggactttgtccctgtagctgttgcagctgtaaacatagaagcctttgatattttttcttttagcgtttcacctttttcttgttctaaagttctctaaaaatgttcaaccatgatgactaattcagctgtatcagtaacttcccatccaatctttcattttttaatcaggtcaccaagctttggtcagagcccatgaatgaataagtctgtaagagctatttcagtttcagcagaaaattttccctgctgtattttaagaccagaatgtttaacaaatctagccttgtaatcagaaactaatttatttctttttatttgtatacatagttgaataacggaccaatcttttgtgggaagacaatagggatcgtttccagcagtttttcggctatttttctggcatcttttttaccatccctagaagtaactattgaagagtcagcagtcctttcctcaggcttatcccatcctgctctttttatccatttgtgtacgtctctgggtcttaatattatgtgtataaactgatataaatcaggaaacacagggtcatagactcctatgaggattctcaattcctcagaaaatttttgtgtattttctttgcaatttggaaaatattttgctatggctctgagttcagtttttgaccaaggaataaaattatttataggagccaaacctgggtattctgagggcctaactttatgaggcatttacttaacttccttcctctctttatgctccagataaaaatgtaattgagcaaaaggattagtaggcttaggagaaagagatggtttcacaaatgagtttgtggatttagaataattaggtagaggagaataaaggcaggaaacaaagtcacatcagttaccacataatttccttactgttgccctcaatttattgcttaagcttttcagttgtcttatttgattttagtaaataagctttttttttttttttcgagacagggtcatgctctgtcgcctaagctggagtgcagtggtgccatcacagctcactgaagcggtgaccttctaggctcaggtgatcctcccatctcggcctatcaagtggctgggaccacaggcatgggccaccatgcccagctaattttttgattttttttttttttttttgagatggagtctcgctctgtcccccaggctggagtgtagtggcgtgatctcggctcactgcaagctctgcctcccgggttcacgccattctcctgcctcagcctcctgagtagctgggactacaggcacctgccaccatgcccggctaattttttatactttttttagtagagacagggtttcaccgtgttagccaggatggtcttgatctcctgacctcgtgatctgcccgcctcggcctcccaaagtgctgggattacaggcgtgagccactgcgcccggccttgatttttttttgtagagactaggtctcactatgttgcccaggcttgtcttgaactcctaggctaaagcaatcctcccactgagacctcccaaagtgttgagattacaagcatgaaccactgaaccactgcgcctggcttgagtaaagagtcttttagagaggcaattttggatcagctagttctttgtaagcctctgtatgccaatcaaaaaatgcatgccattgtttctgaggtatttaagatccattcttttccattatgccccataaataaacaattttatctagattaaaacttccccgttgtggccactgcaacttcaaattatttcttgtaggcacacccatttttctagaatggcacaagtttgtggtctataatttctaaataaaaaatttgctggtgttcccagcagaggagtcccaggctccttagatattgacaaacccataatatcctgtctttttaaaattctatctacctgaggcttccaactacaaactcagtctagttcctattgaatacccagtttaacctcgagatcccaatctggattccagatctattctggaaactagtgcactagactggacctagtctagtttatgtcaagcactcaaatttgatctctggttacaacagggaataaaatgattcagataaacttggagagctcaggacacaaattgtggagcttgaaatctgagagggacttaaccaggacctccagatgcagtgagaaagcagtgagctccatggactcagcaggtaccttttgcctggttccttgatacacccggtggcatggcccaaggatttggggcgtagtcggggggggtctcctttgaatcccacttctgacaccaaacttaaagaaaatctaaagcacagcaaaattttagagtttatttgagtaagaagtaattcatgagttggggaacaccagaccaacagagatttcgcattccagtgcagaacatcagaggcaagcatttatgggaagatgcaaaagtaaaacaaagaaatcagattgacttacagttacataattatccttttgggggtacttttttgggaagttcttagtcacataattatatcttagttggctgcttatgattgactagagttaagtttaatttctgttcaacataaacatttaccagaaacgtcccaagttaagtttagcttatatctgcagtgtgaccccagtcaggttccacctatatttgcaatttaagctagatgaaagctacttttaagccctagctggttttgcttgctcagaaatttttcaggcctggtctccattttaattttactttaacatttctcataacaattttatgaagtagttactattatctctatttcacagatgatgcagatgagggaactgaggtacaaagatgttaaataacttcctcaaggttactcaactctgaaatatcaaggccaggactcaaactaagacaaaatatctacagaatacacacttttaactattagactattaactctttcaaaagaattcctttgaaaccccaggagaagtaatattagaaaatgagagtaatattagaaaaagaaagattattagccctttccttacttatcagtgtatagtttcacttgttacagcaagtatgttttacttctaattcaaaggtcatcaaataagataaaatgttctgctggcactttgcaaaaaaagggtatcctgatggtcaaagtcacgtgaaaagatgctcagctctatgagacatgaggaaaatgcaaattataaccacgatgtgacatcactgtacatgccaaaatgactaaaataaaaaagagaaaaaagccaggcaaggtggctcacgcctgtaatcccagcactttgggaggccaaggcaggcagatcaccaggtcaggagatcaagaccatcctgcctaacatggtgaaactctgtctctaccaaaaatacaaaaaattagctggacgtggtggcacatgcctgtagtaccagatactcgggaggctgaggcagaagaatcacttgaacccaggaggtggaggttgcagtgagctgagatcacactgcactccagtctgggcaacagaggaagactccatctcaacaaaaaaaaaaaaaaaaaaaaaagagagagagagagaaatgataacaattttggtgacaacaaatggaaactactggatatgaaataattggtattcttataggctacttgtgggagtataaattgatataaccactttagaaaactatttggcagtatctattaaagcagacatatgcatacaccaatagtcagcaattctactcccagatatgtacctaacaaatatgtacacatatgaatgttcaataaatgtgtttaagaatacttatagcagtactgttcataatagtcacaaactaaaaacaatccaaatctccatcaacagttgagtgggtacataaattgtggtgtaatgataaaatgaaacactatgttgcattaagaaggaacaaactattgctatgcacaacataaggataaatctaacaaatataatgagtgaagaagctagacacaaaaatgtctataaatgatttcatttacagaaagattaaaaagaagcaaaactaatatgaaacgttagatgtcaggagaatggttacttttggtggggagcaatgaatggaagggaacatgagggggttctgaggtgatgtcaatattctatttcttgatttgtgctagttaatgaggtgtgttcatattgtgaaaattcatcaggggccaggcgcagtggcatgcctgtaatcccagcactttgggaggccaaggtgggagaatcaactgagccaaggagttcaagaccagcctgggcaacatagtgagacctcatctctacgaaaaaaaaaattaattagccaagtatggtagtgcaaacctgtggttccagctatccggcaggctgaggtggggagataacttgggacttggaggttgtggctgcagtaagccatgatcatgccagtgcactccagcctgggtgacagagtgaaaccttagttgaaagaagaaaagaaagaaagagagaaagaggaaggaaggaagaaaggaaggaaggaaggaaagaaggaaggaagggagggatggagggagggaggaaggaaaatttatccggccggacacagaatttatgcattttcctgtatatgttatacttcaataaaaaaaattcttaaggatacagtgttttggagttaaaaatgataacatttttaaagtacctggaaataatactattcatactataataaaatgctactcaagcctgcaccttgccttttgagattcacaagaagtatattatctctagaagtatatgtgaaaagtgatcgattaaaaagtgctggaatggctccagccaagatccattgttgtcaaaggtatctggcagagagctaaatgctactggatctccaaagacaaatttaaaatgattatacttagaagaaataggaattgcactgtgctgctaaagatgtaaatatttgtcttcgactgtggcagagattaaagaaagagcatcaattttttttgtttccttaattttttaaaatagtaacactgtaaaaaggacttccttgttcactgattcaaataccaaatctcaactatggctgaattttaagatgatgaacaaagtacctactttagtcatctccctcacaacaaatccatagaaatgataggaaacatacttcagaagaagaataagaagaaagagaaaagaaggagaaaagaaggggggagcagaaggaaaaagaggaggagaagcagcagttagtggcacttaggcatgggggtagaagggcacctttcaatgaatgagaatctttgaggaatccctaggaaagaaaacaaataggatcgactgaaaaggaaaatttaattacaagcaaaaacaatcactgtgaaaggtgagcaaaacacaaagagagtttgctcccaagagtattttatttcagaagagttctatacctcatgctcttagaggcagtatagccatttgtccaggctgctacaacaaattagcataaactgggtgtcttaaacaacaaaaacatatatctcacagttctagaggctgggaagtccaagatcaaggtaccagcagatccagtgtcctctgggggtcagctccctcagttttcagttgaccaacttcacattgtatccttaacatggttccatagtgtagtggttagcatttttgttttacacacattgtatccttaagtggcagacagtggagccctctcatgtctctttttgtaaggacactaatctcatcatgggggctcctctttcatgacctaattacctcccaaaggcaccatctccaaatatcaccactttagggattcagggtttagcatatgaatttgggggaacacaaaccttcagtttataacacacagtaatgtgctgtattatgctaaaggggaagggatccataaggaaggctaataaggaggaaggtatgggtatggtaagcaggggacaaaggagaacatccttggtggtccgaagaatcccagttatttccatgcagtaagaggacaggtgccccatgggcatgatgggagtggtcattgatgaagaggttcaaggcaagtggtaaaggctcgcagcagttcccatgggagtaagttgagcaacagcaaagcacagaattgggcactggtgttacaaacacacgaagaccgtgaatttatagtcaccgatctgcacatttatgaggttttttttattttctggtagcactcagtatcctgggataataacagagaagataaaggaatcatggtgtttttccagagctgaggtttttccaggaaagtaaaacaaaagacaggggctagggagttgagagtattggtgacatggtgatccaggagagcaacagcctaggttttggggctaagatgagctttgatacaggatatatcaaaggactggaggttgaaatagagaacaatgaagatggaaagataagaggttgtgtcataatggcaagggtctgttgaactagatcttgaatggccttggaagagatatgggggagtggtaatttggaaatggagaggataatgcattccagggaagagaaccacacatgtaaagacacatgcaaagggaaacggtaagaatttccatgtaactagatcacacattgcatggaggaaagtggcatgagatcaagatagaaacccacattaaaccagattgtgaagagcctaaggagtttgggcatcatttcctcccagaggcaggagccaacggaagttctcagatagtgctgtcctgtatggctaccgttggacaggttgtatcctgcacagagtctccttcatggggtctaaactctagatcgagctctgcttgccaagccattcatcctgcttgctctgtagctgttaccccaggaggaagagggtattttctttaattcttcagcccctcaagagagggagccctcttttaattcatctacctgaggggctgcattcctttttgggtagcagtggctctgtgtagagtgatgaccagacagacttctcagggcgacttttctggccgtggtgtagaagatgacccagaatgaggagacacagtaaacatggagagcagaacagttttcagcagtacaagggcttaaccaaaggcagccaagaagaaagaaaaggggccagatccggaagcgaactctgtagtacaattaacaccagggggcttatggacatagggatggtgggaaagggaaaagttaaagatgactcagatatattctccactgtgttcctagaataaaacctgaccacattaatgctcagttaacatctgtaaaatgaaaaaaaaaatagagcttcaagtaacaaaaacatttttaagggaaagatactgtctgctgggatggaacccataggaacccataagaaacagtacctttaattatcttaagcttcctcagtttcgagttgtagaggtcagataactggcctagaaatttagagttactccagacagttgttttcagccctggctgaacattcgagtcacctgaaaagcttttaaaaactccagtgcccacactggatcagttaactccaaaatcctggggatgaaacttagacatcaacattttttaagacagaggctcactctgtcacccagactgaagtacagtggtgtgaccatggctcactgcagcctcaacctcccaggctcaggtgatcctcccatctcagcctcctaagtagctgggactacaggcacacaccaccacatctagctaatttttatttatttatttatttttattttttatttttttgtagagatgaggtctccctgtgttgcccaggctggtctcaaactcttggccttaagaaatcctcccacctcagcctcccaaagtgctgggattacagatgtgagccactgtgccagtccagacatcaacattttttaaagctcctgggttggttcctatatataacaactgctctcatggaatttgcaatctctattctagatttctagacgtgatcagtaatatagcatagataagaggtggatcagagacagggcagaatggtttaacttatttgaccatcttgtcacaacggaaatcaatcatccatttcttacaaaatccttttacatagtgaccagttcttcaaaattaatttctacatcttgacaaaacatcaagaaattcattatgtggcttcattgatttttaggaaactgaattatgggcaagatatgttttaaaaaaacagagcattttaaaatcattacttaaagagtaaataatgcacaggcttggaaattattttaagaccccctcatttgctgctaaggttatgtgtgtaccaggtgtcaaaaagaccaaatgctatagaaaaataaaaggaatggtttaaaaataatttaagggtcagaatgaagatattttgcataaattagaaaggtggtacacaaaaataaagaaagcaaaacaaaacaaaaaaccctagggcctagacctcggttctaggcctggcctttccccctaaatattgcactgaaacttagaggccacctcacctcactgagcctcattttcctcacctataatgagcattctcaccctggtgagtttcagtcctctctaacagccaaacattctctaattctatcattggtaagtcaaagatgagcaggctaaaagtaatttaagcctcaccattcttgatatgaaggcaagaggagcatcgctcaccaaagagaagtcaaggacccaccccaggccacagctgtttttattgatccacaaaggataagaatttcagagtaaagtctggaaacttttgtagtcatttaactatttctgttaaatcacataataaaatattgagccttgtattttgtatatctttgtatttttatttcacctttttagtaatcaatttttattatagtttataatagtgtaagtccacagcaaattagaaatttaaaaaatttcgtctttcaccgtggatagtttggaatacactgagctggagaaccataattacattttaacatcaatgtaaaagtgcacacagaagggaaaaaagcaaatgcaggcaaattaatttttaccttgtccattttgaattttattttagaggcccatttcatttggtcttagatcattgctattaaaagttattttctgctacaagtttatatgaactgctagaggctttttaaaagaaaacagcctgtattagaaaacaggtggtaaggggttggttttctagtactaggtcattatctaagaggaattacaatatgatatgtcaggtagcacagtaaagttattaattcctgttggaaaagataggtactttcctttttttttttttttttttttgagacagagtttcgctcttgctgcccaggctggagtgcaatggtacaacctcagctcactgcaacctctgcctcctgggttcaaacgattctcttgcctcagcctcccaagtagctaggattacaggtgcccaccaccatgcccggctaatttttgtatttttagtagagatggggtctcaccatgttagccaggctggtctcaaactcctgacctcgggtgacccacctgcctcagcctcccaaagtgctgggattacaggcgtgagccaccatgcccagccaggtactttcctttttaagaaaagaattaagtcactcccttttgattggaaatggctaatcatagggtctcaagctattaacatagagacacccttgtttaaaaataaggaaggctgcataatgaggttagttttcccacgattatgcagctaataaataggaaagtctaggttcccacccaagatgctcttctcaggcttgcctgtgctttctctgctgccctagtctcctccaccataaaaagtgttcaggtgggaaccagagagtgaatgcttgcataagcctcacttccaggtgcttgaaatagggtaacaaatattaaaaataatgtggagtgcttatgaatcaccttaatatgtaaatgactatgttctatttagaactttctgcagataaacaagatcaatgtttgttctgaagtgatttgcacatcacacagaaaaatatgagagaaaatctatgctctccacaccatatgtcttgatgtcgagactggtttgatctgtgttaccaatagacatgccccaaaatcaaaccaccttgatccttttaggaaataagtaggatatcaaattttaaaaagtgaatattcctgagaaatatcaagtctttgcagagattctataatcactgtgaggaatccagaaactgcattgatcagtttaaaacatggctgttcagtgaacttaatgactgtgctatttcacaggaatgtttgccaaaaaaaatgaaattgtttatcaattacttgacttttttatctagacaacgccagaaaaatccagatttttggaatatggacaatgcaaaaaaattttagtctatatttatggcattgtctagtcttagcttaagaacacagcatttacttggcttcattatttactgttcactaacagataataaaattaatagcaatttgggggtggtgccatactctgaaacaattaataaaatattttctcttctttgcacattattgtgattttttaaaggcaaagagtgaatgattcctcaattcttagcgtcattgatgtaaagtcaatatttgataaaagaaccaagttatattgtgaatgaaatcagctggttaggtgcaatggatgtgtccactttaataaaagcaataattcaggttgaaaagaacttcattatcttttctcaagataaattttaatggaggcctggtctgagaatacaatgccataagttctgaatcttcaggttcgtgcaacaagtcatttcttaagtgaccttcagctgactacataaaatctgaattggtcttgattagaatctgtccagctgtcagtcttttggcctctgagatacagagggcatatacccatgatgctgtggggttatgtaagagacagtaaagaaataggggggaaaaaaacagaataaaatgtaattacacagagtttcgtttaaaacaaaaattgattgagttctgcttaaagtggcttgttgtttcctgtgccaggaactactgtgcaggcccagcaggaagtgtgctacagagcaggatcaccttacaccctcgttttatggttcatttcacttatttaatgcaatctgagaacctgcaaaaggaacatgttagaaggagggaataggctttttgtcttgttttgttgttgttgttgttttaaatttctttgaatcaaaacatttgtttttacaaggtgcttaaagtcccagagaaacaggacttctagagttgcacagtgaagacatttctctttgtcacacaatttaaagcaagacacaaagttgagttatgtctagagttgagttatgtctgtttcctttgctgtcctactcacataaatttaagcataaagaattacaaccatgcccatgaatggtctaaatcattttgaattccatgtaagttcctcctagggtctctaatttgatagagagcccatgatgttgtggggaatgttggagaaaaggaattaatatttaagatgtagaatagcaattcatttgtcaagcaggggaatgagttcattttactgtattgtttggaaatgtgtgaattgaacagctggatttccttgtggtggcatttgctgctcctcacacgctgtctgttttcccccccagagacctcagtatgaacaacatcagtcagctgctcccgaatcccctgcccagtctccgcttcctggaggagttgtaagtatcactgtagtcttgatgcatccagtcaacactgggcacattcttgtgtttgtctctcatacttactgtgggaaccagataaaacaaggcagaaaacctgtcagcaccaacaatttcagaacatgaggaaacacttagttgggagggggcaaaaatagaattgcttatgattctggaaatcaacttataaaagagtttaccataaggctacaactttctaaggtgagactgagccaaacaaattaaaattttaaaacaaagcctgtttaaaagagctggatagctctttggaaatagttaagcagcaggatattaaaagtttgaatactggttcatgtttattaaaatcgcaagtaaagctataatcaaaaccaaaaactgctgcttggttcggcttatgacagggagaattgagtccacattgcatagcaccaaaacttcttgtcctaatcacttttaattactatttccctacttttaaatttagcttccctcaaggcttcagtagaaaaatgtgaaatccacagaagatttaaaactgggctcttccaaacactaaaaataaaaactaaaaaaggaggaagctaaaattagttaatgatacacagaggaattttgattaagtctagtaaccacttttcagaagatgaaaaagaactgtataaatcaaaaatctgcatttaaaaattcatttgatcctcttacgcttttgaatgatggggataaggaggtgataccccatcacagccctagtgtagaacgtttggcaccatcagttgagtcaatcctctgactgttgattaaaggaattgtttaggtaatgacctcttttgaaaatattttctttataaatcctgaagtcagagtccaatttggggagtaatttaaattgttaatgcaccacagaatccaccatgggaggtggaaagaatgtttcatcataaccaaattacactacgttgaccattttctcaagagaataagaggataacattttgaaatttctcccctctggagttttatctatatttatttttgatggcattatattttatgaaatgctattgttttactaccaaaatcagttgcatgtgataaaattggtatcaagggttatggtagggaatcttagatttctagattgtatagaaggttttgtcattcatggaatagattttcactctaggtcccaggccttttttttccatcttctcttttgtctcaggacatttccattgctaagatttaaccttcataggagctggaacaatgtctgtcttagtcatggctggtacataataaataatctgtaaatttttaatgaataaactaatgagaaagcaaaatatgtaaaaggagtttcttacacatgtcaactccctaagaaaaagtaacagattttcattgacattagtcaacatttttaaaggttattttaaataattttcaaacatcagaattttaaaaaattacatccatcttgttctccctatacttccacaattaatatagaatagacagccctgtttacccccatatttctaaggtatgcccttcctatccttttccctttaattcccatataatatctcatggcaaaatgcttcccttctccctcaacacacacctcaactttagaccacaagctgaatcaataaataattcacttccccaaggactttgtttaatagatttcctccctcagtgacccaactcattcaaaataactcctctttcttcatgaggtgaatattaattctgttctaaggccagtttttaaaaagatagttgaaaaaaaatcacaaaaaaagcaatggtgtttgcggagagaactaccatttgaaaatgctactattaatacttttctgccttgtcttatttttatctctctggaaacttcatcaaatatcttgaccatagaatcacaaaatttcagaaatagaggagaccctttaaagactattcattccattgcctcattctgttctggaattctttctgctaagctggctgacttgctgaatttaaaatcaagactgcttttccatatataattctgtgctgcacctaactgatgtcttaaagacatcattattcatttagcggcaaaagaagttagtatttataaaacctggaaaaatgatcagctcttcttggtttattcctttgttcccaaagctaaatttaggggtttggggaggttctattttttttgtttaaaaaatatccctttaacagaacattttttttatgctgttgattgtttctgttagacatatgcttaagtctatattctcttttaggctatacaatcttcaaaaataataatataagtgcagtaacaacaataataggttactgtgtgccaatcactgttgaaagtgctttacacacatcatttcagtgaattataacaaccccaaaaagatagatattattattcccagttaacagataagaaaacttaaatacagagaaaataaggaacttacccaacataatggagttggtatgtatcagagccaagattcaaacctaggtcaaagctaagattcaaaatgactttcaaagccatgcttggaaagtggagggacggttggaattgtgcatggtttatttgcgctttttttttctccaatagcacctagcactgtgatttcacagtagtttgcatagttgaacacttttaaatgctctataaactgagttgtgtaatgatcagtgtgtatatatgtgtctgtgtctgtgcatgtgtctgggaatgtgaaagaaagcaatgaagagctgtcttcccaggaggaagagattggatattcaggttattaatctacgactatgatatactatctatgagaaaagtatcatcagaactttcaggtgtagaatttcaccaatctagcattgttcaataggtccaaaatagtcttcgataatattttttacatgtaagtacatatacttaagcaccatgtttatgcagtatatattttacttgaactaataaacgaccacccatacagctagaaatgttaactctctctttctctctctctctctctgggtgtgtgtgtttgtgtgtgtgttatgacaattaggacactatgaaagtgttaagtctttcattcagcttattcagctcatttttgtgctttatctctttatacgttaaataggaaactgccactgacactatcaataatattaagaaacctcccatcataaaactcagtctttaaaaatcactatcagctgggtgaaatggttcacacctgtaatcccagcactttcggaggccaaggcgggcagatcacgagttcaggagatcgagaccatcctggccaacatggtgaaacctgtctctactaaaatacaaaaaaaaaaaaaaaaattgttgggagtagtggtgggcacctgtagtcccagctactcgggaggctgaggcaagggaatcgcttgaacccaggaggcagaggttgcagtgagtcgagattgggccattgcactccagtctggtgacagtgcgagactccgtctcaaaaacaaacaaaaaaaatcactattaataaagccacattatcactcttccccttagctctaattaccggatatatcatttctctcatttaattcctttaactatgttataaactgtgtagatagccatggttcatctctcatccatggctaagccttaacaaaggtgtcaaagttcaaaatcctgtaagaatcaataaagcgctagagatatacactgacttaatgtttaaaaaagcaagtaactcagccgggcacaggggctcacacctgtaatcccagcactttgggaggccaaggtgggtggatcatgaggtcaagagatcgagaccatcctggccaatatggtgaaaccccgtctctactaaaaatacaaaaattagctgggtgttgtggcgcgcgcctgtagttccagctactcaggaggctgaggcagtagaatcgcttgaacctgggagacagagattgcagcgagccaagatggtgccactgcagtccagcctggtgatagagtgagactcagtctcaaaaaaaaaaaaaaaaaaaaaaaaagcattgtaactcttgattgaatgatgagttacagaaagtatttcagaagaacagctattacagaaaattgtcttcctctctccttcctgacattctagaacacttactacctatgccgcaagtttttgacacatttcagtcttgttttttatttgtttagtttagttttgctttgttttgttttgtttttgtgactctacaaggtgaccagatatgcagaggccaattgtccttctggtggcaatgtgcccgtgcatagagaaggggagtctttttcttttgcaaaaagaaagaaaagcaggtcgaaattagggaagctgtgctgtatagaaagaaaagctcagaatctagattcagaagcccaggattcccatcctggctctgccacttactagctgataatccacttaatgctcactaggcctcagaggagaatggtgctgtctgccttttaaggtgtttccaagaatcaaatgaaaggatgatgaaagaacgttggtaaactatattctgtatatacagttgtattagtaaaatgaaaacaccttcaaaaagattttaaccccctcttttcttttttcatgagcctgattttgcaggaatctcagggatcctggacttgaaaaactgtttccaattctgagctttaatggatataggcaacgattgcagatagttctttactattttaataacccgagaaatcattgcatttccctccagcagtatctctcctccttctatttactcagttctaggaacttccgttaacgcttgctatgtagacaaataaaagatcctacatttgggccatcagagtgtagtagagatgttgggagctaatggcagatggtgactattactggcgtctacaagttacattaaacttagcttggtagtctgactaaataaggaggggggaatgaattgttaccatttaaaattgtccaagttaaaggcctttatttccaagtagtattttaaaatcttcccagattctagtgctattggaatcaaatactcgatttagaaaagaaacatgagaagctctaggggggtctgtttttaagttactattgttccctggaaccgtttgctcatattatggttggacatgacgaatctctatataaatagtagatatctattattacagatgaaatttgtaatgagagatcactaaacttcctgaaagcataatctaggcttgttacttctacttccccagcatgttactgaaaatagcatctgtatagctgtcctgcctgtcttttgagatttttttcttcctgaggatcaaatgaaacaatgatcaaagaactttggtaaactataatccacatattgagttgtgttcataaaatgaaaacatcttcatgcccatgaataatcttcaggccccttggccttctcacagtgatcgtctcctgtcttcatagatctgcccattgattataaacactgcctccttgaaactcaagtgttatttcacggcagttattttgtatgggtagtcttccaaatgactatccatccagctagatatagacatttagatatcggtcattgtgtatatatatatgtttgtggtgtatatcttttgttatgacaatgaagccactgttttgaaagtgccctacctctctgcctcctttttctccttagcattccattctcccccaccacctataaaatgtagacatccctcatatatttccacttaactttattgtctcctttctctatacttcctccattcacatatttatgaagccactaagaacataagagcaaatacgacttgctgtgtttgttccattcattcattcagcaagcccctgccctcaggaagttgtcaattgagtggaggagacagataataagcaaggacacaactgcatatgatatttgctaattgtgacaagagcagtgaataacacaaacatggtatagataaggaacaaataacaaggagtgagaaggagggaaggcctaagaaggtgatgtctaaactgatgagaaggtggaggagggactgggagcctggagctgagatacagtatttcaagcaggagaacagtgtgagcagaggccttaggtgggaagaacgtgatgtgtttgtggagctgcaaaaaaaatcagtatggctggagcagagtaagagagagggaagtgaggtggatgcagctggagaggaaggaaaagaccagatcgtgcagggccagttaagccatgtatggaattcaaataagagcaatgggaagccattggaggattgtgtgcagctagtgaaccaacaggatttataaacctaaaagatttctctgatttctgcatgcaaaatagattggggaattatggaagccgaaggacctggtaggaggctacgataggtgtctgggcgagaaactcatatagatgacccccaaatctatgtttccagaccagatctcttttgcctttgattgctagaccaatggttctcaatatattgtccctggacagtggtgcactggcaccaccttgttatttattctttatctaaacttgttctttatgagttggcttttgagaaatacaattcatgtgcccccaccccaacctggtaaatcaggaactctgggggttaaactcagaaaactgcctttaacaagctctccaggtgattctgatgcatggtaaagcttgaggaccactactctaggctagtggttctcgaaatctagtgacatcaggatcacctgtagtgcttgtaaaaccacgcatctctgggccccatcacagaatttcagcaggccagggattgggaggagaaagtcaagtggctttataaaccacttccaggtgatgtcaatactgctcgtttagctaccacattttgaaaatccccaactacttaagtgacacctccaccaactatccatcaatacttcaaaactcaacatgtgcagaaccagattcattcatgtgtcacctgcccagccgcccacaagcattttctcctaccttgcctgcttgccaccagcattcttattatccagacttgtgcctgccctgtcattttcttctcttacctcctatattcagccagttttcaagtcttaaagctcataattccaccttgtctttcctgtttgttcactctattttgtcaccacctagttcaggttctcattgtctcatttgggtaactcgtttttggtttgtttgttttgtttgtttgtttgttttttagacaaagtctcactctgtcgcccaggctgcagtgcagtggcacgatgtcagctcattgctacttccaccccctggattcaagcaattctcttgcctcagcctcccaggtagctgggattacaggcacccgccatcatgcccagctaatttttgcattttagtagagatggggtttcaccatgttggccaggctggtctcgaactcctgatctcaaggatccacctgccttgacctcccaaaccgctgggattacgtgagtgagccaccgcgcctagcctgggtacctgttaaaatccattaacaaatcacctgtcctaattctgtcaacaattaatgaattaatcattgtttctggggatggagaccatgaaggtcttcaggtgatcttataaatattaaacagagagaactacttcaaagtatcccatccttgaatatgcattagaatcgcctagcacactttttaaagctactaatgaccagcggttgtccccagagattccgatttaatgggtctcactgggaacccagacatcttttatttcaaagctgtacaggtgggctgagaaccactggaatatatgaaagcaccccaacagacaaaggcagtcagggactcatcagttggttgaacatagggactaaaggggaggtctaaagatgagagatgactctgaatagggttatgaaatcgggtgtcaggagctggtgaaggacaaaaacagggaattcaagggaagaactgattttggaggcaagaggatgcccagttctggatatactaagtgcaaggaggcagcaggacatctaaatgggaatgtcagtaacgttgttggaatgtaagtgtgaagcatgatgggtctgttctagagataatgattggagagtggtttacaaagaggtgatggttgaaggtgctgggtggatgagaaccctgagagagaaacttgagagaggctctgtgtttcccagtgtagtttttcaatctacaataaaatcactggagctgcttattaaaaatgcagatttccaagtccttctcccagaatgtctggttccctgggtcaggattggggccttggggatctgaatttttatggcttctaaagtgatggcaatgcacactaaaatttgagtaccactaagcagagcagaaaaaaagaaaaggtgtgaggacagaaacttgaggaacatctatggttgagcaatgaagactaaaagagagcctagcaaaaggaagaagagatgaccagtcatagtggtaagagtagtaagattgtgctgaatctgaaaggcagtgagaggagtttaaataaaaagcaatgggcaatggttttctgatagccaatgcctcaagtgatacagccattgtgtccctgcattttcctgttttaggtcagggttgctcctgaccaacctaagcttaagaccagccttcctttaaccagagtaataattaaaaacccccaatttggggtcaaaatgctatatttgaaccaaactttcttctgtgaacttttctacatagtgtgagcaaataacctccctttggcccattctgccatctgtaaatggagatgatgccaattgtttaatgtgattgttataaacaaatagcatcatgcccataaagtactgaatattgtgccctagcatttatggactgtttgataaatggtagctactatttatatgtccaaaagcactatatgtggcatattgaaagtgctctaagaaattgctgaatttaagtttgatatgtaacaaagaaggaatattcctcagctgtttctagtctggttttgtgactagctatcttggaatagttatgccagatctgaagcaactgaggcagtatggccagctgcctttggaaacaagatcaaacgatcaataaatatcagttgagctccatactctgtgcatgcaataagactcttgagcttaggagtctataatcagactacttataaaagggtaccaaatgagctaggcagagtggtgcgtacctgtagtcccagctaccagagaggctgagttgggaggatggatcacttaagcccaggatcttaaaaaacaacaacaacaacaaaaacaaacaaacaaacaaaaataacacctttaaaagaaagggtagagggtagaaaatcaaccattataggctacattgtatagaatgtatcttataggagagctgttaaccgagatggttaaggaagattccataaaggaattaaaattgaacttccttagtctggttaaagaaaccacaggggcagggcacggtggctcacgcctgtaatcccagcactttgggaggccgaggcaggtggatcacgaggtcaggagatcgagaccatcctggctaacacagtgaaaccccgtatctactaaaaacataaaaaattagccgggcgtggtggcgggcgcctgtagtcccagctactcaggaggctgaggcaggagaatggcttgaacccggaaggcggagcttgcagtgagcccagatcgcgccactgcactccagcctgggcgaaagagcaagactccctctcaaaaaaaaaaaaagaaagaaaaaaagaaaccacagggccctatgcacattaaagtatctccttattgacttgaaagagttcatttactcagtccagtggtcttagtccttaacaattcttagcccatgaaccttgaaatctgaatgtttttattatatcaaataatgaaagcaaaatgcacagctcatgaatacacagtttaagaaagaaagctttttggctggatttgacaaattggatatgcttaacacaatgacggcatcacttgaggcattggctagaacaatggaagggggtagatacagtttttgaaaattgcaatttttcaaggagtattaggaaagatattttttctcaaatggggagaaaattagttgatgaaatgtcatgattcttatatccaaggcactaaattggcttctgcaaatcttaccaaagatgaacacaagaaggttaagctcttacgtatctggtcccatctgaccagcaggggcaccttgtaaaagaaaacctaccatggtgggctcagtcaattgctgctgtcatgcattactgcaagttgaggcaaattacatcttactataagtttcatcatatttctaattcttgatatgactcagatacttggctcctgtattgataaaccaaagccaaacctataaatgtagttggccctaaaagcaacaaaagcaaattaattaattgaattgaatcatgaatatcaattttaatagactattatactggtttcatcacttatgtatcttttgagagtcactaattatattatcatagttttggctaactttatttaggacaatatttttccaaatgagaatattttgatactttataaaagaataaaagacttttcagaaattttacatttaaatgatagtttaacagcagttaattgttcaggtaaattacaactccaaagagtgggaaaattcagaaatagtcacagaactgctgaaatcaatattggaaaatcacagagaaggaaaacagtaccagaaaactggaaataggcaaatatcatccagatttttagaatggaaaaagagggaaaactattaccattaagcctgatagccctcatcaaatttctagaagaaattaatttaacatttatagactgtatgccctctcactctcgtgtgctttgtaaaagttagaaaataaagcggcaatttctaggagccagcatgaatttactaagtagtctgatgaaatgttttcttttaaatcacaagaattatcatgttcaagttcattctactccaattatttaagtagcactgctattacatggcttccatgctccataagaagactagactacatttaaataaataaggaaagcaacaatgtttttcactttccataaaaccttttggagctttggtgtcttcatctacaaaatgtggacaataataatccctgacctatctctatgatataaattatgagagagtgctttttacaatgttaatgacatgttataataaagtaatcttacaataaacaagaagaaaaagggaggaaaaggagaatgagggaggaaaaaataacagtaggaaatgcaagtgtaatttttttttaaatttgagcgtagaaaaagaccttcatgaaagaaccgtttcattttttttaatttaagggaaataaggcccaggaaagttaagtaacttgtgttgtctcacagcaagttaatggtgagaagaaagaaaatcaaaaagggaaagaaaaaaataactaaattagaactcaagaagaaatttgtgcaagaactgacccaggaggtctggtagatctagccaggccccctcgcttaactctgaaaatgctactcagccaagtggacccctgtcggaccatggtttcctgcacaataatttcccaagggtctcaaatgcaaggtcaaatgcccgcttccatcctcagtactccccagatcttgtacacatacctctccctatgtttagagaggaaaaattagacctatatacaattgctttgctctcatacctccattttaaaaaggaagctacaaaatataaaataaaatcttttatattactttaaagattcaaattactttaacaattcaaagaaaattgtacattctccaaaatactgtagatggtttttacagcaccaaaacatctacctgtttgatttatcgaaaaaggaatgtgtctattttctcttgtaacttaatgggttttttcttttaatagcaattaagtcagtaaaactaacaatggtgggacaatatgagtcacatttggagcaattatttaagggataaaaactttttaaaatattttatgtagaaagacaagttttttttaatcgagttacatcttgttacagaagtgaagataatgaaagggacattgccatgaaataataattttagaaacagcattaaaaaaaaaaaaaaacttctgaccaaatgttatgttgctctctagggttggaaaatagttgtttagcaaactgttgtagttcaaatcatcacaacaaaggtgtgtgtgtttcttactatttgtgtattgtgaacacatttgaaagcctgttttattcctatgtttgtatgcatttcggtttcaaaagtactaaagccaccccacatggtaaagaaataaaaggggaatgatttccttaaattgttgtttttgtcaatgagacagatctgccactagcccagcaaacagccaatagcagatcataaattcctttgctttgagacagactgccctgataacacaggtcagtggttccacaggttagttctgaatacagactcaggggactgaaagtccctgcccaaaaaagaaaaccaatttgtgtgaagtgagtttcaggaaatgtaacagaaaggcattcatcctaacaataatttaaactaatttaaaaaaataaagtttttactttctcctcttcatttccaaagtcactgtttcaaaaaccatccagctacttgatgatactgtcacagcagtgagagctgataaacacctagttgaaggctatgttttagagctcacaaatgcactgttgaagtcctgactgtgaccagtatagttagggacattttgaccaaaataacagttatgagtcagttgagtctgatcaattaagctgtctatcatggtcaaccaaacctgaatctgtcttaattcaaaaagcaacttttttgtatcacatcatgcccatttcatttgcttcagtattatacattatacatcgcattttggataactaatcaaatgcatgtggattatacataatgtaaccataagtataaaacgttgctcctctttgactgcctacattccacctcgaccctagtggctcatcagcttggacttttcttccacaccaaatcccaccacttcatgccacctctgccactgctacactatcccaccatctcccatctggagactttagtccctcctgcgcttccactcttgaccccctggtctattctcccctttaaaagggtcccattgaaaattttggcaaactatgcatctaacaaagatctaatatccagcatctataagaaacttaaacaaatttacaagaaaaaaacaaaaaattaaaaagtgagcaaacagacacttttcaaaagaagacatacatgcagccaacaagtatatgaaaaaaaagctcagcattactgatcattagagaaatgcaaatcaaaaccacaatgagataccatctcacaccagtcagaatgcctgtaattaaaaagtcaaaacataacagttgctggcaagatcgtggagaaaaaggaatgcttatacacagttggtgggagtgaaaattagcgcaaccattgtgaagacagtgtggctattcctcaaagacctaaaaacagaactaccattcgacccagcaatacattactgggtatatacccaaaggaatataaatcattctattataaagacacatgaatgcatatgctcattgcagcacgattcgcaataccaaagacatgaaatcaacctaaatccccatcagaggtagactggataaagaaaatgtggtacatacacaccatggaatattattcagccataaaaaagaacaagatcatgtcctttgcagaaacatggatggaggccattatcctcagtgaactaacacaggaacagaaaaccaggtaccacatagtcttataagtgggagctaaatgatgagaacacatggacacatagagaaaaacaacacacactggggcctatcagaggatgggaggaggcaaaggatccggaaaaataactaatgggtactaggcttgatacctgggtgatgaaataatctgtacaacaaacccccattacacaagtttacctatataacaaacctgcatatgtaccctggacttaaaagttaaataaatatataacaaaagggtcccatcagaaggacatttctaaaacacagatctgatcacattactctctgatctgaagtccttccaaagacctttatgggatgggcctggacacctctccaaccttacctcctgccatcctcctcctgttattccactccagccatgctcgcctccttgcagcttctggaccacaccaggcactctctacctcaggaattttgtcctactgttgtctttatatcgatacctgcatggtgcaggcatctgctgaaatgcctactcagcagagatttttctgaccatcttatctgaaataatagcacgtcaccgccacaaccaccacccattgctctctatccctttgccttgattttgcttttttcagagcatttttcatgttatattattcacttgagtttttatttaatgactatcttgtcacattagaataccagctccatgaggtcaggggctttatcctggtattcactgctgtatcactgtcacctaaagtggtactaacacaaagccgggcacggtggctcatgcctgtaatcctaacactttgggaggctgaggcggtgaatcgcttgagttcaggaatttgagaccagcctggacaacatggtgaaaccctgtctctaccaaaaaaaacaaaaaacaaaaaacaaaaaaaaccacaaaaattagccaggcatggtgtcatgtgcctgtagtcccagctacttgtggggctgaggcaggaagattgcttgagcttgggaggcaaggttgcagtgagccaagcttgagccactacactgtagcctgggtgacagagtgagaccctgtttcaaaaaaataataataataaataaatataaaaaataataataataataaagtggcaccagcacagagcaggccctcaataaataccatgggatattaaaaaaatagcttcagatgtggaggaattataaccctggtgcattattagtgggaatatataaaagtgtaatcatttttccaatggttatgcatagaaccaccatttgacccaagaattccactactagatatatacccaaaggaatggaatccagggacttgaacagatatttgtacactaatattcatagcatcactgttcacaagagccaaaagatggaaaaacacaactttcaattaacagatgaagggataaacaaaatgcagtatatacctacaatggtacattattctatcacaaaaaggaaagcaattttgatatatggtgtaacatggttggacactgaaaatattatgcttagtgaaataagtcagatacaaaaagaaaacattatatgattccactaatatgagatacctagaaaaagcaagttcatagacagaggatgtagaatagaaattaccaggggctggaaataaggggaatggagggatattgctaatcaggtatggagattttgttggggataatcaaaaatttgggtatagatagtggtgatggttagactacattgtgaatacatataatgctactgaatcagaatactacgcagccataaaaaaggatgagtttatgtcctttgcagggacatagatgaaactggaaaccatcattctcagcaaagtaacacaagaagagaaaatcaaacaacgcatgttctcactcataagtgggagttgaacagtgagaacagatggacacagggaggggaacatcacacaccggggcctgtcggggaatgggggacggggggagggatagcattaggagaaatacctaatgtaaataacgagttgatgagtgcagcaaaccaacacagcacatgtatacctgtgtaacaaacctgcacattgtgcacatgtaccccagaacttaaagtataataaaaaagaaaaatctctagacaggcaggctagtgtgggaggaaaattttaaaaatgctactgaatctacacatacaaatgtttaaaatagtaaatattgtttcacgtatattttaccacagtaaaaatatgcatagccaagaccagaaaaaaagatagcttgaaagaataacatttcttcccaacttacactgacttttaggaaaacagcaacatgcgatgtctgtgatagttcaggtgcaccaattgcaagctaacaataggaagacgaaagggaaataaagcagagagacagagaatattgtacattgaaacagctttgcaaacatggtgcattggggacaatatctaggcaagtatgataccatacctttctctcctgcagtggaggtttaccagcccagacagctaaataatccttcaatccttgactttcagaggaaaccgcgggggtccatcctgattcgattattcatccaaaacagacttcagggctttgggacagctcagttccacagggtcatccagcagcctgggttccttctggttttttgttgttcttgttttgccttctgtggaaggttctccaaaccagaattgttgatgttgtctcaccagtaccacttctgcaggaaggggaaattgaagaaattaagaacaagcaatgtctttttaaggaggtgatacaggtgtttcacatatcacttttgatcacagttgagtttagtcacttaatcaggtttagatgcaaggaagactggaaaatcggactgtagctgggtggccatgtaatctgctaaaattctgggtcgggaaattattctacaaggggagaatggatactgggggacagtcagtagtctctactcaactgattagtcaggcactactggggcaacctactttcagacagtattcaaggccctatacggataccaagagaatatccaggtttgagtagttcccagtctttcatgtgtcataagacaagtacacactataacacaaggtagactataaaattcatagtaagacacaaagtgctaccaaaggagttcaaagtagagacactgaccatcagaaactgagctgtccaaatgctttccaaactgatggtcaatctctctactttgaagtcctttggtagcactgaggttgctttgaaaaacagggagtgaaaggagagcattttaggtggaacaaagggctagaggggggaatgtggagggcatgtctaaaaaaagcaaacctcatagtctggttcagttctagcacccactagggatcagggaattctcggaaaagagtctgaggacttttcatttctatttacctggcatgaaaactgacagagagttttcgaatagggcagtaatatggtcagagttgtctttataaagaccatcagtgaatatggaaggggtgggagtaggtcgagactgaatatggggagacaagatggaaggtcagagttagtgtctaaagagagttttctgataagacagttttataggaaacaaagaaataaaatacctttgccctggtcaaatattatgctgaattacatgttaataacacatatttattaagtgccaacaccatgcttaggctagcagctctcaaacctttctgaccatgtataggaagaaacaaatttcctcccccaatccattttcacaaatatatttggaaacaaaggtttttataaaacaatacttcagccaattcactctgctgtttgtctactctatttttttttcttaattttagaccagccactaaattatttatcacttgaaaaaacacttctttaggtaccacgagataggtaggaggaatacaatacagtagctatccaagtcttttaaaagattatatctgtcaagagaaggaaaaacaggcacaaacacaaatgactacaagacaaggtagggaaatcgtggagttttggatctggaagggacccaagaagacattttatcttaacatttcttgtaatcagtgggaaagcaaagctcagcaatattaactaattcaacagcacaaagcaagttagtgctgcagacccaagataagcagagcctcttggagaggtcctaggaccttcttatgttgctaatttttttaagcataattttttaaagtgtgttgtattttaattttatttcatttgcattgagtaaataatgctttaaatacacataccacaaatactactcagaagttctattcatttgataagcgtagcatttctttaaatattcatttatagtatattatcagtggtgtgaagtggcaatgggacacacatttaaagttatataagaaatggcttatttcagtccagtcagtggatctctgtgactgaattctctctcctttaaagatagtatcaaaggtatacatttgaggctcttaggtccttcagaaataagcactagtcaactggaccaacaaaatccttatccccaaatccccatctccatcatagtacccagcagggggctgggtactatggcacacccctgtagttccagctactcaggagggtgacgcaggaggattgcttgagcctaggagttcaaggccagccttggcaataaaccatctctaaaaaagaaaaaaaagaaaaagaaaaaagggcaaaggtatattgagtcccagttctactcaccagtctcagatatgatcagctcctcaaaatactgtgctctttggagtcacattgttgtttttgcatttttcattttgtcctttagtatatgaggttatggctttgatgtggctgccaaaaaaatactgaatcacatgtttcaggtaccacatcttgttggtcttttgcacaatttttcaccttggctatcttctacttagaaaaatattataaagtaaacttctaaaattttaccagttaataatgtcagaattttccattaaataacccatgttaatgtccttcatactaatctctctttgttttcaatttttttaagcattgctctattaaatcatgttaaattaaggtactctatccttttctggtagagtttagaaaaaattgattgtgatagtctacattcttatttgacaaatttagtaagaaagttgggtattttgaggtatagttgcaacagaaatattctaatgtttatctaatctattttatcttacaaagaatagttgtaaaactcgtgacagtcacattttgacattacaattttttgcaaattatcatatggtgttagcatttgcttaaaaattgtttaaaggacagttttatatatatgtacatatggtataagctattaaattgtttattgtaaagtaggtaatttattacatttctttttaggcacttttgccaacattttaattagaaatttatagatattttttgcaaaatataacaaaacaaagttgtttacagttgcttttgatatttgtggtttaaacatagttgtattgcatttttttaacaactaaatgacttccacatgaagaggtatgctcactctctctcctctccattgaaacccacagacgtcttgcgggaaacgctctgacatacattcccaagggagcattcactggcctttacagtcttaaagttctgtaagtaaactgagtgttgttggatatatttctgattttagtgtcaaatggctgctaattaacttgtaaaagctgagtgtctctaatacactatttaaatccatgggataattcatctaaattcaagtttacttcattggtaccatacagccatatcacacttggctaaatttgtatgtgaaaaaaaattcatctctccttttctaattttaatatctaaaatttttgcctttaaataactaccttatcaactcagacttttaaaagagtatttccctttccctttgtgttatgaaattggggtgcgtgtcttcaaaagcattttgatgacaggatgaataaatcactgtgatgctgacataatgagaccacagcttcaaaccggtttcaaaggggagtgaataagcatcagctaaaaaaaccaagtttgtgttccacctgtgaatagatagggtaaagcctagtgtagagcagatacactgaacagttgtttatttgttaattcattgaaaattgtaaatatgaggtttctcattatttaatgtccaatttctcaatttgtttatcagaaaaatcattattattgaatacttccttcttctggtacccattgtttaattttcttttagtttgttctgtgtagaaaaaagaggcacttacgtagataaaacagataatgcaaggaaaagtttatctcagaaaaaaaatcctgattttctttctttgacataaaagttattaactttgatatatttctgcttattgaaaattacatttcagtgacctaaaagacacataggttaaaaaaacagtttattcaatttaatattttgttaaaagtgaaattcaacagcagaaccgttatttgatcgccttaggagattgggtttggtttcccttcctctctttgaatttttttcttttctttctttttttttttgctactaagaagaaatgcttttaagttgtcatgttgccaaatcctaatagtaattccttatgtggtaaaattcagagttgtagcaccagctccgatgcatatagtttcacaaaccccccaaaaaaatttggaaccattcaaaatgtatcgtgagagtcaagtttagataagacaactaaagtgattttttttcccatgttgagctatgtaccactaagtatttgggatacttgtgaaataaattttactagaatcaagtattttaattcacttaacaaagtgtatattggatatataagccagtgtgtgtgtatctccagacatcaaattatactttaattataaatgagtaaaatgaatacatttaaattaatatggatatatatgaattatatataagctagttattataattacatataattataattttaaatccttgaattcttaaatatgaattatacaagtcttatactaatttttctatcatatttttatattttatattaatagttataccattatatatttctaattgtattcactagtgcattactagagaatgtttgtttcccacaatgcactaaagatctatgaaattagagatgtcatctgtcttggtcactggtatatccccagctcctagaacacttccttacttagagtagacattcaataaatatttgttgaattaatgattcaggctgatgatctagagagaataagggagttctagatttttcaactttttcttcatttttgtatgatattgacccaatgctgtatgtttattaatggaatatctattgtgtattaaacaaaaaagttgtgccttcatatctgatatgtacttttacctacaaagaggctttttacccagaatgctcctgcacacactttgctgcttcttaaggtgcattttacctgaagactccagagtggagtggattaatatgattcaaaaatgagaagcatagattatttctcatgctaactattaaaatgtaccctttccatcagaaaaaaaaaaatggtatttagaccctctcttttatccactcctactaaccaatgtttcctgtctcctgtacagtcaagggttcagcaaagcctagtgcgtgtgatactcaaattagcattaaacaaattattactagaaatataaagatcaataaatattgttcatgcccttgaagagtttataatctagtgacagactgtgggaccaagatagtgggacgaagacagaaaaacagagatcacttctgatttttgtggaaagtgtatctagatatctgtgcagggtactgtgaaactacagaggttggggagttgatgtcgtcccatctggtggctcagatttggcttcctaggagagaggctttcccagagatgacccaggagctgaatcttgaagcacaactaggaattagccacccaaataagatggccgactgaggggacaatacgtacagcaacacagagtcagaaaggacctgggatgaacaggtagctccaagcaggttagtacttgagcattcaggagaagctacagagcatttggagaagagcttgtaaagacagaaggagtcccagttgcagggatcccatatgttaagtcacatgggtggacattatgaggaggcatgatgaggagtcaaggaaaagatgtacataagtgagggaaggccatgttcagactttgcactatagctgggtccctgtcagtgtgaggagagttcaagaggaacaagatcctgccagaaattgtgttcactcttctttttactttgctgacctaaagactaatattcaatgaatggactcaaattgtcaaatatttttaaagtattttggtttttgtcttaggttgtttgtgctatgataacggaataccgcaaactgggtaatttataaagaagagaagtttatttctcacagttctggaggctgggaagtccaagatcaaggtgctgacatctggtgagggctgctttctgcttccaagatggcatcttgagagccaaatcctctggaggataggaatgctgtgtcttcctatggcagaaggtggaaaggcaaaaaaggaataaacttcttccaacaaggctttttatgatggaattaatctatttcatatgattgtactccaaacatttttaaggcgataatacaaaatatttataaagcaaacttttgaggaaattcattgagatcaccatttcttatttttctgctaatttaattaaaacatctcccaaaggctctacccaacacctcccaaaggtccccacctcccaacactattgcattggggattaagtttcaacatgaatttttggagaggacaaaaacattcaaaccataacagcattagaataatttttctcagcaatgttggttctgcctgttacagagtgttttggaaatttgtgggagcatctttggttgtccagatgattggcgtgtagcaagctgtcctgcaatgtgctgcacagcccagcataaagaattctcccttattctggcttcttactgtccctccataccaactataaatcagtactttaatgtgtaattgtattgaaacgttttataagatgttctgcatatgcttaataatttgcacaggaaaaattaaatggaataaacagtttctctcaagataattaaataagtaacttagtttatacatcctgtctattcctgatattttaagatttctagccacacatttagtttaaaatcgtgttcgtagctgggcacggtggctcatgcctgtataatcctagcactttgggaggcagaggtgactgaattacttgagctcaggagttcaagaccagcctgggcagcatggcaaaaccccatctctacaaaaaatacaaaaattagcctggcatggtggcgaacacctgtggtcccagctactcaggaggctgaggtgggagggaggatttcatgagcctaggaggttggggctacagtgagccaagattgcaccactatactgtagcctgggcaacagagcaagacctgtctcaaaaaatatataaataaaataaaatagtgttagtgcagtagaagaattacctcaaaagccacaaaccaaattaaaaatatatagccatggaaatgtgcaacctttttaaaataactatcattaaattaccagagtaacaagaaacacaggatctcattgaatttcatcaacaaagtttgctttataaatattttgtattattgccttttaaagtttttagagcacaatcatatgaaatttatgttgtgataattatataatgatttatttatctgagggtggccagcttgttgcttttttaatcttactgttttactgcctagcaaagtctaccacccaacttctgagaaggcagttttgtgactatttctttgtccaattcagcctcaattctctgttgcctatggagggatctccagggccttttaaagtactggggaattaatgcttgcttcagaatgttatggaattttgagacaggataaatattctctgtgatatttccacactatcttaccctaacacatagagaattattttgacactattcatctgtaaggaacactcacttgggagaatattcatgctcaattgtgagtgtcacacttcctgattttctccactatgacgtttgtaatttgattggcatgttatatttattttaataaaggttatttccttctttcccttataatatataacaagtatgatctgttattacatatcgtattagtccattttcacactgctgtaaagaactacctgagactgggtaatttataaagaaaagagctttaattggctcacagttctgcatggctggggaggcctcgggaaacttacaatcatggcagaagcagcaaggtatgtcctacatggcatcaggagagagagagcgaggggggatctgccacacactcttaaaccatcagatctcgtgagaactcactcactatcatgagaacagcatggcagaaagcgcccccatgattcaatcacctcccaccaggtccctcccccgacctgtgaggattacaatttgacatgaaatttgggtggggacacaaagccaaaccatatcagtgtctcaactagtttttattctagtatccatctagatctctactctcatgttcccattctcatacagaatggcttttgatcacgttatttttctcacacccaaccttattctttaaaagtagaggcaaatggctgggtgtggtggctcacacctctaatcccagcactttggaaggctgagacagacagatcacctgaggtcaggagtttaagaccaacctggccaacatgctgaaacctcatctctactaaaaatacaaaaattagctaggtgtcatggtgcacccctgtaatcccagctacttgggaggctgaggcacaagaatctcttgaacctgggaggcagaggctgcagtgagccaaggtagtgctactgcactccagcctgtgcaatagagtgagattctgtctccaaaaaaaaaaaaaaaaagtagaagcaaacatctgattcattcataaaaatgtttcctgaggtagttgcatatgagcatcatgtatataatgacacttacatcatcttactataaattacttttcttatatttcttctttataatacatttagggcacaacaataaagtatattgattttttctttgaaataatgtgtgtaaataggctataattctatgaattttacttaagtataatagaagtggcattacaaaatatttgttattaaagggaacgttgaatccaatatagttgagaaccacagtgctagaggtaaaatgctgaacaagatagtcctgtcccctactctcatgaaaactctcttaactgttttataaagtccaaaagtggttggagaaaagaaataactaatggtattgtgatatggtgagaaagataatgtgagagtaatatttgtctggggccctgacctgagtaaggatggtaaagagggcatatggacaaagaagagaaaaataatcttgatccagtctattaagatggagaatgaagacagcagcagccatccttggctaggtctgttttacatttactgtgaatgctaaaacatcactaatatttaaagttatttttcctgtaaatattggccctaataaaaaaaataagtaattggttctgtatggcaaaatacccagtccgtggaattctgaaccaggctgtcctcaacaaaggttcattttctagtgtaagccattccatcaaagaatggctcatccttctgccactcaacaccaaaaccaaagccacatggaggtgatgggtaaaactaaccatagaaaagtcacaattaggcagaattcccctgttctcatgtagacccagaatagagccttgatggttacttgatatctacacagaggacaaataggccaagggaatacctaagaattgagccatcagttgtaaccaagttcccactcagcaggttatttaatctccctctccttcactgtacctgttcttacttagtcctgttgggaaaaaaaaaaaaaaaaagtgggggagggaccaaaaaattgtgtagagtagcatggggatgctgtatgaaatagtgattattttaaagctcctggggcaaagaaattaagaaaatatagaagtcatcttttgtctctagagaaagtattccatttgcttttcctaatcatatgtgaatgataaaaatgaagttttaagtgcctacacctatattcagtatctttatattgcatgtactcagtaaggagtattttcaaaagaaatcagcagccatgtgtaaatgttttgtttcaattgcaccccctagcactataaaccttgtaattgttttccctcccattggaatatcttaaacaaaaacagaatgttctaattaacccactggagacttataatgatataataaagataacttgctcttgttttgtcatttgaaagtaattaaacaaaagttccttatttagggagtgatcagggcttaaattgtttttttgttttttaagttatattcttggtgttttactggtagacgtagttgaaaatttaaatcattaggaggtaacgtgggggtagctttaaaagttatcatcggtcaggtgcggtggctcatgcctgtaatcccagcactttggaaggccaaggtgggtagatcatttgaggtcaggagttcaagacaagcctggccaacatggtgaaaccccgttgctgctaaaaatataaaaattagccggcggtagtggcgcacgcctctaatcccagctactcaggagactgaggcaggagaatcgcttgaacccgggaggcggaggttgcagtgagccgagatcgcaccactgcactcccgtgtgggcgacagagtgagaccctgtcccccctccaaaaaaaagttatcatcactaaagttcatttaagttccattatctgaagaaagatatataaagcagcagagaaagttcgcaactattcaatgacaaaaagctatctgaaactctcatcttccacctcaatttttcagatattttagggaaatcatattttaagagttccactgtttggttagtaaggcaaaggacaatgcaatacataccttgtaccagtaatatattatttattaataaaaagtttagacatcaattaattctattatctttatcttatttaaatgtaacacaaaagtaaagaaatacttagaaaacatttttgtgaacttaaaattggatgatggattgaaactgcttgggaaaatgtaaaataacaaaaatgtaaaataacaataaaataacacagaaatccaaacttttaatattcagataaattatgcaaaacatagaattcaagtttcaattctcctaattccctaactggtaagtgaagtgtggggatcttcctaaaactcacctttattcctaaggaaccaatacatttgagactcttgatttatgaaattttaattgaatctaaatttaacataatgaaattagttgagtagaactattgtaatacaaacgtaattacgttccttagaaaaaactctcaggcatggtgttaaaggcataatttttatgatctccaaatatttttcaagtcttgtttgtatatgagcacgtatttatatacataaaagtactataaatactttcatattttaatcctccaacaccttttcaaccagatgatattattcccattatacagataaaagaccaagggtcaggaggttaaatgagtttcctctccaagactaaaagcttaggtcttgtctgcaaacccagtgcagctcttcctcaagttcaaatgaagattttttttttttttgagacagggtctcattttgtccagagtaggtaggactataagtacatgcaaccactctcacttccccaagtgaaaatatcctattagaaatgtttagatagctaggtgtagtaactcacacctgtagaccaggctactctaaaggctgaggcgggaggatcccttgagctcaggagttcgagtccagtcctgggcaacaaagcaagattctcctacccttcgtttctaaataaataaatacataggctgggcgtggcggctcacacctgggattacagaatcccagaactttgggaggttgaggtgggaggatcacttgaggtcaggagtttgagaccagcctggccaacatggtgaaaccccatctctactaaaaatacaaaaattagccgggcacggtgatgcatgcctgtagtcccagctactcgggaggctgaggcaaaagaattgcttgaacccaggaggcagaggttgcagtgggccgagattgcgccactgcactccagcctggtgacagagtgagactccgtctcaaaataaataaataaataattaaataactaaatacataaatatttagcacagcatggggtagttctcagtgtgtggtgccctgctcagcagtattggcgtcacctgagagcttgttacaagtgtgaatttcctggcccttcctcagacctactaaaccagaaactttgggatggggcccagcattctgttttaacaaaccttccaatggcttctgatgaaccctaaagtttgacaaccaatggcatagagttttctttttctctggctcattaaattgtcaaacccagtacaaaaattattagtttcgagaaagggcctattaatgtacattaaaagggccaatttttactgaatgcttatcatgtagcaagcattgttctatgaaccttcactcattgaatcatcacaatgagccctgcaaggtaggtgttattactgatcgctgaggcatagagagatttggtgattttccaatctctagtggcagagaagaggtggtcagatttgagaatccatattcttaaccataccgttcacatgcaatctgagaatttacacagtcagcacatatgcctcaagagaatgctgcctggtgcactggaaaacacaccaagctttggagttagacacacctgggtggaattccagctagtcaagtagtgaacagaaagaaacttcctttgcagagatgaaagaaccaggcagattgtttctgaaacacaaatacaagtttgcaacttaataagtagaaatatttctttaaaacttctgctttcctaaaatagtcttctgcctcaggcttacatggactacaaaatactgggagaaaaaaaatgtgctgcagaattcttgtgttataaacatttatgaataaggtagcaaaatataaggaatctcatgggaatttgtttccatgctatttcctcattagcaatgatatatttttatttcatagcttccaggcgtttccattctgtagtccccatattatgaaaaactgttcaagattttcaagtgcaagtgcaaaaacacaaatacttcacaaaaagaatttagcttatatcaaaataaagccatgcagagaagggagacaattttagcctcctaccattatccttatttccatttggtgtaacttatacaagtagcagatcctttaaaaaacatatataagagcatgtcattttcctacatatgcccttcaacagtggtttctcatcacacataaaataaagccttatggtggctggcaaagccctccatgagatggtctcaggctctctctcccaacctcgagtcctcactcattcctcagaaacagttggtcctttgctgctcctttaacaagtcaagcaagctccctccagcctccagcccttgtacttactcttctcttttccttggtaacttttcccaaatattcacaaggattttctccctgtattccttctggtctccagttaaatatcacctttcagagagaccttccctgaccacctttaaaataaaaatctcaccccctgataccatctatcccaaattcatagttttgttttttattcatagtacttatcacttgtctcatgttaatatattcatttgttcatctttaattatcttcactcttcacaggaatttcagctccccaaaagacaagactttgtctgatgctctgttgtttttctgacacctggaacagtgcctggccttgtttaggcctgttattgttcattttttttaacatttttctttatttcttttaacatacagtatgctgcagaataatcagctaagacacgtacccacagaagctctgcagaatttgcgaagccttcaatccctgtaagtatagtagacattgcaaaatatatttaagatcaatttgggaagaagcattgaaatgttcagttgaccattttagtatgttccttggttgggagtcatacctaaatgtattgtgaatgagagcccattagagtaacaactcttcatagcctcattgagcaatatgtatgggaggaaccagtgttggagtttggggttttagggtggacatttaattgcaacatctccagtccaaagcactacttccaagatcctgtcctacattcccttgtaatattcttgcttctgaattcgaataagaaatagtgctttccttttacctaaaaaaaaaaaatagatgctgtaatctagacattttgacatctttgatttattctgttttaggattatttgagttgccttgtaatcaagttttttcgagtcaaataaaggcttactattttagtactgcctatataatacattagggatcctcaagtcaggagcctaagatctactggtatatcctgaagcttccccatcacagaacacagatgtgcagacatggccataaacaatcccacagatacaaacataccttagattcacacaccacacacagacacatggactcacagaggtgttggtgttccctactctgaatccacaacttttccatcaggagtttcctacccccctacacacactgatttaaaacttctgaataaataaaattactcacaaaagaacattctcccagctaaatgttttggaacttgtattgtaagcagttgattgtagtgattacttggcaagtctataccactactatttagtcagtaaatcttcctcccattagaatgtataagtgtttacaatatactgcatgatgtccaatatatcacacgtgtgatatatgctgtaattttacttacaatggagatgcacatctgccaaacaaaatactgggttgtagttcgtgatgaggaagataaatgcattaaaagggcaaataaatattgataaatattgtggactccagctgaaaattgttgtaaagaatccttcggttaataattacatatagtttgcttaatgcgttttaccgaggtaacatagaaggaggactgtgagatttgaagatgatactttcgtcctttgatctttttttctttttaatgaaagaaaatctgtgcttgagatcatttcaagccttttactccagtcaaacaaagtgacttcctaggttttcaccagcctatagataaacaagcccacaagggcccctttgtggtatgagataggtctgttgtattttctggagctccttaatgtcatgacagtatcacttctcctttgttgcacaagcctttacctgaaggaaagaagaaacagctggagaagcaaaacagcctcaagttggggtatctgtgtggcaaaattgaaatggtgataatggcggtagccagtaggaactttaaacagctgcaaggcaggcagtagatagaaggataagagtttgtaaccaaaagccactatcagctgaaagaagatcacaaacagaacacaaacagaagtgaactctttgagaaaaagaaaaccatgaatcttttgttcactggaactggtggtgcctgcctgataaaggtgttcagatttagtttcttacagtctagatattcactgttcaccaggtgtctctacatttggtttctggttttgcaaaaagaataacattttgaaactttataactatgtgttccctgtgaaaaggtcaagggttaactttctggtttgacactgaccacatccaaactaaaggatctagatagatactcggcccccagttcacactggattgtatcagctgggttatgcaatgtttgtcaggggcccctttgtccagagcacagacagaccagtgtgagtgttgaatgttgacaatgtgtgccagtgtcccactttttctcactgatattttttgtgcagctttgatgcaagacttaagagttgtcaaaaaaaaaaaaaaaagcatgatatgttgggaggttaaagtgggaggatcacttggaggccaggagtttgagatcagcttgggcaacatagtgagacacccccactgccatctctacaaaataaaaattaaaaaacttagctaggtgtggtgacatgtgcccgcagtcccagctagtcgggaggctgaagcaggaggatcacttgggcccaggagtttgaggttacaggttacagtgagctatatcatgccactgcactccagcctgagctacagagcaccactccagagtaagaaaagaaaagaaaagaaaaaagaaaagagcatgataaacataggctgaaccaccaactctgcagataccatattgtaccaacaaaaggagtgccctacccatacatacacaaggccagtttggaggtttagggtatattgtgcccctttaaagttctattgtcctggttttaaagtatttaattgtacttctccttcttcctttaagcacgtctaaaaataaaaacattagtttgaatttactgatcattacaaacatgcattccttatccattctccattcattttccaggccatacgttagcctctgtgcttccgtatcaataaagtaatgatgagagtaggactctgcctcatccacactgccaatgcctagaaagtctccactccattgccatctcttcttggactggagtcaacccttagatcttcacttagcctttttttctacatggtttccctttttttttcttttcactctcttgaattcactttatttttctccacgttattatttttcttggattatacattcactctttaagaagcactctacccttgataggggctgtgagctcattgtctttatacatgcctggccttgtataaagagtaatggcaaaaaccacatttacttttgtaccaactgaataacttctacagcaggccttctcaacactggctacaaataagattcttctggaaagacccaaagcctagactgcagcctagaacaattaaaatcagaatctctggccaggtatggtggctcatgcctgtaatctcagcgttttgggaggctgaagtgggaggatcacttgaacccaggagtttgagaccagcttggacaacatagtgagacccctgtctctctataaaaaattaaaaagttagctgggcatggtggcctgcgcctataatcccagctacacatgaggctgaggtgggaggatcacttgaactcaagaagaattcgagggtacagtgagccctgatcatgccactgcactctctgaggataggactcatgcatgcactagtgttttctaactggcttaattgcacagttaagtatttcctaagtgaaaattaggaaaactattgacctgacctggagcattccctcagatgatctgcaaagtattctccagaactcttttcaaacctgaaattacaagcttgagtaatgcagtgagatgctgtctctaaaaataattaagtaaataaataaaattggctgggcgtcatgtgcatgactgtagtcccacctatgctggaggctgaggtgggaggatcatttgagcccaggagtttgaggctgcagtgagctatgatcctgccactgcactccagcccgggcaatagagcaagaccgtgtctctgaaaaaaaggaaaagaaatacctgaaataataacaaaatccatactttgcactcttctatgagctaataatatacttaaaatataaaagtcaggcattgtcttatttgtgtttaattgaaaacagcttgcatgcctatgcattccactgataacccagggagataaagttaagaggccacatgctctatcaccctgctattcagatttgttctgtgggccagcagcatcagcactgcctaagaaatgcagaacacttggtctcagctctgtcttacttaaaaaaatcttcattttaacaaaatcctaggtgattcgtaggcaaaatgcatttgagaaattaaaattgttagtgttctataacactaacaaagtggtctacaaatcaaaaatggttgaaaacgactgacgtagatcatttgcattctttgctccacccatatacacttggcttccttgaataaagtttaggaaatttgatacactgaaattggtaacattgctgtcaggaagaaacaaattgtgctcatgtttcaaggaatgttaattttccacttattccacatatacaaaagatgttttgttcataatggaaacacataggtacacttgtggtttttttgttttgttttgttttttgagttggagtctcactctgttgcccaggctggagtacagtggtgcgatctcagctcgctgcaacctccacctcccaggttcaagcgatttttctgcctcagcctcctaagtagctggaattacaggcacctgccaccacggctggctaattttttgtatttttgtagagacagggtttcactatgttggtcaggctggtctcgaatgcctgagctcaagtaatctgcctgccttggcctcccaaagtgccgggattacaggagtgagccacagtacccaggccacttgtgttcttttaactcttctgatgctaacaaattgctgggctaaggaataagagtgcaggcccacaagccagagcccagaagcccagagcctgcccctgtacagtatgtacatttggcttctgacatggcaatgacttcccagacaccaattagattttttgtaatgtaatcaaatataacctaatttcctttctgttttttggaagggaataggaaatgtaatcagaattcacagtaagctgtattttaccaaaaaacttttgggagtatagacatttgaggactagaatcagattacagtgatttgatggaaactcaaaacttaaccctcccataccctcacacttttatattaatagttaagaaatcaatctatttaaaaaattgcttcatttgtgattgtcattaatgaattttaagcaactcactgtcactagtgaagttcaagatgaccaaagagagttgcatattcatgtttgtccagataaccagagtactatttaatgcctgttggtttttattccaagtgtgcacaagtgaagctaactgtggaatttgcataatcgcaaaggtaataggttggcaaatagaaaatgaaagaagaattaaacatatctttattattgtctctattctccaattaactaatattcatcttcagaatatgactatattttaaaactcaagaataatgtataatttctgcctggcacaccagctgcccatacatcttattatgatatcatcttcagggctatagaacccacccctggactctataaaatgtcaataacttcatcggattctgcatggtaatcttttccttacagtagtcaaaaaagagagagaaaataagtgagaggaatgggtgaggaggaagacatggggctcactgtgctgagcaggaggtaagacaagcctagaaccaggagcagttttctcccattaatatccaggaggctattgggcttcagacatgggatatagaatgggaaggaagtaacagaagacaaggaagtgtaagcagaccaaaagaaagaagatgaggtagccaaaagaataagattaaaggatcaaaggggttaaaaaaacagtggttttagtattggtgatattccttccactaaaatagtctccagaaacagaaatcacaagcctatacaataaaaatgaaccgtgactttagtttgttttgctttcttcacaaaagtgccagggtattaggtacgtattgggatggaggtgaacttagaagttctagaggccaaagcatttgtctattgcacagtgaagcgttcacttcacggaaccatatgcagatcagcacccagtgaattcttatgaggaggaaaagttttgcccggactcttctccaatttgaacattggggagaattattttaacaggaaaagctccttctacataatgtttacaagaagagagagctaaaattggagcattgtccacagaatcatataaggagggaaaagtgaatactttatgcaatagccatgcatgaaagattcttatatcaggttacctgccagtcctgtgataaattgcatgcatggcagtcatatcagagaaataaagagaatatgggtattatggaatgagaagtaaaataaatttttttaaagcttgtggtgtaaaatgaaggttaactttggaaagtagattgaactcttggttacagagatgactaccatataagtgaggcacagtctttctgccttttcaggataaacacggtctgtgatcagttgtgaaaagacacataaggaaagcagcagagaatgtgaatattgcaaagacaaaatcagaatgtggaattgaatgcacttccatggttatcaaagcagcagcctcccatatttactaaacagttttacttccatcatcatgctttatcctcacagaaacctcatgaagtaggtgctgagattattccctccttagtactgaggaagcaaagagtgcagagaggtcagctgatcttcccaaggtcacatgatttgtaacggagtcaggctagaggtgagtctgggataagaaccctagtttgccaccagattccagaatctgaccatttcaccaccacattatcttacctccctcagagaatcctctgcagaaaatgggcactgatgaaaagaaggaaaggcttaacagaaacacatattatacctgtagacatataattgtgaatgtttataaaaagaaagggaagttggaatgctggaaaacagaaagaaataaatgaaagaagggaaggcaacaatatcaaagcgtgagccagtcagccttttcaagtgtttctctgtgcatttagttgtctggtccctcactacctatgaggtagaaactgtctccacttttctgatgaggaaaccgtaggtgagaaagtgaaaggcatcctactgctaatgcaaaagtaaggattgattagacaaagacaagaaagaagaacattccagacagagggaactatgtgtgcaactccttatattggtgggggaagcctggtatatcaagaaacagaaggtcagtgcagctgaagcagaagtgaggtggagagacgtgcaagaagagcacatctagtgaggcaggtggaggccagaccccttgaaagatatttgggacatgtcaaggatttcagtctttactgtaaaagcaatgggaatctgttggagggttttaaggctggcaggtgggggtactcagatctgtgtcattgcaatagtctaggagagaaaggagaacttcatcaggttagggacggtggagatgaagaaagggagatggattcgagaaatatctaggagatgaaattaccagtgtttggtaatgaattggctatgaagaatgaagcagaaagaagtgtggagaataatttctaagtttctgatttatacagccatgtgcttactgaagccagtcactgggcaagacacactgggagacggctatacatatttggggagtgtgtggttccaggataatgagtttggtcttgagcacttgtgtttgaggaggaacaactaagtagagatgtcacatagtttgaaatccagatctggatggaaagaaaaaaaaaaagtaaaatctagtttaggttccccaaccatgcattcctcttcacctaacacttcattataatgattgatttgtctgactaccctttagaaaacatgctccataatggctgggaccatgcctccctggtttactgctaaatcttcagcaccagtagagtagctaggacaaagaaagcactaggacatacgtatcagactgaactgaaacctcaaactcttaagtgttgatctagacagctgctcagacaagatcgggcacattcaaggtgatagggccataggctagacagccactcaagatcagttcatctcccctagtttaactgtaacctgcattcattcatctccctggctccaaactcttacctctgtaccctggctttcccacatgcctttcctgggctgggagttggacccagtggttcctgcagagattttagagttgatctatctgccagaattagttttcccattgtctcaactgaggactccccattccaagagtaagacacaggaaagaaccatgatattaagtcttggaaggttaatgagattcagataggcagtgggtaggggatgctcatgaacaaaaggcccagaagtactgtgggaaagagccagaaaagagacttgactgggacagagaaatgaggtaaaagtttggccagataaggtaagtagagagctttgaatatcagaatggaaagttagggtttaaaaggaatgataatgtggaagaactgtagatttctaacagggaaattatttaaggcgtaacttcagggagattaatctggcagcagcctacaggattaattgaagagataagagatcaaaggcaaaaggaccagctcagaggctgttgcagtaatgcaggtgtgaagagataagagaattaactagacagtggaaatggaaagtctcggagatgaagataaatggaaagaacttagtgaatgattggctggaaggcaatggaagattcaaaaatgacccctagattttaaaccctggtgatacctggaagactaatagtgcccctgatagaaaaagggtcttcgttttctatgaagaaaaataaaactgaagaagttattgctcacattacattggctgtagatcatctccttgctacagtattcacagcagtggtgatctctgagctcaccaagcaacttttaatgtgatttgactttaaaatatattccttattggagtcttgcactcctcaaagacgccagagagacagaggtttggttcctttagacatttcatctggctgctagtcaagacagctgattagtctctaaattactgcacttcaatgaacctgtagactttatctctccccaacctggagagggagaaaggggaaattcttttttttttttctttgtcttttttttttcttcgtctttttttttttcttcttcttcttttttttttttttgttaaccatttcagaggtaagtctaaagcaataatttttcttcctactggcctcattaagtttaccagtaaataagatggtgattagaaagacaaaagcacaaatttcccatataagcaatcatgttatttaatatcttcctagataggcttaatatctccctggatattaatttggaatcacacattatggtctccataaatattaaaaaaaaaaaaaccaccaccacaacaaaagtgaccctggtgttattgcaaagaattaatataaatcaatatggattcaagctgtaagagtacatatagattaaataataggccgatagtattataatagttctgtgacaaatttagctccaatgatccactgattccagggcaataaaatttcaatgcagtaaaattttatcacaacaaaaaatgtatgtactttgttaaactgtaatatatgcagatacagaaccacacgattttcactttattgaaaaagtaaaataataatcaagaatgcttttatttcttaaaatttataaatgaactatattgctgtggttttttggctttcctgacttgttcaaagtggtctcacaaaatgtacaatgtactgtttaagagggttggtcacctctttaaaacttatttttttaaaatgctcatccaggccaggagccgtggctcacacctgtaaacccagcactttgggaagccgaggcaggaggattgcttgagcccaggagttcaagaccagcctaggcaacatggcaagaccccatctctacaaaagtaacaaaataaaaataaaaataaaaataaatctttttataatgctcatccagccgggcacagtggctcacccctgtagtcctaacactttcggaggccaaggcgggaggatcacttgagatcaggagtttgagaccaacctggccaacatggtgaaaccctgtctctaccaaaaaatacaaaaaattagctgggcatggtggtgtacacctgtggtcccagctgctctgctggggaggctgagatggaagaatcacttgaacccaagagcagaggttgcagtgagctgagatcctgccactgcactccagcgtgagtgacagagtgagaccctgtctcaaaaaaataaataaataaaatgctcatccaaatataaaatagcagtatcagtcataaaaatgcattgcttcataactctgtttattacaagaatccctataaactgtattatgcagctgcaagattcttcacacttttggcttttttttttctccaagtcatccatgttaataattgacattattacagtcatctcagatatggaattaaccaagatcaatggcttatcttttgactaacactttacttcttatagttaatggctcatcaaagacattcttaaacaaagatacagatttgtgtgatacattgacaaggtgtcatatatgagatatgtataaagggccattttctggaacaacaatagcaataatgatctgatacattctctaatctttacaataacaccatttataagtggaaagttttttcagggagtatggagcagattggcaaaatgtttcttgtaaaagagaaaatttgcattattaaccttttcacatagaaatattaggaagaaaactttaaacacaaagaaaatgagcttattttatttggtggcaggggcaggtggggttgcctgaacataaaagattaattgtttgaggcctagcactttgggaggccaaggcaggcagatcacctgaggtcaggagttcaagaccagcctggcaaacatggggaaaccctgtctctactaaaaatacaaaaaaattagctgggtgtggtggcatgcacctataataccagctactcaggaggctgaggcaggagaattgcttgaacccaggaggtggaggttgcagtgagccaagattggaccactgcactccagcctgggagacagagtgagactcagtctcaaaatatatatatatatatattaactgtttgcctgttaccttctagctctttgccacatagaacacattgatatgacagaaccgcattcacagtgaacatggagttatgttttatttttattttacctaatactgggtgacattcatctctgttctcgcatccatccagttgcccaggccagaatgctgaatcaccatagcttcctcaccttcctctctggccacatctggggagtcaccaagttctgccaggcccacatatttaacatctctcatagtaggcccttcctcaccattttcacacttccttcaggcactgatctttctcaccctgatgactgcaactgccttggtaatgtactttcccactaggccctcctacacactgctattagagtgacctttctacagcacatgtattatgagggcctccagtcagaaagcctacaacacccccatttcagagaaacactttcatgcaaaccttgaagactgctgggagaggataagtcatttcttgtaggcaggtagcccagaaacctgggagtgatgtcatccagactccacttactttggatactcaaagttattgaggcccctcagggtgaacttgatggttttgaccaggtccagtggtgggagaggcaaccactgggaccgtaagagacagtccccttggccaagcagcttgagcagcagcgcctcttgagtaattgcggagtcttcaacctcaagccctccctccagagaaggagtgatttcaacacacacccgaaagtcataccatgacccttcctcatcagttgtagccctctaagtaacattgcaaagactcatacttaataaaaactccgttcttgcaccaggtgttataatatttttcctcagccattttagccttttggacaccaactattctattgctggcctaacacagaagatgtgcatcctcttttctctgtgatggaaaccttgctataatactaattaaaacatgcagtgtagctgctgaacatagattaaagaatgtatggtaaatagagaaacaccagcccatatggcaagaaaatggcaatctcccatagacagatgtgaaatgacaaagggttaagaaacttcaggaagaataaaataaatttttaaagggaaaaatatgataccacttcctaaatttgaaggttttcctcaaataataaagtctgtcattaaacagtagaatgcttactgtttacaaaacacattcgtattttctcacttaattcccaaagcaattctgtgacatgtgattctgccttatacatgtgaacattgacccacaaagagagatatcaatatgccctcaaatcttggaattaaatgacagtatcttgacttaaatctgtgtctcaagtctcctgattcagtgcactttccagtttaccacatggtaataggtgcatgccaccacacccagctaatttttttgtatttttagtagagacagggtttccccatgtttgccaggctggtcttgaactcctgacctcaggtgatctgcctgccttggcctcccaaagtgctaggcctcaattatgtaggtggctgtagatggcataagatgtagggaaaatttttgttttacctataaattatatatactatatactataaactatatgtaacagaccccccccaaaaggaccataaagtgggtgctatttccgatatagtgatcacttttcagatggcatttcaagatcacaattaagagcttttatctgaatgaaggcaaggccactcattattgaaagtgttttactttgctgcacataactgcagacaggtttggggctgcctctgtcacaatttcaatggatgcgtaaatggccaagatgccaagatcattgctagaaactttctctgaaaatgccatcacttctttgaccttcaaaatgcagatattataatcagtggtgtatcaggaacaaaactatttgccttgttgcactgtgtgtgtgtgtgtgtgtgtgtgcgtagatacatatacacatgcatagcaataatagtaaaggctgaaaaaataagggtgacttctataagtctaattgcaggcacctctaagttatttctattatgagggttgaaagaaatagcctgcatttctcagaactgaaattcactgacaatccagcactcattttggccacttttgcttaagcaaaatttgaatttacctttatttttctgaatggtttcaatggtcaaaagacaaaaatacaaagtgttaaccagcttcacataataatatttaaaatcattaaggtactttagatttacaaagtcctgttgtgttatttccttaatcagaaagcaaccctataagatgggagttatccctgttttacagatgtgaaagctgaggtctgttgatttggccaaggtcatacagcttctagaattggctggaacctggtacttcccattccaaatctctgcactaatttatggattctaaggtgcctacacacacacacacacacacacacacacacacaccctctgtgacttgcacaaaatggaaataacaaagacatacttaaaagcagaactatatagtgtagttatttttgttgctactgataataagtctattatggaaccatattttatatgtgtatgtcttcttgtaccagatagtgatgtttatcttatacccgactgttaaaatattgcatttttcaagcatatgaatagagaatgttcagctgcctgaaaagaccagattgacgtaatatgaactctttgtttacttgctgaatggacacagcttctgccctgtcagctgctttgtccacagtcttaaccttgttgtggaagaaccacctgtgtgagtgactggatagttaattctatactcctgtttacccttggggtcttctgttaagagtaaatcacatatagaagcagagtgtagaatagtggtcgccaggggctgggagtgggagtggttgagtggggagatgttggagaaggggtacaaagcttcagttagacaggatgaataacttctgaagagccattgtatggcatggtgactacagttaataataatatattgtatacttgaaaattgctaatagattagatcttaaatgttgtcaccacaaaaaaatgttaagtatgtgaggtgatggatatgttaattagcttgatttaatcattttacaatgtatacatatatcaaaacatcacattgtacaccataaatatatgcaatttttatttgtcaattattccttaacaaagctggaggaggaaattaaatcagataatgcctttgagtgtgaacaatatacctgaattaggtttagaccactgaggccaggtggatatgaactctaaaacactgcatttagaaggagtatcatttattgagagcttcttatatgaagaaactgtttagtagagagatgtgttaatgcttcactcaggacatctgaaggtctatgctgttgagcattaaatctgggaatattagtatttagagtgttcgatctctgaagaattctcctgtcttactcatttcatttcagatagcaaattggtataagataatagtgtggaggccagattatatccttttttctggggggaaaagaaacgtgattcataaaagatatttgtccagagaaatggctatattaacgttgggaactgatacctgggtcacttcaagatacagcagaaactttggtaggaacataaaataccaaagaagacaatcctatgacttcatgctgaaagagccttttccataaatgcatcccagtgtttgcaatgaacttttttgtcattttcaagacttttatttttttattttttttttattttctgttggccaggctggaatacagtggcaagatctcggctcactgcaacctccacctcctgggttcaagcaattctcgtgcctcagcctcccaagtagctgggattacaggcatgcaccaccacacccacctaatttttgtatttttggtagagatggggtttcaccgtgttggctgggctggtcttgatctcctgacctctgtctccctaagttctgggattacaggcatgaaccactgcgcgcagcccaagacttttagaaaccactcatactttctttttttttttttttttaagacagagtctcactctgttggccaggctggagtgcagtggcatgatctcggctcactgcagcgtctgcctcctgggttcaagcgattctcctgcctcagcctcccaagtagctgggactacagatgtgcatcaccacacccagctaattttttttgtattttttatagaaatggggtttctccatgttggccaggctggtctggaactcctgacctcaggtgatctgcccccctcagcttttcaaagtgctgggattacaggtgtgagccaacgggcccagccaccactcatactttcaatgcataaacgactggcaatgatcagtcaacatatcaacaaaaacatagaagctcatattattaagtctctatcctttaatcagtgcaatagttaaggagagtttacatgtgtgctttacttctagtcaaacaaaagcaatcacctctttatctcctgatgaaattataccttatttgagcataagccaggcacattgttgctagagaaaggaaagagagatggtgttgaattttctaaacatttgtggctccatttgttgacaaaaccttaagatgtttgaaagctgtgtttctgttgctgacaatgatagttgttctattggaaatttaatcgtaaatggggtatgacacccaactcttaaaatttgctccaagtgacgttatctcagctattatcaaaatgtggcccaaggagggcctttgaggcatcgcttgttccttcccattcagtctgtagaagcaggaatcagaagatgattgaagtggcatagtggccaaaagtgaggaagctgctttctatagaaatgagcttcctcccaacaaagaatttcatttctaaattgtttaattttggtttgcaggagattattttgtgatcctggtgtgcttcctgcatctgtttagtcttaaatgcttccaaaaacatttttcaaaatccacttctgattttctactccttcctaatacgtggaccactaaaatacaactcttcttttttttaatcctacctttgaaaatgcaaatgtgtgcgtcttaaaagcagattgggaaaaaaaacaagtgagagctgttggaagcatagtttgagtgatgttggttctagtattcatgcatcttacagaacattgcaaacgatgtgagttttgtcacttccatacgaaaagttaggacctttaaattatagccactgtttatgttggactggggcaaaataaatgtattgcactccctctgctggcttttaggtggcaacagctcattaaccagacttatttttagatgtatttccccattttaaaacagataaaaatggagtgtgggaaaaggaagcaaaagctggaaagttgttaattttattattcatttaaaatgtcagaaaaacaaacatctgcttcatacaaatggttaggataagcaagaaagccagcagttttcaggcctttcagtgttgtcctaagaaaaaggatagggccccttctctgttttccctgaggcatgtctctaacagtctttaaaaatgtactcagttccagtgagaacacgtggacacagagaggggaacatcatacatgggggcctgtcggcaggtggggggcaaggggagggagagcattaggacaaatacctaatgcatgtggggcttaaaacctagatgatgtgttgataggtgcaacaaaccaccatggcacatgtatacctatgtaacaaacctgcatgttctgcacgtgtatcccagaacttaaagtaaaataaaaaaattaaaaattaaaaaaaaattactcggccaggtgcggtggctcacacctgtaatcccagtactttgggaggccgaggtgggcagatcgcatgaggtcaggagttcgagaccaacctggccaacatggtgaaaccctgtctctactaaaaatgtaaaaattagccaggtgtggtggcagacgcctgtaatcccagctactcgagaggctgaagcaggaaaatcgcttgaacccgggaggtggaggttgcagtgagccgagatcgcgccattgcactccagcctgggcgacaagagcgagagacttcgtctcaaaaaaaaaaaaaaaattacgcagttccttcaaatactgaaatgaaataatcttttcccagagcttactgaacagcttattagactagtatgtttagtatgttcaaaacagtcagggaaagcaaaaacattcctttggcttagggtgggaggaggaaaaggatatctctatgctagtgtcagaaagaaactaaaagatcatcacactgaaactccatacctcaggggaggccacttccatccatgagagaacattacctacaagcctggaagagaattatagcaccatggaattttagagccagaggacctaggaagcaacagtctacacatgaatgagaaggagagatcatctggagaggaaaatgctccagatgtcagggctctcggggaccccaggccctgttccactcttgttcatcatgcatggggagggttttcctgcaaagttgaccttctgcttgggctttgctctcttttccattcttgctttctttcttccacaggcgtctggatgctaaccacatcagctatgtgcccccaagctgtttcagtggcctgcattccctgaggcacctgtggctggatgacaatgcgttaacagaaatccccgtccaggcttttagaagtttatcggcattgcaagccatgaccttggccctgaacaaaatacaccacataccagactatgcctttggaaacctctccagcttggtagttctgtaagttttattgattttgctctcttttaacagtttctaatgtcactggaagaccttggccttaaaatgctggctcttcaaagctcaaatggggacattttaagggaggaaaacctcctgagcccctccccaaaatgacttataaatgctccaattgtgtaaatgacttaaacaatacttatcaattacctgctagatgccaagcacagcagggcatacaaagataatgaaatatgacctgtgccttagagaagccccttgcatgttgcacaaggagtcaccgcactgtacagttagtacagtaacctaagttaaacattccttattttaaaaaataattgataattcaggtcaaattgaaagatgctcttcttattatctaataagaactttgtgaacccttaccaaggaaagagaagtgagaacaaatgatgtaactgctcaatgagttctttttgcccactgcccaaatagagccaatttattaagacaagagaattgcaataaagagtaacacacaaggccggcacagtggctcatacctgtaatcccagcactttgcgaagccaaggcgggtgtatcacttgaggtcaggagttcgaggccagcctggtcaacatggtgaaaccccacctctactaaaagtacaaaaattagctgggcgtagtggcacatgcttgtaatcccagctactagggaggctgaggccggaggatcaattgaacccaggttgcagtgagccaagattgtgccactgcactccaccctggggaagagagtgagactctgtctcaaaaaaaaagaaaaaatagtttagcacacatacagccagctcaatggaagactagagttttattattactcaaatcagcctccctgaaaattcagaggcaagagttttttaaagatagtttggctagcagggagctagggaatggggaatgctgatttgttgggtcagggatgaaatcataagggattgaagttgtcctcttgctctgagtcagtcctggatgagggccttaagaccacatgggccagtttacccatctgggtggttccagctgatctatcagaatgcacggtctgaaaaatatcttgaacaccaatcttatgttttacaatagcgatgttatctataggagcaactggggaggttaggagtcttgtggcctctggctgcctgactcctaaaccataatttctaatctgtggctaatttgttacttctacaaaggtagcctggtcccaaggcaaggagggagtttgtttcagaaaaagactgttatcattttgtttcaaagataaactataaactaaattcctcccaaagttagttcagcctatgcccaggaatagacaagggcagcttggaggttaaaggcaagatggagtcggttaggtcagatctctttcattgtcatatttttctcactgttgtatttttgcagaagtggtttaattgacagcatgttatgcatttgcacagttttttcccaccatatgtctagatttcattattttagtaaatccaaaatgattctcaaacaagtaatagtttgaaaaataatcagttttctttaaaaatgtagcagtatgacccccacatgtataatataataaccaatcaatgaggaaggcttcttctcactatttctctctttgcttcatgcccacccactggcccaccgctctcttcaatcattccacttgatgacatgtctgtcccttgcactgtagtatatactcctttgagggctggccaatatcttatttattgttttaggttcccctcaatctccttccttatatgctgcatgtagaatatcctcaatgaatattacataaatctcacctaaaaccaaaatttatttattagaaaaaaaatcttagtatggaaggaaaagaattttttgtgatattaaaaaatttctacactgaatttcacatataaagatgatgctactgacccaccagaagctgggtatgtgctttaatttcttttcctccactagaggaaatggatttacacagatccagctgtactttttcaccctatcctccttaagcccattttctaaaatccttttgagagttggtccagttttcagttgtgcacagctgttctcactggctctgacctaactgacttaccaattgaaccaaagatgataattatatacactaatactgtgtcaagataactaatctccttgggcagcagaaaaatctgattaccattgcctgtgactgaaatcattgtttcctgttgacctgtgctcccgccctgggaaggtagccattataggccttcatctttattagaaaatgtgcttgctacatctatcctccaggtgtcaatgatggtcagtatctctgcttaacatcctatatcccaaagccatgctgaacaaactatgcttacaaatatgccttgagaatgtaaattagttcaaccattgtggaatacagtgtggcaactcctcaaagacctaaagacagaactaccatttgacccagcaatcccattactgggtatatacccaaaggaatagaaatcattctattataaagacacatgcatgtgtatgttcactgcagccctattcacaatagcaaagatgtggaatcagctgaaatgcccatcaatgatagactggataaagaaaatatggtacatatacaccatggaatactatgcagccataaaaaagaacaagatcatgtcctttgcaggaacatggatggaggccattatccttagcaaactaacacaggaacagaaaaccaaatactgaatgttctcacttagaagtgggagttaaatgatgggagcacacatggacacacagaggggaacaacacacgctggggcctctcagagggtggagggtgggaggagggagaagatcaggaaaataactaatgggtactaggcttaatacctgggtgatgaaataatctttacaatagacccccatgacacaagtttacctacataacaaacctgcacatgcacccctgaacttaaaaattaaaaaaaaaaacagccttgaaacccaaagttacttatatcaattatgttcctcatattattatacacaccctgatgtcctgaagctaaaaggtaaaaaactgtgactgtcttttaaattctgtggtatagaatcatctgtggtatgagtgaatgcagcatatagccattttttacattggcttcttataagtagtgcattcttcagtatatgtttctttggatttaagctatcaaaatgttaagtgtggtctgtgcagtgtgccttcctaactatctgtaatgttctactgcagacatctccataacaatagaatccactccctgggaaagaaatgctttgatgggctccacagcctagagactttgtgagttgaccttttatttgtttcccttttttcagtattttcatgaatattctgaagaatcaaaatagccttaaagccagactttgtttggtttggttaattgcctaagctttcaacagatatttacagtggcattatcttacacacacaacccccacagagctaaacaataaaactgggattttattttaatctaatgagagtgataaattagttagaatcattataaattaaatgagatgttctctactaagcagtgactatttgcttagaaatgtgtagtctctgtcaaggatcactcaggctcactgttcatgagtctggtactccctgctgaatgagaggatgcaggccaggccaatgcctgcgtcttcaatctcagatgaacaggcatctctttaggaaacagtgatggctcatgctaaagcaattcaaaagatgaaaaagggactgggcgtggtgactcatgcctgtaatcctaacacttgggaagccaatgcgggaggatcgcttgagcccaggaatttgaggctgcagtgagctgtgaccatgccactgcactccaacctgggtgacagagcaagaccttgtctcaaaaaaagaaaaaagagtgaaaagtaatagtagctactatttattgaatatatctataatcaaatattgcactgagcatttggcatacattgttttaattacttcttacagccatcctatgagagcagatattactatcccattttaggctctagtgaggtaaagttattacatatctagtcagtagcagaactgagatttgctttctcctctagtctgattctgaaatccatgtttactactacatactacttccaaagaataagtcaaaagttcagttcttaattggtacctatagtaaaaatagagtcaagccagcggaccatatcctagacactctcacagagccaaggtagaggttcttgtgggccacaccagggccccaggcttttcccaggggaggagctgctcttcattgccctgttgagaaaggtgtgatgagactgaggtgataggcagggagggtcctgagtgtgctgggagaggagggtagttgcagccatgacaccatccctaccctcacatttttaatgctcaaatgcaataaaccacacaggtcactgaatctgcagtgctggctctgaccagaactgcaaaaggaaaagaccaaagaccacttctcctgtgcccttggggcccactgttcatttgcacacagagcttaggaatttgttcatgatcaattcagcttctaaccagatctgggttactaatttcctgagggaccctgtgttggtggtattcttctagcctatgagcactaacagctctttccagggttaagtcaccctgtgtttcttcttacgtggcaaagatggacttgtccagggaggacctttatgtcaacttaatggcatagacaagcagttcccatcagctgctaggaaaaattagaactcttatctacaaaacgctgggctcagaaatctcagcaatggaaatcaccttccagcccttttgaacaataacaggaatgaaaaacaagatgggctttgatgggtatttccataaatagtcttttttttcccctcaatgtttggggtaaggacccaggattgcatgtaaataacatagagcaaaacatgtcagggaaaagttcatgtgagtcttattgtctccccttcctctaccttgcccagggctacagaggataagcaatttggttattcccagcctcttcctttccctactagaaatccaagtaatttataagggtccaatccttgtttaatcaaaacagagcatctggagagatttacaaacaggaagaaaatttatgtctacaaaagacatgcatttcctgcctgcagtatagcttaaggatggtttgtgccagacaagtaggaaccttgattcatgtttaactcagtcaaattatctctctctttaaattaaatagcaattctccacagaggaggatctaaccacatctgattgcctgacgaaaaggtttttctgcgtcatctgggaaatctgccattcccagagaccaggaggcaattactttttcatacgaagatctagatataaggtagagtaagtctgtaaagcacttgtgagtaatgaaattgaaaagccaattgtgctataacagatacagaaactaatgatttgagataatttgaccacttcatctctggccttgagggataacatagagctttgctgcacagatcaaggaaaacatcctatttctgaattatttgtgactccttgaagaaattctagaccaaatgtcctttctgagattaccctgtctcacataaacctctccagaagcaaggttcatcctggacttcaggctaggagggatgtgggaaccctgtgaaagtcaaggacaaagcagccctgcaagatttcatgtcacaagggagtgaaggagggaacaagaaaagggatgtgatccaggagccctgaggagtgcaaattcacgctggccaattagtgagcccggttcagttgaagagctccatccgccagccgtcaacacctggccaaagagacatctctcctacttagaagttaatactcctgcacactccctttcttttttagacgccccagtgccattgagtcctgactctcaaatttctcatgattagtcaaatgaccattttaacgcagatacttatagaatgttggtagtcagcaagccaagaaaatctctttccataaagaaaagcagtgagaacttccattagtcatatgggttccttggaatagcatgttaactttccttgtaaatagagtatatatgaagttttaaataaaaaactgaaaatactatgtactcattttcagagatttaaattacaataaccttgatgaattccccactgcaattaggacactctccaaccttaaagaactgtaagtatttaggacaattttaatgggagaactttatccttttgtgaatttatttaaaaatacatgtgattgttttacataatatgacttgctagaaaattttaagtttatataaataatgataaagtacacttgaaatatattttaattgattctatctctagcaaataccagataatattttttatttatgcggggtttttctaacatatatattaaaaaaacatatatttctgtaagtcatattcttttctctttttctaagccatacatactctcccaccatttatgtactttatagatttgtagatttttagtagtagaactaaaatggaatttaattgctgagcatttctgagaacttgaacatttctgggttgcataagtctagaaataaatgaatcaaactgtctgtgcctagtaaagtatgagatgcattcacatacattgcagctgacccttgaacaactaggggttagggacaacaacccttgcacagtagaaaatccatgtataacttttgacttcttaaaaacttaactactaatagtctaatgttggccagaagccttatcaataatataaacagtctattaacacatattttgtatatgtattttgaactatattcttataataaagtaagctagagaaaagaaaatgttatttaaaaaattctaagaaacagaaaatatatttactatttattaagtggaagtatatcatcataaaggtcttcatccctgtcatcttcacattgaggaggctgaggaggaagaggaagaggagatgtttgtctcgttatcccaggggtggcaaaggcagaagaaaccccacatataagtggagccatgcaggccagctcaatgggtcatgcctgtaatccccgtgctttgggaggccgaggcaggcagattactcgaggccaggagttcgagaccagcctggccaacatggtgaaaccccgtctctactaaaaatacaaaaattggctgggcctcgtggcacatgcctataatcccagcttcttggaaggctgaggcacgagaattgctttgaaccagaggggcggtgattgcagtgagccgagattgcaccactgcactccagcctgggagacagaacaagattctgtctcaacaacaacaaagaaaagtggatccaggcagtttaaatccattttgtgcaagggtcagctgtatttcatttgtaaatgttcaatgaatcttatttaattctaaaaccccacaattttactaaagaaaagctgactttcagccattggtttgcatatactgccttttagatgataaaatttaattagctttttcatatctaaaaagataaataatctatgttagtaatgttctaacacttggaaaggaaaataaacactgaacctcattcccctagcagtgagaaataagacatacagctaaaggagacacagaggagcttgtttataagaaaaacccttagggtgttctgacttaggaaaccccatgtgtggcttagctgggcagtggcttcatggcatggggtcacctcatacagccacaggcccaaataagctccaaagatcattgaacctgcttctcagccattcagacaacatcaacaacaacagatgacaatcagcttataactacagattcactgagccagggcacctttcttcaagtcagaaaattttgtcctcataaggagactacttaaatctttacttcactgcagcttaagtcaattttctcttctagcttcaaatggggtcagtaggagtgatcataatctctccaaaaatggtttccactctctcaggcttttatacaatgatgctctattggatattaacagattttcttcttataacattagattgtaagtttccatgaagtgcagttattattttcagattctttatttctcttttaagatgacagcacatgactttttttatcctctagagagtaaataacggcacctaagtttcaagatgcatagaggaatttaatattgtcctctggttactaaaggttctgattattgccactgtggtcagggtgggggcctctattaaataattttaccccacacaggattttttataattttttttctctttctagaggatttcatagcaacaatatcaggtcgatacctgagaaagcatttgtaggcaacccttctcttattacaatgtaagtgaccataatgcttttcggtttctccatcctgaaatatagcatatattatactttgaaatacaatgaatattctatatttgcctgagttttgtcttagtcaatctaagagttcatacagaaaggtatatacacatgcattttgccaggttctagctgaacactgaaataatataaaagatttttttaaagatcacattatgattggtatctccagatgtgctaggtatctttaaaataatcttgtaaaatgcttttgattacctctattttctaagaaataaaactgatttttagagcattaatgtcaagtctgcatagtcattctgaacttaaacccgagtatactagaaatataaattattatatacaaatggatgtcttttacagcaatagactccagcctaaattgatggtaggggttttatactgttttgtgctaagcctctatctccattcattattatgcccaaacattcacatttatacaaactaggatgtaattctagaatgataaataacattttagaaaggtgtgtatgaggatttatatgccataaaagaataaaatcggccaggcactgtggctcatgcctgtaattctaacactttgggaggccaatgcaggaggatcacttgagctcaagagttggaggttacagtgaactatgatcatgcctccgaagtctatcatgggcaacagagccctgtctccaacaaaaggataaaatagagttacaactacaaagtataactaattttatgtttcatatttaatacagtagaatgatgatatacagttctgagtatgaggctggctcttagacaaaaggctcctctcggaggcagatttgggacaccatcaaacctgaggttgtgaatgagaagcctgaatatagaggaggagagtaaggacaactgttaaacatgactctaggggcacttctcagcagatgttggtcctgtgccaactggagtgacgggctttctgggaccatgtggtatttgtcacaaatgagcaggagtcccaattagccttgacaaccagaagaaaaaaactattcattgtttctgaaatgttctggcaatattttggcaaactaagagttttaaagtacattgacaataaacattagccctcattagagcgtatttgcgtattaagaggttggcaaattacattgcctttgctcctccttctgcagccacagtactggtttttcatcactcttttgatatgctaatactccctgaggaactagcggcgccaaccccaactctatatatattagacctcctatccactatttgacagtggtgaccactttctcccataaactctcctctccttgctcctgcatctgtttccatctcttcaaagcccgcatttctgtgaatgctttccaggtccagttggctacccactcctcatttccacctctgtagtccccatcctatccatacctcctgacctccactgcaccagcctctctgccaaccatgacatccagattttcaccagtctgcgtgaggctggcctccctcccttcaccgttggcagcactcatcttccttgaagcacggcaaccatcttgttacttctgctgtgaaatgtgcgttcaggatgtctatttacactaaatgcaaactcctcatcctgacattcacagtctaaggccacacatggcctaagccaaccctgtcaaccagttccccaaagctctcctcattcaccctaattcataaaccagactgactaagttatgttcacggaacaaagctcttttcttacttcctttgctcctacgatcccattccctcactatgcttcttgaaattctttcagggcccattttaaaagccatttcttgaagttttttataatctctcccgaacatatgagagagttccctcctgagaaccctaaaactccttatgtgtgtttatgatacttctgccttatgcacacaagcatgtatattcatacctgcccagtgtgtgtgtgtgtgtgtgtgtgtatatagtgtgtatatatatactgtgtgtatacatatacatatatacatatatatgtacacacacaccgtgtatatatgcatatatacgtatctgtacacacgcactgtgtatatatgcatatatacgtatctgtacacacgcaccgtgtatatatgcatatatacgtatctgtatacacgcaccgtgtatatatgcatatatacgtatctgtacacacgcaccgtgtatatatgcatatatacgtatctgtacacacgcaccgtgtatatatgcatatatacgtatctgtacacacgcaccgtgtatatatgcatatatacgtatctgtacacacgcaccgtgtatatatgcatatatacgtatctgtacacacgcaccgtgtatatatgcatatatacgtatctgtacacacgcaccgtgtatatatgcatatatacgtatctgtacacacgcaccgtgtatatatgcatatatacgtatctgtacacacgcaccgtgtatatatgcatatatacgtatctgtacacacgcaccgtgtatatatgcatatatacgtatctgtacacacgcaccgtgtatatatgcatatatacgtaactgtacacacgcaccgtgtatatatgcatatatacgtatctgtacacacgcaccgtgtatatatgcatatatacgtatctgtacacacgcaccgtgtatatatgcatatatacgtatctgtacacacgcaccgtgtatatatgcatatatacgtatctgtacacacgcactgtgtatatatacatatatgtacacacactgtatatatacatatatacatatatgtacacacactgtatatatacatatatacatatatgtacacacactgtatatatatacatatatacatatatgtacacactgcatatatacatatatacatatatgtacacacactgtatatagatacacatatatgtacacacacactgtgtatatatacacatatatgtgcacacactgtatatatacatatataaatatatgtatacccacacactatatatacatatatgtgtatatatacatacgtatgtgtatatatacgtatgtgtgtatatatacgtgtgtatatatatatacgtacatgtatgtgaacacaattatatgcataaagtacatggtatagctaagagctgataagatattaagaggaaagctccatttttcatcataaggcccatattccagctctagctctttctcttactgattaatcccaagagaaaagaagagctcagtgggtaggacagaagaggatttaggtttgttgggtagcaactgtatcccaggttctatttcaaatgttacacatgcattagctcttttaattcttatccaaaccctaccactaagcattattatctcagcttaacaaattagaaaattgaggctctaggaggtaatgagcttgccaaggtgtctgagcctcaattttctcttccaaaagtgaagaaaatagtatctacactatgaatctcataaagttgttgcatggatcaattgagctatatatatatatatatatatagctcatatatagacatatatacatatacatatatatatatatataacacatacatatatgcaagagctttgttaagtagaaagtgatatgctgttatttatttgctttatcccaactgaatccaggctcctttaccacaggaacatcttatcattcttcttcaaacccccagcatctagtataatgccaagtccaaagtagttacccaatgacagctttttaatgaatcaatctttaaatcctcacatacctaccctcatactttaaacgtggtagacattagtgaatatttgttgagtttaattggactagaagaatgactcagctaaaaagtatatggcactccattgaccaggcagttcaaataccactacattgaaaacatctgtaaaacaaaatattttttaatctctaataatgtctcaccttttaaaacaataattaattcaagaaaattctaattttagacatatgccagaatagctcatttcctctccaataatctgatgagtctcttgtgtatgttatggtgaccagcagatataataaccttcagttgatatcgatagatagacttcgtctttcattaagtaatgatctgattgccagtactttgaattacctttttgccactcaatggatattctacagatgttggagggagaggaaactgttaagtattcaatttacttgcttttctccttagtaactatcactcatatctcccttgttgtcagaaatcttcaattttatatagtacagattccttaccaaaaatctcatactgcgagtcaaaacacttttgaggcttgcctgaaaccaaggaattgggaatgttatgtaatacagtataattaaaattacataagtacatttactgtatttgttcaaattttgaacagatattcatctttcaaattttatactaagatattaattgctgtttgggtttcttttagacatttctatgacaatcccatccagtttgttgggagatctgcttttcaacatttacctgaactaagaacactgtaagtttctatgtctcttatggatcactttccctctacagggttgctgtgaaaaaccaaatgaatattataggttgaagtgctttgaaaatggcaataaaaattacccctgtctagaatcttctaccagtaatacttatatactcctctttctaggactctgaatggtgcctcacaaataactgaatttcctgatttaactggaactgcaaacctggagagtctgtaagtactgagtagactcttgactttgcccagaacatacactgccattagagcttgatcagtcttaacatcagtgagtcaaaatatgtcactgtgtgatgcctgaatgaaagaattatgtctggtttgtgttttaacaggactttaactggagcacagatctcatctcttcctcaaaccgtctgcaatcagttacctaatctccaagtgctgtgcgtatcagtaaggcaataatgttgtgtaaacaggcaacttccatttaggggtgaaatggcagacatgatttcaataatctctttaaaagaggagaaagtttttcctttcaggtctgcaggaggtcaagcctcctttgccctctttggtccaggctctctgacatgatcctggtaacaaatggtaatgtaccctttgttttctaagtcccaaacaagctcccactagactttcagttggcacatgttttctttcagaaaagatatgaagaggccaaaatcactttatttccccctctaaaggctttgcagagcagaacaaaataacataatggatcaaccacccaatatggatgccaaaatcaaaaactgagatctcagatccacacaatccttgataaaggtgatcaaacatccttccagtatagttgtcaatgccatgttctaatgtttcctgtaatggttaaacagcttgcatatgttatttctattgacttgggacttttttcctctgcctttcccatgtgttatgaaaaaaagtagtttacatggattcaaggagacttgttttgaccttccatttttcagccttctccctcaacttccactcaacacaatcattgtcctctcaagcatgttgggacttaataaaaggactcttaatcttttgccatggctctgcactcacatagaaggcacctgtggcaattgagcgcctgcaatttcactataagctttacttagcagcactcagaatgttaagtagataaacgggaatggctgcctctgtgattctgcctttccccagccccagcctgccgtgtcacttcagactccagttgctcaatgatatgtgggtgcagtgacaccacatggtagccttggagtcagtgattcacatctgaagaaagggagtatagagcaaatctttctttgccctaccccatcccaccccatgaagtgcagctacagataagaaagcagtattagagaatttaatttgttaaaatcacaaagcaagaaagaagcgagtttgaattcaaatacaatcaatttgattgaataactgggagaaagtgtgtgtatatcaggtggtagaaatttggggggccatgttagaattctgcctaccacacccagaacaggtataatcatccccatttctccagaaaactggcgcagttatatgattaggattttacatactggagctagtaagtaaggaaccagtgtttaaactgcatctctctctgctatgtcacacaatgagtggtaaccactcaggtctagaactgcatgaatggaggctcactggcaaaatgactttaaaagcaaaggctgtggagccaacttttctggttcaaatccaagctctctatatgccagcacaggatcttgagcacattattattcctcctggagctcagtttcccagtctataaaaggagatgtagccacttccttcagagggttctcatgaggactgattaaatgactacatgtcaaacagttacagcagcacctgggacactgtaactctcagtcagtgttaacttttatcatctttctcacttccctggaaccattattctttccttgagttggaacttgaaaagccgggaggaatacacataacattcatagtagatcttgccattttcaaagcattttcacctataatattcatttgttcttcccaatgaccctgcaaaatggtgtcttctcatttaggagaactgagaaagataccaatgcttagctagtgtatcaaccaagtagaattagctgaagttgagactagaaccccagagcctcacccctagtacaaggtgctttatgttctcctgggggtatagatctgagagctctcccctttggctaactcatccactgagtacttgttacatgaggaaatttcactgtacatgactagttttgcgtcatgtgcatgggaattatttagcccattctgtaggttatgtgtaactttccccacttactagctggtcagcttaggcaagtcatttcatattgtatgggtagaattatggtgtctccctcataaggtagccacaggaattaaaccagataattcaagtaaagctataaacatggtacctttatataagaagtgcttggcaatgggcaaaggattccctgtttaataaatggtgctgagagaactggctagccatatgcagaaaattgaaactggatcccttccttacaccttatacaaaaattaactcaagatggattaagacttaaatgtaaaacttaaaatataaaaaccctagaagaaaatctagtcaatgtcattcaggacataggcatgggccaagattttatgatgaaatcgcctaaagcaattgcaacaaaagcaaaaattgacaaatgggatctaattaaactaaagagcttctgcacagcaaatgaaactatcatcagagcgaacagacaacctacagaataggagaaaatttttgcaatctatccatctgccaaggggctaatatccagaatctacaaggaacttaagcaaatttacaagaaaaaaacaaccccattaaaacgtgggcaaaggatatgaacagacacttctcaaaaaaaaagacatacatgcagccaacaaacagatgaaaaatagttcaacatcactgatcattagagaaatgcaagtcaaaaccacaatgagataccatctcacaccagtcagaatggcaattattaaaaagtcaagaaacaacaaatgctggcaaggttgcagagaaataggaatgcttttacactgttggtgggaatataaattagttcaaccattgtggaagacagtatggcaattccttaaatatttagaaccagaaataccatttgacccagcaatcccataactgggtatatacccaagggaatagaaatcattgtattataaagatatatgcccatgtatgttcattgaagcactattcacagtagcaaagacatggaatcaacccaaatgcccaccaatgatagactggataaagaaaatgtgctacatatacaccatggaatactatgcagccataagaagaaatcagatcatgtcctttgcagggacatggatgaagccggaagtcattattctcagcaaactaatgcaggaacagaaaccaaacattgcaagttctcacttgcaagtgggagctgagcaatgagaacacatggacacagggagagaaaccacacttaactgggccttgccgggggagggtgggaaggggaaagcattaaggaaaaaagctaatgcgtccggggcttaatacctaggtgatgggctgataggtgcagtagaccaccatggcacacgtttacctacgtaacaaacctgtacattctgcacatgtaccccagaattttaaaaaaataaaataattttttttaaagtgcttggtcagtgttagccctgaaaatcattaggtagaaggcaacactatgcctttatgtagaaggtcttttgttccctctattaagaggtagacaatgaaggagtatcccctttgcagcctgcagagatgagtaaaccaattatcagctttgataatatgtgtgtccattttattatattcgctatttttcaaaaatacataccatattaataatcaggtatatttgtgcataggtgtgagattttggaggtattgggtgggggggtatctttcaaaccttcagaaagttacaaatttggatttacaagcagcttcatttgtactatttatgcggagtaaatggactttattcctttataaatcccatttattcaataaatgtaggataaagtgatcaattataagactaatttgaagccccttagaaaaagtatgatttttcccattgcatagtggtgatctggttttaagaattagaatcaggcatgaaaatgtgttagttgattagctgataacttttaaaacatgaaacaaaattgttcttatatatctatgttacgttatctaccaactttcttttctttcaagctttcgcaaattatgatggcttgctttagattagttatattatactataaatatgtccagatgtttttgttattctgtaatttgttgaattttggctgaagattttcttagattccgttcccccacctccttcttgtagtgattgatttcaaagctcctgctatgttttgaattgttaggtttttttaaagagttgattagaaaagaaacaacaatgatttgtctgagctgtagagatgtagcagctcttagagacagaggcacaattatttaatttaatttgttctcattgcagtaagataatagctagagcatttagagaagtactaacaaaatataaatgaattcattaagtaaactatttaaatcaattaaagaagtataacagttacatttcagtaaacatttgaatctactggttaatccaataatggctgtgactacctgctccatgtcagggctatgaaaatgttcagagtctgcctttgggagatataacatcttggagggaaaaggagagcaaagcatgtttctttatgatttatttgtaacagattttccctttttgcaccttctgtttttcagagatctgtcttacaacctattagaagatttacccagtttttcagtctgccaaaagcttcagaaaatgtaagtctagaagtctctaagtcacctagcaaaaatcaagaatcaaaactcacatttctcagggtcactggttcatttaccctgtggttcactggggagacatgtgatccttttccttcttacacacacaaggtgtgactgtgcagtgtgcttagaaagttgagaaacatagataatattattttttcatgcactgtaccatattagtaaaacatttattatatatccgcttttttctccccctaactcagggtactagtgaattgggtgtgtttgggctttgaaatttttcttattttagaagtacaaccaaacttacatatccaatgagtggtgttattttttaatatgtggggacttgggtttgttggtgtgtttgtttcacaatagtcaactttaggggaaggccatatttgtcatatttaaagtgctacagatggtacttatgcatgaaactctttagaattcctctcttaacattgcctcccctacaaaacatcagcctttttttttttttttctcaagatggagtctcgctctgtcgcccaggccggagtgcatggcgtgatctcggctcactgccacctctgccttgtgggttcaagcaattctcctgcctcagcctcccgagtagctgggattacaggcacccatcaccatgcctggctaattttttgcatttttactagagacgaggtttcatcatgttggccaggctgctctcgaactcctgacctcatgacctgcccatctcagcctcccaaagtgctgcgattacaggcgtgagccaccgcgcccggccaaacttgttgttttatagtcacacttcagttttgatcaaaacaatattcaccatctatcccttcacatttagtttttctctcaatgcctttgggtgcttaagggaaaaaaacaaagcaaatccatctgtaaaaggtaaagaatttaccctcctgaagaccctcaaagaatccaagggaggctcagaaggcagcactagaagagtcctccagtgttttgaatgatgattgcatgtttggaatatggttttacgtcctcccaagcaaactagctcctttgaaagagacaatacttgagtgtgtaaatggtaatgttcttttttaaacaaacaaaaatcagtcacttgatagatacacttcatgtgttcctttgattaagggcaggtagtccctctataaaagttatctgaagtctgtagtctttgaaaccagtaactttgaaatcaatctttggaaccctgtcatttcagtgacctaagacataatgaaatctacgaaattaaagttgacactttccagcagttgcttagcctccgatcgctgtgagtatcacctcccagtgcgttccccagcacagagcattttctttctctttggggccttcccctaatgttttcttttcattgtgtactattgtggtgggacttttgtgcatatatttgctatgaaacatcaagtattttgcttctggtaatttccaggaataaatctaaaagtagtaaatttgcaattatgctctctaccagtcagcaggcaggaagttttaatgaagaggaaggaagctaagctgttgactagcctactgtgttttctgtccacaacctggaatcgacaagaaacattttacatgcaaaaatgggatgatcacataattctatctgcctgctttttttcctggttaagcatttttttcaacgtgtgtctcaaagtgcttaataatcacctcgaggaaactaaaaaatacagactccagaaccttatctgcctcatgagttagaatctctggagtggggactgggaatctgcattttaacaagtacactaaggtttgaacacagctgttctagaatcacttctgttgctcaggcaactaagatttgtaaatacttgtatttaattccattttatgattgaaatgttatatattaaatttttttaaaaaacttactagcagattgttttatgaaataacagttaaaacttttctatactgaaactggatttcaatatgattttgatgaacggtgatgataggtaatgtttaaactatagtacgtttgttaaaaacctttctcttttgctgacatctaaagtattttttttgtacttaagagactatacctttggtaaaataatactattcctcaaaagactttaaatttacttttaagagtcactttctcccaaaagtttaccttaataaccttaataatttcctcccaaaagtttaccagaataacatcttgttctgaatttcgttgtgttgcccttctctcacttttggttgaaatctacttgtggagtgcttttacttaaaaaaaaaaagtgtaaaaggaaaatacttttattttccttttactaagggttactattttcctaaccctaacccttattcaggtaagtgaataagacttacctgtcttattcacccggtttgatgtctggctgccccaagtcagttctatattaaaaggcaggcggatcacgaggtcaggagttcgagaccagcctggccaacatggtgaaaccccatctctactaaaaatacaaaatattagccgggcatggtggcatgtgcctgtagtcccagctactcaggaggctgaggcaggagaattgcttgaacccagcaggcggaggttgcagtgagccgagatcacgccattgcatccagcctgagtgacagagcaagactctgtctcaaaaaaaaaaaaaaaaaaaaaaggctgatctctatagataccaaaagaatgtgacacagactctgaagaataaatgtctgaatccccctgaattccttcttcccctgtgacctcacattcagtcactcaccaaactgtgccaactccaattcatcctctccactcctctaccgcaggcccattaatgattcgtttggatcaccatcatcctcccaaccagtccttctatcatctctctacccattcatcttattctttcttaaataaatatctaatcatgttatttccctgcttcaaaaactttctaattatttccctgttgtcttcaagatcagaccaaacttcccagcaacactcttcaaaatctgattccagcctcctggtacagtgtcatctctcctcagcacactccaggtccctgacacacgagccagtgtttctcctattcccattgcctataggattcctccccacccatgacttgtccccctgcccatttcacaagaacaagatcttctatctttgggcccacttcactcagatgcgctttgcacattttctactatagaacttaatacttagcactgtcatcaggtagactatgccatacctgaaaacaataagaactttttcaggttcccataaattaaaatttcagtaaaacttctagcccagggtctagtgcagtggcttttttattatttgcttaagaatttaaacatgttctgagcacaagatcagggactgtgaagtcagtgtgcctgcgtttgaattgcagcgcctgagattactctgtaatttattactcaagtgacttgtcacacagtttctatttttcctcatgagtataatgaaggtaatgataatacctacctcttagggttgtggtgagggttatgagactaaaacctgtaaaaaacaaaacaaaacaaacaaacaaaaacctcataactatacctggcacattgtaactatgcaaccttattattattatgaaaataagtatatagcttttgagggttctagcaagaaacagaagtcatttaagatggttgaaatgcagaaataccatttgacccagcaattctattactgggtatataccccccaaaatgtaaatcataatgttgggtgtgatggttcacacctgtaatcccagcactttgggaggctgaagtgggcagaacacttgaggtcaggagttcgagatcagtgtggccaacatggtgaaaccctgtctctactaaaaatacaaaaaaattagctgggcatagtggtgggcacctgtaatcccagctactcgggaggctgaggcaggagaatcgcttgaacctgggaggcagggtttgcagtgagctgagatcgcactaccgccctccaacctgggcgacagagtgagactccatctcaaaaaatatatatgtgtgtgtgtgtgtgtgtgtgtgtgtgtgtgtgtgtatcattctattataaagatacatgcacacatatgttcattgcagcactattcacaatagcaaagacatggaatcaacccaaatgcccaccaatgatagactggataaagaaaatgtggtatatatacaccatggaatactacgcagccataagaagggataagatcatgtcctttacaggcacatgggtggagctggaagccattattctcagcaaactaacacaggaacagaaaaccaaacactgcatgttctcacttataagtgggagctgaacaataagaacacatggacacagggagagagataccacacaccagggcctatcagggtggcagggggagggaaagcatcaggataaatagttaatgcatgcagggcttaatacctaggtgatgggttgataggtgcagcaaacctaccatggcacatgtttacctatgtaacaaacctgcatgtcctgcacgtgtatcctggaacttaaaattaaattaaatttttttaaaagatggttcaaatgaaaagacacttacataggtgttggcagggagcaagcaaaggatgggtgtgcagaaaccagtaacatctggggctagagtcacagggaggaaatgatgtttccaggacaaagaaagagcttaagcatggagaagtgttgcagcccttgagaagtctgtagctgccatgaaagacatgattccaaaacagggaagagaagaccatgagggccctgacctccctttccttctggggcttctcctgagaaaacaactgaggccattagggagctctggggatgcagcctgcaggatcagccccaggcacaaagcagaaaatgactcctctggggctgctgggaggattccagcgcacgggctcatgaattgaaaaggaattacaggcctttgaacatataaattctcacatatttacttaaaccccagccaaatcactctaagcaccatggcaggacttggcctacattccagatattctgctctgtgaagctctcccagggcaccatgatctacttaaagctgccaaaaagactctgacagatggtattacttgctcacctcagtgacacgtatttcttgagcagctcaacagaagacagtcttctcactcaattacccaaagcccagccgccatttgtagcttttctaccttccatacgtttcctccccttgttagctgcaattttcttctgttctgggatcaaggaaaagacttccagtttcctccaggaaaggaggacaggtccctaaggaacctttcaaatgagaatgtaaatattctgtgaataccatttattaaggtaaccctggagcccaatatcataaacttttctacacttaagaaaagttgactttgtttactttcagttctctcaaatgcctacatcttagttaccattgttagtcatttacaaaaattaaaaatcttaaattcatccttcctttttaaaaatgtagttcttattcctgataaattatctacagaagtttttgcaaaatgctttactcctacttaattatctgcagttcattacttgtccatgggaagtgaattttatttccccataaactgtactttttctttactatcaaagaattttatttctaacatatgttggcccctattttattcatatcctggctaataatttacttgtcagtatccttcctggaaattttcttgaaagcatctttgtgtttctttcaaggcctaacatatatgagtgatgtgcccaaatttttttgagtttcattacatatccaaggacattttataatttaacacttacttgtcagaagaagagactcagaagtttctgtcccttcccacagtgctacaaccactcattttagaaaggccctaataaaattttacaaccatgttaaagtcaaccttttagcaagagtaaaaccaaaatatccacctgaacgatgtttccttgattggttttaacaagcttgatttaaagttctctcattagtcattttataccactaatatgataatctgaagggcagtttgataagttaattgtttctgatctgaatggaaattaaattaattttggtagaagactaaatgcatatgataaaacttcacatgttctttattctatataattctctcatttgcctttttttacaataggaatttggcttggaacaaaattgctattattcaccccaatgcattttccactttgccatccctaataaagctgtgagtattccacaacttgtttatggtatgtctcttaataattgaggaccatctagttaattttaaaagttggttttgttgaagaagctggatatgcacagattacctgcctctgtgttctccatgcctagagcttgtcagagccagggaggagttctgctcctccagggccacatgggccattaagtggataattgaagatttgggtgacacctggttctcattattcagctgaagttttttatttgtgctttgtaatcaggtggaatggaataagatgtcaattcaggtctgaagggcttccattttattttatgccattttgactgatagagaatcttcctgtcccttccccccacgccaacttcccacctcttgctccttcctctccccatctcttatctaacaaagaaagaagaaattggttagacagaagttaggagaagaggaaggggagtaaatacaccccctacactttttacctctcactcctaatctagtcagcatcacttttcaaattaaatatagcaccttccccttgattttagatgtccccacctgaaaaaatgaagctgaatatagaacaatttgaatacaattaaaaccttttctcccctacaatcctgattgtgaatagaaaagttatcaagagctaaaccaaaatggttacttttaccattaagagtaaggaccctgcttagaagtttttattgagtagtttaacgatctttaggttgttgttttttttaacataaacgttttatgctaacatagactaaaagccaattgttgtttgatgttttgcagggacctatcgtccaacctcctgtcgtcttttcctataactgggttacatggtttaactcacttaaaattaacaggaaatcatgccttacagagcttgatatcatctgaaaactttccagaactcaagtgagtttgtcattaaaactaataagatacatttgtggtcatgtgaaataatagatgtattatagtggtgttctaaatttatgaggtcgtgagacacttttgaattgcatttcatgccctcaagtctcctaaccctggagcattgttaggacaagccctgaagtgggaaaatgtgtcctcctgaccatatttcctttccttctcaaagatgcctcccagaatcatagagttcataggaggagtttgaaaacaattgatccatggaatatatataaaaataaactagggcatgtaattaaataacattataacattattctactcttgtttacaatttttaatttagcttgtatgtacctaataaaatgtactaaattaatatttgtttgaggaagtaatgctgcttaaaatctgttatgcttattattgacaaagaagtatcttgaaagattatgtattttttaacccacggtagtttttacatacttttaaaattatgaaaataataaaaccccaaaagagagttgggaaagcataagagagaacaaaaatcttttttttaatttttaatgtttttattttttatggttacatagttggtgtttatatttatggggtacatgaaatgttttgatacaggcatgcaatatgtaataagcacatcatggaaaatggggtattcatcccctcaagcatttatcctttgagttacaaacaatccaattacactctttattttaaaatgcccaattaaattattattgactacagtcaccctgttgtgctattgaatagtcggtgttatttattctttctattttttgtacccattaaccatccccacttccccccaagtccacccttcccagtctctattaagcatccaggaacaaaaatcttaaaaatgccactctaaacaacatggttaagttacttctttccaagctttgtttccagtgcattttttattgttagactcaaaatgtgcatagaaatatatgtcatattgtagtcacttattctgccataagcactttttcatgttgctacaatttttcttagcagccttttttttaacctttttattttggaaattttccatcatttgagtaatggaagttgcatcactcagcttcagcaattaacatttcatagtgatcatttttaataacttcattgtttttataaatagcactgtaatgaacacctttatgtgcataacttatactttggattatttatttaggctaaaatccaaaggtagaataattgggtgaaagaacatgaacactatatttaattatccgtttctttaagtgttttttgtttgggttttgttcatttaaagggttatagaaatgccttatgcttaccagtgctgtgcatttggagtgtgtgagaatgcctataagatttctaatcaatggaataaaggtgacaacagcagtatggacgaccttcataagaaagatgctggaatgtttcaggctcaaggtaggacttgctatgccatggtaatgaaattgtgttgtgttcagtggaacacatggaaatgaattatgtttgatgaaaagtcatcgaacaggccgggtgtggtggcacacacctgtaatcccaacagtttgggaggccgaggcagatggatcacttgaggtcagcagttcaagaccagcctggccaacatggtgaaacccctatctctgctaaaaatacaaaaaagtagccaggcatggtggcacatgccagtaatcccaggtacttgggaggctgaggtatgagaatcgcttcaacccgggaggcaggttgattccaaagcaagctgagctgagatcacgccactgcactccagcctgggcaacagagcaagactgtctcaaaaaaaaaggaaaaaaaattatcaaacagattatctgaacttcagacaagtccttgtacctcagcaaattgtgaataaatcccactttttaaagactacttgagaaagagaaaactagctcaggatttatcctaaaatttcatctgttctgtaggtgaattcttatatttatatgtataattagattcccccttagcatatactgtcctcaggggtgattactgacatgatgtttccatcagctttttaaagggtctgtttctgaggatgtctttttcatacgtacttcagaaactttttctccagaagacaaaatccattttcattcttatggcctggaaggattgaaagatataaacattttagattccttcatatttcagcagaagggctaaagaatcctgctttttgtccaactaattctaaatcattctcctcacctaccccaccccggggtatctgtctggaaggtgaaatgagataatgtctgtaaagcttggctttccttgaattaagacgttacctaaacagacaacaatgcctctcaaaccacacctgtggtaatgaggaggtgctttgggcaccaccccctgccttccctgccaaccctgcgagtttgcacaaagtctaaacagactaaacagaaggatggcttctcatgctttgggccttaatgatttgttgattccaaagcaagtatgattcagtctgtctgcagataaccttaccagtttttcctgcatgtgtatctgtttaaggaactgatatcttggtccttgccttttttgttttaggccacagcatgtgtcttgttcttgttcttgcttcagtttttgctcttcctgcctcacccactctaatttctctccaaaattattcactcaaaacataaaaacacaagcaaaaagttattagagagcctactttgtgccaggcactgttctaggccttgaaagtacacaatgaacaacacagagagaaggtcattcatggagtttattttcaaaggcagtgattctcaaccctggaccacatattacactcacatagcaacttttaaaaaatattggtccccaattcccacatgagaccaattaaatctgtatctttggggaaatatgttagatcacaaaactcctatttcatggatagctaaaccaagcaccaagtagttatttgttttgtcctctgttacacagaattccccagggaagactgaaacttactgtgtctgattctctggtgttcagagaacacagcctagaacatttgcagtatagcttttatagtgttagaaatttggataaagcggttcctactctgaacgaagaggcccatagcctcctctaatttagctctgcaatgtggggacatcatgagctgcagggaacacgagcagaatgagagtttagatgttacacccggcgtcttgggtcactctccctcacccccagttgtactagaatagtatgtcatagcagcttgagtcaaacatccaaaggcaactttataataacttgcaagaaagctagagcacaaggaatttgtgacagttcatgtctccagaataacccaggactctccactctgggatttggtcccttgaaaagagagtcagaactaatcattccaggacttcttgtgctgcagatgaacgtgaccttgaagatttcctgcttgactttgaggaagacctgaaagcccttcattcagtgcagtgttcaccttccccaggtgagaaaggcatcaaaaattcctcaacggcagtatccaccactgattctgagtccatgaaaaacaatacagctatactttaaaagccgaatctgtgccaactttgcagctcatcagtaaccctccccatagtggcctgtcaaatacaaatgttcattccctggagttgtttttcacttgccaataggattgaggtgggaggacttttgatttaacttaatgtaaacgaaagaatcaagtatgttgttagaggcatatgtaatttttaaaatgatattagcaatttaccctgaaatagtatgctataatcttgttttgtgtaatcaccgacatttgaaagtgacttaggtttttcttataaataactatttggtaaaagcaaataatagtttgtacagataagaggaaggaaggaaggaaggaagaaaggaaggaaggaaggagaaggggaagggaagggaggggagggaagggaagggaaggaaagaggaaggggaggggaagagatgggaagggaggggaggaaagtgaagttgaattcttaatagtttgtctcattccaaaaaacaggatgagccagttgaaaaaaagatagctaggaagagttgatattttatttttaacgaatagattgtcccttgctccctaacctcaaattttaatctaaaactaagatgagattttcatgaaattcacattcataatattacggagtatttccctaggattctccttgtctgcctatggaaacttatggaaatattctgaaaacttatataatgaaaagtccaggagatctggctttttacctggctccaacacagctgtatcttagagacttcaattaagtgatcgaaattctccattctcatttctccatcaataccctggaacaggagcaccgggtgtactcacccagccagtgctgcagaagatccagggtgacagtggcttgagatagtggagcatgcacatgggcactgtgtgttattaggctgtttttgaccattatctcttggcatcctaaataaagagacaaaagggtaattcagcaaaagttgtaaaccctaatttgatactcaatctttgccttccttggacttctaggccccttcaaaccctgtgaacacctgcttgatggctggctgatcagaattggagtgtggaccatagcagttctggcacttacttgtaatgctttggtgacttcaacagttttcagatcccctctgtacatttcccccattaaactgttaattggggtcatcgcagcagtgaacatgctcacgggagtctccagtgccgtgctggctggtgtggatgcgttcacttttggcagctttgcacgacatggtgcctggtgggagaatggggttggttgccatgtcattggttttttgtccatttttgcttcagaatcatctgttttcctgcttactctggcagccctggagcgtgggttctctgtgaaatattctgcaaaatttgaaacgaaagctccattttctagcctgaaagtaatcattttgctctgtgccctgctggccttgaccatggccgcagttcccctgctgggtggcagcaagtatggcgcctcccctctctgcctgcctttgccttttggggagcccagcaccatgggctacatggtcgctctcatcttgctcaattccctttgcttcctcatgatgaccattgcctacaccaagctctactgcaatttggacaagggagacctggagaatatttgggactgctctatggtaaaacacattgccctgttgctcttcaccaactgcatcctaaactgccctgtggctttcttgtccttctcctctttaataaaccttacatttatcagtcctgaagtaattaagtttatccttctggtggtagtcccacttcctgcatgtctcaatccccttctctacatcttgttcaatcctcactttaaggaggatctggtgagcctgagaaagcaaacctacgtctggacaagatcaaaacacccaagcttgatgtcaattaactctgatgatgtcgaaaaacagtcctgtgactcaactcaagccttggtaacctttaccagctccagcatcacttatgacctgcctcccagttccgtgccatcaccagcttatccagtgactgagagctgccatctttcctctgtggcatttgtcccatgtctctaattaatatgtgaaggaaaatgttttcaaaggttgagaacctgaaaatgtgagattgagtatatcagagcagtaattaataagaagagctgaggtgaaactcggtttaaa

SEQ ID NO: 128 - DNA, 20961 bp, Homo sapiens
cagggttctacccggctgggtccaggcagaagtttttcctccccacctccgggtttgtcctcatcatcggtcactcccattcacagctttaagattctggaggccaagaatttgactccccccggatccatggtctgtggataccaatgttccgactggagacggggagcccgcgagacccgggtctccagggtctgcccaaggaagttgctcatgggagcagacctctagagcaggatttgaggccaggccaaagaggttagttactgatgggggctgcataaattgggggttgtggagggacgccagctgggagggagagactggagaagggggtgtgtggagagcccaagaggaggcccagggggaggtgcgcaggcacagcctctgttgaaggagtctctctaaggctgctagggtccttcacctgtcattgtcaggcctggagagcgggcttttaaggaggccaggccacacctcaagggaagatggaggttaccggaaggtcatacctaaaattacgggcaaaaccagggagagttatgaacaggctgagttaggacttgtgtttacgttaatctgaggccttgcttggatttctttttaacctaaaccacaggcaaatattcccctttagggagagaattcgccgacatctatttaacatcccttaattgttgagagcatccactgtgtgccagacacttcggtacacacagaaagaaacccagaggagggtaagatgcccttatagggagatctttctcctcccttcctccatctctccctctctctctctctcgcttccctctctgaagacggtctagctttgggctaagtatacgtggcctcaggagtcaaatggatcaggacaactccgagctttgtcactgaccagctgggcacaggtgtgagtcatttttttttcttcaagcctcagtgtcccaatctgcaaagtgcatatgatggtaatatctacctcatagggtcaccctagggataaaatgagagaaggcccataaagaacttagtgtggtatctgggctcaataaggcatcagctatttttattagccattcaacaaacattttttcctaggatccaatctgtgccatgcagagtgctaggtgctgccagggagagataaatgagacaccctcaaggattcacagtctagtttgttcatttgttgattgatttcatcaataaatatgtatcatgccctacactgagcactggagatgtcaaagtattaataaaagacactgtccctgtccgcaggttgctcacagcctggtgggagagacattgcaacacaatgtgattggtgctgtgaagagagagagcacacggtactgggagagctcagggcagggggttgatccagttccgggcagggcgatggattcacaagacattttggcaaaggtagacccagcttccgtgtttcccagctcacaggtgcactcctaccctggggcctttgtacttgctcttccctctgcctggagctttcttcccctaggatgtccccatagcttgctccttcacggctttactcaagtgtcacctccccagcaagacctttcttggccaccctgtttaaagtggccactccagcccagtgtggtggctcatgcctgtaatcccagcactttgggaggccgacgtgggtggatcacttgaggccaggagatcgagaccaatctggccaacatggtgaagccctgtccctactaaaaatacaaaaattagccaggtatgatggtgcacagctgtagtcccacctactcaggaggctgaggcaggagaattgcttgaacccaggtggcggaggttgcagtgagctgagatcgcaccgctgcgctccagcctggggcaacagagcaagatgtctcaaaaataaataaataaagtggccactcccaccatcaacagtccccgtccccatccccaaacacacacactcagcactcccaccctgctccctgctttatttttctccatttcatcgatcaccacctgacaagctgtacattttacttattcgcttgtctatttctggcttctccctccagaatgcaagctctgccatgagggtagggttctcagctgttttgctctttgctgtatccccagtgtctagaacagtgcctggcacatgatacgtgcttgctaaatagttattgaatgataagtacgttaagtttacaaagatgagtaggagttgagtaagacaagaaagggagggaataacagatgaaaagggaacagggggagggagagagagacagagaaagagagagagagattgaaattagtgagtttaaggaactaaaagccttcacatccagcttattcccaggaatgcgttaggggtggtataaggcaaggctggcgtaggttgggggccaagctgtgcgaggccatgtcctgtgaggggagacaggtgcctctgacttgggcggatgtgctatgtgctgttacagaggttaggaagattgacccaggaaaaaaggaggaagccatgaactctgctggggagctatcagggaaggtgtctcaaaagaggaggcacctcctcttaggcccagggaaaaagtttcagtgttattctagacgtgacggacattctgaaggcctgttcccacatcccctgtcttaacagacagacactgggttagaaacttttcggtgcttgcacgggtggatttcactttgcatttggtcctcgtagtgcctaacgggacctctgcccacaaaattgctcaagaaagatttgctgggttggattgggattgaggcaggtggagcggccttgaattgtagatgattcaggctcatgagcctagaaccttgggcaccatctgtgatcttgccaggcagagtgacagcctttcctagggtttctccctcctcaaaaaaagaagggacattaaccatgtggaaaaacaagtagattttaaccagttagaaaaagagagtggagagcattttaggtggaggaaaaacaacagaaacaaagacagaaaggaaggttagttcatgggagatttcttaagagtgaacagtttaatggattacatttttcaaagataaaacatgtatttgctatgaagttggtgtgtggattgccttcttagccaaagttatggtgaaagttgaacttgagcctgttattaaccaatagctgtaacatatgtataagctgcatgtgcatgctaggctgacacccagatagaactagtggtgtgtatctttacaggaagctgccaatttacagcctggctgaaacccacttggggctgcttctacttccacatttaattggttcatccatcccatcattcttttattccacaaataattatcagccaccagatatgcattaggggccgggtgcggtggctgacacctgtgaccccagcattttgggaggcagaggcaggcagatcatttgaggttgggagttcgagaccagcctggccaacatggtgaaaccccgtctctatgaaaaatacaaaaattagcccagcgtggtaatcccagctactcaagaggctgaggcaggagaatcacttgaacctgagaggcggaggttgcagtgagccgagatcacaccattgcactccagcctgggcgacagagggagactccatccaaaaaaaaaagaagatatgcattaggccctctgctacctgctaataatataacaaagaacaagatgaacatgtttcccgccctcagatgcctatattctaggggcaggcataaggcacatgagccataaacaagtaagtaaaagagagttaaagatgacggtcagtgccatgaaggggaaaaacagggtgaccttgggtaggtagtcaggggaggcctcctggagaaggtggcatttaaggcgagacctggaggataaagaatcaaggactaagtattctaggcagggggagcaggaaatgcaaaagctgttgttggaaaagctcagagagttcaagaataagtcaattcgagagcacagaatgtcagagcctgcgggcatcctggagcccatccacttctctcatgctggtcattgctcttgtaacatatctgcacacgactctggcctgcataaactgttgcagggagggggtcctacagggcagggagcacaaaataattgacagctctctccatgttacggagcaactgaagggcttatgagttttctttgtttttgaaccttggcaaaatgtaattttaaaaacattttttacaggatagaaccgaggcttcataactgacgaagctgacttcatgagctttgacagatcttgtctgcattttaagtgtttccaacacttaaagattaagttccttttcctgagaagtcgagcgggggcatatcccacccactcagtgcccacctcccatgcgacatttcttttcctaaaaagtggcaaataaaaagtgccttccggggagaggaaactcaccactcccaagacagctcattcaattcccaggacacatgagctgttagaaaaacgttcttggattgagccaaaatctgactgcttagcgcgtccgtgcctggtgggtgttggttccgcaatctggagccacatgggacagttctgattcctcctactccccacagcccttcagagatttggagacagactgggtacccccagccactttccaaacccaagtcagccccaattccctcccttctgtctcctgtgatccagacacctcctaagcctcctcacatgggggcccagggccaggcacatccctctgggtgtggcctgctaggaaccctcgttctgggcaccacagtcctgccaccaccgccaaagatgaccactgcctctgtgatgtgactagtactgggtttgggggtcacgcatgtgattgctgagctgtgttacccaccctgtccttgtgcagttcagctttgggggtctttggacagggcctattcactctcttcttatagaactcaggttatcttgttcttgatcaagatcaggataagatcaggacaagatcaagatccaacctccttagcctgacccccaagggcctttgtgacctacccagctccatctctttggccagtccttcccaccattcctgaattcctactaaacacttgaagaaagtttctgagcagtcacttgggggcatgtcccaccatcctgttaaaaataaccagtatttattgagaccttactatgtgcctaaacatctaccgtgtatcaactcagaacatagacatgagacaggtacaattatttacccaattattcatgatggtgaactaaggcacagagcagttaagaaagttgccagaggtcacacagctaataagtggtcgttccagggcatgggcaccatgcatccagcctcagtccatggtgtgcagcttgtattggcttatgagggctgaccagtgattcctccaggcagagagcaattgtgaggcagattagacttaagactgtaaggagtggttaaggactagggcagagcaaaacacataccacatctatgggggcagctacttcttggcaatggccagttgttgcctgtaggagtccagacccaggattcctagatcttttaaaaagaaactggaaatggaaatgtggaaatgtggatttctttctctttttttttttttttttttttgagacaaagtctcactctgtcccccaggatggtgtgcagtggcgcaacctcggctcactgcaacccccgccttccgggttcaagcgattctcctgcctcagcctcccaagtagctaggattacaggcactcgccaccacacccagctaatttttgtactttttagtagagacagggtttcacctcactggccaggctggtctcgaactcctgacctcaattcgggcctgcctcgggctcccaaagtgctggtattacaggcatgagccactgtgcctggcctggaaatgtggatgtctgtctaggatctcttagcatttatacattggcagctaattccattttgttttttttaaagcaccgtgtagatcaagcaaagcatttcttagggctgtatggagccctgggctgaaagtttataaccaaaaatccagttccactcatcggcaattattggaacactgaaccaacttaaccaactgtaactcagctctcacttttccaccttgtttataaggaaaccacgtgacactctggttagatgtcttgtgaaaatcccaatcattatgtccttactgggtctcaacccttttttgtaaagaacacagatttgacagacagatgggtcaggtgtacgattctgggtcctccttttactaactgtgtgaccttggatgaggtacctaacatctgcccctctgtttccttgcttacacgttgggatcataatgccccatgagattttgtgaagattaaggaataccatgaatgctgaacttgccttgcacttgtagcatagcaaatgttcattaaagaccgagttcttccctcattcctttctgagccatcagccttgtaatcccctccaacaggaaatgccagagtggacagcatatcagatgagttctataacattccagagacaggtaagctccctgtggaaagaaggatcatggaagacttcccggaggaggaggacttgatgtagattttctgccaatgagctctgggtaatcctgttgcatgtgccaataaaccatttgacaaggccagggatatctcagcagcttaggttctcagggtgagggagtttccaggtttccatggctacccttggcagggctttagccctggggcgagcctgcatgtgatagacccagcaaatgacagagaacaagtgtgtttatgtgatgtttaattagttctacaaatagttcttgaggatctataatgggtcagacattgttccaggtgctaagatcagaaatggatcagaggacaattttgccctcaagaggcttccattcaattggaggtggaagtggctggggcatctttaatcaccgaagtgtgaatgattggatccattgccaagaaaggggaactgggaaagactgttttgaggggacagtgagtttagttctgaggttcccaagggttattgggatagaatatcagactctatctatcatctgtctatctatccatccatccatctctgtgtaatcatatttgacgtgtggactgggcagtggggtgagaatggagctggagccagaggagtcgtgcattcactcagcaaactcttactgagcacctactatgtgccaagtgttgggttacagaggcgaagcagacgcagagcctaccctcatggagttctcagtttactggaaagacataatcacaatatttatggtagttatgacttactgagcacctacagggtgccaggcactgtcccgggccgttctgcctgacttatctcatcgaattatcagcgttactaagtgagtctggttctatgattatcctattttacacagataaaactgagacccaaagaggagaaaaagctggttcaggtgacacagtggtcacagctgagacacagatttgaacacacgtctctcctacgttggatcttggatctgacattgtgctttctcctggttgctgtattcagtcattccttcattaagcattgtttgttgagtcaaagctagggccaaacttctctgtccgggacacccccggatgcctgcatagaaataagagctaaatccctgaactcgaatgagctcatccagagagtggctgagacagagaagggcaactccagagggcaggtcccacaaacacacctgcatttggggggccagcagagatgggatggggggattagccacaggagggcaggcggcacagtgcagccttgtgaagcccagagggagagagagtttcgagaaggaggaggtggacttcaagatgagtgccctgaaggactgaggaggtgacccccaagcttgggctatgccaggctttgggggtccctgagggcaagctcaaggatgcagcagatgccaggcagtgaagggttcagagtgggggatgacgaagggcagccttctctgtttagaaatttgacttttagagaaaaaaagaagtagaattgtccctagaggcaagggatttttttttcttttttgtggcttggttttgtttggttgagaatggcggagcaggtgtgtgttcgtaggtgggggaagaaactggttgagaagaagaaacgaaaatacaggatggggagaggactcttccccatggctctgatcaccgccagacaccatctgtgtttacttctgtcttcacgatctgtttcccaccagccacaagggcagctctgtgaaggcacaagttctgtctcattcaccgtgggatcccagtgcctggcacgtagtagacacttcataaatatttttgatattgagttgaattcacagggttcttccgggagcccagtggttagtcctaggaagagaagggttcatgggggccttaaggaggggcttctctctgatgctaccatgacaagagagagggagagaaaaagaagtcaacacaagtagaggcaggagccaaaaatccaagtctttggcggggtacagtggctcatgcctgtcatcccagcactttgggaggcacgggtgagaggatcacttgaccccaggaattcgagactagcctgggcaacatggtgggaccccgactctataaaaaatgcacaaagaaattagccaggcatggtggtgcccactgtagtctcagctactcgagaggcagaggcaggagggaagatggcttgagcccaggaggtggaggctgcagtgagatgtgattgtgtctctgcactccagcctgggggacagagacagaccctgtctcaaaaaaaaaaaaaaaaaaaaaatccaagtcttctcaaaaaagtgtgtgtggggtggtggtgtgaagggtggaattaacagaagtagaaaatggagaatactagtagctacttatgtcctgtgagaacattctagaaggtgagctgtcattgatttattagcattactctgcctttgctatggctctaagttataaatttaagaattcatttaatcctaacaacagctctctgaggcaaatgagcttcagtcagccctgaggtgatgtggctagtggtgaggaagccaggatttgaacccaggacttggagctgatatagagcctgtgatgttacccactgggccatatacttccccaactgacattagtttatatgccttatttttatttttatgtattcatttattcattaatagagacaggggcttgctttgttgctcaggctagagtgcagtggtgcaatcacagttcactgtaacctggacctcctgggctcgggccatcctcccacctgagcctcccagggtgagccattgtgcctgacccacatgtgccttgttttatatactacattcctcaccaggagcctctgggtttggaggggctcataattctcatgttttacattaagaacagagaaatatagtgacttgcccagggtcacacagatactaagtggctgagctgggactccagcttgcatctctctaaccgcaagcctggcactttccccttccctgagagaagaactgtaggaagttagcacagagtcaggtgccaaaaaagggctaccacctggacgtggcaggcaacattctgtggtgtttctgcaggcatctcccgagtcaccccagctcaggaacaaggcagaaaaagttgggggttggcaagttaggaacaagaggaagaggacggggacaaagctgcaagtccgggagcggggctgcctgtcttctctggcagttcctgggttgaggctgagcaaaacaggataaaatctgagcaggagcccacggctgggggacttggcaaagacccagtgtggtgggtgggagggaggctgtgccctggagggggattccagggttcctgttcttagtggggaagagccctggatcgagggtggcccaagctcaactctgatcactgtccctcctgatagccacctgggcactgtgacctgcttcagaaaacagctgcttctgtggcagtaatcccagcactttgggagtgtgaggtgggtggatcacttgaggtcaggagttcgagaccagcctgaccaacatagtaaaaccccgtctctactaaaaatacaaaaattagccaggcgtagtggcatgcacctgtaatcctagatacttaggaggttgaggcaggacaattgtttgaaccagggaggcagaggctgcagtgatctgagatagggctactgtcctccagtctgagggaaagccagacttcgtctcaaaaaaacaaccaaaataaacaactgcttctgaatacacaatggaaaaaaatccccaggggttgtgccagggtgaggggaagtagggcttcctgtgtgacttaccaggaatcttggagctggcccatgcaggggtgtgggaggtgacagagaggtctttaaaaccaggtgggcccagccccggcctcttctgtgggcctgaggacggagaaaaggtctcactggtgaggaatctcatctttggggctgctttgcctgagggaggtgcagagagcagggccgagagaggggctatgagaggagacacctggcccccttggtcaggggagcagggcccgaagaggagtgaacccccatcacctctctcacagacagcaggagggctcagcagtgccttccgtgcaatgaggctccgcactgtgcgttctttccagccaggagacctgaactgggaggtcttggagctgctgcatgtggacttgggggacccgtcccttggcaacctggccacgtcctggcctccacatcttcctatgggctgtccgtctctattctctcccctctcattactgcaaccgctgccctcctctgaaattctctcgcggctatgcgcttcctctctgtggtcgtttgattaaaatagctgagtccacatcctcctcctggcgcccgctttgggctctgctgagtggatggctctccactcttcggggcagccactccatgcctctgccacctccaccatgaaactgcttttttactctttccagggtgtgggttttctccaggtatggggaggccaacagatcaagaaatgattgccattgaaaagatagcttgttatttacagctcccagaagaaggcgtgcttccacccagggccacgcaggaagtgccaggtcggcaggtcaggaggagccacgggaagcatcgcccagggcctttgctgtgatctctgggaaaggctggtggggcaggggacacagtttaggaccggtcagtttgaatcatgtcagtggaactccaggcttccctagttgtccagtttctggccctggggtgatttagggcaggagaaaccttggcttggagtgtgagagtgagggaaaggtggcccgggtgtaccaaggcactggttgtgtcagcagtgggacgtatccatacaggcctcagcatcctcaggtcttgcctcctcagaagaaagaattctcatggctgtaatcccagcactttaggaggccgaggtgggcggatcctgaggtcaggagattgagaccatcctggctaacatggtgaaacccatctctactgaaaatacaaaaaattagccaggcgtggtggcaggcacctgtaatctcagctacttgggaggctgaggcaggagaatcacttgaacctgggaggtggaggttgcagtgagccgagatggtgccactgcactccagcctggtgacagagtgagacaaaaaaaagaattcgactgagggacataaggcagaaggagagactgaggcaagtttcacagcagaagtgaaagcttattaaaaagctttagagcagggatgaaaagaagtaaagtacacttggaagaggggccaaccaggcgacttgagagattcaggggttctgtttgacctttgacttggggttttatacatggcatacttcaggggtcttgttttccttatcccctgattcctcccttgggttggtggggtgggctgtccgcacgctcagtgacctgccagcacttgggagggagcatgcacagtgtgttgactgtagttgtacgcatgctcccttgaggcgttcttcccttaccagccgaacgtccctagcaggtcatataccagttaaatgccgccattttgcctcttcatgcacatgtgtgagcccactcacccagctcctgagatcttactggaagctgctgatcacctgcttcaggtattcctgtttattgggagactacctttccctggtgctggctgtgaccagttattattttagagagatggttaataatttcctgcccatcacctgatggttgcctgacattcctgccctgctcctgtctgaccagctacctactgtcacagttggtctgtatatgaaaggcatgctcacagaggagccatctgaggtgtctaggaattaactagcagccctggaaggagcaggctgtctctggcctccaagatgtcaaagcgtcctaaaatatagaaaatcaaaagcatgtttagtgcccagggatgctcagaggcagtggagtagagtcagtcaaggaaatagattcacagttatgggctaaacccttggggacctcacttcaattgtctgagcctcaatttccttatctgtaaaatcaacaactgttattcattgaacaagtgactgtttaaaaggacagacaccgggcctgccaaggtcattgatgggtttagagagatagaggatagtgcttggcacaccagaggtgctcagtgagtggcaggtggtgtccttgtgccacagctccagggagcagcagagaaagattggtgtggaatggtggggtctagggccatttctttggctgtttggagcccttggagcagaggctatgggtggacagaaccctcaggaatgttcttgggattcagagttgctgctggacaagggttgtcccagaggccagctgtggacagaaccttcaggaatgttcttggaattcagagttgctactggacaagggctggcctgccagcccagtagccaggagcccaggggagtctgaagcatgtttggaggccaggtcttgggaggcgccaggggttcaggtagagctctggcacaagcgaccgttcaactcagggacttgagacaacagagcactgaaggggagagccccaggcctgccgagctgtggacaaacaaggactttggatcctaggaggaaggcaatcaggcagctgccggcaaggaacctctgagaagccaaattagaatcaggtgctggcctgagacacatggaatttcctggactctaagctggcaatggctgtttttaccaaagacagattctaaggagtgaagccaagggctctggcctgagaggtagagcatgagaaggaacaaacacagacccctaaaggattcatgcctctgggaagggaggctgcgtggtgcagtgaggggtgcagaaggacgcggctcgaatccagcctccactgcttaatggctgtgtgacctctggcaaggtccctgagctttctgagcctcaactttcccagtggcaaaatgagaacagtaatacctaccctgcagcactctcgtgagcccccagggttgacttattctttaggtagacacagtgcctgggtcccaggagagtgtcttaattttataaattcttttaaaatcaagaggaaggaaatgaacataataatgaatatataataataaatccagcttggattacatttttctttatagcatcatagttgtcaaaaataattatgtgaatatagatataaagatatagcagaaagatgcctacaaaggcaaaagcgcttggggcccataagagccataatcaggccctgaaagccactggcacattgtgggagcccaggcttcactgctgagcacctcctctgggccaggcactattctcagtggtagaatagaggtgtgcatccgcccagcctctgcctgcaaagaaccatcagggtagacatccttaaaaacaggcaactacagcactgtgagctaaaaggagtatgagatgtagaatcaccggctttccttctgccctcctgctgtgggcgtcaagtgctctctgtccaggaatttttttcttccgtcttacatctttcatcaaaggccatgtctaggttatatcaagtcctgcttctccacgtatgccaccaaatctccatttaagaatcctgcccattctctggtcccttttagccattttgccaacggggtgagtatgtctggggtgtttgtggctaaaagtgcactggtggtagggacagtgtccctgcaaatgcttccattattgtccctctgcctccagggccctcagtggacctacagttttttgcctcatcttttctggctggactcatcttgtttattgcccaccatgacggggagtggaatagatggggcctggtggagagccagggtgggatctgaatgggccacgggggcattgcctgatagatctgttgtgggatgtgtttttttttccagaaccccagagatgaaaggcctcctcccactggcttggttcctggcttgtagtaagtgctggccccgtgaccttcgaatgaacttttaccccatgggagtaacagggtggtgaaaaggacaccagccattgaggtcgtagagacttgggtttgaatctcggctctgcactgactgcatagacattcagcaagagccttcatgcctccgagcctctgcttcctcatctggcatgggctaatgcagtccatgcgtaaggctgtggcagggtcctaggagatattgtacctcagctgtgtaaaggttgtggacatagaggttatgtggctggcaagtgtaggaggcagattttttccctgtatgcaaataaaataagatttacaaaatcccccaatcaatccaaataaaaatcaaaactcttatctaaatatcccaacctatgattcctgggtcattctcagctcaggcttgtccagctgggaagtgactgtatagatggctttagtcccatcctgcggccccgtgaccgtatatacaacccccgacaggctgtcctgctccttgatgtcttgctagatccctggagactccaggaggagctggaggcctggtgcaaggagagagccttgggctcactgtgaaaccctggacagggcacctcttccctccatgcctcagtttcccattagtaagatgagggaactggcttcagcgatttctaagagtcccatcctgcttttagattctctgccttatgttctaaagggtgtgaggggagggagtggtggggaagagggatgtattgccaagagagacaggaagctcctatctgcctgcttcatgcaaatacattatgaattacaccttatatgtcatggtcacttactatgtgtctgccaccgtgctcaaaatttacatagttgatcttattttaaccctcatgacaactccaagatgtagctgctaatttggggtccccgttttccaggggatgaaactgaggctctgactccattcaataccatactttgaattagtggcagagccaggatttgaacccaggtctgctcatttttcaattccaaactcttaaccagttctccatactgcttgcacctcccttcccactaatggagagaataaaaaagagacatgcaggtccctccaagccctgggtgggagaaagggtaggagatgttgggcagtgggcctaaagcagggctgggctgcctgggtgtcacctggggacatgggctatcttccaggtgtgcctgctgtgcaaggaggcttgctggacctaaaatcaatgatcgagaaggtgacagggaagaacgccctgacaaactacggcttctacggctgttactgcggctggggcggccgaggaacccccaaggatggcaccgattggtgagctgatcgctataactgccctttaggctccaggctctgcacccatgttttcttattcaattccatatcagttctggaagatgagtattaaagtaccattttacaaataagaaaactaagcctcaaagaaattagctggcaatcccaagatctcagtggcctaaggtgtcagttggtcaactgtggcgtaacaagtggtcctcaatgtagtagcttatacagcactggtcatttactttgcttatgaatctgccatttgggtagggcttgtggggatggcttgtcgcagcttcagcttggacaactgaggctggacaatccaccttccagatggctcactcctatggctggcaagtggtcagcatctcctggcctaggagcgggtcagaggcctcaattcctgtcacttaggcctctccaaggatgttcgggattcctcccagcatggtgactcttgggttgcaagagtgagtgaccccaaactgcaagaccaaaggatatggtgttttatggtcagcctcagaaatcccattgtgtcacttacactgtactcttggtcaaagcagtcacaaaggctttaagagggagggcatctagattccacctcttgatcgggaagtgctaaagttctagaagaacatgtgaaatgggagattttgctccttggaaagcatacccaactgggttaacaattctgatactgctagacatatataaaggaaagggatgattaagcaaatgaaggacagatggttggggccaagtttctcactgttggagtgggataagccagggcaggaagccagaatgatccatgtgcaaaaggactaaagttggagacatcagtatggactcctgtttagcttattgtagatacagatgtttacatgtggaagtatgcataggtagcagtatgcatagatatcatggatatattagtatcatactaatataagatgtaagtaataggagaaaatggtgtttcctctgtaagatcttctcagtttttctgtaaaccaagaatactttttatgtgcaatctgctacacctaacatacagtcatccctcggactggttccaggacccctgtgaataccaaaatctgcagatgctctagtccctgatataaaatggcacagtattttcatataacctgtgtgatcatatactttttttttttgagacggagtcttgctctgtcgcccaggctggagtgcagtggcgcaatctcggctcactgcaagctccgcctcctgggttcatgccgttctcctgcctcagtctcccaagtagcatatacgttttttttttatacacatgggcaaatagaaacattcttttgctatcagtggagagggtctaaaagaaatgacatctcagtagcaacaagcacacttaatgcctagatctagtttccaatgtcattcttcaatagaaggccccttccaagtcatatatatatatacagggttccttgaagaaatggtcaattctaggaccaaggcaggaaatatacgagatgagcctggaacttcttttagtgccaaaaagtaaggaagtgcttaaataaacgcaaacaaaacggaagcccacattgatggggatgtgacaagtggcacctgtgctgactgaaagagcccccagtggccaaccctggaacaatttagcaacaaaataaatggccccaaactccagtcttatcatgagaaaaaagaaaatcagacaaatcccaatcgtggggcatcttataaaatgtctaaccagtaccccctcaaaacagtcaagaacaaggaaagcatgaggaactgccacacccaagaggagcctaaagagacaagaccatgggccgggcgcggtggctcacgcctgtaatcccagcactttgggaggccaagacaggtggatgacctgaggtcgggagtttgagaccagcctgaccaatgtggaaaaaccccatctctactaaaaatacaaaattatctgggcatggtggcacatgcctgtaatcccagctactcaggaggctgaggcaggagaatcacttgaacctgggaggcagaggttttggtggtgagctgagatcgcgccattgcactccagcctgggcgatgagagtgaaactccgtttcaaaaaaaaaaaaaggcaagacaatgaaatgtaacatgggatccccagtgggatcctgggacagaaaaaggacattaggtaaaaactagggaactctgaatcaattatggcttttttttttttacaattagtgagataatgatgtattatttagtgaataattatcaataatgtatcaatattggttcattaattctaacatgggtctcatactaatataagatattagtaataggaggaactgggtgtttcctctgtaagatctcaattattctgtaaaccaagaaaaccttttatatgcaatctgctacacctaacatacagtcatcccttggactggttccaggatccccgtggacaccaaaatctgcagatgccctagtccctgatataaaatggcatagtatttgcatataacctatgtgattgtatccccccaaccatttttttttttctttgagacagggtctcactctggttgcccaggctggagtgcaatggtgcgatctcagctcactgcatcctagaccttctgcactcaggtgattctcccacctcagcctcctgagtagctgggactgcaggcacgtgccaccatgcctggctaattatatatacatttttaaatagagacagggtttcaccatgttgcccaggctggtctcaaactcctggacttgagcagtctgccttggcctcccaaactgctgagattataggcatgagccaccgcgcccagctgcgatcacatactttaaatcatttctaaattatttatcgtagctgatgcaacgtcagtgctatggaagttgttgttgtattgtttgggaataatgacaagaaaaaagactgtacatgtttagtatagacacaagaaaataggcctgcttacattttccatccatattggttgatccacagatgtgggacctgtgatacgagaagtttatttctggatcacataacagttcagtaggaatcacacgttggctcctcccatcttgtagttctgccatcccctatggcctcagaattctttgctgggtcatctccatccagccgaaggatggcggcagaaggacagtggagtaaactgtgggaagtttgtctgggcaggtctggaggtggagtgtattaattccacctacctcccctggccaggaccaaatcatgtggccacacctactcgcaagggaggctgggaaatgtagtctagtcgtgagaccaggaggaaaaagagggtccatgacctgctggctagaaatgaggagcaggaaattactcagtcacactaccagatcctccctgccacatcgcgtccaccaaggtggcctctgctaaagtgacatggttgaatttttgctcctattagggatggggtcaggagggcacccctcccactcgggatctaagtctcttgcacggacaggtgctgttgggcgcatgaccactgctatgggcggctggaggagaagggctgcaacattcgcacacagtcctacaaatacagattcgcgtggggcgtggtcacctgcggtaaggctggggcttcccgttcgggccattggaagagcacctgactttaagttcagctgccctagagaacagccagcctgtatcttgttgggggaggaggagttgggtgcagaactgggacgagaggagcaggattattgcagctgtatcagacccccagggtagggctgaatcatccactgggtgcaaaagtgcttgacatgcttcctttttcttgattcccccacaaaatacctgtagagtatgtttaggcttctccattttagacatcaagaaatggaagctagaaagcctgccagtgcacacagcaggattcaagctcagggcctctgagttcaaggctaaatctggggatggttctgctctatgagaatgagagttcctccagagcagcggctgcctccaccatcagactgggagtcccccagaggaaggaaggtgcttcctctatcagactgggaactccctgagggcaggagctgtctcctgcactgaaacctcaccctgagcagcagctgtgccccttccatcagattctctattcccccgatttaggagccatgcctcttccatcaggctgaaagctcctcggagcaggaagtccatggggtctctgctgagactggagcatgctcttcccaccctcattctgctcttggtgtccttttgcagagcccgggcccttctgccatgtgaacctctgtgcctgtgaccggaagctcgtctactgcctcaagagaaacctacggagctacaacccacagtaccaatactttcccaacatcctctgctcctaggcctccccagcgagctcctcccagaccaagacttttgttctgtttttctacaacacagagtactgactctgcctggttcctgagagaggctcctaagtcacagacctcagtctttctcgaagcttggcggacccccagggccacactgtaccctccagcgagtcccaggagagtgactctggtcataggacttggtagggtcccagggtccctaggcctccacttctgagggcagcccctctggtgccaagagctctcctccaactcagggttggctgtgtctcttttcttctctgaagacagcgtcctggctccagttggaacactttcctgagatgcacttacttctcagcttctgcgatcagattatcatcaccaccaccctccagagaatttttacgcaagaagagccaaattgactctctaaatctggtgtatgggtattaaataaaattcattctcaaggctaataaaaa

SEQ ID NO: 129 - DNA, 285125 bp, Homo sapiens
agagagagagagagagagagagagagagagagcgagagagcgtgagcgcgcgcaagctagcgagcaaaccagagagacagaccgagagagggaccaggagagagacccagagagagaagaagaagccagaagccgagctctgtcagggctcaacctccaacttgtttcagttcattcatccttctctcctttccgctcagactgtagagctcggtaagaaacattgatgttccttcttccccctcccccaagctcaggtctcctttagcgatagcatctctcccccgtactgagagtctccttgggttggccgggaggcgaggcatgctctgcagctgtgatgctatcctgggttccccagtggggctggtggaagcccagaggcggcatctgagcagggagacactggggtaaaacccgatttgaggaaggggggttgcgatgtggtatatgcgtgatttgcttcattgtcagtgaattgttttgttcctctttggaagcaggtcagcactgaccttgcaaattgcttggggggccccagcagctgctgcagaaagccacggagtggcccctagccaaagcagacagcactgtcatgaccccccagacagctctaggcaccagggatgtagtaatggctggagctttctcccttctttaactctttctccgcagctgcttctcactgctggaaataagaaagaaggagggtaccttgcagcctctttccccatctccccattacctcccccacatgcaagtgagtagaaagttgtaaataactgcttcctttaaagcagattgagccctccccccttcctttgaggggctcactgtggggttgggcctgacttcctccacaaacttgggaggtttgccttgtttcccggcgagaagctccattgcctgcccaccctcaattccagataattgagctgacatcctagatcagagattgagataccccaccccatctcactcataggcatcatgttaagtccagctgtgtccttggaagggaggaaacacctgatggtttgtctgcaactggcctcccagtttgttgctcctctgactgtggctgtggctgtggctgcgggtggcatgggcaagaggactgggggaagggtggctgttggatttatggaaagcagggtgatgaggtaggattactaacgtgagtagtttggcttattgagagtcagcaagttctggttgtctggagctctgcaaagactgattgaggctcttgtagtatagcccttcagaactggtaggggaagggatccaattgtttgatgggagctttctaagtgagtgacgctgctgtgcctgtggtagtaattctgacatccctaatactaattgctaaaattatcgagtatgtagtatattttggattctgggctgagtgtttggtgtgtattacttcattaaattactgtagcagaatagtgcattgaataacagacactattattatctttggtttactcacaaaattgaggcacagagaggttaagtaacttatccaagattacagagcaattacatgtctcagttggaaattaaactggcaacctggttccagaatccgtggtcttaaccatgaagcactactgccttcttggggagaattttgcacctttgtctgttaggcaagtgtagatacaataggtacagtgtggcttggcaaggttttttggaaagtagcggcctggctttcgtgtagagtaacagcaactcagcctggagccgggcttcacctggatttctggaggggctgcccaaaagactttgattggtcagcttcctttccttgaaaatcgtacttcactttttatagcctcatccacccaacatgctccaaactgcaccttttaaaaacagacctcattcttatttcctgagcatttggagttgttctgtgccgaaaattttagaatactaaaaccttggaactggaaggagcccaaaaggtcattcattaagctttatttctctactcagttcttgaatttatcctaagcatccaatttgttgactgatttctagttgaactccctgcagtgacagagagtgcattaggtggctctttgtgtcatggagcaactctgattgtcagaaagtattccccatcataagccaaagtctgtttcccagtaacttatattcgttggttctttgggactatctggaacaaatttgctttttcttaataatagttcttcagttagttgaagacagcaatcatgcctccctcttaacccttggatccaataagaccacagagtaaaggattatcatttacttcatgctggatattagactattcttaatatggcctaatagcccacttgttttgttagccacaaattgaccctacggagttttctagagcagccctgatagtgtatattctcttccttggatgagcttgctatctggtgtcaactggactgatgggagcaaggaaggtcgctttcatattcctaaagaccagaaattggttagtactagtccttctaaagcccccaggatgtctatatggcatccggacaataggcgtgtgggaagatttgagtggcaggaattttcataaagaaaattatgaaattttctaatttcatgaagaaaagtaccacatttgaaatagtggtagttcaaggttcatacagtatgcagaaggtagaagaatatattgttttatcagaaaacacctcaggaataattacatcactgaggggatacaatgcagtgggactgggtggaaaggggtgagtatgtggttgctagaatggaacactgacttggctgttagcaaatttgggttccattcctagctcagatgatttgctgattatcttggacatatgacttcccctccatgtgcctcagtttttccatctgtaagatgttgagatggactgtgtctctgagggtctttcaactctgaaattctctatctgaagtaaattataagatttcagagttatgagaggcttcggaaatcgttaggccagtgcttctcaaactttaatgtgtaaaaatatctcctgggaatcttgttaaaatgcgaattgtgattcagagagtctatggcaggggcctcggattttgcattttagcaatctattaggtgatcctgaaactgctgttccactgaccacacttcaagtagcaaagctctagtagagtactggtcaaactcccctagtgaaggaaaatgtttgttgtcatttgtttgtttgtttcctaatccatcacagaagactgttaatttagtaaaataaattaaccatgaattactagaaaatgaaagaaaagacatacaaaagataagcccgcatttgtattattagattctacagacataaaatgattttttcaaattgctgtaacattttctaagtgcttactcttgacttctgtactttggtccttactgcctggtaataaaagttcacagacaggcactgatttggcgggctacattttgagtgcactggtctaggctacctgcccatctaatttaagaggcccaaattagacccagctttaatttctaaatcacctgtcatgatcttttaccctacagttaaatatctcctttaatgaagaatttaacatttacacaaagttgcattgttcatgtgttgtgacagataaaatgtttgttttttcttaaaactcttaatttccttagagtttctacaaattacgctttcagttatatattccaagtgggtgaagggctgtatcagttcagttaattataccgttagccattagcctagtatatgacatagagtaggaggcttaacagatgttttttaaataaatgaatgaaccatttgacattagttgtggggccatacattcaataaaggaaaggtaatttgggctttcttctgcattggggaaacaggattcatcccattttaaaaatttcttacagtggatagaaagccaacttgactacttcagagggttacttggtatctcaattttattttgaagggattgctggagtgggccattataaggctgttggtctttattctagaaagagtgggactgattaaagggctttgagcaggataactgacatggcttaaatggaatctattcaatataaggttactaagtgcctatgatgaaccaaagataatgtgggagatacaggattatttaagaatagcctctgccctccaagatgacacagtcaagtaggaaagagaagaaatagacaaacaactatagtattaggagatgagatctacacccataagagagaagcaaagggctttaaggagatcaaagacaccttcctggaagtggcatttgaaatgagctttgaagatgagacaaactttgagtgtgcagaattgggggatgggaaaggtattctattcagaggctagttgtgttggagtaaagtgtatgcagaaatacttatgtgggatgtgtttggcaagatagatggagggcttgactgtcaatcatactgaatgctagatgggaaaattaggactttatatgcaaaggagatgcaactccctcattttgtggatgagcaaacccatcttgacagggtgagggacttgatttgcctgaggccacacaggtagtaatattgttgtagcccagtaaaaggtactgagcacatttgaaaatatgggattggaactctggaaagaagtcagtaggagagagtgatttgagagtcattgcctctcaatacttgaaatagaataaaagagattcaggggtggtactttgaagaatgctttttttttttttaggatatgggagagaacaatgaaccttatgtgaaggctacaaaggagaaaaagtcagggatatggaaggaaaattagaagagtacagtgttatgaaggtgccaagagaggagaggcaccttctaatttatttcttgcatacataacatttactaggcatggagaatataatggtgagcaaaacagacaaagttgttgccatcctgggctcatggtttagatggtgagatagacattattcgacagaccactgaactatgtagtcataaattgtgattcatatgtagaggaaaatgtaccgctttaaaaagaaaggtgtggtcagcattattaaacttcacagcagagttgagtagtgatagatgatatctggtttataacagtccttcccactctgatggtcacagtgcctaccaacacttcagttggatgatgcatacgcattttgcaaatgtttggcagatgactgtgcttcaatagtaagggaagggaagggtccctccaggctcatgtccacaggagcagtgacttacttaaaaactaggttatatgtcatgtagcttaactgaaattcacaaagacccagtgcctttcccaggtcctccaactctctctattcagcaatttataggaagaggcacttgataaaaaatatgaagaatttgatattaaaaatccctcttaaaatgggatttctgatagcctagtcctgacttggatactcggtttgttgtgacatatcacttgtcttgttggagcctgtttccataactgtaaaatacggtggggggaggtttggaaaagggttttgaatagggtgactgacatgaatccattaagatatttagaaagagcctccaagctgtaaggttctatagttcatgttctgctctatattgtgttatcatggttctgtgcaggtagctcaggtttggtcacttctataagcaacactaataactttatacagaattctgaaggttgataattttggtgggagtattcacagactttggaaggggtcattgaaatgcaccttccattttttattcctgaggtgactgaaattgtaactgtcctgagagttaaggaaagaactgaccgtattgtaaaatatatagtaaagttggatattaggtggtatttctattactgctggtttgaaataaactaaagtcactgagaataagatggggcataatactgttaaatacacacaaggtgattatctcattctgaaatgtaatggtccaggtagtctcttcctggggggaagatgtatgtgaagggaaatactagttggtaatataaaagcatttttatacttaaaagcatgattttaaacgtattgatgtctgcacaaaatatgtctcctgaatatacacagaagggggaataaaaatctccaggatatatattttgaagggtacttttctctttaaaaactgatttcttaaaaaacacaagtatttttttttttttttttttttttttttgagacggagtctcactctgttgcccaggctggagtgcagtggcgggatctcggctcactgcaagctccgcctcccgggttcacgccattctcctgcctcagcctcccaagtagctgggactacaggcgcccgccaccacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaaaaaaaaacaaacaaacaaacaaaaaaaaacaaaaaaaaaaaaacacacaagtattatatatagtttttaagggaaggggaggtggatggagatggaattatgtaagtgaccatagcataaaataacctttcaaaatagtaaaagaggagttcagaaatggcagggcccttaacaatcatgtgatggcagtcttatcacccagtacatatggtcatctgttttcagtgtgaatggtttcaggaaaggttgcttaacaccaccagataacagacagcttggttgttagcaagttattcttcatactgacctgcaatctgtcttctgaattcaacctattgatcttgcaccttggagcaatagctatactgtgtaattgctgttccccttccttgtagtggccattcaaatgtttaaccatggttgttcttctcatcttttcttcagtctatatattgctagttcttgagcttatgtgatatatattttgagaaacttatacagtagacacttctatcttcagtgtccctcttaatatatgatgtccaaaacgggacccagtactttaagcatggatggctagcacttccatttaaaaaattgagtatattttctaatataccttaagattgtaatatctaccattacattgttttttcctgattataaaagtaaaacaaccgcattacagaaaattttgaaaatgaagagacatttaaaaaaaaaatcacctctaaatccctagtccagagataccttgctgtatttcctttcagatgtgtttctgtgtttatataatcgggatcacatcttatatgtactatttttgatctggctttttcattggtattatattgtgagcatttccccacatcggtcagcagccttcaaacaatttttaatggctgcatacttttcagttttcaatttctaccataattgtatgacagatcacatattgatcgtttaaattatttttgcttctttgaacctcaccttttttaggtctttattcaaatgtcacatttgaattctaaatgatctcacataaaaatgcaaacccatcttttccaacactcactcttcccctttcttgctttacttttttaaacctttggtttgtgtcatcacctgatagactagatacattacatctattgtttggattcctgttttagggtgtaagtccctcaagcccggggatttttttctccattttgttcactcttatatccgctagaacctacaataaggtctgacatattgtagatacttactaaatatttgttgaatgaattattaagatgagtttttatgaaagacattactgggcctgaagatactaacgttttaaaggctcttgatatctatgtgaaggtgttccactctactgtataagattgttgattactgctcatacacccatgacagtgctggccattgccattcttttaaaatttttaccgatctgttaggggcaaaatggtaccttactgttttaatacgtgtttcttttattataatgagattgaatacttttttatatttcttgattaattttgtttcctttctataaacatctatttatgatctttgtacatgttccattaagaacttacatttttttaaatttgtatgggcaatgtatgtttagttgacccattagacctctttctgtcaaatgtagggaaaatattctcccacttacattttaaatgtttacatttaaaagtttacattttaaattgacttttatgcatagtaatcttaattttatgtaattatatttatcttttcatttgtaatttcttctgatgaattcgtgtttaagaatttcttcctcattcaaaattggataagtgcttaaatgaattttgttttagtttttattgcttatgtttaatccctctggaatttattttgctgtgtagtgtgaggtaattttctaaattgttttccctgccaattgtttcatagcaccaaacactgaataattcattcattcccactgttctgtaatatatacaaattgtaatatataatagattctgtttggaatttatctattcttcatttcttttagtctgtctcttcctgtcctagttacaaagtttaaatattattgtagctttaaaataatttttattacctcagctcttctacttactagctgtgtagtctctctaagcctaaatttatctgtatagaatgggtagcagtaacatttattttatgctcttaattttgtgaaggggatctttctaccattatttctgctaattgattatgcagaaaattagtatttatgattttaacttctatttttttcactttgctgaaatttattattataaatgtatagtttacaagttattttcttgttttttttccctttttttattttggaaatttaagggaaactcagagaatctttcaaaacaatgaacaagtaaccacatatatactactcagagtgaacaactgttagcattttgtcgttttggcttttgatatgttttaataaaataaatgaaacattatatataaactttaactttctttgtgtctagcccccgtttcattcctttccacatccctccaaacgtgacactcagggccactcacatttgctgaattttctattcagttgcttcttcttactgattcataagacttatttatatattctggatactaattatttgtgatatatatagcatatatctgcttctataatgttacttcgctttctattttgtttatggggtcctttatcattacagaagttttacattttcatatcaggtttatcaatcttttcctccatgaattgtgctttttgtatcatgctttaagagatattcctgatgctatgatcataaaaaatgttctccaaaattttgctgaagagttcaagaaattttctttacacttagttctttaatccatctggattttattcttgtatgtgatgtaaaatattaagcagttttttttccatgtaaaatactatttgttttaaatatcatttatacacaactagtttagaccgcaaactccaccacattgcctaatttttatatgtgtttgagtctatttctaggctctctattgtgtttcattaatctatttgtctacacttgtgttgttttacctacaaatgctttataacgaatttgatatttgtaaagtcaagttactgttcactgccttcatccacactcacaccacttttcttgttttttctggattatcttatttttggtcctttcctcacttaccttaattttaaaacgaaattatcaaattacaagaaaataatgtttgtttttcttgaaattatattgaatctgtagaatgatttgaagaagaattgacatccttttgacagagatttcctattcatgaatatgttatatcttggcatttattcaggactttttgcaacctttgatgaaggttggtaaatttattgataatactcttacatattagatttagtcccaggcaactttattttttagtcagatttattaatgtataattagcataaaataaaacttaccctttgtaagtgtacagtttaagttctgacacatgtatatgattgtgtaaccactaccaccggtgccaccacaataaggatagagaaaatttcccttactataacaggttcttttgggcccctttgcagccagttcttttcttctacctacaattccaggaaaccatctatctgttttctttttcttttcttttttttttttttattatactataagtctgaggtacatgtgcagaacgtgcagttttgttacatagatatacatgtgccatggtggtttgctgcacccatcaacctgtcacatacattaggtatttctcctagtgctatccctcccctagcctcccaccccctgacgggccccagtgtgtgatgttcccctccctgtgtccatgtgttctcattgttcagctcccactaatgagtgagaacatgcagtgtttggttttctgttcttgtgttagtttgctgagaatgatggtttccagcttcatccatgttcctgcaaaggacatgaactcatccttttttatggctgcatagtattctgtggtgaatatatgccacactttctttatccagtctatcactgacggacatttgggttggttccaagtctttgtgaacagtgccacaataaacatagatgtacacgtgtctttatagtagcatgatttaaaatcctttggatatatacccagtaatgggatcgctgggtcaaatggtatttctagttcgagatcattgaggaattgccacactgtcttccacaatggttgaagtaatttacactcccaccaacagtgtaaagcgttcctatttctccacatcctctctagcatctgttgtttcttgactttttaatgattgccattctaactggtgtgagatggtatctcattgtggttttgatttgcatttctctaatgagcagtgatgatgagctttctttcatatgtttgttggctgcataaatgtgttcttttgagaagtgcctgttcatatcctttgcccactttttgatggggttgtttttttcttgtagatttgtttaagttctttgtagattctggatattagccctttgtcagttggatagattgcaaaaattttctcccattctgtaggttgcctgttcactctgatgatagtctcttttgctgtgcagaagctctttagtttaattagatcccctttgtcaattttggcttttgttgccattgcttttggtgttttagacatgaagtctttgcccatgcctatgttctgaatggtattgcctaggttttcttctaggaattttatggttttaggtcttaggtttactgtcctcaaagtgttgtttcttttatgctatcacatcaatggaaacatttggtatgtagtcttttgtgtctggcttcttctaattagcacttacttttaggattcatccatgtttttgcatattttcattattgtttattctttattattgctgagtaatttattcattcaacagtttagggacatttgtttttttcccactatttagccatgtcgcaatgctgttataaatgttcttgtacaggtttttgcttcacatatatttttatttatgctaggtaaatacctagaaggggactcctggggttatatgcaaagtaaatgtctaactttataagaaattgtcaagctattctccaaagtggctatataattttgcattcccaccggcagtgtgtaagagtctcagctgctcattatccccaccaccacttggtattttcatctttaaaaaactagaccaggcacggtggctcatgcctgtaatcccagtgctttggaggccgtggcaggtgaatcacttgaggtcaggagttcgagaccagcctggccaacatggtgaaaccccgtctctactaaaaatacaaaaattagcctggtgtggtggcaggcgtctgtaatctcagctactcgggagactgaggcaggagaatcaaatcacttgaaactgggaggtggagtttgcagtgagctgagattgtgccgctgcactccagcctgggtgacagagtgagacttcatctcaaaaaataataataataataataataaactttattttagaacagtttcggatttacaaaaaaattcaacggagttaccccatcccccaccccagtttcccttattattaacgtctttaatgtggtgcatttgttacaactgataaactgatattgatatattattattaactcacgtctatagcttgcatttgtgcacactctttgtgttctacagttctatgaattttgacaatgtataacatatatccaccattattgtataatatagaatagtttctctgccctaaaaaatctcctgttatatacctgttcatccctccctccagcctgaacctctagcaaccactgatcttttcactctctttaatgttttgccttttccaaaatgtcatatagttgaaattttacagtatgtagcttttaaggctggcttctttcacttgacaatatgtatttaagatttttccatgtattatcatggcttgataactcatttctttttattgctgaataatattcaattgtgtggatagacacataggctgtaccacagtttgtttatccattcacctactgaaggacatcttggttacttccaagttttggcaattatgaataaagctgctataagtgtttgtaagcaggtttttgtgtggatataagttttcaactcatttgggtaaataccgaggagtgcaattgctggatcatatggtaaaactatgtttagctttgtaagaaactgcctgactgtcttccaaagtggctatatcattttgcactgccatcagcaataaatgagcattcctgttgctccacatgtttactagcatttggtgttgtctacattttggattttggacattctaataggtgtgtagtgatacttcattgttgctgtagtcttcaattccctagcgacatacgagttgagcatctttttgcatgcttatttgcaatcttatctgttttgctgagctgtctcttcagttcttttgctcatttttaacggggctgttttcttattgttcagtgtaagagtcctttatatattttcaatataagttctgtactagatatatgttttgcaaatattttctcctagtctatggcatgtattttcatactcttaacagtgcgtttcacagagcaaagatcttaaattttaatgaaggtcaatttatcagtttttactttcatggatcattctttcttttcccctattttgtcttctaggacttttttggttttgtattttactggctatgacccatgttgagctaatttttgttaagaatgtaaggtctttgtcaagattcatcttttttctgcaagtggatgaccagttattccagcaccatttgttgaaaagactatcatttatcccttatattatctttgcttctttgtcaaggatcagttgactatattcatgtgggtctatctatttctggggtctctattctgttccactgacgtattcatctattcttttaccagcactacactgccttgtttcctgtcaggtagtgtcagtcctctaactttattcctattctttagtattgtgtttactattctgggtcttttgtcttcctatataaacttcagcatctgtttattgatatctagaaaataaattgttgggattttggttgggactgcattgaatgtatatatcagttgagaagaactgaccttaccaataatgaatcttcctatccaacaatactgagtcttcctattcatgaccatggaatatttctccatgtatttagatcttctttgatttctcttatcagagttttatagtctccttaaagatatcatatacatattttgttagatttatacctaagcatttcagattttggtggtaacataaatagtgcattttacatttcaaattccagttgttcattgctagtatataggaatgctattgacttttgaagattagtcttgtatcctgccttgtcagtctttcccgtgagtgcgtagtggtagctcattgtggtttaatttgcattttcctatgactaatgatactgaacattttctcatgtgcttattagccatctgtgtatctcatttggagaaatgtccattcaaatcgtttgcccattttaaaattgggatatttgtgttcttattattgggtcattctataatacaatatataatattaaatataatacaaattctttagaagatatgtgttttggaaatattttctgcccttctgtggcttgtcttttcattttcttaatgggttttctattatgacttgtaccttttgcattctaagaagtctttgcattaattaagttcaaaataattctctcttgttttgttctagagttttgtagtttctgttctttgatttatgtctttggtgcatgtttagatgacttttgcctttggagcaaggtaatgttccaggcatatacaatatatttttccttatgtatgtccagtttttccagccccatttgttgacaagagtatgttttgcccattgaattaccttggcacccttgtccaaaatcaactgactgtgtatggatggatctacttctggactctattctgtttatttgatctgtttgtgtaaccttgaaactaacatgctgcatcaattattataattcagtggttcccaactggggcaatattccccccagggacatttggcaatgtctggagacatttttggttaccacaaatggagggacatgctcctggcatattgtgggtagaggccaggcagctacccaaacaataaagtattgctctgccccaaaatgttaatattgttgaggttgagaaactgcaatagcattttcgtaaatcttgaagtaaagcattgtggatcctttaactttgttcttcatttaaaaattatttttgaaaaacaattaaaaactgtctttggctatcctaggtcctttgtatttccagataaattgatcagccagcttttccctttctcctccaaaaatgctactgaaagatttattgggattgagttaaatctttaggtcaatttgggaagaaatgacatcttaactaccttgagtctcctgatacattaagatggtataacgttttattgtttatttcttctttaaattatcttaacaatgttttgtatatttcagtgtatagatcttgcatatattttgtgaaatttatcttaagtaatacatgctttttgatgctattataaatggtaatttataaattttaacttctgatatttattattagtgcatagcaatacaattaatttttgtctattgatattgtatcttatgaacttataaaacttaattactagttctagtagttgttttgtttgtttttagattcttggtattttctgtattttattattattcctttactttaagttctggggcacatgtgcagaatgtgcaggtttgttacataggtatacatgtgccatgaagtttgctgcatccatcaacctgtcatctgcattaggtatttctcctaatgctatccctcccctagccccccaccccctgacaggccccagtgtgtgatgttcccctccctatgtccatgtgttctcattgttcaactcccccttatgagtgagaacatgtgatgtttggttttctgttcttgtgttagtttgctgagaatgatggtttccagcttcatccatgtccctgcaaaggacatgaactcaccctttgttatggccgcatagtattccctggtgtatatgtgccacattttcttcatccagtctatcactgctgggcatttgggttggtaccaagtctttgctattgtgaacagtgccgcaataaacaaacgtgtgcatgcacctttatagtagagtgatttataatcctttgggtatatactcagtaatgggattgctgggtcaaatggtatttctagttctagatccttgaggaattgccactctgtcttccacagtggctgaactaatttctacacagatgagtatgctgtctggtagtaaacacagttttaattcctattttccaaatcatatctttttttcttgctgtatttatattattttattttatttttactgtattttaactggataggacctctagtagaatgttgaatggaagtgtacagcagatctccttgccttgatcttcattttattgcaggaaatattcagtctttcgccattaactgtggtgccatctttggatttttatcacataccatttataagtttgagggagttcccttctatccatagtttggtgagggatttttatcatgaatgtatgctgatgatcttgaattttttaaaatgctttttatgtatctattgaaatgatctttctaagtctattgctatggtgaattacagtgattgacttttaagtgttgaaccattctaccatttcccatagaaccattctatttggtcatgatgtattattcttgttatatatatctcggcttatttttatttacagttttttttgtgtctgcattcattagatatattggtctttaattttcttttcttataatgcatttatttggttttggaaaagagtcactctagtctcataaaatgaggtgggaagtgttttttccgtcttttgtgaaacagcttgtgtagaattagtattctttcttccttaagtacttggtgtattagtcagagggggagtttattaagtattaacttccatgattacaaggtcccacaataggctgtctgcaagcttgaggaacaaggagagtcagtccgagtctcaaaactgaagaacttggagtcctatgtttgagggcaggaagcatccagcatgggagaaagatgtaggctgcgaggctaggctagtctcgcttcttaatgtttttctgcctgctttacattcgttggcagctgattagattgtgcccactagattaaaggtgggtctgacttccccagcccgctgactcaaatgttaatctcctttggcaacaccctcacagatacacccaggatcaatactttgcatccttcaatacaatcaagttgacactcagtattgaccatcacacttggtgtaattcaccagttgagccaaggtttttaactgtgaatttatacatttaatatatttaatagataaaaagctatagattatctatttcttctcaagtgagagctgatattatgtcttgcaaatattctgcctgtttcatctacattattaaattcatttccataaatttgttatattttcttattatccttttaatttttgtaagatctgtagtgacccacttgtcttcatttctaataaatgttaatttttgttttctttttttttctcattatctgtgtaaaagtttactacttttattgatcttttcaaagaaccagctcttagtttcattgatttttttttttttttttggtcttccttcattctatttcattgaattctgctcttatttttattatttccttccttttgtttgctttgagtttaatttgctcttcattttcatgtgtcttaaagtggaattttaaaccattgagtttttcttatctaatataagatttaatgctgtaactacccctatctgcactttttaagctacattacatagtttttgataatcatatttttgttttgtggctgttttttctattatattttctaattgatatctgtaagttggtcttgcatctagtattcttgaaaattcttattcattcttataatttgttgattcttttgaatttttttcatttctcctacaaatgaaaacgattttgccctccttttaagatccttatgttaaggtattatttcttttcttgttattttggctaagatacacaataaaacattggttactgataggcatggggcagtctttgtcttgtttctgacttgagtgagattgtttctaatgtgtctccattgtgtatggtatttcctctaggttttttggtagatattattcatcaaataaaataagtttcattgtatttctaatttgctaagatttctaccatgaatgagaggaaaatttcattgcatgatttttttcttcatctgttgagatgctcctatacttcttttttttataatatgttaatctattttaaaaaattactagtggtaattcaactccttttctctccttcatcttttttggaactgtgaattgcactgataggttattcaatattaagctctcctttcatttcagagaaaaatctgcttgattacagatcatatgtggctagatttatttgttttccctttaaaaaactgtatctaggttcttaggttgatattaccaatactgttcaattttgataagaatattgcattaagctaaaaggtagtttttatagctttcatctttttccagtttctggaactgtttgcagaagataagaattaattattttttattagtttaataaaactgattttagatcctggtgtgatcccattctttttttattgtatgcagagtgttaggagggagatttgatgtttagcctcctggttcaatttctgttctaatccatttagttttgttttttgtttgctatttgctatttgttttcctagggaattgtcaatttcttcagtttttgaacgtaatggctaaagttgttcataatattcttttatgattttgaacaagttttgttttttgttgaaagcatatgatttttttttaaagtttgctttttgttaaaagtatatgaggtcttaatttaaaatcaaatatttctccaagatttgttaaaaacaacagcagatccctgcccagcttcctagaagcaaccgtgttccaccatttcagattattcttttggtatttataccgtatttctaaataacatgcatatactgatccatcttaatttaaaatgtttatgcaaatttattaatttcctactctggaagataagtgttcagattctttgaaatctgccctacttgtacaacatatataagtttcttctcccatccccatactcttttaatttcagtataacttcgatttaattttttgtttatgttattatgaccatatcagtgccacttacagctgagccagataacatgttgtattagtttaccattgctgctgtaacaaattaccacaaacttagtgactgaaaacaacacagttttagtttttaaatagttttgcaggttttccagggctaaaatcaagacattggcagggctgtgttcctttttggaagctctgaggagaacttgttttcttgacttttccggcttctagagacttcctgcattcctttgctcctggtcccttcccccatcttcaaagtcagcaatgaccaggcaagtcgttttcacatcgtatcactctgacactgacttttctgcctcccacttctgactcttctccctcccacttccacttttaaggacccttgtgattacattgtgtttactcagataatccaaataatctattataaggttaactaattagcatccttcattccatctgctatttaatcactttttgtccagtagcataacatgcttacaggttctggggattaggacattcacatctttggaaggccattattctgcctaccatatataagagcattacttttcattttctgtgcaaagtttagttttcactggaataattgtctttttaaaatgtgcttatcatttatgtactacttatcactacttcaagctcaaactctcttccagtgttgacatgttttctcagtaaatgcagacataaaagatattttattagttttatcttcttattgaaattgtttctttactcttttcccctattaaaatttggactggcttctctctctgctttgttcatagatatcatcctggaatctccatcactatccttagatttccttcctgtttctcttgagttgaaaacattgctccactaccttctagcttccagagtatctgctaggaaatctgaaattattcttgaacatctgtgctcaatttcgtctttctttctcttgaaacatgtaggatattcttttcatctgttgtgttctaacactgttgtaggttcttgtggatctattttcatccattgtgctgatattcagttgactttcaaaaaaagcctatgggatttttttttgaattatttcattgctattctttctttccctctcatttactcattctcacactagctcgttgtccctatctgtatctctttccctttccctcctactattttaatattggccctactaggctgattttattattttcttacattttctattgtccatctcattgtctaaatgctgtatattttggaagatatcttcaactttatctccccacacttctatagagttttgcatttcccgtattatgattttacactgtaatgatttaaaaatatatatcctttgaatttcctttttttatggcaacttgtccttttttcatagatgcaatactgtgatcagtccctagttcagaaccactttttatgttgtcagtttggggcttttattccttgaagatatcaaaggtcaagtttttgaggcagtgcttggcgtgatgcaagtcttagttgcataactatctctactgcctacctgggcaacaccccagttgccagtctcagcttcctgggctggtcatagcatttttagagttattctgcctaggagttccctgcctcatcgtctggtttcctgcagtgatctagctttgctaccctaccatatattcaatattattggtttatgttaccccacagtacttgaacttctggctgcctcttcctgtttcccagtgggtaagtggttttattctctccaaccccatccccagcctattgctgagttcatttttctgtttcagctgcatggacatattttattttttctttaacagttgtggttgtgtttttattttttaatgtatgttttatgatttagttgtcatcactatattctatgtttgaagctgagagagggggatttttttcctgtgtgaactcaaattactagcttgacatgataatccttcaggatttttagatggataataaattctccttcaaataatggctactcaacatttgggaacttagttatgaagaattctctatgattagttttctatacttaatctgtaatcatagattgcaacattcacatatctgagtatcagtctatgttgtgaagcaacagagatatggatccactcaggttaggttaagcagacaggtgtttttgactctgggatcaggaacattggacttgcctaaacctagggcccccattggtatcaaaggaagttttgtaggtcaggtgagtggcaatggttacctcaggaggagagtcttattgtgacagacaggaagaagagaagacaggagtgtgaagaagttgtggttgccagattgatgtttgaactttaaatggaaataggaaaattagatgacaaaacaactatttttaggttgaagacaatgtttctgattgtttcaggaggggtgaatggagccaatggaggttttgccatggtttgaggtcatctctaaggtgggaaggcgtgatttggctagatcttaaaggaccttgtaggtcaaattcaggagtttagtctttccctcaagagcagtagggagcctttgaatagttttaagcaagggagtaaagcaatctgattcgcatttttatggccccctctggttgctgtgtgaagaataggttaatgctgcagaagggcggctgaagtgaatgtgaggccagtaatgctgctttggctaaaatggtaatctggagaaagagagggagggagggagggagagagagaccatgggtttgagaggtatattggaggtagattaatagaagtagtggaaggaatatttagcaaacactaggaagtctggctgaacttgtacttttccctgcatttccttctttaaatttatttcctaccagttttcctgacctgtctcactcacctatggggactcagatatcgttcttacctctcttttaattcaattctttcatatttaatctccaatcttctgctttattccagtgacacaagggcttggctgtgttcttgtgctgggatcccataatcagtcactccattttctttctttgctttccacattggtgacccattaagtgcattcttcattttcagtggtctattgtttttcttcaatttctggcttgctttcaatccatctttctcagttttcagctgggactaacttgagaaaaaacctctcttgctcttgagtagtgggtgtatgcttgccaaatgtttgcaaaaaaagtatctcattgtacaagtggcattccagctgcattaacacccaagcagaaataagtaaatactcaattttagaactcactgtcatctttacttgtggagtgattgcctcctgctttctgagtgcctgtttaggaatctataaatgacacagtttccacaagcatttggggatcctgggcagtatctatgctacaacaatgctcctggttatatgctcagtgggggctggaggctgaaattggtatatattaatgcaaccttcctctgtttttgtgtctagtctgcagattctccacttttagataaaggcaggttgcctgaactatgcacattgcacattcctgtttatagctcctgtaccctggggacaaactacaaatctgcagttactctttagcgtacagcttcatctgtctgactgcagccccagggactactattgagagtagctctttggatgagaggagggacgccaccgcatagcagccagggctctgaatcactgtctgcagggtgcatgttttggaatctgggtgctgagttagaagggactatgagtcagtgcactgttaggacggggccagttgtatattgggccagcagcctgcggagattatacaaatgagacagggtgtctctccttccttggtgatttacttcttaaattattgtatctaattggtaggtctgtgaatctctaagtggcgtcattgctttgccaagtacattgcaggggcaagtacaagaatacttttagctattacctgtattctcataaaaagatgtttagggtaatataagcaatatatatggatgggtgacagctctccagatgttttggtgtgctgaagcgccagccaggatttggctgtagatgttgtggccagagctgacaaattcagtgtttgcttattagatctcttgtgttattgatctctgcagaactcagataaattcaaattccacttcatgaacctcttccttgggcattcgttgttttcttggtgagaaacagaaagttttagctttcattttagcatctatttattgagtatatgaaatatatcagctgactgtgctagaagttaaggatataatggtgactcagatagacctggcccctgcttttttggagttcgcaatctaaaagggaaggcatactttgaaaaagtaattttccggtgagccgaatgctgtggaaaagtagcagaaagtgttataaagaaattaaaaagcagacctaggttagtggggaacatgacaggtaaattttctttaatgaagtaatgttcaagcttagaatgtaaagatctatagctgtttgccatttcagtagtgatagggagagagatgggtaagaatattccagggagagggaaaaggttgcatgaaggccctgataatggcaaaattcatgctgcattctaggaagtaagagaaggtcagtatggctggagtgtacagaatgagatgtgaaaatagagatacagagtacaatgcagtgtttgggccttattccaaggtcatagaggagtcattaaaggactttaaacagggaatgacatagtcagatttgcaggtttcaaagctgattctggcagcaggcaatggatttattgtcaaagaagtcaaaagtagctatagagggagaattaggtgtgagagataataatgatgacttcatctatggtggtgccaaaggagatggagaacagtaatgaggaggcagcataacatacctgccgtattgggttattgtgagggttaaataacttaataaatataaagtgcttagaacagtgcctaacacagatcatgtttcaacaattttaagaagcccagtctcttcccatattttaatatttcccaaataagtatgactcttagctatcaatgacatatcattgtttatttggcagcacatttaatgtgctagtggcataaaaaatattgttgtatctgaaaatttgtggcaacttagatgaaatatgatagttaagtgttagagatatatttgctcttatcatttttctattattattattctgccaaaatctagtgggagataaactcagacacatagaaacaactaatgctaaaccacttcgaataaggaatgcaacgaagaaagtacggagaaaggaagtgacagagaaagtacagcggaggtatacctacctgtttggagaaactgattttcatcaagggaattcttagaagtgagatagaatctcaccatgcccaccacagggttggatctagagtagaattgagtatgaagtgttgactgttagagacttgcaactaactcttgcaagttaatcaattcacctgtacttgtgaatacatagcaaactaagcagtatgattgtaagagtgcttcttatgaagactggatatctcttaatccagaaagaagattaaccctatctatcacttgtgcagcttcctttacatactaaacatgattctagtttgttttacaagaatataatcctacccacccagtgaggtaggtgatggtatccactattcgcatatgaggaagtccaaggtcatatgcagttattctgatctgggatttgaacttggtttctgtgtgactcaaaagtgtttcctttactcttagctgtgtcttaaaatgccagattctgagttaagggagagaatctgacctttcttggatggcattaaataatactagctcctcatttccacaattatagtttagtaggggaagacagacattataattttaattacataaataaataattgggaattataagaagtcataggaagaaaacacacaaagttctgtgttcgtggaaagcaaaggagatgggatttctaaaaagatactatttaacctggacctacaggatgaaaaggagcctgccatgcaaattgagatgaggaagagttttctgggcctacacatgggctctgagataagaagaaacatattttattcaagaagtacatcagggaaaggggacagagtaggaatagataagcagataaggacagctctcctccaggtgcgagagtacaagcagaaaccaggacagaagttgaaagtcaccactttagccaactgatcaaacatcacatcacaacataaaaaacaatcatgtgtctcctgatgtgatgcactaagggcacaatattacttagatagtgttctttccccgaacccataaccctagtttaatcatgagaaaacgtcaggcaaactcagattgagggacattctgatcttttctctttaaaaatttcattttcatgaaagacaaagaaaaattggggaaatgttccagactaaaggagactaaagagatatgataaccaaaggtgtgatcctacattggatcacacatttacctagacgggtaaaaatcactatagagagcgttattgggacaattgttgaaacgtacatatggattctagattagatgacagtgttgtatcaatgataagtttattgattttggtaattgtatataagtgggttatatacaagtgtgatattgttctttagaaaaatacaagccaggcatggtggcttacacctgtaatcccagcactttggcaggctgaggtaggtaattgcttgagtccaggagtttgataccaacctaggcaacgtaacaagattctgtctctacaaaaaaaaaaaccttagctgagcatgatggagcatattgtagcctcagctactcaggaggcagaggtgggagagttgcttgagcctgggcctgggaggtcaaggctgcaatgagccatgattgtgccacttcattccagcccgggtggcagaatgacaccctgtaaaaaaaaaaaaaaaaaaaaaaaaagaaaagaaaaagaaaatatacaatgaagtatttgcaagtatacagatacaatgtgacaaatgttaagaaattgtgcatatggacaaagagtatgttctatttctggaattcgtttggaagtttgaaattattgccaaacaaaaagtaaaaacaaagaaaacatttaaataaaaccactgtgggcacaccaaaagcatattatagtagtgaagatgaatgataaaaacagcttataccagggtagctggcgatggtgatggcagctactttggggtggggtaggggaaaattggcctgacatcatttagatgtacaatgttaagttttgcctatgctaataattttcattatttttaagattactcttgaagccattgaagcatttcaagtggtgggggagctgctgacaaatcaggttatgaaatgctaaacttggctactgtgtaggatggattagaaggagacaacagtagattccagaaaaccagttagcacagtgtcatatacaaagtagatgcttagttattgtgtgattgaggctttagcagtggccaagagtgagtttgtaatggcttgaactagtgttgtggtgaacaatgtgaagagaaataaatgtttttgagggggtgttagggggtaaaattgataaaaagttagacgaaatagacatgggggctgttggaaagggagatgtgaaagatgacttgtcggtttctgattctgcagttgggtagatgatggtactgttcactgagatagggaatgatggaagattatttgattttgggagaatgctgggatctagagaaaattaattcaatcacacagttcaaaaataaaatgaaaaataaagatacacaatacaaaaattgttcttattacaatccctatgaatcatgttcttttcccacaaccctaaaatagctaactttcaaattaatatattagttatcttcccacagttttaaaatattgttttagtgtgtatttttatgattgctattgaggttgaatatatttttacatttgttatccatttgtaatatccaaatgtaatattacatttgttatccatttgtatattccatttgtaatccaattgtaataccaatatccttggtaattatttgtccacatcctttcttcaattttgtattttctttgatgttttaattactgattcatattagctcctcatatatcaggaatgttgatattttcttctaaaccctagtctgttgcttagctcaaacattattgatttttttgttacagagaagtgtaaaattaaagtgtacagaaatatcttcatctttcccaagttcataaaaatatgctcctaaatattttaatatattcagtatttgttgttcacatttagtagcattttattccattgtgcataaaagcctaactttattttctaaaaggatacatttgtccagtgcaacttattgaatacttcataatttcctcattggtcataaattgttctttcatcctacactaaattcctgtatacatatgaatctattcctggaacccttgatttaatttcacttattctttttctatttttacctcagtaccaaactttaaatttgtcaggtttgttaaaataactaattcatgcgcaagggtcataattaagtacaaagatgtctacagtgaaaagtaaatctctttaccatttgtgcccaagtgtcaacaagttcccctgtgaggaggcaacacctatcaccagtgttttggtgcatacacatcatgacacacaaatattctagtactacaatgcttcatttctttagttttatagtatttgttgttcattattagatgaaatatcttctcatagcatttttcaaaatataattacaagcattttcttataaaccttaagcttgacaagtttttaatttattttaattgacaaatgaaaaatgtacatatttatggcatacaacatgatgttttgaaatatgtatacattgtggaatgtctaaatagacatatttattaacatatgtattaccattacctcacatccttttggtgagattgcttgaaatctactcttctagcgagtttcaaatatacaatagattgtcatggactattgtcaccatgttgtataatagatctcttaagttcattcctaccgttgaactgaaatgttgtatcctttgagcaacatttcctcaatctttaagaatattgtgttgggaattttattagaagtacattacattatagaaaatcttgaaaccactagtatctataaaatatttcgctctctccagtcagaaacgtgctatatttccatttactcgggtcttcttttcaatagatgttttgtttaaagaaaactttctaaattgaagtatagcatatatggaaaaaatgcaaaatcctaattgtacagcgcaatgaatttttgttaaatgtaaccactatcagggtcagaaaataaaaaaaaaattaacacaccagaaccatctctttatgtctttcttggccattgtccatactccccccacaaagataactaataccctgatttcttatagtagtttcacttgtttttaaactttatataagtcgaataatattctttatactccagtatgtactttcttgtgtatggcttgttttattcaacatgattttgagattcatccacgttgttgcaaaagctatagttcattaatttttagtgctatgtagtagtctcttctataaatataccacaattatatatccctcctactgttgatggacatttaagttttatctcgtttgatactattataagtaatgttgcaataaaacatttgtatacatttcttttgctgaacacatgtccacattttgttgtctgtataactaagatgagaattttggggtcatagggtatgcatattttcaacttattagatactgccaagaagtttccaaagtttttgttcagatttacacatccactggcagtgtatgaaagatcttatggctctccatcctgcccaccaattactactgttatacatttaaattttagatattataatatgcttgttttggtatcttatcatagtaatttagatttacatttccctgatgacttttgagattgatcataatttcatatgctatttgccatttggatgttcttaaacattttttgaaaagtttattcaaataatttgttcattagtctattcaattgtcaccatttgctttttactgatttataattctttatattctgaatactagtcctctgtcaaatatatgtattgcatgttatcttttcccaccccatggggcttgccttttcactcttatttgtattgtcttttgatgaacagatattcttaattttaatttagtctagttgatcagacttttactttatggttaatactttttagttccatttaagaaatacttgcctacctcagtatcatgaagatattatcctatgttatcctctagaagctttattgttttacattatacaaacacacacgtatatatttaaggatatatatacagtaagtcttcacttaatggcatcagtaggttcttggaaactatgactttcatggaaacagcatactatataacaaaaccaattttaccataagctaattgatataaacgagtaaatttctatggcttacagtatgttgtttccttgaaaattgcagtttccaagaacctactgacaacattaaggtgaggacttactgtacctatataacgaaaggtatatattaattgtatatataggtgccttgtgtgtgtgtgtgtgtgtgtgtgtgtgtgtgtgtataatgtgtaaatatcagtgtgttagtccattctcactctgctatgaagaaatacccaagactgggtaatttataaaggaaagaggtttaattgactcacagttccgcattgctggggaggcctcaggaaacttacaatcatggtggaaggtaaaggagaagcaggcacctttttcacagggcgacaggatccactatctccacctggtcccgaccttgacacgtgagaattatggggattataattgaggtgagatttgtttggggacacagagccaaaccatatcaatcaatataattaatttatttgtatgatgtgtggtagtattcaagagttattcatttctatgtggatatccaaaagttaaccaattaattaatctggtagtataatccctcttttgtccttttcgttctaaattttagaatcggattgccaattcccagacagtaaaggacctcttggaatttgttttgcaattgcacaaaatctatggtcaattttgggataattattatttttacaaattgtagtgttctaatttgggaacatgatatatctgtccatttattatgtttttattttttagtgttatttgatgctattttaaatgtatctttgtaaaaaaaatcactttctaaatttttttgtggtatttaaaatataatcaattttagaatattgatcttgtgctcagagttactgatgaatccatttattaatgctactaatttatctgtagtttcattaatttttcaaataatttaattttcatttcttgattttaagtttttacaaatttcatatttttcctgccttattgtattgcctaagacctctagtacaatgctgaacgtaagcagagatcataggcatcttctatttcattcctgaccttgggggaaatttctcattatttcaccattaagtatgattttcactatagagtttttaaaataccctttatcagattaagaagtttccatttttagtttgcaaagactttttaaaaaatcattaatgggtattgaattttatcagattttttttctacatctattgagttgatcatatatttttctcctttattctgttaatatgatgaactgcattgactgattttcaagtgttaaaccagccttttattctttatataaatcctactcttcgtgttattttgcaacacaggatgggaactatgtgtatgcatgtgtgtgtatatgtgtgagttttaaaatttttgcacccacatttataagtgagattggccgtcagttttcttttttctgtcaagtttgtgtgaggttttgggattaaggttatgttagcttgaaaaatgaattgggatgaaaaactatttttttttctttacattctggaagatattatgtaagactgatgctatttattctttaaatgttgagaggaattcactggtaatgccatctgggactcaagttttctttgggggaaagtctttagtgatagattcaatttctttaagagttataggagtattgggatgtttttattaccttcttttgtcagttttaagttatgttttcaaagaaatacgtttttctaaattttcatgttttttggcataaagtccattttaaaaatatgatacctcttttctctttagtgtctattggatctgtaatgatgccctcctttccattcctaacagtagttgtttggttattttcattttttcatttgttattcatcaggcttgctggtggcttttaattttcttttttcttctttttttgtgtgttacatttattttttattttattttgtattatactttaagttttagggtacatgtgcacaacgtgcaggtttgttacatatgtgtacatgtgccatgttggtgtgcagaacccagtaactcgtcatttaacattaggtatatctccaaatgctatccctccccgcaccccccaccccacaacagaccccggtgtgtgatgttccccttcctgtgtccatgtgttctcattgttcaattcccacctatgagtgagagcatgcggtgtttggttttttgtccttgcggtagtttgctgagaatgatggtttccagcttcatccatgtgcctacagaggacatgagctcatccttttttatggctgcatagtattccatggtgtatatgtgccacattttcttaatccagtctatcattgatggacatttgggttggttctaagtctttgctattgtgaatagtgccgcaataaacatacgtgtgcatgcacctttatagcatcatgatttataatcctttgggtatatacccagtaatgggatggctgggtcaaatggtatttctagctctagatccctgaggaatcaaccaacttttgtatttgctgggcctctttattacagattttttatttcattgatttttgattttatatttgttattttgttctttctactttcttcggttttaacttgcttttattctactattttagatgtataattagatcacagatttatatacttccgtcttttcaaatacatgtatctaagcctataaatttctctctgataatggctctgttgtatcccagaaattttgatttgctatattttcattttcaggtagtacaagatgttttctggtttaatttggatttcttctttgcaccatggtttatttagaattaatttgcttaatttccaaattgagatgattttctatttgttattaattttttctaacttaattaaattgtggtcagagaatatattttgactccaatcatttgaaattggtgtggtctgcttcatggcccattcaacagtaaattttgtttaggttaaatatgtatttcaaaaaatgcaattcttgcacttttgggtgttatgttttaagtatgtcatttaggttaagtttgttaattattttgttgcaatcatatgtatctttactggtatctgatggccggtactattagttacagttattacatcctgaaatccagttatgacatatttaattctataatatctattttttcattttttttcttttttttcttcttttttttattatacattaagttttagggtacatgtgcacattgtgcaggttagttacatatgtatacatgtgccatgctggtgcactgcacccactaactcgtcatctagcattaggtatatctcccagtgctatccctcccccctccccccaccccacaacagtccctggagtgtgatattccccttcctgtgtccatgtgatctcattgttcaattcccacctatgagtgagaatatgcggtgtttggttttttgttcttgtgatagtttactgagaatgatgatttccaacttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacagtggttgaactaatttacagtcccaccaacagtgtaaaagtgttcctatttctccacatcctctccagcaccagttgtttcctgactttttaatgatcaccattctaactggtgtgaggtggtatctcattgtggttttgatttgcatttctctgatggccagtgatgttgagcattttttcatgtgttttttggctgcataaaatcttcttttgagaagtgtctgttcatgtccttcgcccactttttgatggagttgtttgttgttttcttgtaaatttgtttgagttcattgtagattctggacattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaaagcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaacagggaatcctttccccatttcttgtttttctcaggtttgtcaaagatcagatagttgtagatatgtggtgttatttctgagggctctgttctgttccattgatctatatctctgttttggtaccagtaccatgctgttttggttactgtgtagccttgtagtatagtttgaagtcaggtagtgtgatgcctccagctttgttcttttggcttaggattgacttggcgatgcgggctcttttttggttccatatgaactttaaagtagttttttccaattatgtgaagaaaggcattggtagcttgatagggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgctggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaagtattgtatgaaaatttccattatgtctatttttttaaaaaatgaatcatcattatttaattggccatgcaattattacagtacatagattgcatctgagactttttctagtattttcttttcctttctgagtcttatcttattattggtaattgctgtttgaatgctgggcattttaagtgaaatagagaaagccctagttaatgttacctttaaaatgttttttattttgaaataataaactcatgggaagtcgcaaataataaactcatgggaagtacatagagacctataaactttttacttagagtcacccaatgggaattctgataatgacggtagtacaatgttaactatgccatagacttcattaatattattatattgcaacaataaaggaatggtttgatgtgtgctcttttttgtgtgtctctatgtctatagttctatgcaatataatcccatgtatagatttatgtaatccccatcacaatcaagataaagaactgttcaatcaccataaatataaaacccctcatgttactcctttatagtagtatccgtccctgtctctttccatgaaaccatgaatctgttctccatctctatggttgtgtcagtttgataatattacataattgtaattatatactgtgtaacttttttaaaattggcttttagaaaattaatagggtttatattttagagtagttttaggtttacagaaaaattgaggagaaagtacagagttcctatatattcttttcttcctctccctctgagtttcccctattattaacatcttgcatgatgtggtacagttgttactatgaatgagtgaatattagatacatttttattaactaaagtatatagtttgcattagagttcactctgtgttgcacagttctgtgggttttgacaaatgtataatgcattgtatccaccaatacagaatagtttcattgccctaacaatccccagtggcccacctacttaactctccctcttttcctccaagcccttggcaaccactaatctttttagtctttatgtagtattttccaaaatgtcataattagcactatacagtctgtagccttttctgattggcttctttcacttagcaatatacatttaaggttcctccatggttttttttttttttttggtggttcgatagctcattttttttagtggtgaataataatattgcattgtttgtatgtgtcacaggtcatcttggttgcttccaagttttggcaattatgagcaaagctgctataaacatttttgtgtaggcttttgcttgtaaataaactttcaaatcatttggataaataccaaggagtgttattgctggatcatatggtaaaagtatgtttagttttgtaaataactgccagactgtcttccaaactggttgtatcattttgcattaccagcagcaatgtacgagaattcctgttgttccacatcctcatcagcatttggtattgtcaatgttttggaatttagccactgtaatagatgaaagtggtatttcattgttgttttaatctgcgattccctaatgatatgtgatgccgagaatcttatcgtatgcttgtttatcatatgtatattttctttggtgaaagaatgacactttgactaagcatgatgatcttgagttccattcaggttacttcaatacatgcagcagtacttgataccagtaattggtaccttttcattactaagtagtattctgtagtatgaatgtactagaatctgtttatttacctgtaaaaatatttttgcgttgtgtccagcttgatcctattaaaaataaaggtggtgtgaacatccatgtacaggtttttgtatgtacataaaattccatttctttgggatgaatgtccaagaatgacattgatacgtcttatggtaggtgcatgtgtggtttttaagaatctgccaaacaattttccagagtgcttttaccatttaatatttaaatgagaatagctttttttattttgctttgtaagtctgttgctagtatatagaaataaatttttttttcgcatattgatcttgtgtcctgtgactttgacaaactcattattggtaggagattttttttttattcctcgggattttctacataatgaattgttatctgcaaacagagacagtttaaagtctttccttccattctgtaggctttttgtttccttttttttctttattgtattggttaggatttctaatattgtgttaaataaaagtggtaagaacggacaccttcgccttgattttaggaggaaacatttcaccatgaactatgatgcagctcaacgtttttttcaggcgttctttataaagttgagcaagttttcttccatgcctagtttgctgcaagttgtttttataaatcatgtataggtactggattttgtgaaatgatatttctgcattatatagttttgcctctttggcatgttgttatggtgggttaaattgattgtcaaatgttcaaccgaccttgcataactggaataaatcttacttaattaagatgtataattagttttatatttgatggactcaatttgctaatgttttcttgaggatttttgtgtttatattcatgaaggatatttgcctataatattcctttttttctgtactgcccttgtttggtttttggaaccaggacaatactggcctcataaaatccgtttattactgttctttcctattcaccttttgaaaagagattttgttgaattggagttattttttttttaatatatggtaaattctctagtgaagccatctggtctgggatttcattctttaaggtttttggtgagaattcagctgataatcttattgaggatcatttgcatgtgataagttgcttctctcatgctgctttcaaaattttttgtttttgtctttcaaaaatgtaatcataaagtgtcttggcctggatgtatttgaatttattaaacttgaagttcgttgcacttcttggtttcatagagtcgtgtctttcttaaaatttgggaaattttcagccattagttcttcaaatgttctttctgctcttttctctctcctcctcctctgaaacgcccattatgcaaatgttccacatgtctcttaggttttattattattcttttttaaaccattttaaagtgtacgtttcagtgacatttaatacattcacattgttgtgcaaccatcaccactatctgattccagaacactttgtcatcccaaaagtaaacctcatacctattaggcagttactccccattcccctctttctcaaacccctcatgaacgctaatcttcattttgtctctatggatttacctattctggatattttgtatatatggaatcatacaatatgtggtcttttatgtccattttctttcacttaacataatgtcttctaggttcatccatattatagaatgtattagtacttcatttctttttatggaaaaataatattccattttatagttgccacattatatagttgccacatactcacaatgtgtatgtcacatttgtttatccactcatccgttgacagatatttgtgtggtttccatcttttgtctattgtgaagtgtactgctatgacattcatgtacaatttttcatttgaacatgtgttttgaacttttttgggtatatacccaggagtggaattgctgagtcataagtgaattctgtgtttaacttactgaggactcaccaaactgtttttaaacagtagctgagccaatttgcattctcatcagcaatatataagggttctaatctttccatatctttatgaacacttgcttttatctttttttaatgtcaccatcttagtggatgtgaagtggtatgttacaatttttatttgcatttcatgttggctaaatgatgttgaacattttttcgtgtgcttgttggtcatttctgtatctttttttggagaaatgtttattcattccttagcccactgaaaaaaatttggtaagaagctggtaacctttatgtgattctttttttaaaaaacagctttatcgagatataatttacatactggaaattacttgtagcccatcttttaattaggtaattaactttttgttactgagttgtaagagttctttatatattgagggtactagacccactgcagatagatgatgaacaaatattttctctcacttgtggatgtcttttcactcccttgattgcatcatttgatgcatagaagtttttgtttttgatggaatccaatttatctatcttttattttgttccttgtgcttttggtgttgtatctaagaaatcatttcctaattcatgttcatgaagaccaacctctatttttcatctaataattttatagtgttagctcttagaggtagatgtttgaacgagtttgagttaaattttgcatatgataagtgaaacagatccagctccttttgcatatggatatccagttgccccaacatttttcttcattatttttttcttttttctctacagaaagtaatcccaattgattctttttttccgctgctcaaatatactgttgaatcttcatagtaaaattttcattccagttatactttttaacttcagaatttttatttggttctttttttattacttatttattttggttgttgttcatttttgagacagggtctcactctgtcacccaggcttgagttcagtggcacgatcatggctcactgcagcctccatctgctaggctcaagtgatcctcccacctcagcctcccaagtagctgggactacgggcacataccaccatgcccacctgatttcttattttttaattttgtagatacagtgtctcactatgttacccaggctggtcttgaactcctggttgcaagcgatcttcccaccttggcctccccaagtgctgggattacagacatgagtcaccacatgcatccttcgttcctttttataatttctatttcttattgataatttctgtttggtgagacatttttcgcctggtttcctctagtctttgctcatggttttctttagctctttgaacatttttaaaacagtttatttgaagtctcttcctagtgagtccaatgtcttaattttgtccagggacagtttctattaattttcttttttgttgtgaatgacacatattttcttgtatttttgtgtgatttgtatatcttctttggggaaatgtttttggaataatattcattttgaatattatactgtgttcactgtggagattaaattttcccacttccccaggattggttactattgcttttttgtgagtttgtttgtttaatgattttttataaacaatttatttaattttttaataattaaaatttttatttgaaataattatgggtacataatagttctatatgttgatagagtatatgtgatgtttttgttttttaaatataaaatttgttattaattattatggatacatgatagttatacatatttatggggtacatgtgatgtcttgatgcaggcatacaatgtctattgatcaaatggcataattggggtacccatcacctcaagcatttttcatttccttgtgttaggaacattccaatttcacttttttttatttaaaaatacacgataaattattgttaactatattcactctgttctactatcaaatactacctcttgttccttctaactgtatatttgtgctcaataaccattacctctttatccttccccccacaacccttccctgcgtctgataaccctcattctactctttatgttggtgagttgaattgttttaatttttagttctcacaaatgagtgagaacatgcaaagtttttcttttcatgcctggcttagttcacttaacataatgaataatgtcctgcagttccatccatgtttttgcaaatggcaggatttcattcttttttatgacaaataatatttcattgtatatatgtcccacatttcctttacccatttattcattgatggactttaggttgattctctattttgcctattgttaatacagctgcaataaacataacagtgcagatatctctttgttagattgatttcctttcttttgggtatataatgaacagtgggattgctaggtcatacgatagttctctttttatttttttgaggaatctttgtactgttctccatagtggctgtactaatttacctttccaccaacagtgtatgggggttgccttttctccacatctttgccagcattcattattgcctatcttttgttcatttataaatcagattttttttggtattgagttgtttgggctccttgtatattctggttattaatctcttttcacatgggtagtttgcagatattttcttctattctacaagtggcctctttgttgactgttttctttgctatgtagacttttggctttatgtgactccatttgtccatttttgctttgtttgcctgtgcttttgaggtcttagtcaataaatctttgcacagaccaatgtcctggagtgtttccctaatgttttctttcaatagttttatagtttcatatcttagatttaagtttttaacccattttgatttgattgattgatttctttctttagagacagggtatcactctgtcaccctggctggagtgcagtggtgcaatcatagctcactataacctcaaactcctagacaagagtgaacctcctgaatagcagaaactacaggcatgtaccaccatgcctggataattttttaaaaattattttttgtagagattgggtctcactatgttacccaggctggtctcaaactccaggcctcaagcgatcttcctgcctcagcttcccaaagcacttgaattacaggcatgagccaccatgcctggccaattttatttttatgtatggtgagaagcaggggttgaatttcattcttctgcatattggatatccagttttctcagcaacatatattgaaggggtgtccttgtcccagtgtatgttcttgtcatctttgtcaaaaatgaattggtcacaaatgcatggatttatatctgatttatctattctattccattggtctatatgtctgtttttatcccagggccatgctactttagttactatacctttgtagtataatttaaagtcaggtaatacgatttctccaggttttttttttttttttcctcaggatgactttgacttctcctggtccttggtggttgtggttccatatacatttaggactattttctctatttctgtgaagaatatctttggcattttgatagggactacattgaatctgtggattgctttgcatagaatggacattttaacagtattgattcttctaaaatccgtgaactatctttccattttcttgtctgacaatttcttacatcaacattttgcagttttcattgtagatatctttcattttttgtttatttctagatattttattttatttgtagctattgtaaatgggaatactttctttgtttctttttcagattgttcactgctgacatataaacatgctactaatttttgcatgatgatttagtatccggcaactttactgagtttttaaaaatcagttataatggttttttttggtagaatcttttggtttttaacaatataagattatatctgcaaaaaaggataatttgacttcttcttttccagtttgtatgccccttatttctttatcttgtctaattgctctggctaggacttccagtactatgttgaataaaagtggcaaaagtgagcattcttctttagttccagatgttagaggaaagactttccatttttccctgctcagtatgatactagtgtgggtttgtcatatatggcttttatcatgttgagatatgttctttctgtacccggattttgagagtttttgtcatgaagggatgttgaattttattggatgctcttttttttgacatcatttgaaatgatcatatggtttttgtccttcattctattgataataatgtatcacactgattggtttgcatatgttgaaacatccttttattcctgactcatctcttggtcatgatgagtgatctttttaatgtgttgtttaattcagcttactagtattttgttgaggattttagcgtctatgttcattagtgatgctggcctgcaatttgttgctgttgttgtgtcttcctctggttttggtattggtgtaatactggcctcatagaatgagtttggaagtattccctctgcattttttggggacagtttcagtagaattgatgttagttcttctttaaatgtttgatagaattcggcagtgaagccatcaggtcctgagcttttctttgatggaagacattttattacttcttctatctcattactttttattgatctcttcagcttttggatttcttcatggttcaatctttgtaggttgtatatgtctaggaatttatcaatttcttctaggttttccaatttattggcatatagttgcacataataatctctaataatccttttagtttctgtgatattatttgtaatgtctcctttttcatctctgattttattcatttgaaatttttcctttttttgtaagttagttgggctaaatatttgttgattttgtttatttttttaaaaacaagttttcattttggtgatcttttgtatttttttagtgtcaatatcatttatttctgctctgctctttattatttcctttcttctactaactttgagtttgttttgctcttccttttctagtttttaagatgaagccttaggttatttatttgtagcttttctaccttttcaatctaggtgtttatgctaaaaacttccttctttgtattgccccataggctttgatatgttgtgtgttcattttcatttgtttcaagaattttttaaaaatctttttacttgtttattggcccaatggtcattcaggaacatatttaattttcatgtgtttgtatacttccaaaattcctcttgttattaatttctagttatattccatgtgaatggaagaaaaagatagcttatgtaatttttttattttttgagacttgctttgtggcctaacatatggtctatccttgagaatgttccatgtgcttagtagaagaatgtgtattctccagctgttggataaaatattttgcaaatgtctattatgtccagttggtctattgtgctgattaccttggaggtttctttcttgattttctgtctggacgatctgttcattgctgaaagtgggaagtagttgtccccagctattattgtattagagtctatcttgctctttagctctaataacatttgccatataaaaatatatatatatatatatatatattccagtgttaggtgcatagatatttaaaattgtaatatcctcttgctgaactgacccctttattatcatataattaccttccgtttctcttcttatagttttttttttgtcttgaaatctattttatctgatataagatagctaatccttctgttttgggtttccatttgcatggaatatctttttccatcctttttttcttttcattctacgtgtgtctctacaggcgaagtgaatttcttacagacagcatagatttgggtcttgttttcttaaatccattcagccattccatatcttttattggaaaatttagtccatttacattaaaggttattattaatagtacaaacttcttactgccattttgtcgtttgttttctggttgttttgttggtcctctctctcatatatcttgtgatttaagcctggggtcattgcagctgtatcagcacttgggagcacactaaactcgggaatgatgtgactcttgcagaccccaagaggcactgtcttggtgggcttaagtaagataagagagaattccctagattaccccgcaaagcctgttactttccctctctttccattaattagaagcagcctgtctctccatgatgggctatctggagttaggggagaggtcatgtgaacactctcatggcctccatggttaggactgtgctgtgtcacacctgaagccagcacagtactggatcttgcccaagggccatggaatctattgcctagctaccactaatgtttattcaaggcccaagagctttttagtcagtaggtggtgaatcctgccaggactgggtccttcctttcagggttgcgattccctactggcccagggtgagtcaaggaatgccatccaggagctagggccaggaattaggcgcctcaggaatttgcttggtggtttattttactgtggctgagctggtatccacgtcgcaggacaaaatcctctgtactcttctctctccttcccccaagtggaaggactgtcttccttgagatgcactgcctggagttggggaaagtgtgacacaggccctatacatcatagctgctgttgcactgggtcatgcacagtccacgtccactgcctttgagaccagcacagcaccaggacttgcccaaggcctgcagtctttgtgccctgacagtcacttaagtttatttggggccccaggccacttttgttggctgatggtggagctgactgggacttgcattttttttttttttttttttttgcaagggtgcgtaagtaccctctggccttgggctggtgtagatgcaccgtggcaccagcagaattctgccttgtattatgttccactgtgatagggccactgagttctaatgcaaagacccatactcaccttgctctccctcctccaagcacacagattctctctctccacaaggcacagttaggggagagggaaggggtggtgtaggcaatgcaagactgtctttcttatcctcttcaatgcctcctcccttgatattatattaaatattgaaaccagataatttgatctcttacatgagtatttttttcctataaagttgctttcttgcgtggatagttgttcaattcagtgttccttgcagggggacgatcagtggagggttgtaatcagccatcttgctccacctccgtcctctaaactattttttaagactgcactctatgtgttttgtggtcattgaagtctgtgttttcttaacttagctagtgatttgacagaaatttccttagacactgagaaccaataataataataataataataataataataataataataataataataaatgacttcctggctctcctgcttctcctggttgaaagggtttggggtctagactcctcactcagcctctgccagtgctctgtccacagaggagggaatcatcacctcagactacctgtactgctggatggagttgaaagtttgagcccctcacttggcctcctctttcactgctggtgatggactgtttgtggtgtttggctagggtagtgcaggtattgtcaataagttttctgtctttctgggatgtccctttcttggtcctttggctagagagagcagacttttatttgggactttttttttgtctgcctctgttggtggttctttgttacaagcttttctaactcctagtttggggtatgggggaggtaaaaagaaaatgcagggaactccctgccatgttgtttcttaagtttcaaggtccctagccagtctgccttttcctttccacttatatgcaactttttataattttctgctgtggtttgtctagagttttaattgtaaaaacttgagaggaatggggaaaatgattgtatttcatcttgtctggaacccaaagtcctctgttatcttttttaaagagaggatcatatctttcttttccatccttactctttgtgtagcccttaagcattccagctgaaattttgggggtttaccagggacactgaccttactgggccccaaactccatgatactgctgatgagtagcttgtaatcattttaacatctttttttctgcttgagttctccaacacaaccatttagaaatcagtaaatgcctccttggaaaatgtggctcagactgtcagactcatttcttggctcttctgctttctcccggatcttggtttttcaaaacctgggttatataaagccctgaactttgatttttgtttcaccacctctgtgatactgtaggaaactgtgttccacttctctgtctcttaatcattgctttctgcttgacttttcagcctttctggctgtgttagttacttggtaacttaccagtcagcaaattctgacaggggttaagaagtatagtatatcaggctcacctcagcaagttttctttaactccaaaatcttggcccttcaaatcctatttgcgttggctccctggtgaaataacacacacacacacacacacacacgtgtgcacatacacacacgtgtgcacacacacaagcacacacacattttatggaagtattctagattttcttggtggatgagttggtctgttatataaagttgtccattatagccataagcagaaattcttcataaagttttacagttttcttctagtaaattttgtgtatattttgttatatatatttctaagttttatagtttttttgctaatatgaatggcttttttcttccattacattctctagttggttattgttgatgtttgcaaaggatattgactagtgtatttttatttattatttgtccatcttatagtaaactattattccattgcaaactaacactttttctcttttttctaatatttattcattcttttttcttagcttaattcattggccagaaattttagtactatattgaataaagttagtgttagcagccagttttatctccttcccagctttagagggactccttttaatgtttcactactaagtagaaagttttctgtagacttcacataaataaagtattaactcttataaaatgtccatcctatttcttcttatgttaatatagcttccaagttttcactaaaatgtaacctcctttattcaattttatactctctttggccttctcaaattatggttggcttcttcttcaagtggacaacaatacagtgcataaagtgttgtctttgatatttaattatgttttatggtaaatgttagttatgtttttgtctgtccccaggaagacatttttcctgttttatatttgtatccccattcttggtacagtatctgtcacatgctatatagtcaatatttttatataattaattatttcaacatttttatcataatattttacttccatatctgttgtatatctttattatcctgaaggtttctgattcgaagtaaaactgagacatagggaaagaaaggtgcatagggacccagtgctgcttttatgctcctgcttcattctcagttgacatttctctgaattatagattattagacttagaagtttagtcatcatctagtttgaccaattcatcttataaatgaggaaattgagactcagtagaggaagtgaaatgttccaaaacttacggctaatttaaaatctattccttaaatttatctgtgtagcaaaaagagattacatcacacagacaatcttgttttcgctgtatgctaatttccatgaatttcctagtgtccttccccaccttgacatgtagacagtgtgtgacggctggagggataagcattggcttaaggcgttggcacagtctgcagaatagagaaaagttttcctccatcagcttctggaataggagattctgctttagttcaccatttatccagatatgaacagtattccttacggaggtcctgtactattgtgtttcttcatttggacatatgaaagtagcctttgcttcttctacctgtggttgctttctagcttcagatatcatgctgcatttatatctgagattcttgaactttgaaataaagctgaactgtgaagctattgggaggggtatgtgggtgagctgaagaaggaggaagcagagaggattaatggctttggctgaaaccagaatgctctggacttaagaactacatggtttttgctcttcagagagctatagcagattcctaaatcccttagtgctggtttctacatggccttatccaaatctctatcctatagtcgctgttctcctacaatggtctccaagcagaccctttgtgaaattacatttcttgcaaatattcattccaagagcctaggccagccctgtgctacattggaggcatcaaacaacaactcgagcaaaaagtattcctcccactcccaatagtataactgaattttcgccatcatagaaagttcttccagaaatatttacattttaagtaaactatggaaatatcatttgaccaagagtcagaggttttcagttcagtcccttcttttacacttattagtaattggtttgtgagcaagtaaaaacctctttgtgttttagatttttatctgttatgtaagttgaaaaattcttaccttgcttacctatcatgattgtgataaggataaaatctgataatgaatggcaaaatacatcataagagcacagatataatttattatattaatgtaacatcacttgccgccacttattggatactcagtgcatgctgtgtactctaatcaatttgtagagtatatgtgtttgtgtgtgtgtgtgtgtatatatatatatatatatatacacacattaaatcatcacacattccaaaagaaagaactattatcctcctgttagagataaagagcctaagtgtattatctttctattgctgatgtaacaaactactacaaatgtaacagtttaaaaaaacacacgttttatatctcacagctttatagataagaagtctggttggctgacctgggtccttttcttaaagagtctcacaaagacgaagtcaaaatattgtaagggctacattatttttctggaggctctggtgatgaatatgcttgcaagctcactcaggttgttgacagacttctgttttacgtggttgttaaactgaggtccttgtttccttgctggctgttggccagagttttctttatcagctcttagaggtcacctacattccctggatcatgggatcccttcatcttcaaaagcatcaatggaggattgaggacattttacactttgaatctctcctgcctcttcctctgccccatctctctgatctcttactctgcccttcctcttttgcttttaaaggctcatgtaattatattggacccacctgggtaatccaggatactatatctattttaaagtcagttgattatcaactattccatatgcaaagtctctttggttgtgtaatgtttacatattcatagggataatactaggggacagagatcatggggaccaaaatcttgctaccacactaagagagccactatttaatgttattttattttattttatttatttttgagacagggtcttactgtgttgcccaggcgggagtgcagtggcgagatcacagctcactgcagcctccaactcctgggatcaagtgatcctcccgcctcagccttccaagtagctgggactacaggcacgtgtcacgatgcccagctaattttatttatttatttatttatctatttatgtacagatgggatcttttgcagagactctatgttgcccaggctggtttcaaactcctggcctcaagtgatcctcctacctcagtctcccgaagcactgggaatataggagtgagccactgtgcccagcctacttgtatttaaatttaatgtctaggttcctaaatgagtaaataaaactaatattaataaaacataaattaacgtgagaaaatattttatatatttcagagtgacgtgtgtgtatcctctttgctcaaaaagagagaacccctttccccagtttctctgcctcatattttcacttgcaatgttgaggtccccactgtatgttgtccattttagctcttcaacataaaggccttgattcatactacagaaggtggtgtttgtctgtctgatgatgtctttaccaaataggtaagtcactagggttcccttaggttggggctctaggggtgctcagaacttcaaagctattcctgtagagttttgcagtcttccttctagctattgcaaaatcacctcgctatgtctgactggatcctcttactcaatgtcccagcatcaatttcacttccaatcttgattctagtttagtctttttaaatccaatctgtatctagcaatcagaaagctctctctaatatgcaaatctgctagtgtgacagcattcttcagtggtttctcttttctctaaaaatcaaacctaaactctttgaagtggcttgtgagaccacacatgaactgtttctgcttacctctctggttttatttctatccactctcctcttatttctctttgcttcagaagtactgaactactttcatattttctagcctagtatgatctttggctccctttggtcttcatatgtgatagaaaattcttccgcttctttttattttttttaaaatctgagcttcaccagttcctactcagaaacttcccagtgatatcttcctctattccccaaatcatacttcataataattagcatttctttccagtaaactatcaaccccttaaagttgagaatccttattttgttgaatactgtgttgtctgaatttagcacaattgtaaaatattttctgagaacatgaatacatggattaaacttgtgtctgtttgagcattatactcacctagcctgagtggctgtgatggcacacctctattatcttaagatacttccaagaattaggactgagattgtctctttcctcagccctgatctgtgtgagtctttactagatagagtaggaagcttgcctcttgggaactagattatctgaccagaaattagttctccccaagccatcaatcaaattctttttgcttcttctgagaaagtaaaatgttttatccccttgcaggctgagtgcatattgatatatcatgactatctccacacacatcttggagacacattcccacaccatgattgcttcttttctgtgttccttaactgtaaccacctgattctcttccatgcttgtttgcttgtgtactatggtattctgagcacacaacatggttgtatgctttttttaaaaatattcttgagcaaatgtatttatttattggtatgtgcaatcacaaacttggtattttcctatgttgacattatgtatgttatagaatttaatgtttgtctaagtagaaacatatatcagcaaattaaatctgaattgtttcaaaacttctgtactttttatataaaaggagaaaaatatgtctctttcctaatagttttttttctatacccttcattctgttttctaagagcctcaggttgttagatgggtggcagtaacaaagagatcatagctagtttagaaccaatgacatatgggtcaacactgtcctccctctcataagaaccacagccaaaggctgggaagggccagaaaaatggtgaggttagaagttatttaagttagagcaattctctttagggtctgctgtgtcatctggaggaatagattggtggttctgaagtatcccttgtgggcctggcccttaggaacagaacagggctgtagagcccaaaaaaaaaaaaaaaaggtggaaaaactccagctggcagatataatatgaaagccaagccacttgagctatctgaccttattcagagcctaacccatttaaacaggacttaggcatgcttgggaatcttttttgtttccttaggctgaggcagaattgaaaccaagaggaaaggaggttgcagttgtggccacaagtagacataaaagctaatggtctgatcctgagggaagagattataactaaagtcacccaaataaagactgcagaatggccctgggccattcctaacagtcagggtagccttagagggtgtcaattgtgatagcccagcagcaaaggacttgatgacagagtaatagtgctgttgatgacattgtcaccaagcacctactacatgcttcaccttgggatagatacttcgacagtatcttatttaatcccgacagctcgataaggtggttattgtgcccgatccataaatgtgagaaatggtgctctgagagaagttgaagagacataataaacaggagaaatttctcctttcgtgtaagaaaattagaaagaaaagaaaaataaaataggggaaaataagtatattttagaaaggttaatggtcgaggcaaagtcatagatggatcattcaagattttttctcaatattgctgaatggctgaagtactaaatgtttattcggaatacaaatagtctggagtgaagaggactttaagagggtagtaataagtagagtttgtttactccccgagatctagagttttgatgtgatcaagaacatttcctacctgaagcataacctgtcacctgtggcttctgcttctgttagaaatagcatttgcaggatattctaaaaaggaaaaagatttttgtttggttatcaggttgaagagaaatcttaaatgaccataggcagggtgaccatatgtctactatagtcctggtttacacctattatcttggcatattaaagtttgctttttccaaagtgtccaagttttggccataagttatttgatcactgaagccacagaaggtgtaaagagtgtggttctcacaagccgtctcttatagaagccaaatatgccttcactcctcagtgcatttccctgggaccagcttctgcagagattgtatgcctttagacttagggtaacctactcttgcaccatggcctttggctcacacaccaatgctgtgttaacatgatatgttgcgtgattctatggttatctttccctgaagtattgccctttgtcactgtaatatgattctgcatgcttaggtatccaagcaagcaccatggccttctgatcctgaattataagtatctgctcctatataagaagagtttatgcacatgaacgtgaaccatgtttatgatgtcatatgtcatgattttcaagcatgttagttatatttgcccatgtatcaagccagagccagtgacttctgtgttaggtgcaatttaccttgtttaaagtttatctgaacatttaccatgatggtatacacctgtcccggagcttaaggctattgtgttgtgatttccaactcatgaattattttcttggcatgttgcattgtttaacatatcaatgtagtatcctcatgtacaatgttgactatagtcacaaggtatttggatgattctactactctctacttctaataatagatgattgtgagcacactgtactatggctgtcagttcatacatcatgacttcctgataatatttaggggttttctgagtgtgatttttgttcaggtggtaaaactacagggggagatatttatacaccatgcagtcatttaaacatgtctcagagtccttttgtaacaatgtcatctgtatttgtttcccaaggatgccacaacaaagtgctttaaactaggtggcttaaaacaacagaaatgtttttctcacagttctggaggctaaaagttctaaatcaaagtgtcagtaaagccgtgctctctctcgagcctagcaaaggagtcatccttgcatttttcagcttctggtaatcccaagtgtttcttggcttgtggcagcatcactccaatctctaacttcattgtcatatggttttctctcgttgtctgttatatctaaatttcccccttcttataaagacaccagtgattggatttagggctgaccctaatccattataaaggcatcttaacttgattacatctacaaagaccctattaccaaataaagtcacatccacaggtactgggagttataacttcagtgcccctcttttgtagaacacaattcaacccataatagcatttacatttggagacatttgcttttatgttatagcttttaaattaggcatgtgttcatccgaggaagcactacagcttagttctctgttcatatatcactgatgtttgagattgatctgtgattgaccaacttctatgtcatggttatcacactgtgcagcatgttactagctcatatatcagtcatgtcgggctcctacttcaacattgctttttgctcttgtactatatccaactgttcctgtattttgcgtatttacagcgatatagtcttgggatatagtcttctctattatcattcattacctcacattttatggttgttaagttgtgcaccatgatcagatgctcaaacaaaagagccatctgagcatatggcatgaggtgtcattttgcaccactgtcatcttatccttaactgaaaacttgattcagtattgtggatatcggatagggacatgcgtctgaatggataccactcctgaaggatagccaactgcttgtgtattttatgtgtatactaattgattctctgtgtatacatcatagatattgctcacccatcattaatgtgtaaaaaataaacataatctccttctgtgtggagaatgataactttaataacatgaatattagttcctgaattgtggtcactggctcctgcagaatgggtattttctccatatttgctgtctgttcctgtatcatgcttactaactgtatcatagctgttagtttgtgtaatgggatcgtttggatttatatcatgcccaaacacaaatgtgtagagtcaatcaccatggttattttttttatgagtcattatgtccatgtgagtcttttttttgtaccactgtcatcttctcttgggccaaagtcattaattgcttgcatggttatttttgattacataccatatctacccaagtaagaatcacaccatgttttatttccatatcatgtccatctgcacctgtgtcataattgatagcctatgtcctgtaggtgtctgactggacctcatgaacacatattaaaacatgctttttggcatcttattcatctgaacatcctgtattattttgatcttctttttgacaaaatgccatacatacccgtattttttgtatcacctgagcagtttttactctgtgattctttcctgggataccatatctatcccctttttcatgtatgaattgacctattctccatgataatataaacatacataatgaatttgtgctcatatactgtgattgaagttgtactacgtatttaaacttaaacaccacacttgtgtgaaaatacacaatcattgtctacttgtactgggaatgagtattttgtactatgtatattaatttctacaccatgtctttcactattgtgatgagttttctctgtcctttgtcatctgtctactccctataacctggtatcagctcatgttgcagatcttctgtgtgtgcatcgtggtcaaatgctcagactcctgtggtggctgcttatgcaccacggatgtttgagcatgtgctatggtgtctacttttgcaacattgccatctgcttctggaacaaagccactcatttttctgctctgttttaaaatctggtatcatgtctgtcagaagaatcacagcatattgtcatttattgtcatatttacaataatggatagtggagccaaaatgactgaatttgaatcctggattatccacttactagctatgagatcttggacacatcagttcatgaaatggacacatcaattcgtatcttcatgcttcagtttcctgcaaaatgacaaaaaaagtagtaaggttattgtgaggattgtataagctattatacataaaatatttttaatactgcctggcaggtagtgatgatgatgataacaatgatgatgatgatgatgacatgacaatgatgataatgatactgtgtcccttgatcgtgtataataattgtcagctcaaattctggagttctctaagtgtgcattatggtcaaatgctgatacttgtgatagtgtttaaagcatcattatataagtatatgccatggcagtcatttgaatcgttgccatctgtagtattctattagctactgcactatcgttttctgctattttattatcagcatcttcttcaatatccttgttcatctgctcctatattatggtcatcagcttatttttgttgggatatctgggtgtacatcgtggtttaacagtcaaatattagtgttagttgctcatgcaccatgattgcctgagtatgtgccatgatatctcctccagcatcattgtcatatgctgtttgcctaaataagttgtattcatgtgttatgtttcctttattcatatgtcctgtccatctgggcatattcctcattgtgttattcactcttgtatcacacccacctgcttttatattgtaggtttttgctcatgcaccatggttgtctgagcatgcagcatgcttgtctgctcataccccatggtttctgagcaggaaccttcattgtctactgctttacagggaaatagtgttttatgcatcgtgtatatgagtttagtatttactcatattctatgactctctactcttagatcacttctgcctttttctgcacattgtttatctgttccaaaaagacagatgttatctcatgtcactgggctttctaattgtacatcagtcaaatgcttaaatgcctatgatgtgatggctgttcatgcaacatggctgtttcagcatatatcataacttcacccgtttaatcattgccatcttctcccagactaaagaaaataatgatttttaatcaccaaccatatccgttttggtaatcatggtttcatgtctacctgctcctgtatcattcttttactttatgtcgtgggattgtgtaggtagccatcatagtcaaatgcccaaatactagtggtggctgttcatgcaatggtcatctgagtatatggtgtcaggtctcttttgacatatctgacatctactcatggacaaagctgtttacccctgtaccgtggctcttgtataaggcacaatatctgtctaagtaagcaccacagcatggttttattctccgaaaacaagtttgtgtgctgtatctatctatgcctcttagctcctttggcataaatgctacgtaatagtgtaaactacttttgtgtacctgtgtaagtcaagatcaaacagtcaaatatcactaatggctttcatcaacttttgtctgaacatgttacacggtgggtcctctatgcacctttgccacctacatttgaaataatcattcatgtattgagatgttttgatcttgtactatatccatctatgaggtctccacttatgattattttctcataagatgtctcttggctctaagtgagccctggctaattttccatggttgtatgaatgtgcttatgccctttagctatggtcttctgctcattcatcatgatttgtgaaaatgcaccatcgttgtctacattgtactaaaaatggaattttctgtaccatgaatataattttgtgcaccatgattttttgtcatacagtgtgtttgcctccttcttcgtcctcagtatctactcctatatattggatgtcagcttctgttgcagaacctgagtgtgcatcgtggtcaaatgctcagactcctgtggtggctgctcatgcaccacggatgtttgagcatgtgctacggtgtctacttttgctacattgccgtctgcttctggaccaaagccatttgttcctgtgctctgtgtttctaatcttgtatcacatccatatgaggaagcatggcaccatcagtgtatgtgcacaatgctcactgcttggacttaaatcccagttctcctatttaatagtttgaaattcttgaggaagtcatttcacccttctgtttctgttttctaaactgtaaaataaataataatacctcatagagttgtgaggattcaaagatgcacatgtagaatgcttagattagtgcctgacacatataaatgataagtatttgctgatattgttatattatttgtattatgtctctttattctttatcatgacttttagcttgcattctgagaatgtctggttgtgtaccttagtcacatgctaaattactggtggtggctgtccattcagcatggtcgtctgatgttataccttggtttttccttttgcacatataccctttactcctttggcaaagtcattcattgctgtgttgtatttcattattcatcgtgtctttctgagaaagaatagcacagtagttgactactattctatttccacctgtacctgtatcataattgatagctcacctttcagtgtatattggtgtgtattgtggttaaattctcaaacaccagtggtagtttttcttccatgtgatcattggagcgcatgtcatggtgtctcctaccattgccatctcctcctaaaccaaggaattctttcccgtattgtggcttttcgattatatattgtgatcatctgtacaatttcaactatgtggctattttctttgtgtcatgtctgttttcttttatgtgtaagtattggctcattctccatggtagactgagcacgcgtaaggaatttctgctcatatattgtgtatggggttgtactatagactttcgctcatacactatggttgtgtaaaaatgcagttgtcattgtctactcctgaactgataaaaggatggaatcatctgtatcatgaataacagtttgttaattttgacagtatcgtgtttgcctgtgcttctgccatcctgaatgtcagttcatattgcaggattatctgagtgtgcctgtggtcaaatgttctgactattgtgactgctcatacaccaagaatgtctggcaatggactatatatttatttatgcaacaggaattattgtctctatcagcaatatagccattaattcctctgttaagcatgtgttttttaatttaccatatccattagaggtagcatagcaccactgatatataataagggtagactgcattatatacaaatcacttttttttgtttttccctaaaataataacatctacctcatatgcttgtttttttaaagtgcttagtgcttggtatgtaataagttctaaataattataatttttaataatatcctcatcatcgttatcatcgttattatactagaattttttcttcattctctatcatggttggcagcctatgttctgggattatcttggtgtgtgttatagtctaatggttaagcactggtggtggctttacaatgcacaaatgttgtacaaccatttgccttgatgtcatctatagggccattgccatctgctcctggactatttcatgccatcttattttgaaaatattgtaccatgcccctctcggtaagtaccagtctatggctttcttgacctaccatttctaatttttcctcaaacatacttgtatgtgcatcaccatagttatctaatgtgctcacataccatggttttctgcataaggcataattgtgtctactgttgtaatgagatagccatcattcatgttattgaaataagtttatatatcaaatttatttcatttgaattccctttttatggtttcctgtcattgctgtcagtttctgtatcacatcctttagctctgtgtccttactctcagcatacactttatagttatctgattgatgactttgacgagctgagagaagaaggcttcagacgatcaaattactctgagctatgggaggacattcaaaccaaaggcaaagaagttgaaaactgattgtatattagaagttcaaacaccaggaatgtttgttcataccacattgctatttaaatatatactgtgttgttttactttttactattgccatttactttgcccccaaatctttgttcctgtgttgtatttttttaatctcaaatcttatccatgtgaacaagctctaaacgatgtctctctgctcctatatttttttttatcatttaccatgcttcccttccatgtaccatatataaaaaatcacaattttctaagcatgagccattatagtttgatcctgcaccgaaaatgccatcttctgtgtattggactatgtattagctgatgcatgatggtttttaggtccggcactgaggtattcttcccctccatcagtgttgtctccttctatatcatcttctcataacatagtcaagagctcattttgcagttgtcttagggtacattgtgatcatatggtattcatgatctccttttgcatcattgccatctgctacattccttcatatatcaattactgtctgcacttaggctgcatagatgtgttcttgaatcattgctatctcctcttatatagctgctgtcatctgattatgcatcacggtcaaatcctcagcctctagtagtgccgcttcatcacgcagcatggttgtctgggaatgtgccgtgggatctccatttgcattaattccttcagctcctggaccaaagccatttttaaaaattcatgttctgtgtatcacataacacagtatttgtgattgcacctgtactatgtccatttatttctgcatcatggctacttcctcctgtttcgtaagtttcaattcataatctgaggttgtttgttatgtatcatggtcaaattataaaacgctgttgatggatatttatgtgctatggtcttcttgatctatgccgaggttttcttttttataccattaccctctacttctggaccaaagctactactttctatgccttgtgtgtgtttaagtcaagcaacacatatacttcagtaagcagatcattagtgacatctccttctgtcttaagttgtagagttgtgcatatttactatgtgtatctatgcctgaactatgattgtctactatagtactaagaatgaagtattataagccctagatggttagctcatataccacatttgcctgctcttctattaccattcttttcctttttcatctccaaatgtctactgttgcatgccttgcagcaaatgtggcagagttgtttgagtgtccattataatgaatttttcaaacttaagtgatagctgttcatgtaccctgtgtgcttgagcatgtattagtataatcttttgcatggttgcatctgatcctgaagcaaatccatttgtttcataattttaaaaatacatgcagtatctgcctgaataataaccatcctatagttgtgtgctccagcactattatgacatgtttcatgatttaatgacttcatattattggtgaaaacatcattacttcactatggatatctacttatttaccattgcaaatttagtattcattctaaatagtagtgttcttggaatagtgatatcttctcataaacagtggttgtcaacttacgcattgtgaatatcggctcatttatggtcagggttatctgaacacatgcagggtgagaatctatagttggctactgattattattatggaccactaagttatgcaattcaatggtaatgctcttaagaatgtttatttgtccactttgatgatcatacatagaaaatacaccatgatcaggtgggcactcattgattgaacgctcctgtgctatagttattctctttgataatatttgtttcaattccattctctgttttcattgtattacgacattggacaagacactctatctctttgattgaaaacttatatttctgggttatatatcctgactttcaaatatattaatatatcatatacatttttccacataaaatagttctaaaatgtaattttcacctgtataatatttagatgtatcaacgaccattgtttatttaaccattctgttagtatgcacattcaatttattttttaaaatttaactaatatactgttatattgcagaaaatatatttgaacatgacttttttgaatctttggtttttttctgtccagtagattcctagaagtgcagttactgagtcaaagcatggatttttttttacaggctttttattcatgctgcaagattgtttacaaggaaggaagcatagatttacgctcacactagcagatatatggaattcttgtctcgtcctatcttcaacagaattgtttagcatttttttaaaaagcttttgttcatttgataggtggagtgatgccttgttgctttaattgcatttcttcaatcaatcttaagactaagtttttaaggatatatatcaatgtaatcaacaatctgaaatttttattattcaactgtgcataggacttacttttctgtgttttagcttaaaatatgaaacactatatatgtaaatataattatcacacaaagatgcacgctgttttagaataattaagaagtgaacacctgtagaaccactaagtcaacagctataacattgtgggtactccagaagcctgtaacgaacttatttctaatttcaaccttttctttcccactttacttccactatccttaatcttacttttaaaaataactttattatatgtataacaaaatacactttagttttgctgtttttgaactttatatgaatggaatcatgattttcctttgtggcttctttattattattatactttaagttttagggtacatgtgcacaatgtgcagcttagttacacatgtacacatgtgccatgctggtgtgctgcacccattaactcgtcatttagcattaggtatatctcctaaagctatccctcccccctccccctaccccacaacagtccccagagtgtgatgttccccttcctgtgtccaagtgttctcattgttcaattcccacctatgagtgagaatatgcggtgtttgattttttgtgcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtaaatagtgccacaataaacatacgtgtgcatgtgtctttatagcagcatgatttatagtcctttgggtatatacccagtaatgggatggctgggtcaaaaagtatttctggttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggtttcgatttgcatttctctgatggccagtgatggtgagcattttttcatgtgttttttggctgcataaatgtcttcttttgaaagtgtctgttcatgtccttcgcccactttttgatggggttgtttgtttttttcttgtaaatttgtttgagttcattgtagattctggatattagccctttgtcagatgagtaggttgtgaaaattcatgagtgaactcccattcacgattgcttcaaagagaataaaatacctaggaatccaacttacaagggacgtgaaggacctcttcaaggagaactacaaaccactgctcaacgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacactacctgacttcaaactgtactacaaggctacagtaaccaaaacagcatggtactggtaccaaaacagagatatagatcaatggaacagaacagagccctcagaaagaacgccgcatatctacaactatctgatctttgacaaacgtgagaaaaacaagcaatggggaaaggattccctatttaataaatggtgctgggaaaactggctagccatatgtagaaagctgaaactggatcccttccttacaccttatacgaaaattaattcaagatggattaaagacttaaacgttagacccaaaaccataaaaaccctagaagaaaacctaggcattaccattcaggacataggcatgggcaaggacttcatgtctaaaacaccaaaagcaatggcaacaaaagccaaaattgacaaatgggatctaattacactaaagagcttctgcacagcaaaagaaactaccatcagagtgaacaggcaacctacaaaatgggagaaaattttcacaacctttgtggcttcttgcttgttaatttaatgttaggtttgtgagatgtgtacaggttgttgcatgtaattgtagttcattctgtttcattgtggtatggtattcctttgtatgaatacagcacaatgtattcattctattgtaagatagaccttcagattgtttccagttctgtttttacagaacagtgtttctatgaacatgctttaacaattatcctggtgcatcaatatatgtttctttaacatatatgtctaacagtagaaatagtacatcatgtatatgtgtatcatcaaatttatagtctaatgccaaacttttctccaaagagtttgtaccattttatactcctacctgaagtgtaagagatctcttgtgcttcattattcttgccaaactttgtattatgagactttaaatttttttgtcaatcaattagtttgtggtgagagcttattttctaatttctaatttctaaatttctaattttcattatcatgattattaatgaggcaaacactttttcttatggttaatgacaatttgaccttccttttttgtgaagtgcctttttaagtcttttgtccatttttctattggattttctctctttttcttatgatgttgtaggaattctttggataatgtttctttatcagatatacgtatgatgtgtgacaaacgtctaccattcggtatttgttgtttactcactttcttgcatcttttaatgaacagagatctgaattttaatgtagtctgttttaacagttgcttcctttataggttatcactttgtgtaagtttaagtaatattctcttactctgtgaagaagttcatttctattgtacaggctttatcattctgcctttcatatttagatcttcaatccacctgtaatacatttttgtatactatgggtaaggttacaatttaattttgtataaattttgaaaatagcaaattgtcctacaaccatttattgaaaagcctgtatttgccagaaagtctttggtgctactttagtcacaaatcaattgtcttataaacctatatctatttctgaactctctattcaatgccatttgtttatctcttctggcaccaataccctctgtgctaattaattttttttaaatagtcttttttctatttctctgaaaaatgtcattggtattttggtaaggttttcattaaatctgtagatcactttgggtagtatggagattgaaaaacattaattctttcaatttatgaacatgagctatctttccatttatttgtgttttcttcaatgtctttaatcagtgttctatagttttcagcatacaggtcttttacctacttggctgaatttacaccaaatatattatttttgttgctgttataaatggggttgttttcttgatttttctttttgggtagttcattcatagtatgtagaaaggctcctgatttttgtaagggtattttgtatccttcaactttactgagtttgttaatcagcttggataggtttttctttttttttttttttttgtggtggagtctgtagggttttccacatataaaaatcatgtcatcagtaaccagagacaatttcgcctcttcctttccattaagaatgctttttaactctttctcttgcttaattgctctggctagaaattcttttactaagctgaaaagaagtggcaagggtgggcatccttgtcttgtttctgatattagaggaaaaacttttaacttttcgctgtcgagaatgatgttagctgcaggtttggcatgtatggcctttatcgagggtttttttttttttgtaatcaagagagtgttgaattttgtcacattctttttctaaattgattgagatgatcgtagggattttaccctttgctttcttaatatggagtattataaatttttgatttgcatatgttaaaccatctttgcattctagtagacataaatgccagttgatcatggtaaatgattctttcagtatgttattgaatttgctttgctaatgttttgttgaatggttttgaatctatatttatcagggatattggcctgtaattttcttttcttttctttctttcttttttttttttttttttttttgagatggagtctcactctgtcacccaggctggagtgcggtggcgtgatcttggctcactgcaagttccacctcccaggttcgtatcattctcctgcatcagcctcccgagtagctgggactataggcgcccgccaccacacccggctaatttttttttgtattttcagtagagacagggtttcattgtgttagccaggatggtctcgatctcctgacctcatgatctgcctgcctcggcctcccaaagtgctgggattacaggtgtgagccaccatgcctggctggcctgtaattttctttgtatgtgtgtgtgttcttgtctagctttggtattaaggtgttgaaaaaaaatcattaaatttatatgatactacaaaagatccagaatagccaaaataatcttgagcaaaaagaacaaatgtgaaggcatcactgtccttgatttcaaagtctattataaagcagttgtaatcaatcaaaacaatatggtactggcataaaaagagacacatcaaccaatggaacaggataggaagcccagaaataagcccatatgtttatggtcctttgatttttgacaaaggtgccaagaacatgcaatgggtaaaggatggtctctttaataaatagtgttgggaaaactgaatatacacatgccaaagaatgaaattggaccctcatctcacaccatattaaaaaatcagctccaatagattagagacttaaacataagacctacaactataaaacaactagaaaaaaacatgagatgagaaaaagctctatgacagtggcctgggcaatacttttttatctatgaccccaaaagcacaggcaacaaaagcaaaaatagacaagatgccatcaaattaaaaagtctctgcacagcaaaggaaacaacacagtaaagaggcaactccctttatggtagaatgatttacaatcctttgggtatatacccagtaatgggattgctgggtcaaatgatatttctagttctagatccttcaggaatcgccacactgtcttccacaatggttgaactaatttacactcccacaaaccgtgtaaaagcattcctgtttctccacatcctctccagcatctgttgtttcttgactttttaatgatcgccattctgactggtgtgagatggtatctcattgtggttttgatttgcatttctctaataaccagtgatgatgaactttttttcatatgtttgttggctgcataattgtcttcttttgagaagtgtctgttaatatcctttgcccactttttgatggggttatttgtttttttcttgtaaatctgtttaagttctttgtagattctggatgttaaccctttgtcagatggataggttgcacacgtatgtttgttgcggcactgttcatgttagcaaagacttggaaccaacccaaatgcccatcaatgatagactggataaagaaaatgtggcgcataggcaccatggaatactatgcagccataaaaaacaataagttcatgtcctttgcagggacatagatgatgctggaaaccatcattctcagcaaactaacacaagaacagaaagccaaacaccgcatgttctcactcataagtgggagttgaacaatgagaacatatggacacagggaggggaacatcacacaccagggcccgttggtgggtggggggggttaggggagggatagtgttaggagaaatacctaatgtagatgacagtttgatgggtgcagcaaaccaccatggcacctatgtaacaaacctccacgttctgcacatgtacctcagaacttaaagtatacataataaaaaagaaacaagtatcaatatgactaaataaatgcttaaatatattaagaagagacaaccccgtgaatgagagaaaatatttacaaaccatgcatctgataagaggttagtatccaaaatacataaggaactcacacaactcaatagcaagaaaacaaataactggatcaaaaaatgggcaaagaacttgaacagacatttctcaaaagaacatatacaaatggcaaacaagtacatgaaaaaaatgctcagcatcactactcttcagggaaatgcaaattaaaagcataatcagtgtcttagctaattttgtgtttctataaaggaatacctgaggctgggtaattcataaagaaaagaagtttatttagttcacagttctgtaggccgtgcaagaagcatggtgtcagcatccactggctgctggtcagggcttttgtgttgtgctgaaatatgacagagaaagtcaaaggggaagccggcatgtgcaaaaggagatcaaatctgaggggtgtcctagctttataacaattcactctcctaggaacgaatctatttccccaagaaccaatccagacttgagagataaagaattcactcactactgctagaacagcactaagtcattaatgagggatctgcccccatgacccaaacatctttcactagaccccacctcccaacactgccacactgggcatcagatctcagtataagcttggtagggctagacaaaccatattcataacatagcaatgatatatcacctcacacctgtaaggcaggcttttataaaaaagatgaaagataagtgccggcattaatacagagaaaagggaactcttgtacattgttggtgggaatgtaaattacattatcaaaaatgatacagaagttcctcaaaaaactaagaatagaactacaatatgatccagtaacctcacttgtgggtatataccccaaaagaaggagatcaatatattgaagagatatctgcactcccatgtttgttgcagcactgttcacaatagccaagatttggtagcaacctaagtggccatcaacagatgaatagataaagaaaatgtggtatatatacacaatggaatactattcagccttaacgaagaaggaaatcttgccatttgtgacaatatagatgaacctgaaggatactatgctaactgaaataagccaggaacagaaagaccaatagcacattctcttttatgtgaaatctaaaaaagttgaattcatagaagcagagtagaatgatacttaccagagattgggtggggtagagagaaaggaatgaaaagttgttgatcaaagggtacgatgtttcagatagacaggaggaataggttttgagatctattgcacagcagggcaactgtagtcagtaataatgtattgtatatttcaaaatgaaggagtaaatttcaaatgtcttaccataaaaagatgataggtaagaaaagtgatcgatatgttaatcatcttgatttaatcattccacatgtatatgtatatcaaaacatcacatttaaatacaaaaattagccaggcatggtggtgggcgcctctaatcccagctactcaggaggctgaggcacgagactcgcttgaacccgggaggcagaggctgcagtgagcctagatcgcggcactgcactccagcctgggtgacagagcaagactccatctcaaaaaaaaaatcacattgtaccccataaatgtatacaacaatgatttgtcaattaaaaataatatcagtcctgatatttggtaaagtccttttgccttattcttcaaaacttcaagaggctattgtttgctttgcatttccatataaattttggaattcctttgtcaaattttatcaaccaatcaaaaaataagcccaaagaaaaggaagatgatagtaaatatctattatgttattttctatttcaaaaatttatcatcatattttaattatcatcttctttcttttggggctttaattttaatctcattctttctgattgaactaggtgcttagctcattacttttttttaaatctttttaatatacgtgtttaaggctacatggctttccttaagtactgtgtaagctgtatgccataattttgatagcaattttgttattgtacagttaagaatatgttctaatatgtattttgattttatttcaccatgagttatttagaagtgtgtttcttaattttcaaccacttatcaatgttatcattatcacctaattactaatttctaccttaattgcatgtggcaggataagatatcctatattattttaataattgaaatttgttgtgattttctttatagccttgtacatttttgtaaatatacctagtgagattttttaaatgtgtattttcttttgccatcaatgggtatggtattctccatatttccatgaggtcagatttgttactcgatcttgttcaaatcttctgtatctgtcctaacttctttaatctctctaatacgttaatttctgaaagagatatgttatgatgagagacatctatgttttgtgtagttttgttaattttgatttatatattttgaatcttcattattaggtgtatagaaatttattatatctccctggtaagttgaaccttttttctcattacttctagtaaaacctttcacatgaaagtctttatttcttattaaaaaatagaggattttttggttaataattacataacatatatactgtcaacttttctgttttcttatgtgttagatatgactcatgaacaatatgtagttaatttagttttaatcacttttaatctttctgataacttttttatttgcaccagagcctttagttcctttacatgtaaaaaatcgccgatatatctgggtttgaaactatcatcttcttttaatgctttctatttagcttgcccattttatgttcattttccttttgtgtgtgtgtttttttcatttatttattttatatttggatcgatagctttaaaatcattttttctcctcttctaatatagaagacatacagtctatttttatttagatttagtgggtgtcttagtaatacacacattttactttctaaagtctttttatatctggaagttgtatttgattctttaataaaatcatctagtttattgtttaaatatcctgtactctgcagatattttaaacttcttttggtggaggtcctaaaccttttatataatatgcacctgataaattcaatatctgaagtatggggatttgctttctgctctagctgtttctgttgtttctctctcattgtgcctagattcctcgttttagtgatctttctctgtataccgaccaatgtctgcgaaaaattatttatgggggtttcccaaagcctaatacaaaaatgtcattttctagtgatgatttatgtttacttctgcaggtcacctgaggcagagtttgcaggtactttaaattaaattcatgacttgagatttattggatcaaacattaatgtgaatttgagttgcaaacttaagagagtaagagaggcctgcttgtggtttaaaaccttttgcagggggatcgttttgtctgttttatttgtctcaatttgtctatgccctgttcaaactaaagcaactctcttgcagtctcctggggtttgaagaagatacacaggcatgcttctgattcatcaataatctgaaattgtagcatgtgtttgtgtgtatgtgtgtgcatgcatgttgtcagactccacaccacttgaaaattctaggctttggtttatgcactccttgctctatgaggctgtcaaaactacaacatggtttggtagctctgtatttattttctcttacttttccttggattgctgtttttgttttcttttttttaaaatttccttaggttgtttttttttctctcttatttaatcataaagacattgagtaatggcaatttattaatttatccatctgtacagttttgggtttattctccccaaaataaagttttgttttatagttttgctgccttaattattcttgagatggtgttatttagagaacaaatttcaatttctgtttagtctgttgtgttaattatgatgtttgaatctgtcttcatatttgtcagcttagtcattgcaaactgagtgctgtgttaatttacattaacacccgatttctttcatttatcttttatttctaagattttattttatttagtctgcagtattattattgaaagcagaaggttttatgagttgttgctaatagtggggatggataaagaatagcaactatacctatatatacctcacagaagagtacagtacaaaatatattaatcatggaatgaccacatacattttttgctagttcagcccctaggtttctaaattacggtgtttatgtgacattggtttgtcttttcctaacagtctttgggtatttttagaagatgaaacatgtgttgtatagtacaagaatgtttatctgaatccattctcaatagcaatgtatataatcaaattcccttttagacattggatttttgccttttttccattattcttgacaatcaaacttccttccacccactgttttctgttattcctgtctctcttaatgagaatttcagaggtgatatattttctgttgtgttaactctgaggcaaggagccccaaattagaggtatccatatagaaacccacaaaaatattgaatagaaatagacagaactgcagtgtaattagattggtatcattaaattcagtaaggaagaaggcagaatgtagatgattaaaaaataaacagaaggcaattaagctggagtaaacaattataaattactagttcaagaaacttgattgataaaagaaagaaggtaacagctagaaagaaacatattggtagaatttctcttacagtggaagaaactttattatgtttatagtctaagagaaaggagtcattagagaacaagagatttaagatataggtgagaaggagagtcgatggaaaggaaaaaagttcatgaggtcaggagcttaggttgagagattatcctaagatagggaaggttcacctcattttctgaaacaaaaagaaaaagtaaggataaatataaaagtgagttaattttgtaggttgagacaagctgatgtcttaaattgggtttcactcaagcaggctcggagattaggattcatatgaaggtagtttattgggaagtgttcccagaaaaaaaaaataagagttttgggaagtggggcaaggaagtgagggtggccaagcaagggtaatgtatcaagcaaagtaccatggaaactgtgtgggtcacacctcactgttgcccctatcagggagctgcattatttgtacttctgtatctgtcagtcttagtttagggctgccctagtttggaaactcaaattctcaggcaattctgattgtcagtgtgcacgggcaaaagttagtttcagcaacctgaggacagctctaatcctcagacaaagaaatgcagatgctgccttttgggcgggaaggctcaatggagtcaggatatgtgaaactggtgaagagatccaaggggatatgaatgaggcattaataattagctagtgtctaatatgggtggtttgtctcttctgatcatcttgactttgtactgaaagaatatactagtttccctaaataggcaacttgagaagaatgacaaaggtttaaaatagttgagaggaatagggaagaggactggtttatgacaaattgaaggattattgaagaatgctggtattggaaataatgaatttattgtggaattttcttcagctgctttcatcagtctaagacaaaacagattgtttgtggattgatcccaaatagggtttctagacaaatacagtggaaggtcatatgaacaaggtgctgaaagagtagtccaagtaatttactttggatccagccttgaaatgaaaggaagtaacactaggcaagtccaagagcctgggtgacaatgaaaggatcaacagactagaacactaatttcaaagagcaagtggagtagaagtaaaagtttataaactagaagaataacagaataaggtcaaacatcaaataccatagtttaatatttgtgatataggagcaattatgcataagatacagggtgtgattgaatggaagagaaagtcatagagattgtgcagatcaaataactatgatagatatattatctacacaaacagtgaaatactgaaaatgatagagggatatgaaaagcatgaattggttattgtagccttgtagtatagtttgaagcggggagtgtgatgcctccaactttgttctttttgcttaggattaactatttgggctcttttttggttccatattaattttaaagtagttttttctgattctgtgaagaatgtcgatggtagtttaatgggaatataaattactttgggcggtatggccattttcatggtattgattcttcctatccatgaacatggtcctggcacaagaacagacacatcgaccaatggaacagaaaagagaactcaggaaaaagaccacacacctacaataatctgatctttgacaaacttgacaaaaacaagcaatgtggaaaggatttcctatttaataaatagtgctgggagaactggctagccatatgcagaaaattggaactggaccccttccttataccttatacaaaaattaactcaagatggataaaagacttaaatgtaaaaccaaaaactataaaatgaagaaaatcctagaagaaaatctaggtaataccattcaggatataggcataggcaaacatttcatgacaaaaacatcaaaagcaattgcaacaaaagcaaaaattgggccaagcgcggtggctcacgcctgtaatcccaacactttgagaggccgagacaggcagatcacgaggtcaggagatcgagaccatgttggctaacacagtgaaaccctatctctactaaaaatacgaaaaatcagccaggtgtggtggcgcgtgcctgtagtcccagctactcgggaggctgaggcaggagaatggcgtgaacctgggaggtggagcttgcagtgagtggagattgtgccactgcactccagcctctccagcctgggtgacagagcaagattccatctcaaaaaaaaaaaaaaaaaaaaaagaaaagaaaagaaaaaattgacgaatggtatctaattaaactaaagagctcctccacaacaaaagaaactatcatcagagtgaacagacaacctacagaatgggagaaaatgtttgcaatctatccatctgacaaaggtttgctatatagagtctacaaggaatctaaacaaacttacaagcaaaaaaccccattaaaaagtgggcaaaggacatgaacagacactcctcacaagacattcatgtggccaacaaacatatgaaaaaatgctcaacatcattgatcattagagaaatgcaaatgtccatcaatgatagactggattaagaaaatgtggcacatacacaccatggaatactgtgcagccataaaaaaggatgagttcatgtcctttgtagtgacatggataaagctggaaaccatcattctgagcaaactatcccaatgacagaaaaccaaacgccgcatgttctcactcatgggtgagaattgaacaatgaggacacttggacacagggcagggaacatcacacaccggggcctgttgtagggtggggggatgggggagggatagcattgggagaaatacctaacgtaaataacgagttaacgggtgcagcaaaccaacacgacacatgtatacatatgtaacaaacctgcacgttgtgcacatgtaccctagaagttaaagcataataataataaaaaaaaagaaatgcaaatcaaaactacactttgagataccatcttacgccagtcagaatggcgattattaaaaagtcaagaaacaatagatgttggcaaagttgcagaggaaaaggaatacttttacactgctgatgggaatgtaattagttcaaccactgtggaagacagtgtggcaattcctcaaagatctagaaacagaaataccatttgacccagcaatcccacttctgggtatatacctaaaggaatataaatcactttattataaagatacatacacgtgtatgttcattgcacacatggggaggaacaatatacactggggcctctccacagtgggttgggggaagaagagcatcaagaatacctaatgaattctgggcttaatacttaggtgatgggttgatctgtgcagcaaactatcatggcacatgtttacctatgtaacacacctgcacatcctgcacatgtaccctggaacttaaaataaaagttgaagaaaaaatagtatacagaaacgccacaaaaagatagaagtatgaactgagcatagtttccgaatcagtgtcgggaggcttcaaggaggcagacgtaagattgaaaggcagagagtgatacagataggaggcatgaacctcaaataagaaggactgtggtgcacatgcatagatgagagatggtttcaacgtggcattgaaaaaatgagatagttctcatcttgtctctcagttgcataatatatgggagtatgcacatgtcacacttcaggggaaagttaatgaagtagtgtctataatataaatcccaatttatttaaggcaaagagaacagaaaagttttcctttaaaaagttgagagcatagaataatttgttttccataaaatgaaggattgaaagggcatgggggaaaggttttaggaaagtagcatagtcttgagattatacctctgagaagaaaaggatgcccagagttgtgtgagcatgaactcatgaaaaaattcactctttttttccaacaaatattttattgagtaacagtcatgtgctaggctctactctatggcccagagttagagttaagttcctgcactaatgaagcttatatccagtgggagaaatggaaataagtaagtacataatgtaattttgtgtagttatatatcccataagaaagtggaattggataaggaggcaaagagatatatgggaaaagcatttatgacagaggaaagagcaagtacaaagtcccttaaggctgggtgttttcaaggagtattgggaaaacaagtgtgaattggtatgagtaggggagaccgaaagtagaaagaggtgaggttttagaggtagccagtggtcaaataaagtagattcttataggtcatggcaagtacttaggattccgaaaatatccactaggaaagtttgagaagagagtgggtctgacttatatatatttttttttctaaaaacccctcattctgactactgtccagagaatggactataagggggcaagagttgcagcagagaaagaagttagccattcattgcagtcatgggggtggttttgaacagctaaggggcaatgaaagtattgagaagtggtcagagtctgggtctgttccaaaatcaacaagataagctgacagtttgaatatagggcatggaagagagaaatcaaggtatggatatggatcggatagggatggctttgatatgtaagggaagagtccttggtcccgtgttcttgtttttcttcattgattcactttttggctgttttgttcactgctgtattcctagaacttagaatggtgcctggtacatagatgatactccataaattttgaatgaattaatactaagagtggattcagtggagtgatagatgaaaatacttgattgatatagatagtatgagggaatgattgttgaggaagttgagatagagataatgattgaaatgggttaccataaaaggcaggcagaaaaattgagaaagggttggaggaatgtcaggtcaagggatgatttttttttcaaaatgatcgatgatattgcatcacttttatgctgcaaggaatgagccagtatagagggacaaactgacaagtgtgggagagatgagacaataaccaaataatacatttgaccaggagacaggaaatgggatccaggacacatgtgggggtgcttgcattagataggagcagacactcctggtaacagggaaaaggttaaagtatatggctgacattctggtaggttggtatagttgatattaggaaggagagcgcatggtcttttgattgcttggtaaaataagaagcaaagctatttgcagagattctgggaaaagagttatttcttctcccagagagaaaagaaagtaaaatattatctcttgagagtgggagagtgaattggtttggcaagtgcaaaaggatcgtgggacattgaagtatgttgaagaaaatttaaagagaggccagtcaggcattatgcagatttttccagatatattaaggtgcttatttgtagatggagagttggatttgaccaaggtttatgtttttccaggcaggtacagtacagtatgagagatacaagtgtattcagggtgtataccagacaatgattatactgattttaattatggactatgtatgttatccaagcagggtaagaaaggaaatgagaacgtgaagatgatgatgagcaattctaagattgtaagatcagtagattagaaatccgtggagtggggtggaatgggtggatgtgggtagaagaattgacagtatgaaggtgctagatgaaaaatgttggaaatatgtggtcagagagtgattcaagatcatggacttgtaatgacaagtcttaggatatggccatggaagggacaaatggattaggatagagctgaggctcattggaggaaaagaggtcaaataatagacctgtagtttacagtgaccaaaatttactatatgtcaagcttaaggctaatgctacatatgaattagattatttaattcttatgacaacaatggattaattaatccattatttggattagaatattgagtcaaataacctgcccaatttcaaatttctatgtggtatatccagaattgaaactaagatgtttttgtcttgaaaacctttatgaatgacagtgctttgaggctaggtggaattagatgaccttaaatgaaactctggtgacaagttgtgacaaatggcagagttgactttgtagtatctgggtaacaacatgtggaatgactttgttcaggtaaagttctggcagacagtcctcatgtcatccaaacagggacatttgtaagcataatgtcagtatctggtggtttctaggtactgaaataaagaagttttaggaattccaatagaataattggtcgtattggtaccttgtacatagcaggtgctcaaatgtgataaaatgaatttgtctttggacaagacttatcagaagacttatcccagtagcaggtgtttaactaggcattttacgtttgttatcttatataatattgacagcctttacaagatggatgttatccccattttttattgaagaagtaggtcattaaagcctaacacaactagtatttggtagtgcccagtaacctttcagtctggcaggttccaaagcccatcctacaccttatccttcttaaccaattttcctcatttaggaatgtgacttagttacaataccattcatttattcagtatttattaagtactcattatttgtcagatattcttctatgcattgggcatatatctttgaatttaaaaaaaaccaaaatcctcatccccattgagcttttctatctgagaaacaagcaatttttcttccttttagacacaaaggaagaaaaatagggcagacaactgtataggatgtatgaggaatgtgtggaaggcttgaaattttagatagggtggccagggaagccctcaatgaaaagatgatattttaataacactatgaaggaagtgacggaacaaattatatgaaaattggatggaagaacatcccaggtagaggggatagcaggtgcaaaggccctggtgcaggagcatacctgacatatttcatgagcagcgaaggaggccacagtggctgaagtggagtgtgtgagacgggagggtagtaggggatgagactagccagctatttggagatcaggtcatgtaggaccttgtagatcatatatttatttatttatttattaattgacagataaaaattgcatgcatttaccatgtacaacatgatgtttcaaggtatatacacattgtggaatgactaaatccagctaattagcatatgcattctctcatgtagttataatttttatggtgacacatacaaggggccaataggtatatgataaaattctcaatatcactaatcttaaaggaaatgtaaatcacctcacacctgttagactgggcattatcaaaaagaccaatcatgttagagaggatgtggagaaaagggaccttcacacactgttggtgggaatgcaaattagcacagccattatggaaaacaatgtggaggtctctcaaaaaaaattaaaaatagggcctagcgcggtggcttacgcctgtaatcccagcactttgggaggccgagatgggcggatcacaaggtcaggagatcgagacaatcctggctaacacggtgaaaccccgtctctactacaaatacaaaaaattagctgggcgtggtggccggtgcctgtagtcccagctactcgggaggctgaggcaggagaatggtgtgaacccaggaggcagagcttgcagtgagccgagatcacgccactgcactccagcctgggcgacagagcgagactctgtctcaaaaaaaaaaaaaaaaaaaaaagaaaaaaaattaaaaatagagttacatgattcagcaatctcactactggttatatatccaaaggatattaaattagtatgttgaagagatatatgcacttccatgttaatgcagcgttattcacaataaccaagatatgaaatcaacttaaatgtccattaatgcattaatggataaagaaaatgtggtatacatacacaatggaatatgattcagccttcaaaaacagtgaaatcttgtcatttgtgacaacatggatgaacctatagtacattatgttaagtgaaataaggcatacagagaaagacagatacctcatgatgccacttacatgtggattaatctaaaaaaggtgatttcacagaagcagagagtagaatggtggttaccaggggctggaaggtatggtctggggtgggtagatgttggcccaaggatacaaaatttcagttatataggaggaataagtccaagagatttcttgtacaacatggtgactagagttaataatataatatattctcaaaaaatgctaagagactgaggcttttgaaatgggaagaaatgggaggattatgagcagggggaagaaattatctgccttagcactttaaaagttccctctgcccactttgtagggaacagactctaggggagcaaggacagaggcagcaaaaccagttaagaagcttttacaatgatcttgacaagagatgacaagctagagtggtagcaacagaggtaatgatcaatggctttaatttggatatatttccttttgaatggaatgccaatgagacttgttaatagatcagatgtgtggtttgaacgttaaaggggagtcaagaatgacattagagttttaatcagagcaaatggaagtgcagaggagtcactattacttgagatgggaaatactgcacaggaccaggtctatatatgtgtgtgggggtggatatctgaacttcatatctgaaaatgttatgtttaagatgcctctcagacatttaggtacagagttttgtgagaggtatcttaaacctaacctgggtttaagttttacttatgagttacgatatgagtttaagatatgtgttatctcctggaacccatatctagatacatatatggattcgaggtaatatctggaatgaagatattaatttgcaagtcatcagtttataaatgatattttcgtctatttgtttgttccttgtaccttcctttagctctttagtagggtgaattggttggtaatcatttgctaatttggccatgcaattacatattataatggcctgagcacgtgtcatgattatgtgttcatgtatcatggataatctcttctaacaccatgattatctgagtttgcacaagagttgtctcctcctgtttcatagccaatctgctcctgccaaaggcatctgcatttgtgccatggttgactgtaaactcacaggacattttttttttatgtactgtacttatataagcatacactatggttgtctacttttgcaacatagcctggcttcttgattaaaatcagcaataggttttaccttctgcttgtacatcatggttgtctgaatattcgtatgatgttccttcactgtaattttcattttattcaccatggatatgtgcgttatatttgtgtgttcgtacactacaaatagctatttattcactgtcatcatcattacccaaaggatatcaattcttcactatggtcacttgcaactgtatcttacctttctgctacagtgaaaaatttttgaccatgtctgcctactcatggaccatgaccttttgtgttcctgcaccatggtaatctaattccatagcacttcagtctgctcctaaaccatttcacttaattcctatagtatggttgctatgatacatatattctgtgtgcatttatcatggttaagaattgatgtaccaaatgcttcttcacatgtatcatgtttgtctatgcatatactgtatttgcctccagccacatggatgtgtgatcatttttgaaggctctttgtttcactgtcacagacattttatttagttatgatttcatgtaatgctgttgtcttttttatgtatcatagtatatgtcttagttttctctttccaaatcatgggcatttaattctatgtaattgccatctattcttaatatgatagtttgctgcttatctaccatgataatttgaacataacccatagtgatatagtagaatagcatagctgaacacacactatggatctctttgtttacacagcatggccatcttctcctacatccaggattgttactcatggactcatgttttctaagcatgcatcatggctatgtcttatgttccatggattatttctatgatttgaacttcatatcctagcccaagtgtctctgttcctgtagagtagttgtcaattcatgtatcgtgattatctgaacattaattcttgtcatatgattacacaacattaaggtctgctaaagcactgtgaatgtttgagcgtatatcatggttactgcccttaccatggaagttacttatgcttggagttgtctgatcatgcactatcttttcttactcatatactatggttttctgaaccgtaccattcctgtatactcctgtaaaatgtccatcaactcttttattgttcatgaagcatggatgtcacagctcttatattaggttgaccataagaaattgctttctttgataaaaccaaaattgtgaaatattggcaatttcatatggtgcaatctaatactatgattatctctgtctctaatgttgacacttcatcatgtcagaagtctgtcttctccattgttgtagtttttcaaatgcctataccagattcatgaagacagcttaatatagatccagtggctgcttttttgaggcgtgtggggtgaatttaaaaggccttttgttcttaatctcaccaaccagaatagctccttaatgtgtatctgttttacatattggtctcttgtataagctttcttggaaaaaaaaccagttatatatccctccattttctctgaaaattaattcactgatatgactgaaaaagggtatgttgttgggtcagagttaggtctccttcaagttctcagtgtctcataatcaaagaagccacacaaattagaggtagcaagtaaccatcactttattggttgctttcttaaccccatgtcttgggtaaatctccactgatccagggttcataaaacagccttccttatagggaactccatatcactagttctatcaccagtataatttgctgacctcttagagatttcagtgtcaggaagtaggcttggatttctctttttgttgtgtcccctatctaaaggaacaagtttgctttcaaatatctctttatggggaaatactgcattcttattcaagagccatgatgtctcattattcagtattttctcaacctaatttagaggaaacagtctatccacttcaggccatttaatcttttggaaaattgtttaactctatgaagctgagaatcaatcccaaaaatgctataaaaagactccaggtcttaatatactaggatagtaggattctctacgatattacacagttaaccaaggcaaaggactttgtaacactaaagatcaaacagggaattggagggaaataaaatgaagacatgagagaatatttttaagatcttagattataagaggtaacccaagctgagggaagttctgtgattcacctaatcacatagggtgaagccaaggaaagagatgttgcagtaacctcagactcctgattactgacttagggctgtttgtgctacactgtgcatcctttcttggatgggctctggtatatttaggagaagggtatattgggggcgattttggtggcattgacaagctgggaaaaggggactgttgaattaagcactgagtaactagacactagagaagttaaatggctctaatagagtttaataacatctctttctctcttttttacctctttctcctctctccctttgttttctactctctacctcttatcccttatctaaactgtgaatctcacaggtctctccaagtttgtgcctaagaagatgataatcacacaaacaagtcactgttacatgaccagccttgggattcttttcctgattaatattctccctggaaccactggtcaaggggaatcaagacgacaagaacccggggactttgtgaagcaggacattggcgggtaagaacccctaactcttaggatgaaagaagactgtgataaatgtttgcctcagaccaaaacttctgatgttttcccccagatgaacccaagtactctggtctctgatacttatacattacattatatttagaaaaaagtcataggctcagactctcaaagtagaaagagatctcaaagtttctttttcttagacaacaccctggcccaggcttgaatcacctctgtaatatcttaaaaatagttcttttgccctcaattttatctctcctctcttagatcttcaaccttttcctttttattggctgtgtggctccatagcatttaaacatgataatgtttaggaatcactcatcttaaatttaaaaatcttccctccagatactgccttaattatttgctccccttcatagccatatttcttgaaggagtggtatgcttcattgcatctatttacctctcaccctttcattcacttgctgccatctgacttccaaccccagactctaaggcaacttctgcagccaagatggccaatgttggttctgttgctgaaatgaacacttctctgttcttacgttccaatattgttgacttctccatccttgacttcattttattatgaaataaaaatacatgtagaaacatgcataaaatataaatatatagtttaataataattctttttggcttcagagacactataattctctggtgttttgattgggttctctagaaacagagtatgaaacaaggattcttgagcaaatgatttattgagaggtcactttcaacagaaacctgtaaggaagtaagggaaggaagatagggaaagagaagaagtaaagcaaaggtgtagcctcaatttgacctcatgaggagaagtggggcataaatggcactaaaagatttgtcctactttgaggcaagggacccaagcttgtgtactctcacctcaattagtctttgcctgtggatcccctggagaaaggcatagtcttccagatattttaggtgaggcgactccctgcaacagatagtaattttccaaagtagctgcaggatgatttcactggcccagtaaagggatccgagaatagtattataccaataataaatactacatctggttttctttatacttttatgactatgctttctgcaatattttccacaatactacacaggtacatcaaagacctttgtgatataaagatcctttttagtcttcttttgttcacccctcaggtgtttgtgtttttccttgttttgttctaggcacacttcttaccctacagatcccctgagtgatgtaatccatttctatgatgtagttaccttatatatgtaaatgccaatgactcccatctcaatcttcattctagacttctcttgaatgtcagacttctatatccaactgtctactgaacatgcccacttggctattccacacacttcttaaactaagcatgtccaatgtatttaattagcttcatctccctcccccatcctaaagaacaaacataacaaaacaaacaacaaacagacaaaaatattcctcttccatttttttcctgtttcagtcagtggtaccactgtgtacccagttgctcaagtcagaaacttggaatcatttttgccagttttctaccctttactctccagattgaatcaatcaccaagatttgtcatttctacctcccacatctcttggattcatctacttttttccaacttttctgctagcaccctagtttaatctgatgttgtctctcacttggaccactgtgcaaaccttgtcttacttcctaaaatcttgtttccatccaaactaacctccactctgtaactatttttttctgtaatgcatgtttgaccatacctaccctatttagagccctttcatggttttctgttgtccctacaataaggtacaaactctttaacatgattttataaaacccattaggacccagcttctacccaccttgctagccttatttcttagtctttctgccaccaaactgtgttcagcaatgttgaactccttttagactttaaaatcccttctaatccaaggaatatcattactagaaatgacctcttagccctgcaatatttcaatattacccaaggtattttattccttggtagtgactttttttttttggttttacatttggctattgtcctatattcttggaagcatgcatcttgaagtaggaagtattcctaattatttttgcagtgttgattatcttaatgtactctgagtcttttcatcttatatcagcatttttacagtaatctctggggctgaggctgcagaactgggcttgtatatccttagaatcttggtatataagactctttttgttctttcttccaaaatggaaaataaaaccagttctgttttgttaactcctcatgtatttcatttcactgggccatgatagattctaaataagatgaaggttctaaataaattaaccttaccgcttcaagtgttaaagccttttacattttaactctgataatatagttttctaaaaatgtattgcatattttcttataatcctaaacaaggatttttttaaacagaatagtcccatttctttgtgacttttggtcatcataaagaaaattcacggttgcatgccatggcacatgcctgtagtcccagctacttgggtggctgatacagaaggatctcttgagcccaggagttaaaggccagccatggccacacagtgagactctatctctaaaacaaacaaacagacaaaaaaaaaaaccacaaaaaattcttaagcacatgttcattatattcattcgaattttttttttttttttttttttgagatggagtctcactcttcacccaggctgtagtgcaatggtgcgatctcagctcactgcaacttccgtgtcctgggttcaagccattctcctgcctcagcctccggagtagctgggattacaggcacatgccaccacgcccagctaatttttgtatttttagtagagatggggtttcaccatgttggtcaggctggtttcgaacccctgaccttgtgatccgcccgcctcagcctcccagtatgagccactgtgcccagccagtgttagttcttatgtcccgtgtcctctttacaatggtttgttagcatcctgttgatgcttagaaaaccagatagcctagtttttagtaattatgtcaaggagtaggccaagaaatcctacctgaaaaagcagagtgaagtgcttggttttagtaaagaggcaatacaatcactgcatgttttctttctttctttctttctttttttttttttttttaaagacgtggtcttactctgctacccaggctggaatgcagtgatgtgatcatagctcattgtaacttcaaactttcaaactcctgggctcacatgatcacatgatcctcctgcctgagcctcctgagtagctgggactacaggtataagccaccacacgtggctgatttttaaaattattttttagagatagggtctcactgtcttgcccaggctgatctcaaactcctgacctcaaaagatcttcccacattgacctcccaaagtgttggtattacaggtgtgggccaccacacctggtttctgtttcttgaattagaaacattttttttttttaatttatttttttttttaatttttttttttaattttttttttttaatttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaattagaaacatttttttctttactttcctccaagcccagtgcaattaatacttttgaggcatgatactactaaaagcatggcccaaatattaaggttgtattcttctgcatgtcttttgggtaaataatgaaattaaggcagaaataaagaaatttcttgaaagtaatgagaacaaagatacaaataccagaatctctgggacatggctaaagagtgttaagagggaagtttgtagcactaaatgcccaagtcaaaaagttacacagatctcaaattaacaacctaatgtcacacctaggggaactagagaaccaagaggaaaccaaccccaaagctagcaaaagacaagaaataacaaaaatcagagctgaactgaaggaaattgagatgcaaaaaaacatacaaaagattaagtccaggagtgtgttctttgaaagaatgaataagatggatagaccactagttattctaatacagaaaaaaagagaagatccaaataaacacaatcagaaataacaaagaacatgttactgctgaccccagagaaatacagaaaaccctcagagactactatgaacatctctatgcatacaaactagaaaacctagaagaaatggataaattccttgaaacttgcgacttcctaagactgaaccaggaagaaattgaatccctgaacagaccaataacaagttccaaaattgaatcagtaaaaaaaagcctaccaatccgaaaaagtctaggaacaaattaattcacagccaaattctaccagatatataaagaagaactggtaccattcctactgcaactattccaaataactgaggaggaaggactcctccctaactcattctgtgagaaccagcatcatcctgataccaaaacctggtacacaacaaaaaagaaaacttgtggcctatatccttgaggaacgtagatgcaaaaatcctcaataaaatgtagcaaaccaaatccagtagcatatcaaaaattgaatccaccatgatcaagtagactttatgcctggaatgcaaggttggttcagcatatgcaaattaataaatgtgattcaccacataagtagaactaaaaacaaaaacacacataattgtctcagtagatgcataaaagccttttgataaaaatcaacattatttcattaaaatgaaggactacaggtataagccaccacccaaactaggcattgaaggaacatacttcaaaataataaggactatctgtgaaaaaacccatagccaatagcatactgaatgggcaaaagctggaagcattctccttgaaaggcagaacaagacatggatgccctctctcactactcctattaaacatggtactgaagtcctagccagagcaatcaggcaagagaaagatataaaaggcataccaatcagaagatagggagtctaactatctctgtttgcagacaatatgattctatacccagaaaagtctctgcccaaaagttccttgatctgattttaaaacttcagcaaagtttcaggatacaaaattaatgtacaaaaatcagtagcatcatacaccaacaacatccaagctgagagccaaatcaaaaacgcaatcccattcacgatagccataaaagagtaaaatacctgtgaatacagctaaccagggtggtgaaagagctctacaataagcattacaacacactgctcaaagaaatcagagatgacacaaacaaatgaaaaaaattccatgcacatggataggaagaatcaatattgttaaaatggccatacttccaaaagcaatttacagattcaatgctattcttatcaaactaccaatgacattctttactgaactagaaaaaaactattttaaaatgtatatggaaccccaaaagagcccaaatagccaaggtaatcctaagcaaaaagaacaaagctagagacatcacactacctgacttcaaactatactatggggctgtagtaaccaaaacagcatggtaccggtacagaaatagacacctagaccaagggaaccgaatagagagcccagaaataatgccacagatctacaaacatctgatctttcacagcattgacaaaaacaagcaatggggacagaaatccctattcaataaatggtgctgggaaggtggattaaaaacttacatgtcaaacctaaaactacaaaaaccctggaagataatctagaaaatatcattctagacataggacctggcaaagatttcatgatgaagacatgaaaagcaattgcaacaaaaccaaaaattgacaaatgagacctaataaaatgaaagagcttctgcacagcaaaagaaactatcaagggagtaaacagtctacagaatggaagaaaatatttgtaaggtgtgcatccaacaagggtctaatatccagcatctataaggaacctaaacaaattcacaagcaaaaaacaacccaattaaaaaataggcaacagacatgaacagacactcctcaaaagaagacatttttttgtggcaaacaagcatatgaaaaaatgctgaacatcactgatcattagagaaatgcaaatcaaaaccacaatgagataccatctcatatcagtccgaatggctattattaaaaagtcaaattataacagctgctggtcaggttgcagagaacagaatacggagctcagaaataatgctgcacacctacaactatctcatacactgctggtgggaatgtaaattagttcagccattgtggaaagtagttcggtgatttctcaaagaacttaaaatggaattactatttgacccaggcatcccattattggatatatatccaaaggaatatacctcattctatcataaagacacatgtatgcatatgttcattgcagcactcttcataataggaaagacatggaatcaacctaaatgctcattaaagtggattagataaaataaatgtggtacatatacaccatggaatactatgcagtcataaaaaagaacgagatcatgtcatttgcagcaacatggatgcagctggaggctattatcctgagcaaactaacacaggaacaataaaccaaatactatgtgttctcacttataagtgggagctgaacattgagtacacatggacacaaagaagggaacaataaacaccagggcctagttgagggtagagtgtggaaggagggtgagtataggaaaattaccttttgggtactatgcttattacctgggtgacgaaatatctgtacaccaaccctcatgacatataatttacctacataacaaacctgcacatgtatcccctaacctaaaataaagctgtaaagaaaaaaattatgacaaaattagacttggttaatcataaaaagcacaaatattagagttgtatttgccataaataaaggatccaatataattttaaagtatagagtttttgctgatagttgtggtacttaagagctgctgctgctttttgattatttccgtactttcttaattatgtttttgtgtattgaaaaaaatccattactgcattattttatccaactttaatgatttattcaattaaaccacctacattggccgccacagccattttaacaatcaacagtggtttatcgaccagtactttgtataactcatgtgcttgatgtaatagttctcaacattcagtatttgtaagcaagaaagcaggcttctgcatttgaagattatgatttggtagctctgggaatagtgcctaaaatgccccagatgattctggtgtaaggaatctttggggacacagttcctgtttttaagaaactaacagtatagtttgggatttgggattctggaactttagaacagcacccatggaaaaacctgtagagagcatctaatctgattttttaatctgtacctgaagaaactgaagcccagaaaggaaaattgactttcttacaatgagttcataagagacccaggtctagagcaccagtttctgattcccagtcctgcatttttgataagaagctacagagagtaatttcaacttcatataataaatgaatttcctatactcctggttcctggtcaagtattttgaccattagcaaatggaattatgtacgtgaacaatgtcaagttgaaccattttgaaactgacattttgctaggtcagaacgattgaatatcagcaattttcataatgggtcaacacgtaagtgcctaagcagcaaatgccaggtctgactgcaatttgttgaatttgtcaggatcccagagaatacagatgggacatttcaattatttgaggaggatatatttgcagagactaatcataaagttatgatctaagtggagggaaaccgcaaggaatagagtaagaacctaaggtgaacagcacacatatcatgtaaatcaagctttcttcagaggtgcagatttttggtggaggaaacagccagcctgagaagatttcacagggagagagccagggagttacatgcccagtcttttcgtcttcctctgatcttcagccaaggtggccaaactcaagttgaagcaataggccaatggcgcccataatgtagtgcataaaaattagccttctagaaaggagaacggggtggagaatagtgaaaaggcaaacgaaatatgctgcacacaaggccgcatatttccacactactaatagagtagggactatgatttgggaggaatatgacactatattaacacattttctgcatcaacatcatatggtggtggccatggtgacaactgatgcagtgaactgaagaggagactgctggggagttgcttgtctccttgtcatatctacagcctgacttggttctactatctaaaggtgtcagtgcttgtaagcatctgtattcatcttgaaaatgattttctcagttctcttaatctcagaataaactgtcacctgtggccacacatgtacttacttttacttggaatataagtatgaaaagtccaaacccttccatttacatgtaatttctattaaagaatcaatgcatcaatactcttagcatttgaccatcaaatcttaaaatttcagaaccagacttgggacctgagaggctgtcagttcctaggctcctatcctgggaaagaatccctcctgctttatggttgatgattcacctaccagtttgaatctctgcagtgataagctgcattagtaccacagggcatagctccaggggttagaaagtgcttcctatattgagctgaagtccaccttcttcaaacacctcctagttatagggccctgtaacatttgcaacatttgcttctttttccacatagtggctttcagatatactccatgctttcttgtctgcaggctaactctcattcctttcaaatattctcttggcataatatggttttccagacattgcttcaaactggacactctcccttgttatctaattaagccatttttttgagattcgattccttagtcttacttattccattatgttagtttaaactttatattcatagagtcctatataccaagctctattctaagttattaatatatgttgattaatataatccttataacagacctgatagctaagtgatgttattattcctttgcagataaaatatggagacagagagaggtcaggtaacttgccaaagctcacacagctagaaaatagaagagttaggattgaaacccagaaagtttggttccagagtccatgctattaatcattatgatatattgcttttcctgagtttggttacttttaagtaagaatgaggcacatgtcaatttcttttacatacctgaatatttacttacatatagtaacctctcaaccactgaattcttaatatctcagccacatagctgggtagaccatgttcagatgtggcaagtgcatttttcttataggacctggagaaataagaaatgtaattttatcctaccattttcccttttgaggtggaagtgcagaatttgtaacacagaacagggatggacatgtgaggccacaatcaatgatactttgtaggtgatgttgtggcttcctgttgcgttatgtcaggaggcaaggttgtctcagtatggctgatactgaattttatcacttgcttagggtgatgactgtcgggactcgccattgtaaggatatcaaccatcaggattaattcaaagtctttgagctgatggccagctcattgctttgatcatggctgtgggtgtgggggtaaagaacaaataatagtaggggagataatatttttagtactttagttttcttttcttttgtgtcaaaaaatgtctttccacataaacagtgttataaatggttctcaggttggcctattaatacctgcttaaccagaaacgttgccaaaatagtgctcatgcattggcactatggttacagtcattcagattaaccatgagaaacagtattgcttactcttgtctagaaaactagctaccctttatggcattgtttcaaaggaagaatgtacccctgcttctttgcaaactttggttcatgacacattttaaattgcgatatgtctgcttatggtcacatggaatcatatgtctactagcttattttatcattcacaacatatactaattaaatatttctcttttttgtgaagcagtggcttttagttactaagaaggcatgaaggacttggtctttattttaccaagtgggtaggtgtgtctcaagtcagtacctctgtagttttattaccagtccatataagctatttcagaaaagaacagctgtctttttcagatggatttggcgtattctagccaaaatcaggttagttcttcttctttttttttttcttcaagcagcttctgtaaagagaaagtgtgctattgaattctaggtgtttctcatttcctccctagtatataactggcatccttagtgctgaatctttagttgaacatttccacttataggaaagactggacttgaaaaatgaaaacatgaggaatatttggaaatggtgagtaatctgatttgcctgtgattggtggtcagaaagagaagtagtagaatttgcaactgtaaaagtatatcaggaacagattgcagaaggccatgattgtcaggcttaggcattggaattttatttggttagctatgaagagttatgaaaggtttgtgagcgatgcagagacataatatgctcagtaattccgaatttttattatttaaaaaaatctgctctctcccaggaaatatgtggtttaggaaaaatgccatccttttaatgaagtaagtatctttcctctttgggatgttgtatgaactgcgtcagcaactccacatttgtgcctctcctgctttcccttaacataaacacaccaggatcctcaatgaaggatgctggcagtgacagcatgagtttgacagcttcattgaggatgctctagatggtcagtgatcttgactttctcccattgcctaaaagataatgtattgtaaaggtttttcattgcattttcaggagtttggggggaagttaatgaacaaccttcatttataaaacaattttgtatttattatcttatttacctatttatttcaaaagttttctaatgtaggttattgttatccccattttacatatatggaaatacaggcatacctcatttgactgtgcttcactttattgtgctttgtggatagcatgttttttacaaattgaatgtttgtggcaaccctgtgttgagtgagtctattggtgccatttttccaacagcatgtgctcactttatgtctctgtgccgcattttggtcattcttgcaaattttcaaagtcttgattattatatctgttatggtgatctgtgattggtgatctttgatgttattattttaattgttttggggcaccatgaattccactcatgtaagacagtggacttaatcggtaaatattgtgtttgctctgactgattattccactgaagggccattcccctgtctctctccctctccttaggccttccttctccctgagatacagtaatgttgaaaataggccaattagtagccctatatagcctctaagtgttaagtgaaataaaaatttacatggctctcactttaaatcaaaagctagaaatgattaagcttagtaaggaaggcatgacaaaagttgagatactctaaaagctaggcctcttgtggcaagcagttagccaagttgtcaatgcgaatgaaaggtttttgaaggaaattaaaaatgctactccagtgagcacataaatgataagaaagtgaaacagccttattgcaaatatggagaaagttttagtggatagaagatcaagccagacacaacattctcttcaagcaaagtctaattcaaagcaatgctataactcccttcagttctgtgaagactgggagagataaagaagctgcagaaaaagtttgaagctagtggaggttggttcatgaggtttaaggaaagaagccatctccataacataaaagtgcaaggtgagacacaagtgctgatggaggagctgcagcaagttctccagaagatctagctatgataattgataaaggtggctacatgaacaacagattttggtagaagaaacatccttctattggaagaagatgtctttcaggactttaatagctagagagaagaagtaaatgcctgactttgaagcttcaaagcagtggctgactcttttgtcaggggcaaatgcagctggtaactttaagctgaagcccattgttcatttactattgggaaaatcctaggacccttaagaattatgctaaatccactctctctatgctctgtaaatgaaataacaaagcttgaatgacagcacatctgtttatagcacggtttaccgaatattttaagcacacggttgcagtctacttcccaggaaaaagtactccttttgaaatattatttttcattgacaatgcacctggtcacccaagagctttgatggagatgtgcaagatgaatgttgttttcatccttacaatacaacatccattcttcagcccattgatcaagaagaaattttgactttcaagttttattatttaagagatacatttcataaggttatagcttccatagatagtgattcctctgatggatccaagaaaagcccattgaaaaccttctggaaaggattcacctttctggatatcagtaagagcattcatgattcagaggagcaggtcaaaatataaacattaacaggagtgtggaagaagttggttccaatcctcatgggtgactttgaggggttcgagacttcagtggaggaagtaactgcagatgtggtggaaatagcaagaaaactataattagaaataaagccctttcaaaaaaccagctcctggattcattaattttttgaagggttttttgtgtctctatttccttcagttctgctctgattttagttatttcttgccttctgctagctgttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcattttgttatgtacccagtagtcattcaggagcaggttgttcagtttccatgtaattgagcggttttgagtgagattcttaatcctgagttctagtttgattgcaccgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtcctcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctttgcacgtgagatgggtttcctgaatacagcacactcatgggtcttgactctttatccaatttgccagtctgtgtcttttaattggagcacttagtccatttacatttaaagttaatattgttatgtgtgaatttgatcctgtcattatgatgttagctggttattttgctcgttagttgatgcagtttcttcctagtctcgatggtgtttacattttggcatgattttgcagcggctggtaccggttgttcctctccatgtttagcgcttccttcaggagctcttttagagcccaaagttgtgactgaattgctgcaatctcgtgaaaaaacttgaagggatgagttgcttcttacagacgagcaatgagagtgatttcttgataaggaatctactcctagtaaagatgctgtgaatattgttgaaatgacaacaaaggatttagaatattacataaacttagttgataaagcagtgccagggtttaagaggattggctccaattttgaaagaagttctactgtgggtaaaatgcgaccaaacagcatcacatgctgaagataaatcttttgtgaaaagaagagtcaattgatgaggcaaacttcattgttgtcttattttaagaaattgccacagctgccccaacctttagcaaccactgccctgactggtcagcagccatccacactgaggcaaaaccttccaccagcaagaagattatgacttgttgaagcgtcagatgattcttagcatttttttagcaataaagtatttttaattaaggtatgtaaattgatttttagacataatgctattgaacacttaatagagtgctgtacagtataaacataacttttacatgcacgggaaaccaaaatatttgtgactcacttaattgtgatatttgctttattgcagtggcctggaaccaaactcacaatatcccagaggtatgcctgtaggtctcacagtcagttagtggcagagacagaactaaattctagtcatttgattctggtcctgtgaatttaccactgatccatctttagggctaggaaaatgactaaacttggcataaccttcagatagtgtattagtaacgtcattttcatttttcaatgatgaattattattattatcatattttatctaaccagtagtggcaaatatgaggtgcaatggacatgttttagtgttgctctcattaagttgataaacacatagcatcaagcaattcatttctctctttggtgttggtgtcttaggtgtctcatgtgtaaaatgaagggagagaattatacaatatctaagcttctccataattctgacatgccatgattccttttttccccaaactacctttgaattcaaactataggatcacgttgcagtttagttactgaataagaaagagttctacttaggtcgcagattaaatctgcttccccacacaataatttagtgcacattaggagaaaaaaaatcagtaataaagaataaaaccatagaacaatatattgaaaataatttgggggtgatatttagcattgatttttatttatttatttatttattttagacagggtcttgctctgttgcccatgcagtagcatgatctcagctcactgcaacctccgcttcccaggctcaagtaatcctccaacctcagcctccccagtaaatgggactacaggtgtgccaccatgcctagctaatttttgtgtttttgtagaggcaggatttcgccatattgtccagactggtcacaaactagcattgctttttgacttaaaagttttcaactttttgatgaagaatgatgctaagatatcaacagtcaccaggaggaaatggaaatgcattctcatggaagctagtatttcagtaagaaagcaagcacagtgtattggccttctattcaggattttaaagaattgtttaatttttcatttttgtgggtacatcataggtatatatatttatggggtgcgtgagatgttttgatacaggcatgcaatatgaaataatcacatcatggagaatgtggtatccatcccctcaaacatttatcctttgtgttaaaaacaatccaattagttattttaaaatgtacaattaaattattactactgatgtcaccctttgtgctatcaaatactaggtttcattctttttattattttatacacattaaccatccccactttccctcaaccactccactatccttcccaacctctagtaacaatgcttctactctctatctccatgagttcaattgttttaatttttagctcccacaaataaatgacagcatgcaatttttgtctttttgtgcctggcttatttcacttagcataatgatctccagtttcatccatgttttgcaaatgacaggatctcattatttttatgactgaatagtactccagtgtgtacgtgtatcatattttctttatccaatcatctactatggatatttaggttgcttccaaatcttaccgattgtgaacagtcctgtgacaaacatgggtgtgcggatatctctttgatatactgatttcctttctttggggtatatacccagcagtgggattgctggatcatatggtagctctatttttaatattttgaggaaccaccaaactcttctccatagtggttgtactaatttacattcccaccaacagtgtacgagggttccctttcctctacattctcatcagcatttgttatttcctgtcttttggatgtaagccatttcatctggggtgagatgatatgttattgtagttgtgatttgcatttctctgatgatcagtgatattaagcaccttttcatatgcctgtttgtcatttgtatgtcttcttttgagaaatgtctattcaaatattctgcccatttttaattggattattatactttttcctacagagttgtttgagctctttatctattctggttattaattctttgtcagatggatagtttgcaaatattttctcccattctgtaggttgtcccttcactttgttgattgcttcctttgctgtgaagaagctttgtaatttgatgtgatcccatttgtccatttttgctttggttgcctgtgcttgtagggtattgctcaagaaatttttgcccagactgatgtcctggagatgttccccaaagttttcttgtagtagtcttatagtgtgaagtcttggatttcagtcttttaatccattttgatgtgatttttgtatattgcaagagataggggtctagtttcagtcttctgcatatggatatccagttttcccagcaccgtttattgaaaagactgtctttttttccagtgtatgttcttgatattcagcaaatagttttccctttccccataggatgagggtagaagtagactatgtacaatttaaggatctgtctaaccctgtttttctgtgaacttaaatttctctgggctagaagtgaggtaagttctcagtaacatttcccttctttattttgatgcctgtttaatcatgcaacacaatttgatgaaccaactgtatgccgggaaatgttctcagtgacattctgtccagaatttctacttgtgtctctttactgctgggttggggccaggatatatgcctggcaaagctcataccaatgctagagtaagagttcgagtattaaccacactgtctgcctcctacacaagcaatcattgtgacaaatatgtagtgattgctattttggataagatataggtctatgtaattggcccagtctattaattgaaatcttgaattacgatatctagtcatgtattttttttcctattaagaactattattttttttcttttccttgcattgcctcaggctgtctcctaagcatgccccagatattcctgatgacagcactgacaacatcactatcttcaccagaatcttggatcgtcttctggacggctatgacaaccggctgcgacctgggcttggaggtcagtccttttaagatctttgaagtccttttcagatcttcttcttggccattgttatctaaaaacagttataaggtgccttcagtagtctattggccaatgagattagtgtaaagctgaatttcttccctatgagcactaaaaattagtcataatccttcatttcagtaggtgatttctctggtctggcttcagaagattctaggtttttgctaggtgcatatggagtaatacacagatgttccatgactcacaatggtttgacgtatgatttttgtctttatgatgggtttatgggacatagcccaatggatttagacttactatatttccaacttatgatgggtttattgggatggggtcttgtaagttgaggagcatctctccctcaaggttagacaatgcccatttctagtaacagaataccaatacctgcctgggtgactggtgtggtccaggaaaagctgagaaacatgcctttgttttcaaaaccctgagcatatatcagcctgacactccaaaaaggaataatctactggctatgtgagatcttagttggccatcagtttagtataatcagcaatatgatcacaataaggtaaatatattataatatatcacgggttattataaattcacaaaatgtaatctaatgctcttttgtaatctgtagtccatattcaaatttttccaattatccccaaaatgtactttatagaaattttcattgatttaggattcaatctaggattatgcattacatttattgttgtgtctgtttagcctacactcagcatttctttgtctttcatgacattgattaaatcttccatatttattttcaaagtaacaccataggagttaattatgtctttatcagcacattgctcaagaagggacttgaagtctgtttgctccattactggtaatgttaatgtagatgtttaccaggttgctgcactctaaaattactattttaaaagtttataattaatacgtaatttgtggagagatgttctgacactattttatgccttttccagcttacacccaatagtcttaacaactatagattatccctgtgagactaataacaattatggtggcaaaatggtgattttctaaagcgattattattctacacttactaaatgacattctattgtaagaaaaaatctctttctctttaattaattagctaatgtcagtatgaatggatttttgctttattcggtggattacagtccattaatatcattcatttcaatagactattttgattaaaatttttgctaataatttcccatattccctaagtggaagcctattccatttggcttctgtttccttttgatatgctctcattttttgagtactttcttattatatggcatgacagtatattccagacttattttgtactttcataatccagccttggaattagtcatttttccaagaataagtggtaccttttttgggaaattacatttagaatcaaatttctggctgctaggtgtcctcattactgctaggatctcattgcttccaggatttttcagtagatagaactgggaaaatagcaaatgcacacacactcacacatatacacacacagatgtattgtatatatgtatatgtatgtgtgtgtgcatgtatggcaataagtttacactgatactactaattgcagtccaacaagtacttttaattgatacatgtacccatttgtttaatcctacaatatacaaaaatattttgaaattactacacccatagtactacaataaacacattaagtaaagttaaatatatatttgcagttttttcattgtgttttgattttggactaaggctatgtaacgcctgcttttatataaataatggattagagtagagcggtattgaaggaggagagaccagtcacaaattaattgcaattttctaggatgaaaataatgactgtgtgaatggagagaatttggtgactgcttagattatggggttagaaaaagaggaggagaaagggataacttctaggttcctggcttgtatcactgggtggtgctattttctaaaatagggaagactggagggagaatggtgcaattgcgttttgttttttttttttttggatttgaggttggaacaattaatatggaaagaagagaaagaaaataaggaccagatttactctcccatcttaaacaaccacaaagaaatgaacaaatatatagtgttttatagaaatcaaacaaaggcagcacaggatattgattcctgaaagaaagaaaacaaacaaggtgagctctgtgattgctgatccttaactgcctggagcaaatttttaggctacagtgcagggaggggagcccagatagcgtctggtggactgtttcagttgagaagaagttgagaaattggggaggccaaggttattaattcataaggcagaggagaagatagagctgcatggagactaaaaagttgtggagagaaagacagagagagagaaagcagaaatctgtagagggtgcttcacaagttttcaagtatgtactccttacctcacaactcaaggatgtactccttacctcacagctcaaggatgaggaaaagaccactggaaacagtgggtaaaacatcagggtttggaataacttgtgttttcaccaaccagagtttccatcactctacttggtggaaacacttttaacacctggtacatggggtagggtacttagaatatggcctcagtggcatggcaaaattatcccaagactaaaggctgctctagtcccacatgacaaaggttaaaatcaagcttcaaagaatttaactatttctaagtaacacattatctcggaacaaaaatcaaaaatatttatagcagtaaaaaaatctgatatctgacaaagtggaattcacgatgattccagtcaaaagtttccagtcaaaaaatttgagaaaattttctggaaaaaagtttccagtcaaaaattaccaagcatgcaaggaaacaagaaactacaacccaaaaaggacagaaacgctaataagcctaaggatatagcaataataattagcaaaaacaagacatggagagaaagaaagactgaaaaatgaaatggaaatcagtgcactgtggtacagcttcatgtagtctaatgtaactgtaatgggattatctgaagggggcagaaaatatacttgaagaaaaactggtcaaaagattctgactttttgggcaaatgacattaatagacatttctcaaaagaatatatataaatggttaagaaacatgtgaaaaactgctcaacatcactaatcatcagggaaatgcaaattaaaaccacagtgagatactacattcctcctgcaagaatggccattattaaaaagtcaatagggccgggcgtggtggctcacgcctataatcccaaaactttgagaggctgaggtgggcggatcacgaggtcaggagttcgagaccagcctggctaatatgatgaagccccgtctctactaaaaatacaaaaattagccaggcgtggtgaggtgtgcctgtagtcccagctacttgggaggctgaggcaggagaattgcttgaatccgggagacggaggttgcagtgacctgagatcacgccactgcattccagcctgggcaacagagtgagactccatctaaaataaaatagaataaaataaaataaagtaaaataaaacaaaataaagtcaggctgggcatggtggctcatgcctgtaatcccagcacttttggaggccgaggcaggtagatcacaaggtcaagagatcgagaccatcctggataacattgtgaaaccccgtctctacgaaaaatacaaaaaaattagcggggggtagtggtgtgtgcctgtagtcccagctagttgggaggctgaggcaggagaatggcttgaatccgggaggcagagatggtagtgagccaagatcacgccactgcactccagcctggcaacagagcaagactcaaaaaaaaaaaaaaaaaaagtcaatagatgttgttatggatatggtgaaagggaaacgtttatacactgctagtgggcatataaattagtacaacctctatggaaaacagtatggagattccttaaagaactaaaagtatagctaccatttgatccagtaatcccactacttggtatctagtaaaaggaaaagaagtcattgtataaaaaagacacatgcacatatatgtttgttgcagcccaattcacaattgcaaagatacggaaccaacctaagtgcccatcaaccaatgagtggaaaaagaaaatgtgatacatacacattgtggaaaactacttggccataaaaaggagtggaataatgtccttgcagtaacttgggtggacggagctggaggccattatactaagtgaaataactaagaaatggaaaaccaaatactatatgttctcacttataagtgagaactaagctatgattacacaaaggcagacagagtgataaaatggactttggagactcagaagtgggagattgagagggagatatgggataaaaaagtacatattgggtacaacgtacactactcaagtgatgggtgcactaaaatctcagaattcaccactgtataattcatccatgtaaccaaaaacacttgtacccaaagggtattgaaataaaaaaattaaacaattctaactttgattaaaattgcaatctccccaaccaagaaagtcaacaactccaaggacaagaagcatgaagaaaattacaccaagagaaaggaaaaaattgcttagaaccaatgataaaaagaaaatctgaaaagcaaatagagtaaaagaagacattatgtgcagatgaaaaactttagaaggatactagactttttgtcacaaggtagtggagcaacagctttaaagtactgagagaagaacaaaagccatcctaggattctttaaccagagaaaataaatttccccccaaaaggcaaaataaacacttttttcaaacacataaacacttaaaaagattcatcaccagcagatctgtactggaagaaatgtgtcagcacaaggaaaatgatgccagatagaaatctggatctatacaaagaagggaagggcagtggaaatggaaactgtgggtaaatgtaaaatagttcctcatttaaaaattctcaccaaatgataagtaaatacttaaagcaaaaataataaccatgtattgtgtagcttgtaatatatgtacaaggaaaatgtatgtcaatgaaatcacaaagaagtggaaatatgccattgaacagttttgtattacacagaaagtgagataatattacctgtaggtaaactgtgataaggatgtgcactatagaacttgaaaatttagctaataaagcaacgaaggatgtaaaaatgtaataagaaaaatattcaatccataggaaggcagaaaaagaggaaaagctaacaaagaatagaagaaacaaacagaaaacaaatagcaaggttgtagatttaaacttaactacacagataatctcattaaatataaatcatctaaacacccatatttaaaggcagaggtggtcagattggatttaaaaagagcaaatttctccctgagagaaatgcactttaaatataaaaccacaagtgggttaaagataaaatgataggaaaagatgcatcatactaacacaaattaaaagaaggttggagtagttattttaatatcagaaaaagtagacatgagagcaaagaatattactaggagtacagaccgagaagtgaaacgagaaagagatggtctataatatagttagagatttcaacaacgcccgaattagataatggaacaagtagacagaaaataagtaaagaaagcagaaacttgacccatgctaacaaccaacttcacctaactgacatttatagaacattccaatcaacaacagcaaaatacacattctcttcaagtgtactgcaacatttatgaaaatagaccatattctgcattataacatttaaaaaaattacaacataggctgggggcagtggctcacgtctgtgatcccagcactttgggaggccaaggtgggcagatcatctgaggtcaggagtttgagaccagcctggccaacatggtgaaaccccgtctctactaaacatacaaaaattatccaggcgtggtggcgtgtcccagctacttgggaggctgaggcaggagaattacttgaacctgggaggtggaggttgcaatgagccgagatcacaccaccgcactccagcctgggcgacagagcaagactccgtcttaaaaaaaaaaaaaaattacaacataatagggtgttctttcccgactttatgtttttgtttgttttgttgaagattgattggctgtatttgagtttatttattaatattgttaaaatgacaatactacccaaagcaatttacagactcaatgtaatctctaccgatataccaaagacgttcttcatagaaataggaaaaaaaaaatccttaaatgtacataggatgacaagagaccccaaatagccaaagcaatttgaaaataaataacaaaactggaggtaacccactcctgatttcaaaatcaactgtgaaactgtagtaatcaaaacagcatcatactggcaaaaaactgacacataaaccagtggaacagaatagaaaacccacatataaatccacatgtttacagccaatttatcttggacgaaagatccaagaacatacaatgataaaaggacagtcgcttcaacaaataatgctgggaaaactggataattatatgcagaagaatgaaactcaacccctatctctcatcatacacaataatcaaatcaaaatgaattaaatactaaaatctaaaacctgaactataaaactgttggaagaaaatattggggaaatgctccaggaagttggtctgggcaaatactatttttgtaagacctcgaaagcacagatgacaaaagcaaaaataaacaaatgggattctatctagctaaaaggcttctgtgctgcaaaggaaacaaccaataaagtgaagagacacccacaaaatgggagaaaatatttgcaagctacctatctgacaagagattaacaactagaatatataaggatctcaaaaaactcagtagcaaaaaataaataatccaatttaaaaatagacaaaagatctgaacagacatttctcagaagaagacatacaaatggccaagaggtacatgaaaaaatgctcaaaatcattaacgatcagggaagtgcacatcgaaactacagttatatatcatctcaactcagttaaaatggctgttacccaaaagttggacaataacagatgctggtgacaatacagtaaaaggagagcccttgggcactgttgagtggaatgtaaatcagtatgggcactatgcagaacagggtggcgattattcagaaaactaaaaacagagctaccatatgatccagcaattgcactattgggtatatatctaaaataaatcaatatatccaacagatagctgtactcccatgtttattacagcactatttacaatagccaaaatatggaatcgacctaagtgcccattaacagatgaatggataaagaaaatgtggtatatgtacatcatggaatattattcagccacggaaaattacaaaatctcttttttctgtttttatttgttgtttgttttttaattttttgtaaggcagggtcttgctctgttgcccgagctggagtgcagtagcatgatcatggctccctgcagccttgatttcctgggctcacgggatcttccttccttagcctcctgaatagctgggactacaggctaatttattttttatatttattttttgtagagacagggtctcactatgttgcccaggctggtcttgaactcctgggctcaaacaatcctcccaccttagcctcccaaagtgctgggattacagttgtgagtcaccatgcccaaccaaaataatgaattcctgtcatttgcagcaacatgggtggaactggaggtctttgttaagttaaacaagccaagcacagaaagacaaatatcacatgttctcactcatgtgtggaccttaaaatagtggatcccatggagttagagagtagattggtggttactagaggctgggaagggtgggaggaagggagagatgaagagaagttgattaggtataaatatacaattagatagtaaaaataagacctagtgttagtacaatcaatagggtgactttagtttacaatgatgtatttctatttcaagacagctaggagtgaaaaatttgaatggttctagcacaaagaaaagacgcatatctaaggtgatggatatcctaagtacactgatttaatctttacaaactatatgaatatattaaattatcacatgtatcccaaagccgtgtacatctgttaagcaccagtaaatttttataaaaaaatattttatcttgattctgagcgttatctttgggggaatccacatgaccaaacactctgcaaccataacctgcagtttctctctccttgtatctttttaatggatggattaatcaaatctgaatccatctagaaggggaattagaagacatctatgactctgacttgtctcttgtagccaatggatttcctcttgaagctgtttaaaatagaattgggggaccacttgagacccctttgagacatgttattctgtgactcctaaaatcattttctgcataatatttaaaactcttcctgaaaccagcttctggaaattataatgcagagccttctgaagactccaaattacgaaactggggtctttctaggaggccagcaaagtgcttttctctttattaattagctgttcctgaaaggttcagttctactcatcttgttttctggtctcactgaattttgaatgaactaagaaacttcaccaaacttacataaaggcagcaagtatttctagatgtgtatgttgtcttaggaaaacattgctcattgacaaattatacatttaaacttatgggatgggtgggatgattgtcaagcaaggtatggaaacccatggttggtaatgaagatgtttgtctggctgccaaaaggattttatttttgtgacattagaacaagaaacaggtttaaattgtacacgatccaagctacatattcattaggagtgatacggagaagtggagccattgtgagctgaagcaggaacagtttcttagcattaacttggtcattggctgtgttaaaatcactctcctggagccattgttataactaagttttgactataagtgtcattggcaggagcaaaaaatgaagggggggagatattgaatataaagaataaaggcctgtggtggggtgggatagaaaaaatcttttaacataggtctcagtaactgcccttttggggaccaatatttgttcctttccttggacctctgtgctaaataaattaagaaaatatacttcaaaaaactttgaaattggcaggatgctggcttacccctgtaatcccaacactttgggaggttaaggcaggaggatcgcttgaggctaggagtttaagagcaacctgggtattatagtgagaccctgtctctacaaaacaataaaaagattagctgggcatggtagcatgcaactgtagtcccagctcctcgagaggctgaggtagcaggatcgcttgagctcaagaattagaggcagtgagccataactgtgccactgtacttcagcctgggtaaacagaaagagactcagtctctgaaaaaaaagaatctttgaagtttcaggtggtgggtatagtaaaagcccagacatcaccactatgcaatatatccaggtaacacaactgcacttgtacacttaaatctataaaaataaaatttaaaaaattctttgaaggttttaatagttgcagaggtgaaagatttgtttggtatttgttctgactgcagaagggctccttctagctttctttttcccagtttctctccagcaaactagctggtctgcagtttggcctgtacatccaatgtatctttcagttttctcctaattgcctttcactacagtctcccttgtttttgagagcacccctaggcttgaacttctccatactttgttgcaaatgaagtcagttcctttggggaacgatctgatgctctctcttctatggtctgcttctctcttgggcaaaatctctaagctatggttctagttcttggggtgagaacaaggcacacttttctctgaggaacgaccctatgttagttgctgagtgcttggtagaggggtgatggcagtggccccaggtctcctcagcttgcatttttgagcatggaccactgctccattagccagatcaagagaacttgaggccacagtactctcagcagtgctattcccaagttagagtctccgtgccgtaagtgagggctgggagcaagaaaggaagaaactctcagccaaagttgcttagaatttagctcagcaacaggtagcttattcctggatgagaaatgctgacgtcgtgccttacccaggaagatagctcttcagctgggagatgggggaagagagagccctgtgttcttggttgcacacatctagaatagagtttctgtttcactgagctggcaggtgggtgggaatggttctcggtttaaatattctaacctcttgctttcttactcagttttagtagattttcttgaatacattttttcttgaataatttttttttgattttatgtatgcccataggagcattttcagaaactttatttcgttgtttcaaaaataaattttagaccaggcatagtggctcacacctgtaatccaagcacttagggaggcaaaggcatgaagatagcttgagcccagaaatttgagaacaggctgggcaacgtagccagaccccattcttcacagaaaggaaaaataatgataataaatttccatttcactgaggagcaggtctgcagagttcttcatgttttcatatcagaagtgaaacttctagtagctttttttgtagattcattagataatatgcttaaatgattatgtcctataggaagaaagaccattttaattcttcctgtgcaatatggatgctcttttttctttctttattgcactgagtagacttcacatataatgttgaatagacatggtgaaagcagacaccattgtcttgttcctgatcttagggagaaagggttcagtctttcaacattaaatatgatgataggtgtaggtttttcctagatgaaatttatcaattttgggaagttttcttctactcctagtttgctaaaagtttttaacaggaacgtcagaatttttcaattgttctttctctgtctattaggctagttatataatttttctttttagtgtgttgacacagtaaataacaatgattgatttacatatgtttaggccaaacttcattctcatgataaatgtcacttctatcttaattactatatatttatgataggtttgatatctggtaatataagtcatccagccttgttattttcaagattatcttgactattcatggcctttcaaatttctagataaattttataatccgcttatcattttctgagaaaaaaatctactcaggttggcttcatattgaatatataagtaaacttgtggagttttaaaaaatctttataatactgaatgttctaattcataaattagtatattcctcttaattttattctgtaattcctctgaataatgttttggccttttcactttcgaggtcttacatatttttgcttgatctatgccttgagatatgatttttcatgccattttgagaatttgttcttcaatataggaggattagggcaaaagaaggataaaataacatttgttatagctatgtagagatatgattggttttacacattgcccttgtatctggaagcctttttctactgacttactaattccaacatttgtctacaatttcttttagattttctgcatacaaattcatatcatcttcaattagagtagaacagaagaggtaatagcagctatccttgttttgtttcttatttcagtggaaagcttttgatatttcaccattaataatggaatttgttgtaggtttactttgtaaatttttttatatgattaaggaagttcttttctccgtgtttcataagcactgcaaggctacaggatattttgttctccttttctgaaattttggcctgcctcttcagcgtcttgtgcaacctcagaattcagcaaatgttctgtgagaaaagctgccatgtatataaaatttttcaattttattataccagtctcatgtatccactaaaagctttggtgctttctaccaggatcacacccagatctttcgcctctaagcaatgccaaggatcacaaaattgccccgggaagaaaaacaatggccaattctcagctcacagttcttatccaaatgattttactacatgtagtaatctacacaaacttggcttgtgcaaagggagttgtgatgggtggataatgtataccattaggaagaaattttcagtaagtagcatgattaaagctgctgaatttgaattcccaagcctccaaagagaatttttgaccataaaattttaaaatgagaagcaagatgatgcttgtgggttaaagcaaaaacactagggcctgggtcctgctcattataaggcagcttttgtctacacaggcctctgcgttggcatggatctttgccccttcaaacagggtttgcaccagagaacagggcttttacaggcaggcagaccaagaggtcagtccgttctctgccggttgttccagctgtctaatcatggagcactttcttgttctccccaagtctgttttctcatctgtaaaaaaaagggtcgagataccttgccaagttgttctgaggattaagaaaataaattatgtaaataacctatcaaatagatgctcagtaagtgggagtttgttttcttccctttcttccacctaagtactgggaaagaaagtgcttgagaaagtgcttgctgtaactgaaataatgaacacaaggtggacagaaagggcataacctctcccaattagcaatcttagcatagctttttttgagaaatagttttcactctccaccagaaaaaggaacccagggaatgaattagtggttgtaggcattctgtcttctatgcattatgaagagagaagccatattaataagataactgaaaagtcacgttagtaagatatttgacagaacaatgtttatagtattggataagaaacagcacacagaattgttttcaaattgaaaagtagatgtgatcttgtgtttaagaaagactcctttgacattcaggagataactacagcattttgatgggctgttttgatttctagctaaaaggaagttaaataggaaatgaatcatcaagttaatgggcatagtggtgaattaaagaagatgtgtggtagtgtaacacaccaactcaaaacttggctgatggggcacttaactcttcagagaaaactttaatgactaaatgtagatttatttaacattaattaggtatatattaaaacctaaagataagtttattcttgaggcaattccagattattattgatcatagtacatcaggggtttggtagtcattggagtgatgggaacagtcttggactgagaggagactttagttatatagctctaccagcatgagttgtcaactttggttaaatctcttcctgtccctttacttgttgacctgtaaataagtttagatttcacctccttcattcttcagtttgattattctaaaatggtaaatttattgttttactgctatacttgggcccctactgtgcaatagctggctggtatgaaattaagtgtggtatttgatatttactttaccaaggagtgcattctgtgtgtccctgggcaaacaccttcatggaatttcaactcattactgaattactctgcatcgcagaacacttccagttgaagtgcctgtaaaatcataagatgtccatgagctggttagtgaggtacagaatgttaactcatgaagaaacttccaaattttttcccaaccagcctctctttgaggacgataatcccttttgtagcactgctgatacttagctatctagcttctgcttgattacctctaattcgtgagttagtgctcccactttaaaccttcctaagaagttctgtagatggtccctttgaattcatggtgccagttttaattatgggagagttggcttttttttttttttccttccaaagtctgtttttatgtgatgagcctctggaaatttgaggggaattctatctttagtgtcttcaagtgtccttcatgttttctggtttcagggtgtttcacagtcctgatcactgtcttctcagtcaacattcctcaaactgtgttccactgaatgttaacatcctgtgagaaatcaacaagtgacccagtgttttgaaaaatgaaattgttttgtcaaatgtttaggtagcttaacaaaggcaaatgggtttttaatgcaagactacaaagattcctttttatgttaatattaattatgaatacataggaaacagttttctttttttattatacttttaagttctagggtacatgtggacaatgggcaggtttgttacatatgtatacatgtgccatgttggtgtgctgcacctattaactcgtcatttacattaggtatatctcctaatgctacccctcccccctccctgcaccccacgacaggtcccggtgtgtgatgttctccacgctgtgtccaagtgttctcattgttcaattcccacctatgagtgagaacatgcggtgtttggttttctgtccttgcgatagtttgctcagaatgagggtttccagtttcatccatgtcccaaaaaagaacatgaacgcatcgttttttatggctgcatactattgcatggtgtatatgtgccacattttcttaatccagtctatcattgatggacatttggcttggttacaagtctttgctattgtgaatagtgccacaataaacatatgtatgcatgtgtctttatagcagcatgatttataatcctttgggtatatacccagtaatgggatggctgggtcaaatggtatttctagttctagatccttgaggaattgccacactgtcttccacaatagttgaactagtttacagtcccaccagcagtgtaaaagtgttcctatttctccacatcctttccaacacctgttgtttcctgactttttaatgatccccattctaacaggtgtgagatggtatctcattgtggttttgatttgcatttctctgatggccagtgatgatgagcattttttcatgtgtctgttggttgtattaatgtattcttttgagaagtgtatgttcatatcctttgcccactttttgatgaggttgtttgatttttttcttgtaaatttgtttaagttccttgtagattctggatatcagccttttgtcagatgggtagattgtaaaaattttctcccattctgtaggttgcctgttcactctgatggtagttacttttgctgtgcagaagctcgttagtttaattagatcccatttttcgattttggcttttgttgccattgcttttggtgttttagtcatcaagtccttgcccatgcctgtgtcctgaatggtttcacctaggttttcttctagggtttttatggttctaggtctaacatttaagtctttaatccatcctgaattaatttttgtgtaaggtgtaagaaagggatccagtttcagctttctacttattgctagccagttttcccagcaccatttattaaatagggaatcctttccccatttcttgtttttgtcaggtttatcaaagatcagatggttgaagatgtgtggtattatttctgagggctgtgttctgatccgttggtctatatctctgttttgataccagtaccatgctgttttggttactgtagctttgtagtataatttgaagtcgggtagcatgatgcctccagctttgttcttttggcttaggattgtcttggctatgtgggctcttttttggttccatatgaactttaaagtagttttttccaattctgtgaagaaagccattggtagcttgatggggatggcattgaatctataaattaccttgggcagtatggccattttcacgatactgattcttcctatccatgagcatggaatgttcctccatttgtttgtgtcctcttttatttcgttgagcagtggtttgtagttctccttgaagaggtccttcatgtcccttgtaagttggattcctagatatttcattctctttgaagcaattgtgaatgggagttcactcatgatgtggctctctgtccgttattggtgtataggaatgcctgtgattgttgcacattgattttgtatccagagactttgctgaagttgcttatcagcttaaggagattttgggctgagacgatggggttttctaaatatacaatcatgtcatctgcaaatggggacaatttgacttcctcgtttcctaattgaataccctttatttctttctcttgcctgattgccctggccagaacttccaacactatgttgaataggagtggtgagagagggcatccctgtcttgtgccagttttcaaagggaatgcttccagtttttgcccattcagtatgatattggctgtgggtttgtcataaatagctcttattattttgagatacattccatcaatacctagtttattgggagtttttagcatgaagggctgttgaatattgtcaaaggcgttttctgcatctattgaaataattgtgtggtttttgtctttggttctgtttatatgctgatttacgtttattgatttgtgtatgttgaaccagcctggaatccctgggatgaagctaacttgatcgtggtggataatctttttgatgtgctgctggattcggtttgccagtattttattgaggatttttgcatcgatgttcatcagggataatggtctaaaattctccttttttgttgtgtctctgccaggctttggtatgaggaagatgctagccccataaaatgagttagagaggattcccccttcttctattgattggaatagtttcagaaggaatggtaccagctcctcattgtacctctgctagaatttggctgtaaatccgtctggtcctggactttttttcgttggtaggctattaattattgcctcaatttcagagcctgttattggtctattcagggattcaacttcttcctggtttagtcttgggagggtgtatgtgtccaggaatttatccatttcttctagattttctagtttatttgtgtaggtgtttatagtattctctgatggtagtttttatttctgtgggatcagtggtgatatcccctttatcattttttatcgtgtttatttgattcttctctcatttcttcttttttagtcttgctagcagtctatcaattttgttgatctttcaaaaaacctgctcctggattctttgattttttgaagtgttttttgtgtctctatctcctccagttctgctctgatcttagttatttcttgccttctgctagcttttgaatgtgtttgcccttacttctctagttcttttaattgtgatgttagggtgtcaattttagatctttcctgctttctcttgtgggcatttagtgctataaatgtccctctacacactgctttaaatgtgtcccagagattctggtatgttgtgtctttgttctcattggtttccaagaacatctttctttctgccttcatttcgttatgtacccagtagtcattcaggagcaggttgttcagtttccatgtagttgagcggttttgagtgagtttcttaatcctgagttctagtttgattgcactgtggtctgagagatagtttgttgtaatttctgttcttttacatttgctaaggagtgcttttcttccaactatgtggtcaattttggaataagtgtgatgtggtgctgagaagaatgtatattctgttgatttggggtggagagttctgtagatgtctattaggtccgcttggtgcagagctgagttcaattcctggatatccttgttaactttctgtctcgttgatctgtctaatgttgacagtggggtgttaaagtctcccattattattgtgtgggagtctcagtctcttttaggtctctaagggcttgctttgtgaatctgggtgctcctgtattgggtgcatatatatttaggatagttagctcttcttgttgaattggtccctctatcattatgtaatggccttctttgtctcttgatctttgttggtttaaagtctgttttatcagagactaggattgcaacccctgctttttttttttttccatttgcttggtaggtctttctccatccctttattttgagcctgtatgtgtctctgcacgtgaaatgggtctcctgaatacagcacactgatgggtctagattctttatccaatttgccagtctgtgtctttcaattggagcatttagcccatttacatttaaggataatattgttatgtgtgaatataatcctgtcattatgatgttagctgtttattttccccgttagttgatgcagtttttcttagcatcgatggtctttacaatttggcatgtttttgcagtggttggtaccagttgttcctttccatgtttagtgcttccttcaggagctcttttagggcaggcctggtggtgacaaaatctctcagcatttgcttgtctgtaaaggattttatttctccttcagctataaagcttagtttggctggatatgaaattctgggttgaaaattcttttctttaagaatgttgaatatcggcccccactctcttctggctcgtagagtttttgctgagagatccactggtagtctgatgggcttccctttgtgggtaacccgacctttctttctggctgcccttaacattttttccttcatttcaacattggtgaatctgtcaattatgtgtcttggggttgctcttctcaaggagtatctttgtgacgttctctgtatttcccgaatttgaatgttggcctgccttgctaggttggagaagttctcctggataatatcctgaagagtgttttccaacttggttccattctccccatcactttcaggtacaccaatcagatgtagatttggtcttttcacgtagtcccatatttcttggaggctttgttcatttctttttactcttttttctctaaacttctcttctcactccatttcattcacttgatcttcaatcactgataccctttcttccacttgatcaaatcggctactgaagcttgtgcatgtgtcacgtagtcctagtgccatggttttcagctccgtcaggtcattaaaggtcttctctacactgtttattctagttagccattcgcctaatcttttttcaaggtttttagcttgtttgtgatgggttcgaacatcctcctttagctcggagaggttggttattactgatctgctgaagccttcttctctcaactcgtcaaagtcattctctgtccagctttgttccgttgctggtgaggagctgcgttcctttggaggagaagaggcgctctgatttttagaattttcagcttttctgctctggtttctccccatctttgtggttttatctaccgttggtctttgatgatggtgacgtacagatgggattttggtgtggatgtcctttctgtttgttagttttccttctaaccgttaggaccctcagctgcaggtctgttggagtttgctagaggtccactccagaccctctttgcctgggtatcaccagcagaggctgcagaacagcaaatattgcagaacagcagatgttgctgcctgatacttcctctggaagctttgtctcagaggggcacctggctgtatgaggtgtcagtcggcccctactgggaggtgtctcccagttagtctactcgggggtcagggacccacttgaggaggcagtctgtccgttctcagatctcaaactccatgctgggagaaccactactctcttcaaagctcagttagaaatgcagaaatcattcgtcttctgcattgctcacgctgggagctgtagactggagctgttcctattcggccatcttagaacctccaggaaacagttttcatatgtagtcttttttgaccttgggcctttttctcccctccacaaaacacctaatcacttctcacttgggatacaagtcatccatagatcagcttgaaaaatgctgctctgtaatctaccaggtttattaatatccagcctaaggtgtgttatctagtaaagaacacaatactctggatgctttcaagctatctcacagaacaacaggactatcacctctcccattttacacatcacacttccattaatgtaacctaaaaataaaattggcctatttggtgatggcattgcccacttggcttaccttaatgctttttgatcaattaaaatctagtagattattttttttacaaccattgaccagccaatctcctcaatcctatgtatcctagtatttatttttggagacaaatgcaagaatttctatttatccgtattaaatttcaccttatatattatactctaataactccaagccacataaagctttctatttcttttattcaatgtattgactataatttttatctgtatcattgaatcatgtcttctatgtctttatttttagtataattatttaaggacaaagcctgatattagccattagagactatatcagtgttttatattgacctactaaacaaaatctttggatatattttaaccagttaagaagccatataaatattctctaatctatttaatttttccatgtagcataatggacacatgatatagtctgtcagtgccttgatgaaattcagatacacaatgtcaacagcttctctctttgatgtgaaatgtgtggcaattttgttttccataaaagttaggcttggcataatttgtttttagtgaatccatggtagctcctgctaataattatctgtttttccaaagcttacgtatttttgtttaccagtctgacccagaattttactgctgattgatattgatattagccttaataaagaaagtattctatataactaattaagcctatcttcccaagctattgataatgacacagcacagttaaagtaagaacattctttttggcattgggataattttccagcctctctgttgtctgattccaccaacaaataaatgagcttcatgacttccatcactgccacagggatgttgatggattaaatcattaattaattcatttattaagttcctttaataaggcagatactctgctaagtgctctggggatgtaaggttggataagacatagtgtttttcttaaaatcatataaattagaaatagtagctcaatgagacaaagggctagtttccaaagctaagctgtttgaattatgttaagggaaacaaacgtatccttggtctcttaagagtttctttgttctattttctctaaatacagattttatgcccaggtagactctgtgttttaggttcctcaaaaaagaccagtgtaaatgtaaacagtattaagcacacaagcatgattagagaaaaggttggtgttaatatttttttaacagaaagcaattacagtttaatcctctcattacaaaagttgcttcaaagaatgtgaagaaaagaatatatctgataatatattactcatttataagctgctactagtgcagaaggaattctttctttaattggaagaaaaaacaaagagattcccaggatccttgttacccttcatgaatgctggcagggcactttcacatccatttagtccttacttttatgtaatattctgttctcaaaacattgctgggaaagtgagaaggttatagatggtaaaactcagggtcatagcagagaggaaactttcccgttcaaggaatagaacattggcctcttgaattccagtccagggtgtttactgatcccccgctgctacttgtactagaactgacattcaaaatgaagtaaaaaataaaagtaagacagattaaacaaacaaaaaaacatgctcagaatggctatgagtgcaacactgaatgatatcccactccaaagaattcggtagtggttgatggagacaaagccattaagatgactttaattaagagttgactttgaggctgggtgcattggctcacgcctataatcccagcactttgagaggctgaggcaggcagatcacgagatcaagagatcaagaccgtcctgaccaacatggtgaaaccccgtctctactaaaaatacaaaaattagctgggcatggtggtgcgcgcctgtagtcccagctactcaggaggctgaggcaggagaatcgcttgaacctgggaggcggaggttgcagtgagccgagattgcgccactgcactccagcctggtgacagagcaagactttgtctcaaaaaaaaaaaaaaaaaaaaaaaaaaagagtagactttggcctggtgcagtggctcacacctgtaatcccagcactttgggtggccagagtgggtggatcacctgaggtcaggagttcgagaccaacctgaccaacatggtgaaaccccatttttactaaaaatacaaaaattatctgggtgtggtagtgtgcacctgtaatcccagctactggggaggctgaggcaggagaattgtttcaacccgggaggcagaagtttcaatgagccgagatcgtgccattgcactccagcctaggcaacaagagcaaaactccatctcaaaaaaaaaaaaaagagttgactttatttattttaaattatttattgtggtgaaattcacataacataaaaaggtaaccattttacgggaacaattcagtggcatttagtacatgttcacagtgttaggctaccacaacttctgtctagttccaaatcatttccatccctccaaagtaaaaccccttatccattaagcagtttacccctgtttctcctcttctcagcccctggcaaccatgaatttgcattctctatgtcctcacccattctgaatatttcgtatagatgaaatcatacaatatgtggccttttgtgtctgctttctttgatttagcaagatatattggaggtacatccatgtatcagtacatgtatcagtatgtcattcttttttatgaatgaataatattctattgtatggataaaccacaatttgtttatctgtttattcattcataaacatttgaggtgcttccattttttgctaatgtaaattgtattgctgtaaacatttatgtataagcttttgtttgaacacctgttttcaggttttatacctaggagtggaattgtggggtcatgtagcaattctatgattaaatgtttgagaaacttttaaattgttttactttattttttgatggagaggagaggagtggcggggagaagagaggagagagtagggaaggacagggaggaaaggaattcagcatgtttgacatgaaggtctgtgtactttgtataaccccaatatttgtcattgaaaactgtgaggagggttctcttgcacaaacacctaactaggaaaacggagaaatgttcatggacatttgcgaaatcactgattggtggagagggatgctacatagcaacagaaagactgcagtcttttgttactactttgtttcactttctgcccaagagatccaattaaattaatgcctaaaatcaatctccaaagagtaggtttgaatttggaattagaccgaagggatgcctgaggactaatcaaggaagtcatatgacaacagtcttttccaagggccctcagcactcacaatgatgcccatgagacttcaatacagtggtgctcatattttgatgcactaaattcgattttgtgcactgattttgatgcacattggaattccctgatgatctttaaaaaatattgattccctgtattttaccgtaataaaaagcactgattcttggactttacccacagatgttctgatttgactggtggaactaggacaatcagaagatttaaaagctccccatgtgagtctaatatgtagccaagtttgggaatcattgctttaacctatgtgaggttatttaaccgtatgtgaggccctgcttgctgaagtgacaggaagatgttttatctttaccctatcttttccttcttattctccaccttgaatcatccaattttattcaaccatgtcttaatgtctatagcagagaagattctggaacatataaaaataaaacaatttgtgatcaaatagattaccaggtattcaaagggtaaacaaatgggaccataaaataatcaggcaacagagaaaaaaatgttttttgtttattttagcatgtttatttttggcccaagcctttatcaggttggagttggaggctggggaggaagaataacaaagcattgaggatatggagctctgagaagtttgatccctcctctgtgtgattaatgttaagaaagaccaaatcaaggtaactttaaagcagatatgctggatatccttccatttgtatacctacctatccatctttattttttttgttttttagattttttatttccataggctttgggggaacaggtggtattttgttacatgagtaagttctttagtggtgatttgtgagattttggtgcacccatcacctgagcagtatacactcaaccccatttgtagtcttttattcctcactcccttccaccctttcccctgagtcctcaaagttcattgtatcattcttacacctttgcatcctcatagtttagctcccatttatgagtgagaacatacgatgtttggttttccattcctgagttacttcactgagaatgatagtctccaggtctatccaggttgttgagaatgccattaatttgttccttttatggctgagtagtattccatagtatatgtatatacgacaatttctttatccacttattgattgctgggcatttgggctggttccatatttttgcaattgtgagttgtgctgctataaacatgcgtgtgcaagtgtctccttcatataatgacttctttttttctgggtagatatccagtagtgggattgctggataaaatggtagttctacttttagttctttaaggaatctccacactatttaccatagtggctgtactagtttatattcccaccagcagtgtagaagtgtgcccttttcactgcatctatgccaacgtctttttttttatgtttttgattatggccatcctttcaggagctaggtggtatcacattgtggattttatttgcatttccctgatcattagtgatgttgagcattttttcatgtttgttggccatttgtatatcttcttttgagaattgtctattcatgtccttagcctactttttgatgcaattgtttgtttttttcttgctatttttttaattcattatagattctggatataagtcctttgtcagatgtatagatttgtgaagattttctcctagtctgtgggttgtctgtttactctactgactgtcccttttaccgtacagatctctaggttaattaagtcccacctatttatcttttgtttttgttacatttgcttttgggttcttagtcataaaggctttgcctaagccaatgtctgaggtttttttctgatgtcatctttcagaatttttgtagtttcaggtcttagatttaagtccttaatccatgttgagttgattttcctataaggtgagagatgaggaccgagtttcattctcctacatgtggcttgccagttgtcccagaagcatttgttgaatagagtgtcctttccccattttatgtttttgcttgctttgtggaagatcagttggctgtaagtatttaagtttatttctgggttctctattttgtcccattggtctccgtgcttatttttataccagtaccatgctgttttggtgactatggccttatagtatagtttgaagtcaagtaatgtgatgccaccagatttgttctttttgcttagccttgctttggctatgtgggctcttttttggttccatatgaattttaggattgctttttctagttctgtgaagaatggtggtggtacattgatgggaattgcattacatttgttgattggttttggcaatatggtcattttcacaatattgattctacccatctataagcatgggctgtgtttctctttgtttacagtcttcttggcatatgatcatattagcaaacagtaacagtttgacttcctctttaccgattttgatgctctttattccattcttgtgtcggctctggctaggacttctggtactatgttaaatagaagtggtgagaatgggcatccttgtcttgttccagttctcagagggaatgctttcaacttttctccgtttagtattattttggctgtgggtttgtcattgatggcttttattacattgaggtatgctgactttgctgagggttttaatcagaaagggatgctggattttgtcaagtgctcttcccgcataaataaagacactttttctgcatctattgagatgatcatgtgatttttgtttttaattctgtttatgtggtgtatcacatttattgacttgcatgtgttaaatcatccctgcatccctggtatgaaacccacttgatcatggtggattacctttttgataagctgttggatttggttagctagtattttgttagggatttttgcatctatgttcatcatggatattggtctgtagttttctttttttgttatgtcctcttctggtttttgtattagggtgttactggcttcatagaatgatttagggaggattccctgtttctctatcttgttaaatagtgtcaataggattggtaccaattctactttgaatgtctgatagaattcagctgtgaattggtctggtcctgggtttttatggtttttttgtttggtaatttttttaaattaacatttcaatctcactgcttgttattggtctgttcagggtttctaattcttcctgatttaaggtaggagggttgtatgtttccaggaatttatccatctcttctaggttttctagattatgcaggtaaaggtgttcatactagctttaaatgatcttttgtatttctgtggtgtcagctgtaatatctcccatttcatttctaattgagcttattcggatcttctctcttctttttttggttaatcttgctaatgatctatcaattttgtgtatctgttcaaagaacaggctttttgtttcatttatctttttattgtttcttttttgtttcaatttcatagtctgctctaatcttggttatttcttttcttctgctgggtttaggtttggtccgttatttctctggatccttgaggtgtgacctttgattgtctatttgtgctctttcagactttttgatgtaggcatttaaggctatgaactttcctcttagcactgcttttgccgtatcccagaggttttgataggttgtgtcactattatcattcagttcaaataatttttaaatgtccatcttgatttcattgttgacccaatgattattgatgagcaggttattcaatttccatgtattagcatggttttgaaggttccttttggagttgatttacaattttattccactgtggtctgagagagtacttgatataatttcaattttcttaaatttatggagacttattttatgtcctatcatatggtctatcttggagaaaattccatgtgctgataaatagaatgtttattctgtgtttgttgagtggaatgttttgtaaatatctgttaagtccattttttcttgggtatagtttaaatccattgtttctatgttgacttggtcttgatgacctgtctagtgctgtcagtggagtattgaagtccctcactattattgtgttactatctatctcatttcttaggtctagtagtaatcgttttataaatttgggagctccagtgttaggtgcatatatatttaggtttgtgacattttactcttggacaaggccttttatcattatataatgtccctctttgacttttgtaactgctgttgctttaaaatttgtttgtctgatgtaagaatagctactcctgctcacttttggtgtcaatttgcaaactccttatttgttaggtgagtctcttgagggcagcagatacttggttggtgaattcttatccatttcaattctgtatcttttaagtggagcatgcaggccatttacattcaacattagtattgatatgtgagctactattccaatcattgtgctatttgttgcctgaatacatggttttttaattgtgtttttgttttataggtcctgtgagactcatgctttaaagaggttctgttttgacatatttctgggatttgtttcaagattcagaggtccttttagcttttcttgtagtgctggcttggtaatggtgaattatctcagcatttgtttgtctgaaagagactgtatctttccttcatttatgaagcttagtttcactggatacaaaattcttggctgataattgttttgtttaaggaggctgaagcgagggccccaatcctttctagcttgtagggtttctgctgagaaatctgctcttaatttgataggttttcctttataggttacctggtgcttttgcctcacagctcttaagattctctcctttgtcttcactttagataacctgatgactatgtgcctaggtgatgatctttttgtgatgaatttccaaggagttctttgagcttattgtgtttggatgtctagatctctagcaaggctggggaagttttccttgattattcccccaaatatgctttccaaacttttaaatttcttttcttcctcaggaatggcaattattcttaggtttgttcgtttaacataatcccaaacttcttggagtctttgttcattagttttaattcttttttctttgtgtttgttggattgggttatttcaaaaactatgtttttgagctctgaagtgctttcttctgctttttctgttctattgctgagacttttcagtacagtttgcatttctctaagtcctgtgatgtgaactgtcttcaggtctctcagtcatggatgcctgcacctgctccagtggaggtggcagcggaatgaaatggattctgtgaggacccttagttgtagttgtttaacacactaattttgtgctggttggtctcctgccaggaggtgttgctttcaagagagcatcagttgtggtagtacaggagaggatcatgtggtggggggggggggggtcggggggcgggcctaaaactcccaagagaatatgacctttgtcttcagctaccagggtgggaagggaaggaccatcagctgggggcagggttaggtgtgtctgagctcagactctccttgggtggtgcttgctgtggctgctgtgggggatggaggtatggttcccacctcaatggagtcatgtttccaggaggattatggctgcctctgctgtatcatgcaggttgtcagggaagtgggggacagccagcagttacaggcctcacccagctcccttgcaacccaacaggccagtctcactcctaccgtgctcccacaaatggcaccgagtttgtttccagacagtgggtgagcaaggctgagaacttgtctcaggctaccagcttcccagctgagaaagcaagcagggctttcacgcctcctcacctgtcgaatctgcacaccagattcatgccttcccctgagttctggccaggaaacttcacgtttggatggaattgttacaaagttcagctgggggtttccttctccctgtggtattttcccaatttctctggcagccctccccaaagacctctgtgagacaagtcagaaatggctttcctgaggactcagagagcccacaggacttcccgctgcttcctctacccctgtattttgcgtggctctctaaattgtctcagctccaggtaaggtcaaatccttctcccatgatctggaccttcaggttcctcagtgagggtgtgtgtttgggggcagatgatccccctttctcactttcacagtttgggcactaacagtattccggctgtctcccgggtcctgcaggagcaatctgcttccttcaaaaggtctgtgggttctctcagctttcctggtatattcctgcagtagttcttggaccagaagttcatggtgcgagtctccacatgctgctctgtctgcccgagtgggaactgcaatttggtcctgcctcctatccaccattttttttcctagaaaaaaaatctttttattcaacacattttttgattaccagctatgtgccaaccattgtacttaatgtagaggttagcttggtaaataaaatggccaaaaatttctacttcatgatatttgcaatctggcatgtgagacagacaaacattaaagaaataatcatacaatttctaactataaactgtgacgtgaaatagaataacagtaatacctaattcagatttaggaaaaacagagagaatgcctctctgacgaagtgccatttaagccaagacataaagagtgagtgagagttcaccagacagagctttccaggtggagggaatagcacatgtgacaaatctgagatgataatggccttgttacattccagagacaaagaaacaaaaacaaccagttgggatgggctgtagaaaggacatgaaattagaggggtaggcagaagccagatcatgtgggaattatacggcttggtaaagacttgagttttattcaaattatgttatgaagccatcagaaggttttaacacagggaagtgataagatcttacttactcttaaaataagattttattctagaaaatggacaacttgacagtttcctttatttatccaattcagcaattatttattgttctgttgttttattgggttctgggtgggtacaaatgagcaatatatgattcctgccctcaagaagctaaatgtagttgacaaggcagaactctgaaaacataaaattatgatagggtgtgataaatgcaacaggagaagtatgtatgtggcactgagagaaaaaagacaaatactctgattgtgttagcagttggtgggtcgacgtgtcatgtagcagggaagtcctggtgtgcttggatgtggtcagataaatgagcccgtctgaatgaactgttagtcatacttttgacctcatgatatcttcctttcctgggactcattgcatcctgggcaaggagcttgattatgatggtcctgtgttccctgctggaatcttaaatagtgttaatgaccatcttcctgggtaagactgccaaccaggttcctcagtgcttatttgaaacctaggaatgggtctcagctgaccagaccacttatcgaaaggaaagacacctctcttcatccccccaactttagcacaaacaccataaagacagcctgcactgtgttcctctgtgagcctagagctcaagttctactgatgcaaatatatctgaaggggaaaggatgtggttttagcataaccagtacatttctcaggcagtcgctgcagcagaaatagcaataaatagcagtagggatgatggcagatattagagccaaaaatgccagtttcagttccagcaattacattcaggtaatttctagctagagtaaagtcaaggccagtaatggaggtactggaaatagcatttccttaaaaacctgagagaacatacagctagtatctgtgctgagcgcagactgggcagacctggcttgtaggctgcagaatgtggagtccagggataacagatttgagaggcaaatggtgcaacttaagcaccaatataaagggactgaacataaaggcacagactaattataaggcaacaagatgcaaagaaaactcaccagacaggggtaactgagaggtgctttgagacactgggaagtgaaagggaattgttaacatcttagattagtgatccccaaactttgctgatcatgaaaatcatctagaaggcttgcagaaacctgaattccagggttccattaagaccaccaaatcagtatttctgggactaaagctgtcaatccatatttttttcagaattttacatttttatttaatgtatggatatttttatacattttatttatttatttttccttccaacttttaggttcagggagtacatgtgcaggtttgttacatagacgaattgcatcacagtggctgaactactttacattcccaccagcactgtataaagtttaccttatacagtatataataccatctcacaccagtcggaatggctatctcattgtggctttgatttgtatttctccaatgattagtgatgttgagcattttttcatatgcctgttggttgcatgtatgttttctttgaagaagtgtctgttcatgtccttttcccattttttaatggagttgtttgattcttgcttgttgatttgtttgaattctgtatagattatggaaattagatctttgtcagatgtgtagtttgtgattatttttcccattctgtaggctgtccatttacatttttgattcttttgctgtgcagaagctcatcagtttaattaggtattatttgtcaatttttgttcttgttgcaattgcttttaatttctttgtcatgaaatatttgccaggtcctatgtccagaatggtatttcccaggttttcttcaagggtctttatagttttaggttttaaatttaagtctttaatctaccttgagttgattttgtatatggtgaaaagaaaacgtatagtttcgatcttctgcatatggctagccagttatcccagcacaatttattaaataaggagacttttcgccattgcttgttattgtcaactttgtcaaatatcacatggttgtaggtgtgtagctttatttctgggttctgtagcatgttctattggtctatgtgtctgtttttgttctagtgccatactgttttggttattgtagccttatagtacagtttgaagtagaacagtatgatgcctccggctttgttctttttgcttaggacttctttggctatttgggcttctcattgaatctgtacattgctttggtcagtatggccattttaagaatattgattcttcctatccatgagcatagagtttttccatttgtttgtgtcatctctgatttcttagagcagtgttttataattcttgttgtagacagagatcttttacctccgtggttagctgtattcctaggtgttttattcattttgtggctattgtgaatgggattgcattcttgatttggctttcagcttggatgcttttggtgtacggaaatactactgaaatttgtacattgattttgtatcctaaaactttgctgatgtttttttttttatcagctctaggagtctgtggcccaaaactatggtgttttctaggtatagaatcatatcatccatgaagagagatagtctgactttctctcttttatttggatgtctgtcttctatttccttcttttgcccgattgctctagcaagaacttccagtgaatgtgttgaataggagtggtgagagtggacatccatgtcttgttcttgttttcaaggggaatgattacagcttttgcccattcagtatgatgtttgttgtgggtttgtcattggtgactcctattattttgaagtatgtctttgatgcctagtttgttgaggttttaacatgaaggaatgttgaattttatcaaaagctgtttttgtgcctattgggatgatcatgtggtttttgtttttatttctatgtgatgaatcacatttattaatttgcacatgttgaaccaaccttgtatcccaggaataaagcctagttgattgtggtggattagccttttgatgtgttgctggatttggtgtgctagtattttgttaaggatttttgcatctatgtttatcagggatattggctgaagctttctttttgcattgtgtttttgccaggttttggtatcagaatgatactggcttcatagaatgagttagagaggagtcccttctcctcattttttggaatagatggtaggattgttacaagctcttctttatacatctggtagaattgggccatgagcacatctggtccagggctttttctggttagtaggtattttattattaattgaattttggaactcattattgatttgctcagggtttcaatttcttcctctttcaatcttgggaggttgtatgtttccaggaatttatcagtttcttccaggttttctagtttgtgatcatagaggtgctcgtaatagtctctgagagatttttgtgtttctgtggagtcagtgataatatccccttagtcatttctgatagtattcatatggatcttctctcattctttctttattagtataattagtggtctttcagtcttatttattcttccaaagaaagccttttagtttcatggatcttttgaatgttttttttaatctcgattttcttcaattcaactctgattttggttattgtttttttcttctgctagctttggagtagtttactcttgcttttctagttcctctagccatgctattaggttgttaatttgaaatctttgtaactttttgatgcaggtgtttaatactataaactttcctattaacactgctttagctgtgtcctggagattctggtgtgtcatatctttgtatattgtttaatttccatgtaattgtatggttttgagagatattttggtattgatttctatttttattgcactgtgatctaaaagtgtcattggtatgatttcagtttttctgtatttgttcagatttgctttacagttaagaatgtagttcagtttaggaattgtgccatgtttatatgagaaaaatgtgtgttttgttgttgaatggagtgttctgtaaatatctgctaagtccatttggttaagtgtcaagtttaggtcctgaatgtctttgttagttttctgccttgattatctttctaacactgtcagtggattgttgaagtctctcactattattgagtggctatctaagtctgtgtgtaggtctctaagaacttgtttaatgaatctggctgttccagtgttggttgcatatatatttaagatagtgaagtcttcttgttgaattgaaccctttaccattatgtaatgcagttttttgtctttttcttatcattgtcagttcaaagtctgttttgtctaaaattagaatatcaactcctgctttttttggatttctgtttgcttggtagatttttctctatccctttactttgagcctatgagtgtcactgcatgtgaaatgggtctcttgaagacagcattacagttgagtcttgcttctttatccaacttgccactctgtgccatttaattgggacatttagcccatttacattcaaggttaatgttgatatgtgtggatttgatcctgttaccacgttgttaactggttgttatgtagacttgctttgtagtgttaattgtctatgtacctgaatgtgtttttgtcgtggcagataccagtcttttgtttctgtgtttaacactcctttaaggacctcttgtaaggcaggtctggtgggaatgaattcccttagcatttgcttatctgaaaaggatttaatttctcatttgctaatgaggcttaatttggctggatataaaaatctttttttttttctcttttatgatgctgaatatgggcctccaatctcttctggcttatagggtttctgctgaaagatgtgctattagcttgatgatgttccctttgtaggtgacctgccccttctctctagcttctctagctgcgtttaatatattttcttttatgttgacctttgagaatctgatgactatgtgttttggggatagtcgtcttgcatagtatctcacagggattctataaatttcctgaatttgaatgttgatctctccagtgaagttagggaaattttcacaggcaatatgctgaaatatattttccaagttgattgttctctctccctctctttgagagatgccaatgaatcataggttttgtctctttacataatcctatatttcttgggggttttgttcattctattttattcttttaaaaagatttttgctgactgagtttattcaaaggtgcagttttcaagatatgagaatctttcctcagttttctctattctgctgttaataatttcttctgtattacaaaattcttacagtgagttttttagctctattagatcaatttggttctttcttaaaatggctatttcatctttcagctcttgtatgttttactggattccttagattccttggattgagtttcaactttcttcacaatcttgatgacctgcatgctgaattctatgtctgacatttcagccatttcagcctggttaggaaccatttctggggaggtagttcagtcatttggatggaagaaaacactcaggctttttgagtttccagagttcttgagctggttctttctcatctgtgtgggctggtgttcctctaatctttgaagttgctgtcatttggatggggcttctgcttttatatcttttgatgccgtttagggtttgactgtgctataggttggattcagtcaactggcttcatttctggatgatttcaggtagccaaggcttagttcagcattcctgggctgtgtgctctaatcctggagggctgagaccaggccctctgctttgttgtctcgcccctcaagcttatgtacctgctggactggaggggctgagatgttcctgatctgccagcaataacattgttgggaggtcctggcaaaagtgcttaatcagggcagcagctgcagggtttgtgcgtatgcatgccagcagcagaagggcagccggtcagttgggtccacatgcatgccagcaaagcagtggaaggatgctgtgtgtgggtacacccagtagtgatccttctgcaaaagctctctgatggctaggcagggtctgccagtaaagcagacatggtgatggctgctgggaagtgccctggtttggcatctgatgctgtgctgcaagtaggtgcagccaggcagggaccctgggaaaggccagcagaccaggggcactcagatcagactggccttatcctataggcaagatgtccctgttccatccaggtgggacagtcaacaaaggccaaggccacctagaggagtgtggcaagctttggtggatgggcatccctggctgtgctccactgtagccattctcacgccaaaccctctgtgctccacaaaggcagaagtcctgtccctgccaactacccatgaagctctccttgccagctcaaatgtctgtgggtgtcatgggttctcccccagttaggattccagaggtctatggcgagagtgggctactccatgcctatttaactcaccccttctccatgagttactcaggaccaggaatgagccctggtgctcagtaaccctgtgcagggttcctagcttcctcctcatttcacccctgactttgcatcttccctctgtcccctcttaatgcctttcttccgaagatatgctcagagtgtgccagtcttcttaatggtctggtctgttgatgggagaagctcttcctggctatgtctagtctgccatttttgctcttctccctacatcatattggctggtctccccatattttttaaataaactaaataaatgaccctcccctggaaattctggccctttcttttttcccaaatggccactacttctaagagtttctaattaatccataggagatgagtcatttcttcttcctcaaatatttagaatatttcacagaaggtgttaggtacaggaaaattctaccataatggatatgatagtactggtgataactagcatttagatagcactttacaatttcaaagtgccttttcacatccagcatcccttatttaatttactttactttactttaatttcgtttaattatcacaatagggccgtgaggtcaggtattgatatccccatttcacagatgtggaaactaagactaaaatgattaagagaatttagccaataaggagttgacccaggactcagtctcaggttttctgctactagatataggcttctttatacctcattcatgaggtacgaagggagaaatagtgaggcaggaataagagtgaacagtgtactctcacagaatgttccagtctgccactatctgaatatcaaaatttggtgggaggtgatatattttctataaaagggtactgaaacagaacagatctatgtcaaagctggggcaggcatgttggggcactgtaggtgtatatcaacttagaggagggttcctcatccgaaaattaaaagagcagattctggctaatattgatgtcagaggaaaaatacaagaaatttttggtttaaaactgaaattcagaaatggcagattggcagtgtatttagaaggtacggttttgttttgttttttctaacaggctcaaaggagtaagaaaactttaacaaagacatgggaggtaaaacttctcattttgcgttgcaaagtaaagatgtctgattctaggcagaaagcctgggatctgcctagaccagcttggccagacccaccatattaacttactccattacaatggggaaagagaccacatctcacttgcaacacattaagcaacagtgattgcaaagtagtctttactggagacttcagaggcaactgagaatactatttgtacaaagatacctattatattgtctataaagaacaacattttaaacactaaatggacattcttatacatgtttctttgcacacatgtgtagacatttctggtaaatatagatcagaggaacagctgacttatagggaatatacatctaagctttagcagatattgcccaattgctctccaaaattgtcgtgctagttttcttccccacatcccccaactgcagcagtgtgtgagaggtctctttatttcacttccttatcaacacttggtactaccaagggtctagatatttgacagggtatagctgtgaaatagtaccagcttttaatttgcattaccgtgatcatgtattgatattggaaaccttatgttcattgagtattcagattccttctttcatgaattgcttttttatttgagatttttaatacacttacaattaatatttatatgtggtatgagataaaaatgtactttttacagctggataacctgtagtcccagtgcattttaaaatcattcattctttctcactaatatgtaatgtctttgttaccttatatcaagcttccatatattcatagaacagtttctgggtatcctgttctgtttcattggttttgatatgtaggctcatttgaatgggagtatttgtgcttattttcactttaatatttaattttagttaaattttatatttttaaaaatgaatataacatgcacaatatagtttgttgtggtggtatataatcatcactaataagacaatcaacatataaaacagttccattgaatggaaaaattccttaattattctttcttttactatgtaaataatttttattttcttatcactttacttttaggtagttattacaacattaaaaaatctgatttggaaaagtgttctttttaatcagataaataaaagatgaaattaatttaaatatgtgtgtcagggggtttgtatagttgggacatttaattttgtgattacttgggacaataatttttttttttttttacattttagattcaggtggtacatttgcaggtttcttacatggatatattgtgtgatgctgaggtttgggcttctgttgaacccatcacttaaatagtgagcatagtacccaataggtagtttttcaacccttgcccccatcctactttgccccttctggaatccccagtatctattgtttccatctttgtgccatctctacccatcgtttagctcctacttataaatgagaacatatggtatgtgattttctgtttctgtattaattaggtgctcatctatgatggattggataaagaaaatgtggtacatatacacgtcaaaatactaagcaggcataagctattgaaataataaaaagaaaataagaaaaaataaatgaatgaaatgtgaaaaaagattgatgagaataaaattgcttgctttgttcattaaaaaggaaatcagagatgatacaaataaatggaataatatttcttgctcattggttggaagaatcaatattactgaaatggccatactgcccaaagcaatctacagattcaacactattcctatatcaagctaccaatgtcatttttcacagaacttgaaaaattattctaaaattcatacagaacaacaacaacaacaaaaaaacagtctgaggagccaaagcaattatatgcaaaaagaataaagctggaggcatcacattagcctatttcaaactatactagaaagccacagtaaccaaaacagcatggtactggtacaaaaacagacacatagaccaatggaacagaatggagaccagaaataaagcctcacacctacaaccatctgatcttcaacaaagtggataaaaatgagcaatggggaaaggacaccctattcaataaatggtgctggaataagtggctatccacgtgtagaagaatgaaactggaaactacctatcaccatatagaaaatcaactccagatggattaaagattcaaatataagacgccaaactacaaaaatcctaaaagaaaatctaggaaatacccttctcaacatcagccatggtaaatacatggctaagtcctcaaaagcaattgcaacaaaaataaagattgacaagtgggatctaattaatctaaggtaacttctgcacagaagaaaaaattatcaacagagttaacagacaacctacagaatgagagaaaatatttgtaaattatgcatctgatcaaggtttaatatccatatgctataaggaacttaaataaatcaagaagcaaaaaacaactccattaaaaagtgggcaaataacatggacacttctctaaaggagatatacaaacatccaaaaaacaaatgaaaaaaatgctcaatattgctaatcatcagagaaatgtaaattaaactcacaataagataccatctcacgccagttagaatggctattttttaatatatattttactttaagttctgggatacatgtgcagaacatgcaggtttgttacataggtatacatatgccatggtgttttgctgcacttatcaacccgtcatctaggttttaagccccacatgcgttaggtgtttgtcctaatgctctccccccgttggcccccaccccctgacaggccccagagtgtgatgttcccctccctgtgtccatgtgttctcattgttcaactcccacttatgagtgagaacatgtggtgtttggttttctgttcctgtgttagtttgctgagaatgatagtttccagcttcatccatatccctgcaaaggtcataaactctttcatttttatggctgcatggtattccatgggtatatgtgccacattttctttatccagtctatcattgatgggcatttgggttggttacaagtccttgctattgtaaatagtgctgcacaaacatctgtgtgcatgtgtctttataatagaatgatttataatcctttgggtatatacccagtaatgggattgctgggtcaaatggtaattctggttctagatccttgaggaatcaccacactgtcttccacaatggttgaactaatttacactcccaacaacagtgtaaaagcgttcctattcctccacatcctggccggcatctgttgtttcctgactttttaatgatcgccattctaactggcatgagatggtatttcattgtggtttaaaagtcaaaaagatattgccaatgttgtagagaaaaggcaacacttatacactgttggtgggaatgcaaattaatcagcctctgtggaaagatgtctggaaattcctgaaataactaaaaatagaagtatcattggatccagcaatcccattactggtatatacccaaaggaaaataaataattctaccaaaaagacacatgcaccagtatgttcagtgcagcactattcacaatagaaaagacatggagtcaatgtaggtctccatcaatggtggattggataaagaaaatgtggtacatatacaccacggaatcctacacagtcataaaagaataaaatcatgtcctttgcagcaacatggatgcaaatggaggccatcgtcctaagtgaactaactgagaaacagaaaaccaaatactataagttctcacttacaggtgggagctaaacatagggcatacacagacataaagatgaaaacagtagaccctggggactacaagagaatggggggaggcagtggggaaagggttgaaaaactacctattatggactgttctcactacctgggtgatgagatcaatagtaccccaagcttcagcgtcaccatataccttggtgacaaacctgaacatgtaacccctgaatctaaattattgaaattattcataaaattaccttcaggctatgtttataagctctatataaaacataactgaattttgtgtttagatttgggtcccatccccaaaatatctcattatatatgtgcaaatttttcaaaaatccaaaaatttgaagtgcaaaacacttctgaccccaagcatttcagataagggaaagttaacctgaatggccaccaaatctatcttttgaattagtgtttgcattgcatacattttttattcacttacttttatcatatttatacccttatatttaaagtatgctttttgtacacagaatgtggttggctattttttttttcaatctggcaatctctactttaattggcgtgtttagatcacctacatttaatatatttatttacatgtttgtgcttacattcatcatcttattatttgttttctatttgtcccacatccttatatttatcttttccccctttctgccttcttttggaatatttgaatatttgaattgttttattctaattcatatattgtctttttagaaatatttctttataatatgagattcattggttgctatagggcttacaatcttcacaagattaacttcaaaagtcagcttttgacagtcctaaagtttacatcattccacttccagtaaattgtagtagcctggcaaccaaataggtcagtttaccactcaaatgacctttatgttgcagttatcaattatatcaatattcattaaaaaccacacaagatggctgggcacggtggctcacacttgtaatcccagctttttgggaggctgaggtgggcagatcatgaggtcaggagttcaagaccagcctggccaacatagtgaaaccctgtctctactaaaatgcaaaaaattagccaggcattgtggcaggtgcctgtaatcccagctactcaggaggctgaggcaggagaatcacttgaacccgggatgtggaggttgcagtgagccgagatcgcaccattaaactctagcctgggcaacaagagtgagactctgtctcaaaaagaaaaaagaaacaaaaaaacataggacaaggttgtaatattttatttcaagtcataactattttaaagaatttaaaaagggaaaaaatatttacccagaatttccatttctgttgtatttccttaattcctgattatctaatttccccatgacattatttctcttgagcccaaagaaacttctttggaatttcttataaaatgattttgctggagacaaattatcttagtcctttgaaaatttgagaatgtctttatttttacttctttcctaaacatagttttgctggatataggattctggtattgatggttgttttctttaaacttgttgaagatgctttttcaccatcatatatcctctgtgatttatcttcagtctccaattattgctcccctatatagaatgtgctatttcccaatatcttctttcaagatctttctttactttggtatttagcagtttgattatgatatgtctaggcatgattctctttaatctttctgttttatgttttctgagcatattgattctgtacattgatgtagtctatcagattttggaagtttctgagcgctatttcttcaaaaaaatttttttctgcacgaatctctttctcttctctttttggaactacagtgctctgtatgtgaaaccttatcctattatccaataaggctatttgttccagccatttttcttactgtttctcatattggatgatttctattagcctcccttcaagttcactgactcctttgtcatctctgttctgctattgagatcgcccagataattttttattttggtaattgcattttttatttctaaaatttcaaataggttattttaatattttctaatttctctgctgagaacatctatctttccattcatttcgaacgtgttttcctttacctcatgaaacagagttataatagttgatttaaactctttggctgacacttcaaacatctgggctttcgcagttgacatttgttgattgtcatttcccttgagaattggtgacattttcctttttctttctaagtactaatgctggattttatctagggcattttgaatattttgctgtgtagattctgggctctggagaatgttgattttttttttcatttgttttatcaggtaatcaacttagttaagtttagtttgtgagttctgccttgcgttctgtgggtgatagtctacatctcgttcagttttcaaagactttactaggctatgtttggtttctttcacacatgtaccacttaggagatagtccaagactgtggttttaatctaagttcatagttcaattatcaaagtctgtgctatgcagccttgtatctgtaccatacttgtactactcagggatttttctgaaatttatgtagtggtttaaatatagtgtagttctcaaagctttttctatgctaccttgggtttggcctctgcatgtgcagctcaagagtgaatctattatttgtggggcctcaaacacagaaattagtagaacatcttctttaaccatctccactctggtattcccccacactctctgacctgcagaagcccttttccctctctttgtggtaagaccagtgaggtttctctcagagttttagccacctgtgtcacagtccccctttgtgtctttgcctttggagcaaacctgtaaaagaaaataagaaaaaacaataacatacaggaaatttatttctctgtgggttgcttctccatgttttaactctcttcaaaaattcacctgatcatgtttacttttcagagtctttggtaattacctttgatattttttcagaaatttatttataacaagtgggagagaaagactatagtgcacttaatccatcatgccagaaaccagttcagttttgttttaatttcagtttttaccttctttttcttactatcaagtggttttgtggttgcttctacactgaccctcactccaaattaatagtattttgcagtttattctccgttatgacattgctgatacattcttggtacaacaaaccacttggctcagttccgattcccaggacaatgtctttgtatgccattgtaccttccccctgcttccccgcttatcccaacccagggctgcagccccaaacacaaccataacccacagcctcaaactgagccataccccaggcatcagttcagcttcactttttctaacctcttttcaaggagatccccaggtctgagccacaagcactcaccctgcttccagtcttccctttcatacagagcaattttagtcttttttactttactctttattttcagactcagaattcgggcttcaacattacttactccttttttttgtttctttttcatgatactttgatcttttatttaaaataactatatcttttatattttacctaccattattgtatgtttggaacagaggggttatactgaaatgtaaagttgcctgttccatcttatctggatgttccaaacacttcttaggaacgacagtgtagctacctctggtagtctcttttaatctattatgtccttggaaactataatattttaaatattgaagtcataacaaaatcaactccctttttacaccagttagaatggcgatcattaaaaagtcaggaaacaacaggtgctggagaggatgtggagaaataggaacacttttatactgttggtgggactgtaaactagttcaaccattgtggaagtcagtgtggtgattcctcagggatctagaactagaaataccatttaacccagccatcccattactgggtatatacccaaaggattataaatcatgctgctataaagacacatgcacacgtatgtttattacggcactattcacaatagcaaagacttggaaccaaaccaaatgtccaacaatgatagactggattaagaaaatgtggcacatatacaccatggaacactatgcagccataaaaaatgatgagttcatgtcctttgtagggacatggatgaagctggaaaccatcattctcagcaaactatcgcaaggacaaaaaaccaaacaccgcatgttctcactcataggtgggaattgaacaatgagaacacttggacacaggaaggggaacatcacacaccggggcctgttgtggggtgggggaaggggggagggatagcattaggagatatacctaatgtaaatgacgagttaatgggtgccgcacaccaacatggcacatgtatacatatgtaactaacctgcacgttgtgcacatgtaccctaaaaattaaagtataataaaaaaaacagacaaggaaactgaggcatagttaacttgaagtagagccaggactaacccaacctccacatcctatattagtggtttttctaccaattaattttatgttcaggctaagaatctgtaggccctggaaagatagcagcatatccctgtaatatttaggaatatttcagctgttttgaagattttattattctcctctggctctcagcttgttccagttgaaggacattcctctacagtggaaaggatattgtgcagtgagcctccaagttatgttttggtcatcatttgggcactgcatcaacttctctttctaattttgttataatggtgctccaaggaagtcctactagctcttgggagtgaactctatttgcagcgaggagcaatgaactggtgaagagtctgctctcgaatgttttatttcttccacacttgttactgacatttctttctatgaggctggctatatctacccttttcctcctattatagaatattttttgaaatggaccttaaatatctctgtgctgaaactcttcatgttctagataaagaaactgaagctcagagagtttaaagtcttattcaaggtcataaagcttgtcagtggtactgctagagcttatactgagatgttataaaatcagatgcagtgcttttcccattacattctgggtaagtatcagtataagtaaccaataataagtgtagggaaaaagcaaaaggagagtttggaggaagggaaaatctagaacgagtgaaaggcaaatgaaatcatttgaattgacaattgaaatatgttttggtactttacaatttcagtattaaatgtcaaactgaggaatggaataaagatgaagaaagtggaatgctgagagtgatggcacaagaatcagtgcttttgtagggccagtgaatggagtagaatcctctgaatggtgtctactgtccaacaactatatgtggcctgggactggaacataaattttgagacttcattaagaatgaaacatctgagaattttgggaaacaggcagtgaactttgtccaatcctacctttgtcagagtctagattctagtaaaacaatagtggagttaacaaaaacccacagtggttagggtggtgattgtgatctcttaaatgttttggtagttccttctggtgttattttatcagcatatgttgtgtacactcctccactaaagtcctcaacagaaaagcagctggctggccgggcatggtggctcatgcctgtaatctcagcacttgggaggccaaggcgggtggatcacttgaggtcaggagttcaataccagcctggccaacatggtgaaatcccttatctactaaaaatacaaaaatagtcaggtgtggtggtgggtgcctgtaatcccggctacttgggaggctgaggaaggagattggcttgagcccaggagatggaggttgcagtgagccaagatcatgccactgcattccagcctgggcaactgtgtgagactctgtctcaaaaaaaaaaaaaagagaaagaaaaggaaaagcagctgattatcaaagttttgctgcacattccaggtactagacactagagggaatagcatatgcaagcaaaatgctagaacccaagcctaccaaatgtcaaaagttgtcaggtttgcccaaacagcctgcaaaagtgggcatgagtctattgcagagcctagattggagctcaggacttctgatacaatcttttgtaatttctgcttccgtaagcaacctgtttatgattcttccagagtgtttatctatgattaatgctactgcaaggggaaggggaaattaatgagtacttatagtatcttagtccccaaatattgccaatgacaaatggaaaggtcgttaacgtgagaacaaagcactctagatcttagatgtgcaagagcttgtacataagtcactgttgtccactccttaaatctatgaagctagccaactcagatagctagtcacctgggagctcatttacaggcacccagtccctcttcaagatgaaaagtgtatgcaataatgagcacttattcaccaaaattcccagtgatctggaggtgagaaaacaggaaactcatgactttgttctcttggccaaagcccaaatcctcaaaacctcactatccttagaatggcattgtgaggaactaaagagtctgtcatgacccatagtgagatgtaaaggtgtagttgagttttgttcatatcatttatctcatatgtctaatagaactgtgacaaactctcaccacaaaatgtatttcagagggacagttaacaaatctgacctgagccagaggaaaaaaattaatagggtacagtgagggtgctcaaagccatgtcaaaagaagggagacatttttccattccaagtggccgaataggaacagctccagtctgcagctcccagcgtgattgactcagaagatgggtgatttccgcatttcaaactgaggtaaacgtttcatctcattgggactgtttggacagtgggtgcagcccatggagggtgacccgaaacagggcggagcattgcctcaccgaggatgtgcaaggggtcaagggatttccccttccaagccaagggaagctgtgaaagacactacctggaaaaatgggacactcccgcccaaatactgtgcttttccaacggtcttagcaaacggcagagcaggagattatatcccatgcctggctcagcagatcccatgcccacggagccttgctcactgctagcgcagcagtctgagattgacctgtgaggcaacagcctggcagggggaggggcatctgccattggtgaggcttgagcaggtaaacaaagcagctggggaagcttgaactgggtggagcacaccacagctcagcaaggccagctgcctctgtagtctccacctctaggggcagggcatagctgaacaaaaggcagcagaaacttctgcagacttaaacgtccatctgacagctctgaagagagcagtggttctcccagcacagtgtttgagctcggagaatggacagactgcctcctcaagtgggtcccagacccccgtgtagcctaactaggagacacctcccaataggggccaactgacacctcattacaggcgggtaaccctctggtatgaagcttccagaggaagaatcaggcagcaatattcgctgttctgcaatatttgctgttctgcagcctccactggtgatacccaggcaaacagggtctggagtggacctccagcaaactccaacagacctgcagctgttggagcaaactccaacagacctgcagctgttggagcaaacgccaacagacctgactgttagaaggaaaactaacaaagagaaaggaatagcatcaacatcaacaaaaagaacatccacaccaaaaccccatctgtatgtcaccatcatcaaagaccaaaggtagataaaacaacaaagatggggagaaaccagagcagaaaagctgaaaattctaaaaaccagagtgcctcttctcctccaaaggatcgcagctcctcaccagcaatggaacaaagctggatggagaatgactttgacgagttgacagaagtaggcttcagaagggtggtaataacaaacttctctgagctaaaggaggatgtttgaacccattgcaaggaagacaaaaatcttcaaaaaagattagatgaatggctaactagaataaacagtgtagagaagaacttcagtgacccgatggagctgaaaaccatggcacgagaactatgtgacgcatgcacaagcttcagtagccaattcgatcaagtggaagaaagggtatcggtgattgaagatcaaattaatgaaatcaagtgagaagagaagtttagagaaaaaagagtacaaagaaacaaacggagcctccaagaaatatgggactatgtgaaaagaccaaatctacgtctgattggtgtacctgaaagtgatggggagaatggaaccaagttggaaaacactcttcaggatattatccaggagaacttccccaacctagcaaggtaggccaatgttcaaattcaggaaatacagagaagaccacaaagatactcctcaagaagagcaaccccaagacacataatggtcagattcaccaaggttgaaatgaaggaaaaatgttaagggcagccagagagaaaggtcggattacccacaaagggaagcccatcagactaacagcggatctcttggcagaaactctacaggccagaagagagtaggggccaatattcaacattcttaaagaaaagaattttcaacccagaatgtcatatccagccaaactaagcttcataactgaaggagaaataaaatcctttacagagaggcaaatgctgagagatttttttcaccaccaggcctgccttacaagagctcctgaaggaagcactaaacatggaaaggaacaactggtcccagccactgcaaaaacatgacaaattgtaaagacaattgatgctaggaagaaattgcatcaacgaatgggcaatataatcagctaacatcataatgacaggatcaaattcacacaaactattgtttgttaacaataacagttgttattgttattattgttattattgttgttattgtaatgttaacagttgttaaccttaattgtaaatggactaaacgccccaattaaaagacacagactgacaaattggatagagagtcaagacccatcactgtgctgtattcaggagacccatctcacgtgcagagacacacataggctcaaaataaagggatggagaaagatctaacaagcaagtggaaaacaaaacaaaaaaaagcaggggtttgcaatcctagtctatgataaaacagactttaaaccaacaaagatcaaaagagacaaagaaggccattacataatggtaaagggatccattcaacaagaagagctaagtatcctaaatatatatgcacccaatacaggagcacccagattcataaaggaagtccttagagacctacaaagagacttagactctcacacattaatagtgggagactttaacaccccactgtcaatattagacagatcaacgagacagaaggttaaaaaggatacccaggacttgaactcagctctgcaccaagcagatctaatagacatctacagaactctccaccccaaatcaacagaatatacattcttttcagcaccacatcgcacttattccaaagtcgaccacatagttggaagtaaagcactcctcagcacatgtaaaagaacagaaatcacaacaaactgtctctcagaccacagtgcaatcaagttagaactcaggattaagaaactcactcaaaaccgcacagctacgtggaaactgaacaacctgctcctgaatgactaccgggtaaataacaaaatgatggcagaaataaatatgttctttgacaccaatgagaacaaagacaccacctaccagaatctctgggacacatttaaagcagtgtgtagagggaaatttatatagcactaaatgccctcaagagaaagcaggaaagatctaaaatcaaaaccctagcatcataattaaaagaactagagaagcaacaacaagcaaattcaaaagctatcagaaggcaagaaataattaagatcagagcagaactgaaggagctagagacacaaaaaaaatcctttaaaaaatcagtgaatccaggagctcgatttctgaaaagatcaacaaaattgatagaccgctagcgagactaataaagaagaaacgagagaagaatcaaatagatgcaataaaaaatgataaaggggatatcaccaccgatcccacagaaatacaaacatcaatacaaactacatcagaaatacaaactaccatcagagaatacaataaacacctctatgcaaataaactagaaaatctaaaagaaatgaataaattcctcgacacatacaccctcccaagactaaaccaggaacaagttgaatctctgaatagaccaataacaggctctgaaattgagacaataattaatagcctaccaactaaaaaaaagtccaggaccagacggattcacagccaaattcaccagaggtacaaagaggagctggtaccatctttttgaaactataccaatcaacagaaaaagagggaatcctccctaactcattttatgagggcagcattatcctgatatcaaagcctggcagagacacaacaaaaaaaagagaattttaaaccaatatccctgatgaacattgatgcaaaaatcctcaataaaatactggcaaatcgaatccagcagtaagtacatcaaaaagcttatccgccacgatgaagttggcttcatccctgggatgcaaggctggttcaacatatgcaaatcaataaacataatccatcacataaacagaaccaaagacgaaaaccacatgattatctcaatagatgcagaaaaggccttcgacaagattcaacagcccttcatgctaaaaactctcaatacactaggtattgatggaacgtatctcaaaataataagagctatttatgacaaacccacagccaatatcatactgaatgggcacaaactggaagcattccctttgaaaactggcacaagacagtgatgccctctcccaccactcctattcaacatagtgttgaaagttctggccagggcaatcatgcaagagaaataaataaagggtattcaattaggaaaagaggaagtcaaattgtccctgtttgcagatgacgtgactgtatatttagaagaccccatcatctcagcccaaaatctccttaagatgataagcaacttcagcaaagtctcaggatgcaaaatcaatgtgcaaaaatcacaagtattcctatacaccaataacagacagagagccacatcatgagtgaactcccattcacaattgcttcaaagagaataaaatacctaggaatccaacttacaagagatgtgaaggacctcttcaaggagagctacaaactattgctcaacgaaataaaagaggacacaaacaaatggaagaacattctaccctcatggatgggaagaatcaatattgtgaaaatggccatactgcccaaggtaatttatagattcaatgccatccccatcaagttaccaatgactttcttcacagaattggaaaaaaactactttaaagttcatatggaaccaaaaaagagcccacattgccaagataatcctaagccaaaagaacaaagctggagacgtcatgctacctgacttcaaactatactacaaagctatagtaaccaaaacagcatgttactggtaccaaaacagatatatagaccaatggaacagaacagaggccttagaaataacaccacatatctacaactatctgatctttgacaaacctgacaaaaacaagaaatggggaaaggattccctatttaataaatggtgctgggaaaactggctagccatatgtagaaagttgaaattggatccctcctttaacccttatacaaaaattaattcaagattgaataaagaattaaatgttagacctgaaaccgtaaaagccctaaaagaaaacctaggcaataccattcaggacataggcatgggcaaggacttgatgactaaaacaccaaaagcaatggcaacaaaagccaaaattgacaaatgggatctaattaaactaaagagcttctgcacagcaaaagaaactatcatcagggtgaacaggcaacctacagaatgggagaaaatttttgcaatctacccatctgacaaagggctgatatccagaatctacaaggaacttaaacaaatttacaagaaaaaaacaaacaaccccatcaaaaagtgggtgaaggacatgaacatacacttctcaaaagaagacatttatgcagccaacagacacatgaaaaaatgctcatcatcactggtcatcagagaaatgcaaatcaaaaccacaatggggtaccatcacacaccagttagaatggcgatcattaaaaaggaaagaacagatactggagaggatgtggagaaataggaatacttttacattgttggtgggagggtaaactagttcaatcattgtgaaagacattgtgggattcctcaaggatctagaactggaaataccatttgacctagcgatcccattactgggtatatacccacaggattataaatcatgctactataaagaaacatgcacacatatgtttattgtggcactattcacaatagcagaaacttggaaccaacccaaatgtccaccaatgatagactggattgagaaaatatggcatatatacaccatggaatactatgcagccataaagaaaggatgagttcatgtcctttgcagggacatggatgcagctggaaaccgtcattctgagcaaattattgcaaggacagaaaaccaaacaccacatgttctcactcataggtgattatttaacagtgaaagcacctggacacagggcagggaacatcacatcccagggcctgtcgtggggtggggggcagggggagggatagcattaggagaaatacctaatgtaagtgatgaattaatgggtgcagcaaaccaacatggcacatgtatgcctatgtaacaaacctgcacgttgtgcatatgtatcctagaacttaaagtataatttaaaaaaagaaagaaagaaagataaaatacaaggtgagccaaaggaaaaaaaaaaaagaagggagacataatcaaaataagtcggggcatttagtatggaaagaaacaagaagagcagacaggggtacaaggatcactttctttaaatctctgaagcttttaaatatatatttttttttcttaaagggaagagaaagcagactttgttgtgtggatccaaagggtagcactaagataaatgtgcatgattgtgctggggtggagcagctagaaatggcaaacttacagagactggtttcaagaaaattcaagaattattggacatatatttgaggtaaaaccagaaaatacagtatattatgagcagtatactcaacataaatacagtgatcacttgttgatcggctcatctttattctttcagattagcagcaagcagaagtactgtagggtctggcaaatgagttccctaccaatgggagtcctattgaggtttaagggtgtgtgtaatcatgtgtatgtgtacgttatgcatatatgtgcagaccacttgaggatcatccaagtgcttccaatactgcagtaaatttgcaaaaggaaaaacaattgtgttcaccttttgtttcagaggataatattggaaggaaattaaatccctgaagcaaatgaagaaagagccaagcagcaactgtaaacaattatataaaaagagaagaaaaatcccttcttatcttctactaattaaaatttcatatttgtctctatcaagaattctgtcaacagaggctagactctatatattgtggccctcatgagtttcagtttaattcactggcctttgcacttaattaaatgaaataggaaactcctagtcattccttcacatagaggagctgaagtggtgagtggatactgtcttcagtgtctaggacccaggaccttagacatctgtgtgagttctgcccatttggccttatgggtggctcatgtgatctattctcagaaatagtattaagcagcagcattagctaacatgtactaaactctgaatctgttctaactactggtctaaatactatctccttaaattctcagagcaattctgaagtatcattacctcaattttcccaagaagaaacaggtacaaaggcacacaaaagagcagtggcagaacctaaatccaaacttagtcatgcttttaactactgtatcatattcatcagggttcttctccatgtgttatcaggtgccttgccccaagacagcccgatttcttagccagaaaatggggctagacatcaaggcatagtggtccccgtgtagaacactggagtcatgtcaaatatccctgcttttgcctgggcttggaatagaggcctgtggatggtaacataaattcagagccctctctcacttatgataccaggatgcagtaacaatctcttttccacacctgactgcatgaaggatttctggttgatgcaaatctggtgccattcttatttctaacctgttcactttcattgaaaaggcaaccattgattgttaagaaagaaacagtgtggggaacagcaggaaaataatgttgagaagtttgatctagtagctagctgatctggtacactggacaccaaatcccttcttcctccacttctatcccatttggaaagagtctggcaggtaagaaaattggaatagaggaagtggtgttgaatgaaggaggagaggaaagaaggatggaagaaaaaaaagaaatagaagaaaggtacttagaagaggattggaggaggcaatatagacagaagaccttccttggtcattttagagttgggattgccatcaagccatcctacccattaactcttgagtcccaccataaccattgtattcatccgttcttacgctgctatgaagaaatatccgagactgggtaatttataaagaaaataggtttaattgtctcacagttttgcatggctcgggatacctcaagaaacttacaatcactgtggaaggcacctcttcacagggcaacaggagagagaatgagtgccagcaggggaaatgccagacacttataaaaccatcaaatctcatgaaattcactcattatcatgagaacagcatggggaaaaccgcccccatgatttaattaccaccacctggtcccgccttgacacatgggaattatggggattacaattcaaggtgagatttggatggggacacaaagccaaatcatattacctataaattttatagacttttccctactatctctcttcttatctgtaggatgttggaagtctgcatgactatcttacaattttacaaccatgttgatttagaaagttattctgtatctgcaatgtttttgcctaaaatattggattcaaatataatggtggtctcttccattaatgaatttattttgttttatgtatttggggataggacaattggaggtcattatgtcacacagtaggtatataggcatttgcttctttagccaatgagcctggcaatgtgtctgaagggagaaaccttaagggagcatattctgggttctgaagttttgtctcttctccttcaagtaccgaaatagctccaaagaatcctctgctctagatgagagcccagctatttaaaacacagctctagtttcagagacatgttatttgctgattaagtttgggagtaaattgtgtattttggtgaactgattatagtgttgattattattaaatgatactcatagtctcttctcaaaatgggaatttttatggatgagtgtagtggccttgagtatattgaacacataaatgcctgagtaggggcacaatatattaagcctaaggaatggttctggaaagtgagaaatcaacgagagctaaaatacatttgggccaaaactcaggtctggatgagtacagctaatatggtacagatggagtagatgtgttccctacctttccgtgagagaaaagaaatagcaccataaactgcagtagccagctctattatagacatacatcaaggcttgtgtaggctttactcctgttagctgtgttactagtgtgctcaattcaggtcagctatgctgggctggagtgagacttgtttggtttactgtaatcttgaggtgtctggtaggctgaaatgggctttgcaaggctgggatagcctgccttagctcatgctccatttgaggtacgctggaatgggtaggctaactgggctgcagtgggggtaagtagggctgacagaagcaggaaaagaaaaactcagtagtggaaaaacttcacttctctgggtagctgctgttctggatgtatatatacttatataacttatatactatactatacttatagtatataagtatataacttatatactatactatacttatagtatataagtatataacttatttataagtatatttataactaacttataagtatataacttatttatatactataaacttcacttctctgggtagctgctgttctggatgtttttgtctccccacaatctgtatgctgaaatttatagtactaagtactataaatacttagtactaagtactatatagtatataagtactatatagtacttaatactatagtattaagatagtactaagcagtgaggcctttagaaggcgattaggtcaggagggctccaccctcatgattgggattagtgctcttataaaagaagcttgagcaagctccctagccccttccatcatgtgaggacatagaaggcaccatctatgaggagtggaccctcaccagacactgaacctgctggtgccttgatctaagacttcccagactccagaactgtgagcaatgaatttatgttctttataaattacccagtctaaggtattttgttgtaacagcctgaatggactaagacagtattaatttccaatttggcaaatatgtggtgtgtgatgagattaatccattcatgcaaaacttgatgtttagtgagcaccatctgagtcataaacctttcagaagctcttgggttaggtgggaagattgacaagtaaaacaaatggttacaatgaaggaaagtaaatgtaaagagtgtatcaaatgatatcagttgtctccaaatatgggacaattaacccccccaaaaattatttctcattcatgcaaagtctattgtggatccaggcaactctccagggcagtgctcctccatatattagctcatcattccagactttttcaattttattgtagcaccacagcaatgtgtgtttttacgatcatcatggcatggagggtcttgcattagacatcaattgttccagccatgagagacacatattactttctcccacatccagaaccattcctattgcccctctatattttaaaaaggcaggggagtggaagaacaatcatcctatgttcctagaagtggaagagtgttggatattgcaacatttgtaacctactacaggtaagggtaagcccagtgagagctcagctcttgtgaatgtcagggatctctaagggccctatctaagctttgttgttttggtattatgctgtcattttcaatgatactaaagggatagactttgagtctgtacctagcatgttccctgtgaagagatagcacagatgagaagtttttgaggggttttcctttctcagaagtagtaagttggctgtcattcagagtactgcactggactctctctgagctaagacaaaagcctttcctgacattctgcttttctactttctttcacgcagatgcagtgactgaagtgaagactgacatctacgtgaccagttttggccctgtgtcagacactgacatggtaagttcttgcaaaggtaaatgtaaaagaggatgcactagaccaaagaaaataaattggagctttcctaaggcagggccttgtagctatattctaaggagtggtcttttctcatatgaatttcctaccctcgccaccctacgtttagccaaatccatctttgccctgctctccccacctattcacatataatgtatatacccctttcaggagtgcccttatctttctcccacgacacatctttcaaaagtttgtttggttccctatccttaattaaagcttccctgacttctcccttcacactctgctggcaccacacatattggtacaggtaggtcatatgaggagagaattgtggtggggattctcagtaaagcagctggtggtgtcatccaagaagtctgttccttgtaactgggtttcatccactagggacatggactggccagaatgatacaaacagtttggagaaagaatctaaatcacttctggaaactattctttgtacagatttgggcatggagagagcttcattgcagactcaaaatatagagcagggcacagcagaacaagcaagggagtggccccttttctcaccattatccattgtattcaaaacaaagagtacagtggagagttgaagcagaaggcctcactcaaatagataccctatcgatatatactgagtatcaaatattcaattgaataattatgatttagagacacaaaaaagctattatctgctttgtatacctggccattattagatgttcaataagtttttgttgaatgactgactttgtgttgcaagcaaaaatcctagtatcagggaaaatatgtttgaagataatgacatgcccatgttcactatttagagtttttttctgtgtgtctattttcagtgggactactacttggcaggggacaaagcttctttccgcctgttggactaacacaaacagttgtgtagggaagtggtagaggttttcttataggtaatgcagagccattgggtggattttgttaggacagtaaaaatatatgtgttgttttggaatgattgatctggtgatctgtgcaggatggagtacaaaggggaaaaggctggagcctgagagttgatttaggcccgttgattttacatgactcttcaatcaggtgcaaggtctatgagtcaattggaaaagctggctagttctcaggagaagaaatcatcagtatgtgaatgtttggaaggccaggcatgggtaaaggagaggtctgaaccttgtctttcaagtgtagagtaaagagaagggtacattagacttcctttgaactcctcgagggcaagtaccaagtctccatggcttccctggcacttaacagcatttgacacacagggagagctcattaaggggtatgtaagatataaggaatggaggagatggttctctcttagggacagcaagaaagcctgtatgtctccattgccctctgtcaacttgttgactagtaattcccacaggcatgtgttaaaatccaggcatgtgttaacattgttgccagttggccattcaacaagtactccttacgagcccaactatgcattaaaggctctaggaagccctatattcagagatctcacagcccatcagagacaaccatactcaccaggtgtatgtagctctttttctattgttaggaattaaattaggatatttataaaaggataaatgaagtgactcttctcacacacacatacactcactcactcattttcattcatgcaccaacaaccataaataacattcagacaaatatacatacacataacaaatacatatagggtacacagcccacacactattctaggcattctgtagaaacacatatgcaaacagatacctaaacccaggcataccagagaaggacacacacagtccctgttccaaccagctcctcactctgctgcttcctcaccatagcaggcgtgtatgggtgtgtccaggctctggagacgtttctaacaattgggactttctgtctatgtctcttgaagtttcatgttataatttgcttgtttgtttttattcctcattatttagctgaagcaacagaatggcaccttcctgatagagagggcagactttggtcaaatgaatttcacattatttttagccgcatgtccatccagtcacaaggcagaatagctacaatcattctggctaaaaagcatatttcgggtgttttgagaaatgtttttttttctgtgctactaagtagactgttcaattgatcccagggccagggatgcatttgggtaaagctttaggcagtcttctgactttggcaactagtttcaccaagaacccaggctcccctgagaccacagactacttggaaaagttgatgaaaatttgggctgcctgggttcttggctcatttccaggaaaagagggcgtttgggtccaaaatactttcctaaggaaatagaggcagtcttttgttcacaaagggggaaaattacgctgccactttgaacattgacacaccaccacccataatattttacatccattacgttccttggccaaacactggcccttacagacacagcttctcagcttttttgacaaaagctccatgaaggtataagccatgtctgttttgttcatctcaataccataaatgtctgactcagtgtttggtacatggcaaactcccaactttttattaagtgcaagaataaatgagaaggaacaaatcaaatctgagggaaaaataatgactgtcttcctccacttagctgaaaaattttcaaggacagaaaacatgtcagggacatctctggttctccagcatttagcacagaacctgacagaggtcctctgtatgtgtttgttgagatgaaattaaacattaatagcaagccctgcagataaagagtgaaaatagctttcctcaggagacattagtgattattaagactggtgactcaatgattgatgattccaagcttcagctactaggtttggtggcttctccattcatgaatataaggaactatgacagtagggaactgagcaaagatgaaagctaaacagtggtagatgtttctaaggagaaagtcagagggaaaaaaaagaaatttaatttagagtacaagagataagttggaaaatggttgccctggcagtttcacaggcttgtggtgaggctggtgttattcatttgcaacaaattgagcttgctggtcacacaaagcatcatagctcctcagtagtaatgccaatcctgtgtccatgatctcctaggagagaaacagaacaaagaagactatcccaatttgagtgaactggggccatgcaaccttctataattatctattattaggagagtttagaccattttctccatcagatgtataggaagagggtggaaatggcaataagagaaaggttgcaaagaattagaatgcagagacagtgggcaagtggcttaggaatatcattctaggcatattgtcagtcactggaaaggaaagcagaaaagtaacagctgagaaaaacattggctgctcttctatctggtccaaattcccttctgacctagcttccatcctagctctcaagatcctaaggctccaggcactgctccaccttctcttctagtccctgagcatgtcagaggtgcaggaacccagggtcccatggtatgtaattaacaagtatttgtctgaactataccaagaaaactaatgagaaaataaagagggaaaagaggagtaatgttaggagagtcagggagataataactgggaaacttaaaatgccaattttaggtattattaacctcaccctctccccaggaatactttgcttagatcccactaggtgccagctagtgccactagtgtcagctgccacagagaaatttcctaggatatacagtggacaatcaggtaatggtgcaagtatacaatacaatgaaagaactaaccatctagcttaatgagaaaaacaaaatggaatcctgggaaataagaacacagaaaaagacattatagtaataattctagacaacagattcagataacgtacattctgatatgacaactgcttatgaaaattatgccattatcctagtatccaaacaccatggagaaaaaaaaattgtgttaattaaaaggagaatagcacagggatctctttcctggtggcagtagaattgaaattattgtacctgttttctctctagtgctagaaaaagtagctatgtctacttcaaactctcccttactggcagtctgaggcacagactggatgagaacctttgtctattttaggctgtcaatttattcttattccacaggatatggcattgcagatgcaatatagaaaggaatctatgtccttgagctttttctaggagtctatgaccaggaatctccttggatatttttacgtaacatagagagccaggaaatataaacaatgccaataagagagggatgccctctctcaccactcctgttcaacatagtgttggaagttctggccagggcaatcaggcaggagaaggaaataaatggtattcaattaggaaaagaggaagtcaaattgtctctgtttgcagatgacatgcttgtatatctagaaaaccccatcatctcagcccaaaatctccttaagctgataagcaacttcagcaaagtctcaggatacaaaatcaatgtgcaaaaatcacaagcatccttatacaccaataacagacaaacagagagccaaatcatgagtgagctcccattcacaattgcttcaaagagaataaaatacctaggaatccaacttgcaagggatgtgaaggacctcttcaaggagaactacaaaccacttctcaatgaaataaaagaggatacaaacaaatgtaagaacattccatgcacatgggtaggaagaatcaatatcgtgaaaatggccatactgcccaaggtaatttatagattcattgccatccccatcaagctaccagtgattttcttcacagaattggaaaaaactactttaaatttcatatggaaccaaaaaaaagcccgcattgccaagtcaatcctaagccaaaagaacaaagctggaggcatcacactacctgacttcaagctatactacaaagctacagtaaccaaaacagcatggtactggtaccaaaacagagatatagaccaatggaacagaacagagcccttagaaataatgccacatatctacaactatctgatctttgacaaacctgacaaaaacaagaaatggggaaaggattccctatttaataaatggtgctgggaaaactggctagccatatggagaaagctgaaactggatcccttccttacaccttagacaaaaatcaattcaagatggattaaagacttaaatgttagacctaaaaccataaaaaccctagaagaaaacctaggcaataccattcaggacataggcatgggcaaagacttcatatctaaaacaccaaaagcaatggcaacaaaagccaaaattgacaaatgggatctaattaaactaaagagcttctgcacagctaaagaaactaccatcagagtgaacaggcaacctacagaatgggagaaaatttttgaaatctactcatctgacaaagggctaatatccagaatctacaaagaactcaaacaaatttacaagaaaaaaacaaacaaccccatcaacaagtgggcgaaggatatgaacagacacttctcaaaagaagacatttatgcagccaaaagacacatgaaaaaatgctcatcatcagtggcaatcagagaaatggaaatcaaaaccacaatgagataccatctcacaccagttagaatggcaatcattaaaaagtcaggaaacaacaggtactggagaggatgtggagaaataggaacacttttacactgttggtgagagtgtaaactagttcaactattgcggaagtcagtgtggcaattcctcagggatctagaactagaaataccatttgacccagccctcccattactgggtatatacccaaaggaatatacatcatactgctataaagacacatgcacatgtatgtttattgtggcactattcacaatagcgaagacttggaaccaagccaaatgtccatcaatgatagactggattaagaaaatatggcacatatacagcatggaatactatgcagccataaaaactgatgagttcatgtcctttgtagggacatggatgaagctggaaaccatcattctcagcaaactattgcaaggacaaaaaaccaaacaccacatgttctcactcataggtgggaattgaacaatgagaacacatggacacaggaaggggaacatcacacactggggcctgttgtggggtggggggaagaaggaaggatagcattaggagatatacctaatgttaaatgacaagttagtggttgcagcacaccaacatggcacatgtatacatatgtaacaaacctgcacattgtgcacatgtaccctaaaactttaatttaaaaaaaagactatttcatggactaaatacatctgaaataacgtatcaattatgtttcttcaaaatagagaatgatgaagagaaggcgaagagtagaggaaagatgggatggccaaaataagagggagtggcccttgtaatgggaaaatggcaaggccttcattgtaatgcagttatcacgtgccttggccccatacactgctaaagctgaataaactttgcaggctttatctgggagcctgctttgacacatcgaacagtgttagagagttgaagccattcaagctctaacaagacagaaatgcttccccaagaactaagtgtcatctctgccctgtgtagaaaatgtattaagcgtctttcccaggaggcagactcaggcttattatctggaagatgtgatttaaatgcctcacaaaacaacagaattcatttgtcaatttctaggcagtcatccttggagcgtatacaagggatcaatttgcaaggaaggaattgattacatttctagaatggttaggtcaaaatctgattgcttttggccaaaggtcatggaatacttgtggagcaaataatcactttgtgattttccccagtagttttgactgtgtagagaaaatttcctatggtatacagtggataatcaggggggaaaatggtgcaagtatacaatacaataaaagaactgaccatccagcttaatgagaaaaataaaatggaagcctgggaaataacacagaaaaagacattatagtaataattctagataacagattcagataacatacattctgatatggcaactgcttatgaaaattatgccattatcctagtatccaaacaccatgcagaaaaaaaaaactgttaattaaaaggagagtagcacagggatctctttcctggtggcaatagacttgaaattattgtacctgttttctctctagtactagaaaaagtagctatgtctacttcaagctcccgcttattggcagtctgaggcacagactggatgaaaacctttttctattttaggctgtcaatttctctgtgtagagaaaaaatagatatgatcatccaactttttaaaatcttaaaaatgagtcaaatgtctttttatggcatattatctaaaaaataatatttaaagatacaagcaaaattacctgtgtaccttaccctgataccatttccctgtttccctccctcctcaaagatattcacaaccgtgaagttgcttttgtctttttgtcatttatatgcatactttataaataagaatgtgtatatcacatacattcataaataacaaatagtggcttttgtgttttgaaacttttatataaaactcatccatagcatgtgtatcattatacaacttattttttaccacgtattaaaaactctacttttttgtgtattttactctaattcatttattttaactatcaaagattattacattgtatgaatatgtggtcatacattcatccattctcttgttaatgtgcatttgggctgtttccttttttggctattaaaaagcagtaatacaacaaacattcttgtacacatatttttgtgaacattttttaatttctttagggtgtgtacctaaagataaaatttgtggtttgttagggcttgcacatttttaacttttttcagtttagggccaaatactcttgtgatgaatcatatcaatgtataatctcaatagcagtgtatgagagctcaatttctctgcacttttgctaatgcttcgtattgtcatactttatttttgacactgtgatgggtataacatggtatctaatttattttgtttgcatttttctgattacctttggtgtttaagcatctttttatatgtttagtggtcaatctgtacatactaaagacaagatggctttgccaccacctgcatcagcaaaagtataaactctaggcaaccttgtttcttcatattgccacttttgtattaaagtttcctgtgggctgtgtgtgtgtgtgtgtttaataatgaatgtatttgaaattttgtaactcttcctttggcctgtattaagatgattgcatgaattttctcctctaatatgttaatgttattaattacatcaatagatttcctaatattagaccatcttttcattccttaaaaaaatcggattttacagggaggtattcctttttatacatgttttagttaggtttactattattttattattagtatttgtatgtgtgttcataagtattcccaaattaactgtctctcattcatatctagccatctatatctatcctataaatatatatataaatgatttatttacaggatataaatatatttatttatttatttattttgagatggaatctcactctgttgtccaggccggagtgcagttgcacgatctcgactcactgcaacttctgcctcccaggttcaagcgattctcctgcctcagcctccccagtagctaggattacaggcacgcgccaccacacctggctaatttttgtatttttagtagagacagggtttcaccatgttggccaggctggctcatctcgaactcctgatcttgtgatctgcctgccttggcctcccaaagtgctgggattacaggcatgagccaccacagccagctctatttatttgatatttaaaataaatatgtaaatatatattttatatttaaaataaatatgtaaatatatattttacatttaaaataaatatgtaaatatatattttatatttaaaatatatatttattatatataatattaaatatatattatatattatatatatttatatataatattaaattatatataatttatatatataatttatatatattttattatatataataaaatatatataaattatatatatataatattatatatataaattatatatataatattaaatatatataaattatatatataatattaaatatatatattatattatatatatttaatgtttaaattaaataatatatgatacatgtatacatttattatatatatgaatatatttctataaatatattcatatcctataaataaatatatatgtaaaacatatgccacacacacaccccaaagtagaaaaaaatagtgtaattgggctccatgtacccatattcttacccctacccataacaattctccctgtctcgttttctcaattaaacttatcaaaatttttgatatcattagtgttttcaaagtaacctttttttgttttgttcatcatctgtattatttatttttgttttctgtttcactgatttgtgctcttatctggatcatctctttctttactttccttggggtattctgtggtccttttggtttcctgaggtatattaacttattggttttccttttccttaaaggctatctttaagccatctttatgaatatcaatttccctccaagcaccactttaagagccccaaacaagatttcatatgtaaacattttcactattgttcacttctaaagattttcaaataatctttaaggtttcttttttgtttcttgaaatttttttagtgtttttcaatttccaactataaaactttttgttattgattcttaatttaatgcctcatattgaaagagaatgatctgtaggatgtaaaacctttttgtgtttcttgagatttgtcctatgtcttagcacgtggtcatttttttttgtcgggggtggggtgggaagtaaatatgctgtgtgtgttttactaagtgttaagtagataagtttatgagtgtttattagctcatccttaccaactgggttgttctaattttttaaacttacaaattattggtctgattggtctttcacttatcgtgagtctaaaggtttgttgatttttccttgtaattcaattttttgcagtagatattttgagtacctgttattgaaacatacaaagttagagttgttactttttccactcaagatactccatctgttagtgtaatgatattttatctcaaagaggatttttaatatgcccttttgtctgtactttacagctctacctttatgattttcctacacatatttgtccatcacagtactttcaaaccttctgtgtttttatgtcttcagatgtgtctcttgtatgtacatagcatatagccacattgtgtttccttcagtaatatttatttatctattttacttatagaggtaaaataatacatatacactttaccatctttaccattttgagtgtacagttcagtggtaataaatatcttttgttcttttttgtcctgtaatctgtcctccctactacccttcccctgctctactaatcatcattctattctctatcttcattagctcaaactttttagctcctacatgtaagtgagaatatgcaatatttgtctttctgtgattaccttattttacataacgtaatgacctccagttccatccaagtttctgcaaatggcaggatttcattatacttaaggctgaatagtatttcattacatatacataccgtattttctttatgcattcatccattggtgggcacttaggtcaatgccatattttggctattgtgaatagtgctgcaatcaacatgggaggacaggtagctcttggacatattgatttcctttctttttgatatgtacccagtagtggatttgcaggatcatatggtagttctatctttaatattttgaggaatctccatactgttctccatagtgtttatactaatttacatttccaccaacagtgtataagctttcccttttatcgcatccttgcaagcatctgtaattgcctgtctttcagatagaagccattttcactgagatgaggtgctatctcgttgtggttttgttttgcatttccttgatgattagtgatgttgagcgtttttcatacacctgttgggcatttgtatgtcttctttagaaaaatgtctattcagatcttttgcccattttaaaacaggattatttatttatttatattttctattgagttgtttgagcggcttatatcttctggttgttaatcccttgtcagatggtgtgttagtccattctcctgctgctataaagaactgcccaagattgggtaacttataaagcaaaaagttttaattgactcacagttccgcatgactggggaagcctcaggaaacttaaatcaaagcagaagggaaagcaagcacatcccccttcacatggttgcagggacagcagtgctaagcaaagggggaaaatccccttataaaaccatcaaatctcatgagaactcactcactatcatgagaacagcatgaggatacctgccccctgattcaatttcctcccaccagttccctcccaccacacgtggggattatggaaactacaattcaaaatgagattcggatggagacacagccataccatatcatttcacccctggcccttcccaaatcttatgtcctcacatttcaaaacataatcatgcctttccaacagtcccccaaattattaactcattccagcattaactcaaaagtccaaatccagagtctcatctgagacaaggcaagtcctttccacctacgagcctgtaaaattgaaagcaagttagttactttctagatacaatgggggtacaggcgctggataaatacatccattccaaaggggagaaattggccaaattggcaacaggccccatgcgtgtccaaaatccaatagggcagtcattaaatcttcaagttccaaaatgatctcctttgaattcatgtctcacatctaggtcatgccgatgcaagaggtgggctcccacagccttgggcatctccacccttatggctttgcagggtacagtccccctcccagctgctttcacaggctggcatcgagtgcctgcagcttttccacgtgcatgatgtaagctgtccatggatctaccattctggggtctgcaggatgctggctctcttctcacagctccactaggcagtgccccagtggggacctgtgtgtgggatccaactcgatcattcccctttcacactgccctaacacaggttctccatgagggctctacccctgcagcaaacttctgcctggacatccaggagtttccatatatcctctgaaatctagacagaggttcccaaacctcaattattgacttctgtgcacctgtaggctcaacatcacatggaaactgccaaggcttgggggctgcaccctccaaagcaatggcccgagctatacattggccctttttagacacagctggagtggctgggatgcaggacaccaagtcctgagactgcatacagcagaggggccctggacctggtccaggaaaccatttttccctcataggcctctgggcctgtgatgggaggggctgccataaaggtctctgatatgccccggaaatattttccccattgtcttggcaattagcattcaattcctcattacttacacaaatttctgcagccagcttgaatttctccccagaaaatgggtttttcttttctatcacattttcaggctgaacgttttccaatcttctatactctgcttcctcttgaacactttgctgcttagaaatttcttctgccagatacactaaatcatctttctcaagttcaaagttccacagatctctagggcaggggcaaaatgccaccagtctctttgctaaagcatagcaagaattatctttattccagttccccccaagtttctcaaccccatctgagaccatatcagtctggactttattgtccatatcatcatcagcattttggtccaagccattcaagaagtctctaggaggccaggtgcattggctcatgcctgtaatcccagcactttgggaggcctaggcgggtggatcacctgaggtcaggagttctagaccagcttggccaacatggtgcaaacctgtctctactaaaaatgcaataattagccaggcatggtagcaggtgcctgtaatctcagctactcttgggggccgaggcaggagaatcgcttgaacccgggaggcagagattgcagtgagctgagtttgcaccattgcagtccagcctgggggacaaaagcgaggctttctctcaaaaaaaaaaaaaagaagtctctaggaagatccaaacattcccacatgttcctgtcttctcaggcctccaagtctccaggaagttccaaagtttcccaaattttcctgtcttttttttttttttaagttggaatctcactctgtcacccaggctgaagtgtagtgatgcgttcttggctcactgcaacctctgcctcctgggttcaagtgattctcctacctcagcctcccaagtagctgggatgacaggcatatgccaccgtgcctggctaatttttgtatttttagtagagacggggtttcaccacgttggccaggctggtcttgaactcctgacctcaagtgatccactggccttggcctcccaaagtgctgggattacaggtgtgagccactgcacttggcctttctgacttcttctgagccctccaagctgttccaccttctgcctgttatccagtcccgaagttgcttccagattttcaggtatacttacagcagcaccctagtacctcctggtactaaggtactgtattagtccgttctcacactgccataaagaactgcctaagactgtaatttataaaggaaagaggtttaattgactcacagttcagcatggctggggaggcctcaggaaacgtacagtaatggcagatggggaagcaaacacgtccttcttcacatgctggcagaagagagaagtgtcaagtaaagggggggaaagcctcttataaaaccatcagatctcactcactcactatgacaagaacagcatgagggtaactgccactgtaattcaattacctcccacgacacatggggattatgggaaatacatttcaagatgagatttgggtgggtacacagccaaaccatatcgtatggatattttgcaaatatttcctcctgttctgtgggttgtctcttcactttgtgaagattgtttcattttctttgcagaagcttttgaacttgatgtaatccacttgtcaatttttactttggttgtccatgcttttgagtcttatataaaacatctgtacccaggccagtatcatggagcatttccgcaatgttttcttccagtagtttcataattttaagtcttaaatttaagtcttcaatccattttgattttattattgtgtgtgatgagagataggggacgagtttatttcttccacatatgggttattctgttttcccagcactatttactaatgagactttccttcccctgttgtatgttcttgctgcctttgttggagaggaattttctgtaaatgtgtggatttatatctgggttctccattctgttccattagtctatgtatctctgtttatgccagcaccatgatgtggtgtttttttagtattgctttacagtaagttttgaagtcagatactgtgatgcctcaggctttgttctttttgctcaggattgctttggttattcaaggccttttgttattctacataaattttaggattcgtcttttctttttctgtggagaatgtcattggtatttttggtagggattgcattgatttgtaagttgctttgtgtaatattgtcattttaacaatatcaattctgtcaatcaatgagtgtggtatatctttccattttttgtgccccttcaattcctttcatcagtttttaaatttccttgtattgatctttctatttttgagttagattgatttttaggtattttgcattttttgcagttattgtaaatgggattgccttcttgatttgtctgacattggcatatataaatgttactgtttttgaatgttgatttcatatcctgcaactttatggaattcatttatcagtactaacaattttttgttggagtctttaggtatttctaggtataagatcatattatctgcaaatgatgctccataggcaacaaaacaagtctgaacaatttcaaggaaatagaatttatatcatgtatcttttctgtccacaatggaataaaactagaaatcagaaacaagatgaacattttaagctacacaaacacatggaaattaaagaacatgttcctgaatgaccaataagccaatgaaaaaattaagtagtaaatttaagaccaggcacagtggctcatgcctgcaatctcagcactttgggtggtccaggcacaccgatcccttgagctcaggagttcaagaccagcctgggcaacatcacaaaacctcatctctacacaaaaagtacaaaaattagccaggtgtggtgacatgcacttatagtctcagctacttgggaggctgaggtgggaggatcacttgagcccagaagattgaggctgcagtgagccatgttcatgccactgcattccagcctgggtgacaaagtgaaaccccatctcaaagcaaagtgtattagtccattcttatgctgctaataaagacatacccaggaatgggtaatttataaaggaaagaggtttaatggactcacagttacacatggctaggaggcctcataatcctggtggtagacaaaggaagagcaaagggacatcttacatggtggcagggaagagggcatgtgcaggggcactcccctttataaaaccatcttatctcatgaaacttattcactatcaggagaacagcatgggaaaaacccacccccatgattcaattaccttctaccgggtccctcccatgacatggaattattacaattgaaggtgagatttgggtggggacacagagcaaaaccttatcacaaagcaaatttgaaaatgtactgaaacaacaaaagtggaaatacaacataaaaaaaatctgtgggatacagtaaaagcagtactaagagtaaagtttacagcaatagacacttaagtgaaaaaaatagaaagacactccaaaaaaaacctaatgatgcacttcaaaaactaaaaaaaagtaagaacaaatcaaaccccaaattagtaggtgtaatagtaaagatcagtgcaaaaataaatgaaattaaaacaaaatatacagaagatcaatgaaaaaacttgtttttttgaaaagataaaatcaacaaacctgtagctacactaagagaaagagagaagacccaaataaaatcagaaatgaaaaaggaagcacaagtgagatctcagaaataaaaagaataattccaaactattataaacaattatacaccaataaattggaaaaactagaagaaatggatacattccttgacacatacagcttactaagactaaaccatgaagaaagagaaaaccccaataaaccaataatgagtgatgagatagaagctataataaaatttctcctgtcaaataaaacccaggacctgatggctgcattgcttaattccagcaaacatttaaaaaattaataataccaattcactcaaactcttcaaaaacttaaagagatgggaatatgtccaaactcattccacaaggccaatgttaccccaatgctaaaaccatacaaggccacaaaaaaagaaaactagaagccaatatcactgatgaacctagatacaaaaatcctcaacaaaatactagcaaagcaaatacaacaatacattaaaaagtttattcaccataatcaagtaagattcatcccaggaatgcaagaatggttcaacatatacaaattaataaatgtgatgcatcacattaagggtgtcaagaacaaaaacccatgtgattattttaatagataccaaaaaagaatttgataaaatccaacatccatttatgatgaaagccctcaacaaaatggacatagaaggaacataactcaaaataataaagctcgtatatgacaaacccacagttaacattgtgttaaacagtgaaaaaattgaattaatgtagttatttgttccactttgtttttacagctcttattgtcatttgtagatattcatatttgtttaggataactgtgtcaatacttatgctcaccattcctttttgcatctttctgctggctatatttttaaacacatgaagatcttcttttagtagttcttttcatgataattcattcaatcatctactgatttaaaattcttatagagcatctgctatacgctatgcagagttttatgtggtgtagatatagcagtaaacaaaacaaagtccctgctgtcatggagcttccaggctagtggaagctggctagtgcagtgtaaacaaataaaaaaatatttttttttcagtgctataaggaagaaaaataactcatggtaagaggaagggagattactattaatgataggatgttcaagcaatgcttcggatacagtaacttttgattaaaacctgaaggctgtgagtgattcagccatgagaaaacctggagcaacagtgaagatctgttcatggtaaattctctgccttattttacttatctaaaattatctttattttgacttcactcttaaatggtaatctaagtttggctatagaattctgaggtgatcgttacttttctgtcaacattttcttcccaggtttgtgggtttttatgatgaagggatgttgaattttatcaaatgctttttcagcatcaattgaaatgatcatatggtttttgtctttcattctatagatatgctgtatcgcattgactgaattgcatatgttgaacaatccttgaatcccagggataaatcccacttggacatgatgagtgatctttttaatgtgttgttgaatttggtttgctagtattttcttgaaaatctttgcatcaatattcatcagatatattgtcttgtagtttttttatgtgtctttgtctagttttggtatgaaggtaatgctggccttgtagaatgctcttgatataggattcccttctcctctattttttgaaatagtttgagtaggattggtattagttcttctttaaatgtttggtagaattcatcagtgaagccatcaggtcccaggcttttctttactaggagtctttttattatggctttgatcacattacctgttattggtctgttcaggtttggatttcttcatggttcaatcttggtaggtttgtatgtgtcttagaatttctcaatttcttctagattttccaatttattggcaaatagttgctctcagtagccaataatgatcctttgaatttcttccttatcagttttaatgtctcctttttcatctctgattttatttcattattctctcttttcttcttagtctggctaaaggtttatcaagtttatcttttcacaaacctactgtttttcattgatcttttgtgctgttttatttattaaagtttcatttatttctgctctgatctttattatttcttttcttctactaatgttgggcttggtttgctcttgttttttctagttctttaagatgcattgttaggttgtttatttgaagtttttcttcctttttggtagaggcacttatatctataaacttccctcttagcactgctttcactgcatgccataggttttggtatgttgtgtttgcattatcatttgtttcaaggaatttttcaatttctctcttaattccttcaatgacccattggtcattcagcagtatgttgtttaatttccatgtgtttgtgtagtttccaaaattcctcttattattgatttctggtttttttccattgtggttagagaataggcttgatattatttcaaatttttttaatgttttaaggcttgttttgcagcctaacatagggtctatccttaagaatgtcccatgtgctgaggaaaaaaatgtgtattctgcaaccattggaggaaaagatctgtaaatatctattaggtccatttgatctatactgcagattaagtccaatgtttatgtgatgattgtctgtctggactatctgtccaatgttgaaatgagttattgaattctccagccatcattgcatagggctccatctctctctttaactctaataatatttgctatatatttctgggtgctccagcattgggtgcatatatatttacaattgttatttcctattgctgaattgaaccctttatcattatatagtgaccttctttgtatcttcttatagtttttttcttgatatctattttgtctgatataagtgtagctactcctgctcttttttgctttccatctgcatggaatatctttttccatccctttattttcagtttacatgtgtctttaaaggtgaggtgtgtttcttttaggcaacagaccactggctcttgcttttttcatccattcacccactgtattttttttattatagcatttagtcaatatacattcagcattattagtagtaagcaaggacttacttctgccattttgttatttgttttctagttgttttgtggtcttttcttccttttttcttcccttcttgtgattgttttactgaaggtgattttctctgatgatatgatttagtttcttactttttactttttaagtatccattgtatggtttttggtttaagtttaccaggaggtttgcaaatactatcttatgccccgttatttaagctgatgacaacttagtattgttcccataaacaaacaaacaagcaaaaagaaaactaataaaaattctataccttatttgttcccccactttttaactttttgttgtttctatttatatcttattctactgtctatgtcttggaaagttgttgtagttattatttttgattagtacatgattgaatctttctatgaagataagagtagtttacacagcacagctgcaatgttatagtattctgtgtttttctgtgtacttagtaacaccagggagttttgtaccttcagattatttcttattactcattaatgttcttttctttctgattgaagtactccccttagcatttcctatagggcaggtctggttgtgatgaaatccctccgcttttgtttttctgggaaattatttatttctttttcatgtttgaaggatattttcaatagatttactattctagggtaaaagtttttttacttcagtactttaaatatgtcatgccattctctcctgtcctgtaaggtttccattgaaaagtctgctgccagatgtattggagatccattgcatgttgtttcttttctctagctgcttttataattatttctttatttttgacctttgggagtttgattatgaaatgttcttgaagtagtcttctttgagttaagtctggttgatgttctataaccttcttgtacttggataatgatatctttctctgggtttggaatattctcttttattgtccctttcaataaattttctacctctatctctttctgtacctcctctttaaggccaataactcttagatttgcccttttgaggctattttcttgttcttgaaagcatgcttcattgttttttattccttttacttttgtctcctattactgtgtacattcaaatagcctgtcttcaggctcaataattatttcttctgcttgactcattctactattaaaagactctgatgcattctccagtatgcctattgcatttttcagttcgagaatttctgcttgattctttttaactatttcagttaattttatctgatagaattctgaattccttctctgtgtgttattgaatttctttgagtttcctcaacacagttactttgaattatctctctgaaaggtcacatatctctttctccaggtttgttccctggttccttatttagtttatgatgtggtttagctgtgtccccacccaaaactcatcttaaattgtagttctcataatccccacatgtcacagaagggacccggttggaggtaattgaatcatgggggtgcttactctcatgctgttcttgtgatagtgagtgagttctcaagagatataaggggcttttcccccttttgcttggcacttctctctcctgccgccatgtgaagaaggatgtgtttgcttccccttctgctataattgtaaatttcctgaggcccccccagccatgctgaactgtgatttaatcaagcttctttcccttataagttacagtctcggatatgtctttattagcagtgtgagaatggactaatacagtaaactggtatcacagagagtcgggcactgttgtaaagatgcctgaaaatgtggaagagactttggaactggatgacaggcagaggttgaaacagtttggaggtctcagaagaagaaagaaaaatgtgggaaagtttggaactttctagagacttagagggctcagaaacaggaagatgtggggaagttttgagcttcctagagactcattgaatggctttgaccaaaatgctgatagcaatatgtacaataaagtccaggctgaggtggtctcagatggaaataaggaacttgttggaaactggagcaaagatgacttttgttatgctttagcaaagagaccggtgaaattttgcccctgccctagcgatctgtggaactttgaatttgaaagagatgatttagggtatctggtggaagaaatttctaagtggcaaagcattcaagaggtgacagagcataaaagtttggaaaatttgcacactggcaatgtgatggaaaagaaaaagccattttctgggaagaaattcaggctggctgcagaaatttgtataagtaacaaggagcagaatgttatttaccaagacaatgggtaaaatatctccaggacatgtcagagaccgttacagcagccccttccatcacaggcccagaggcctaggaggaaaaaatggtttcatgggccaggtccaggaaccccctgctccatgcagcctggggacagtgccctgcatcttcagttgcttcagctccagctgtggctaaaagaggccaaggtacagctcaggccatggcttcagacggtgcaagccccaagccttggcagcttccacaagatgttgagcctgcaggtacacagaagtcaagaattgagatttgggaacctccacctagatttcagaggatgtatggaaactcctggatgtccaggcaaaagtttgctgcaggggcagaacactcatgtataacctctgctagggcagtgtggaagggaaatatggggttgaaggccacacacagaattcccactggggcaccgcatagtggaagtgtgagaagagggccaccatcctccagaccccagaatggtagatccactgacagcttgcaccatgcacctggaaaagccacagacactcaactccagcccatgaaaacaactgggaggggggctgtaccctgcgaagccacaggggtggagctgcccaaggccatggcagtccacctcttgcatcagcatgacctggatgtgagacatggagtcaaaggacatcattttggaactttaaggtttaatgactgcactgttggattttggacttgcatggggactgtagcccctttgtttggccagtttctctcatttggaatggatgcatttacccaatgcctgtacccccattgtatccaggtagtaacgaacttgcttctgattttacaggctcataggtggaaaggacttgccttgtctccgatgaaactttgaatttggacttttgagttaatgctggagttagttaagaatttggggaactgttggaaggacatgattgtacttttaaatgtgaggatattaaatttgggaggcaccaggagtggaattatatgatttggctgttccctcatccaaatctcatcttgaattttagttcccctaatccccatgtgtcataggaggggcctggtgggggtgattaaattatgggggtgattacccttatgctgtttcatgatagtgagagagttctaatgaaatctgatggttttataagtggcttttccccctcttgcctggcacttcttgctgccactgtgtgaacaaggacatgtttgcttccccttctgccatgattgtaagtttcctgaggtctctccatccatgttgaactttgagtcaattaaatttctttcctttataaattgcccagcctcaggtatgtctttatttgtatcatgagaatggagtaatacagttcatttggtgagttcatgtttttcttggattgtctttatacttctagatgttcatcaggtctgggcattgaagagtatggtatttatcatagtcttctcagtctgggcttgtttgtacccctcctttttgggaaggctttctggatatttgaaaggacttgggtgttgtgatctaagctgtatctgttttagggggcacctcaagctcagtaacactgtggttcttgcagtcttttagagattctgccttaatgttcttagacagtatccagaagaattctctgcattaccagtcaaagacttttcttggcttcccttactaactttcaaacaaattaagtctctccctatgttctaagccacctgaagctgagagtggagtgacaaaagcacccctatggccaccaccactatgactgtgctgggtcagacctgaacccagcacagtattgggtctcactcaaggcttcctgtaactacttcctggctactgcctatgttcactcaaggccttggtgttctacaatcagtatatgacaaagccagccaggcctgtgtccttccatttggggtggtgaattcttccaggcccttggcagatctagacatgccatctgggagccagagactacagtcataaatagaaatctacctggtttttctcttgtactgcagctgagctggctcttaaaccacagcatgcagtctttcctactccaccttccccttttcataggcagaggagcctcacctcatggccaccaccaccgccccacaagagtaccgccagactactactgatgttcccttaaggcccaaaagctcttcagttagcttgtactgagtacttcctggcctgggactcacctttcagggcagtctcctccagtctggcccaaggcaggtccagaaatgctgtccaggaaccaagtcctcaaatcagggtccccaagagcctgcttgatgctctaacacactgaagccaagctcgtaccgaagattgaataaaaaaatcccatttacttttccctccacttttttcaagcagaaagcgtctagtaccatagccatcacagctgggaatgtactgagtctcacctgaagctagcaaatctcagagcctaatccaaggcctaccacatagtgtttgggtatcactgctggttattcagggcccaagggcactttagttagcaggtgataaatcctgccggggttcgttccttcctttcaaggcaatgggtttccttctgacccgctgtgtttctagaaatgtcacctgggagttagggcctgtaaaaagggcctcacaactctgactgctgccctgtcctgctttggctgagctggtatccaagatgcaagacaaaatcttccctactcttccctctcctctactcgagtggaaggaagcgatctcttttggagctgcgagctgtgcagctttgggttaggagaggaatgaagccagcactcccttagctgccctggctggtgtctccataggtcacatgtctccccacagtcagtccactggctctgggcccagtttagcactagaaatcacctacgagttgctgcccttgtggcctagactgctgttcatgtttacttagggctccagagcactttagcccaaggtggcaaggcttatggaaactgaagttgcaactgctgggatcagtgattcccctctggctagggctaggataaatactccctccatcggcaggcatcagctaagtttggtctggttttgctttctgttgtaacagggcagcactagttcaatgtctcacaattgctgtgttctccccctcgtcagtgtacagaacagttctccatgccacaccaccagtgacagcagattggggaggggtggtgtcagtgattcaagactgtttttcctacctcttctgtaactctttcagtgatatgtagttaaaatcaggcactgtgagtgctctcctgatttttaattcctatgaaggtacttttttgtgtgtgtatagatagttgttaaattggtgtccctgctgagtgggggagggacaatcagtggagccttctattgtgccatcttgttgtgccctcaacaacattttcaaagtgtatttttattgtctttttggtttctattgttgcatttaagaagtcaacataagtggtggttataagtcaagtggtcatatctatgtaggtagtatgtcttttctgttttgcaattttaaaaatctcttctttggtattctttaaattcattatgtactggctgggatctattgtaatgtattgagcttgcaattcattatggtacttgaagctaaggatgcatatatttcaacaattctggaaattgtagtccattactactttgaatattttttctcccctattttctcaaatctctcacatttagaatcgtaatacacgtatactgaaacttttgtttttatccttcatagtactatatctccctttcatatttcctatcagttatatgtcttaaatgtgaactgggcaatttttcctcatatgtattttccagttcactaatatctctttcataatatctaatcttcaatgtaacacacccactgaacttttattttcaatgactatttttcttttacagaaagtcaacttcaattagatatatctttttcaaatttgcttttactttctcccttcccctcataacctttataattttaattatagtttttttcataatcactactggataattatgttatatgaagtccttggaggggctctaattcagttttatcttgtatctgttgacccttacttgtaaccatttccttaggtgttttgtcattaaggacagtgaagtaattttcagcaagcattaatttgtggttctgtccttccagttttttgtgtgtttgctttggcaagtcaatctagtggtatacccagcttaagaccaatttttgtgttaagttttcagcttgtaaacttcagatcaggcagacagtatatattcggatgtcaatcccacatatgattagaattttgaggttgctacatttcagtagaaacactttctcctcaactcctccctcttcctttttgaacttttgtgttgtgatctgattttgtctagttaagttgatctagtttacccttttgctaagctcttaacagattcttggctttatgtgaaagtctagttccagcttctcatctgccacagtcctgcctcctcttcctcttaaaagtgttccagtttaggcaaccaattatatgatctttaaatctgtaggcaggaatgtttttggtctactaaaggaagagaaatgccagaatggctaatctttaaaggaaagagtgtttggagaataactcagagaggaaggcaagggccagcttatggcaaggaaaagttcatcccacatacgattggaagccattaggggattttaaaccaaagaatattcagcaaattctggctttcatttcttttaacctggctatctggaagtgtcccctgtgccttgtgtagttcagtggtcaaatatttgggcagatgttatactcagattttgggactcaccctctcagtggttctcttgttcccaggacatcctcatgaatttccatcttccaatccagagcttattctctgataagctaatactttttcagatttcctccacttgaattgtgatggattaaggaattccttcagtctaaatcgtagcaaattcacaaacatcacccagctcatttctttcatttagtggaccactatcttattgtttctgcctattttttttaactgggccccagggtctctcctatttgtgtgtagtatagtgatcagccggaatttttcggcagaatatatattcagatttggaggcccatcccttctgggattctcttacttttgagtcttccatccctaatggtccagattctctgccaccttgagccagtaagggtgttgtatatgccacaggaattctaggtttgggaagcaccttcaagaaagaaaaatcacaaactcacaattctaatctattgctgctgccatctttcaaaggtaaactcaccttaggtttctgtctgctttcagtcacgctccactgctttcaaggaatacaggtatatacagttgttgttcaggttttataattaatagctacaagaaaatgtaatcaaacaatttattatgctgttaccaatacctggaacatttattgttcatttattttgtatttagataaacagcaaatttgaatattttcttcacgtttattagcaatttttatccatttcatgactttgctgttcatttacccatttttatcttatttgtctataaggtatgttttttatcttatttatctataatatttcattatttattgaggataataagctatttgctaatcagacatattgttattttgaggctcagattaaatgtacgataaaatgtaaggttttggttttgtggcgatttttatattggcctttgatgttcatatggggtcattaagcagtagagacaaggtaagaaacttgttcttatttgggtgtcactgcatacaggagggagcacttgccttttcataaggcaaagtcttatgatcagcttgtgtgctgtgtggggatgtgttggcagttgtcttccttaaaaatgccttgtcaaatatgttatccccatgcttattaatctccatggcattatttctcaatcataatcattttccttacacaccaggagctactgttaatagactgctgcttctctgcatcagaggaaatactgcaaggtaattaatatttgctaagggcactatgagcccttaccagaactcaactgaaacattgttttctctcttttcacccctaggagtacactattgatgtattttttcggcagacatggcatgatgaaagactgaaatttgatggccccatgaagatccttccactgaacaatctcctggctagtaagatctggacaccggacaccttcttccacaatggcaagaaatcagtggctcataacatgaccacgcccaacaagctgctcagattggtggacaacggaaccctcctctatacaatgaggtcagagagtggtggttcccacccaaagtatattgggagtaggactgggcttgaaagcagaatgttttagagtatccattgaaaattccctcaagtgtatagattagaaatgtacaggtatgtatatacttcctaatacaattgcatgcatacatactcacagacatatatattctaataaacacataaataaagagttgcatagatgaacattttgagaaacacagaggtatacattcatgatttgtatatgcatgcatacctaaagacacatgtggactaacacagaaggacataatgtattcaaggacacttaaatacacagattcacaaaaacatacacacaggcatgaacgctgataattagaattgactaggtttaactgcaacaacaaactatccctatgatgcagagttgtgagaatcaaatgagataactatgggtattttgtgaaacatacagtgttttataaacataaatttaaaaatacttattttaattttttatttatttgaatatgtttattttatgctacattaccttaggatactgaggatgataataagtgaattttccaaacaatttaagattatatctctatctatctatacatggtgtttatatgtgtgtgcatatgtgtgtgtgtatatatagatatagaaatcttcataaaatataaattatatttcatacttttccaactcccaatggataaaaacatcacaattttatgtatttcataacttgttactgtcatagagttattaggcattgaattttgctgtcaaaaagaataaatttgaaaaaattttcagtgcaataagattctttccccaatactgaaaaacattcttggtttttgggtttgcttttttatgaatttgcttgttcctccgatatcagttgtcacttcctgaagcttccttccacattaatgagtgctaattttgtgtagtggagcttctatggctatttagaattggtgtatttgttattttgcagaacaaacctcaaataatgcatgcctggtaaataggtggtgaataaatgaagtgtgtttgtctgtatactaatctctcattacttcaaatttgctatttattggtgtttttcctacaagaatttggaagatgaggagatggtcaaggaaaaaaggataatacttcagagagaagttggatgagagatgggaggaaaaatgaacatagaggagaaatgagcatagagtggaggataaaataatgaagaaggaaagtggatagaagtgggaagatgagggtcaagaggggaggagaagactaattacacagagtacatagaggcatgtatattggagaaatgagaatggtgaaaagaaagagagtatgagaagagaggacaaaaagagtagagaagttgagaagacaaaggataagatggtgtaaaataaagaagctagattagatattaggatattctaaagagataggcgaatataatgaagtggatgtagtagatgggaataaagaggaaaagacatagagaagtaggggaagggacatgggaggagatgaacaagagggagggaaattgtagacgaaagaaagagaagctttccctcatttattcatttgccaaacatgttttgacttcctaatatatacatgaccctaaagtaaattctggaaatgcaaacattaatgagacataatctctgtccttaagataatcacaatataataggggagaaagactaataggataatagcaaattatgttaactaaaatgctaaagagatgggtagttattggaatatagagcagggtcatctaactcattgttttgggacaggttgagagaagagtccctggataaggcaacagctaggcttctgattattggtattagcattagcattttatattattatgtaagtagaatgcagtcaagaaacttgtaggtggataggtagaggcagaaggaagagaggaaggacgttctagacagagaaaaccaagtgagcagttgcagggaatggaaggacatattttaggcaagagactgaggtggtcagttttctatttcatatatggctctgtagttactgggtaaataatgcatttgaaggtaaaaagactggaattagataaaatgattaagaaacagctgaaatagtctagattagcagtggtgttctaattcagaacaatggattaagatggagaagtgacgatatgttaaggaaatcggcagtaaatatagaaaacttcagaatgacagagaggaggagttgtgaaggtagtaggtatccaaataacatgggtgaaagatggtactataggctggagtagatgatatgaaagttaggacaaatttagataagtctgtgaggttaatttgggacaagataagcttaaggtgattgtagattatccagggaaagaagtcttaacagcagttagatattcaagtcttaagatcaggagagagatacaatgtagagatataaagtgtggtattgttagtatattggaacaaatggaaacgtgaaaatggatgtcatcacttcaggaaagagtatagagtaagaagaatttcatgccaggtatctagtcatctagaactactatcagtaaggcagtggaggggaaagaggaacctatgaaagaaaccaggaagaaaatgtcagggagctgttaacaatgtgcagtatcatgaaagctaagtgtggtagtcaatattaccacttgccaatattttcacttcacctccatctggatgcaaagtagtactacacttccctgagccttgaagttcagcatggacaaatgacttgctttggctaaccaaatgtgagtgtaaatagtatgtgtcagctctgagagaggatgggaagcccctcaagagccaatacataatttgccatgttgccttcccctggccacagtaagtagcattatgccaggtggtcttggccctatcattctatgccccttattgaagatgacatagaagcgagtgggtcccacttccccaaccagaggtagtgtgagtgagaaataaacttccgttactttaggacactgagattttcagattgtttcctactgcatattaatctaacccatcttgactgataaattaaagtttcaaaacaatgagagttatcaataataacaccactaatagtataagtattattaattaacatcaatatagtacttaaaatatgacagacactgttctaatcattcttttataatattcataacagctttaacaacagtatgagataggtactattatcccaactttacagataaaaaaaaactgagacacgacgtgggtaacagaatttttcaagttcacttgggtagtagatggttgagccagcattattaatatggtagtgtagctgcaagttcatgcactttaccctgtttacacattttttacaacattgttggctataaaaagagatgtaatatagagacttaaaagtctgtcttaagtttggtaacatggaggatattagtgttcttcacatacactgtttcaatagagtggctagtgcaatggagagttttaggagttggagtggggagatagtgcacatagaaaataccttcgagaagcttgtttgaaaaatgaaagggagggaggtatcatagctacattcaggggtaaaagaaattgcttttgttttcagaggagagattgacacatatttgtgaggtagtacaaaagagtcagtaggaagacaaagatagaagatataggagaaataacacatcgctgacagcaagttctcataaataccatcaaggggatgatatcaaatctacagttagagttttacttgaaaggaagagggacacctcttctcacattgcatgaaaggttatgaggttatatataaatgttgaaatgaaggtggggaggataggacagagaaaaggtatgaatgagtgtcatatatcaaggagaatttggggaaacagagcattagggaaggaatagatggaagagaggcatgcttgtaataaattataggaaagagaagagtttgaaaaagagataagagttcacacaattgtggaaagaatggagtggagtatatgtaaacagaaaagaagctgtatggaatgaggtggatggagggacagaataatgaggaggagatgtggatgggcagaagacagtaagcaaatggaagagaagcaagaggaaggagagagtaatgggcaggaaaggatctgaacccagtagagattgcaaatagtgaggagaaatagagaatgaatgaaaagaacaggatagaggagaaacaacaataaaaggaataaagcatagagaataggtttaagttttggaggagggatagagaagagagaagaaaggagagaggatgggaatattgaaatacaaaaaaatagaaggtgcaggttgaggagggcagaggatgaagccgagcaaaggattagtttccttgaaatacagttgaatgaatgggaagatgatgataattgggccctttattctagtctgaattggacaagaaagtcaagttcgatgagattagagtctatgtagaatgcccttgtgcttattctgttttacagaatagaggaagtacagaagcacagaagcatgatgaagccatcggtttcctacacagtagcaccttggatccaggaaggtgggcctggagggagacataggctcaaaatggaaaaataaaagcctggctctttttacagccccacaattgattcacctagtgacctttctcaagtcacaaaccgttcactttctctagtctgataataatgtagctgctgccagtcttgcaggcatatgaaaagcacaaattgaataaggtctgcagaacacttagaatttttcagaaagtgttattctatagcacccctattattattttgaccctcaggaatcttatctggagtccatgggaaaactacagaaggacagcttcctactaaaatctgagcaagcattgcatgggtatgtaactagggcagtttagaaagaagccttgctttgcctcatcttgggacctcagaacaaccgtaaaaatacaggctaaaacccgttacctgctgcttacttcatcagcacacatactaaaattggaacaatgcatagataattagcagagcccagcccgagatgatacacacatttataaaatatgttctattattcaggtatggatatatagaaaacttcatctctattaatgtcatattatttgtatatgaggacacgggtaaacatgttcgttgtatataaatgttgcataatatataatatagtaaaaaagtcctattgactatctgaatatgaaggagaactatttatggaatttaactagattttatcctattgacttaaaacattcatcagcacattcacgagtgcttactatgtttaaagttctggaatatctgctgagctacagagataaataaggcacaggtcatgctcttaatgactctacagttaaagagacctgtgcacagatagctgcacaataatataaaattcctgaaatggaggtgcaaaatgtgatagaatcgcaggagaagtcacatctaaaatgatatagggttatcaaagaaagctgcaaaaggaggtgctgcatagtttgtcccttgaatcttgaaggaagtgtaggtgactgtcaaacaaatgagagacagggctgaggtagaggagggttttccaggcagaagaaatagtatacacaaagacatgtattcatgaatcgacatcatgcatcagaaaatccatgcttctttgtgagacatgataggggaaagagagagtactatgggagcatctaacaaggacagtgaaatgagtctgtggggtatagccacaataaattccagaggatatcaccttctgaatgatttctgagacctaaaagatctgtagaagtaaattaaaagacagggaggaaacattgcagagatagagcatagcatgtataaaggcttgaagagtgagaggagaaggtagtgatgatacattgaaggactaaaagttcagtgtgattggaccagagtacagtgcaggaaagcagtccgaggtggggagaggggcttatacgctatgttggcataaacatgatgaggatccactaaagactttattgcggaggaagaaatcaaacaaatttgcatttaagatagatcactctgggagcagtgtaggaggcagattagaggaaggcaaggctgaagatgaggtacctagctaagaagctgccataatactcaaatgataatcctaatgacaactacgtattatatatactgtgtatatgtagtatactatgtgttgaacacctactatttgttaggtactttacgtaaaacatctctaatcttcacaacacttattctagcttcatgttactgctctttccactaaattaggttttgaggaagaattgtgggcatacaatatgttcaagaggtaacattgatggcacttggtgcctaattggaagtgtggagttcaggaggttgtatggctggtttctacaagtaaataagttgcctaggataatggaagtattaggggtgtaatataaatgatgacccaattgttaacatttccgtagaacaaagaggagtaataagattttggaacatggcagtgataaagggagtaggaaatatagccaaatagcatacctatttggaaggatttgtgcatgacagatgagggatgatagtgaagaagtgatacagaatatgtttatcctgtagttacagggaagcattattgtttttacagatttatttatgttttgattgacatataaaattgtatttactgtgtacaacatgatgttaagtacatatacattgcagaataattaaatctagctaattcgcaaatgcattacctcacatagttaacgttttgtgatgagaacacttgacatccactgtcagcatttttcaagaatgcaatatatcgtcattattgtcagctagtcaccatgcagtatgatagatcacttgaacttattactcctacctaattataaatatgcatcctttgaccaacataatgtattttttaaagtgaaagacatgacaagagaatttgtgataacacaagttgctgaaccccaaaatgaataacagttcaaacatgatagaagtgtatttcttgctccttaaatttcaaagcaggtgttccccattgacaagcggctcatttccaagtggtgcaacacatggttttcttttttttttaaattttattattattatactttaagttttagggtacatgtgcacaacgtgcaagtttgtttcaagaccactgtgcttatttgtattaagtcagtagaagatgaaagagcacgacagattgtatatgggaggtatttatagaccaggccttgagtggcatactcatgtctactgacgttactttaactagaatgaggtcacatggacatggtgggaaaagaaacattaccaagaaaatgagaaagtggatttggtgaacagttggcaagtgtttgccaatcccagtttttttttttaaattgaaatccctggttgcattctggaagataaatagaaatactagttaacagaccctttcatagtccaggaaggaatgacagaggtccaagaaaaggcagtgagaagtgagagtggaagaagaagggcaagtataatgagagacgttttcaatagatgttgaagtccaactggatatagggtatcgaggaaaaaggtgcgttgagaatgtccctgacatattctccctggatactgagtgaattattaacgacaacaaccaccacaacaaaaactcattataggagaagaaggagatattttggagagaggaggggttagagagtttacatatcttggggatttgctatatgccacctgttgtgctagttgcttcacatgtatttgttaaatttaatcctcacagcaatgttcatgtgtatatactacagaagcataatatagcatggttattaagaaggtgggttctgcagtaagactgctcctggtccttcctctgtaaaataaggcaaatcataacaatgcctgcctcatagaccattgcaggaagtgaatgcgataaggcatgtaaattgcttgatatacttcttggcattctgtgaagtgttttcatttttattgttaacatccctatttttacacttagtaaactgaagtttcaatagagcaaactcacaccaccaataagtggcagagctggtatagagacccaagtcattctgctagtgaaaaccttttttcccctttacatcccatcatttcctctaataagggagggtgtggcctatcaattttaaataacaaatctgaagtggacacgacaagctgcagttggaaatgcaggtctggaactcaggaaaacattgacacagtgggattttgtaaaactgaatacattgcacaaaatgtcagctatgggttacgttacacagtaatagtgtcctgcatttagctcaaaggaaataggcgctagtttctccatgtttaataatcaagaggaaagtggtgctctgaaccaattgagtgagggttgctatcatattgagaccatgaaattttttattgtatgactgagtcagttttatgtgctttgaatattccaaagacaaactatgtgaaggctaaattctgcatgtcaggagccctcctcccacaaacttcatcagtaaaattcttctcctacttatttagatgcaaatggcttgcacttgtgttttcattatagactctgcctctgaaatggccaggaaccagggaaagcatttgggccacactgttagttgtataggatttaatgtaatcagatcaaccaagcattgatagcttgtttcacacagtctttttttttgtaatggcttttgctctaggggattccacctgtagtttcttattcattaagctagcaactgactcacagagccacacttagtgaatctcactctaatgaacagaagtaagagcatagaagagatggagtggttcattttggtctctgagaaagcttacaatgaggtgagaaggaaataatggtgtaagtcctcagtcaatcccaaattactgtgtgcacttcatgcaaggacatcagctcctgccctccaagagctcatatcttaggaggaaagacagggcacatcattcactgtaccaaaaggcataatggaagtttcacataaagctaacagtgaagtgctatgtgctaaaaattacaggattcactgaaacttggggacatggacccagatgtgtggcagggcttcacaggggaactaacatttgagctggaaggtggggaggaaaaaagtattcctgagaagtttcctcacatttatttcatttttgccagttccatgtggaaatcatggccttgaaataacaaggactgcctttattctccaagcaagaaactggtctccaggcaaattgagtctgtttaaaagttcattctaacagagggatttacaggtcaaagtaagtgtccctcttgttccaaagaacccagctattttagatgctacccctagacagagtagaaactctgttgtaatggaataaacatcagagaaggaattaagagccatgggtgtgaatcccacctttggaacagatcagcagtgtaaccatggacaaggcatttctcttctctgggtctcggtctcttcttttgggatacattgctgaaaatacctgctctgcctatctcacagaaatatttattaaatcaggaaacagctgtcaaccatctgctatgtgccaattaccataccagggatgggattacaatgatgaagagaccactctctcaagttgcttatagtcctgtgcagaagacagagagctaaacagacactaataatcctatgtggtaacgtctaagactgttgtccaaagagcccttagattgctgtgagctggaggaaaccacagtacttgtagggcacagacgaacatcatggaagagggaatatttgagaaaagacttgaaggaaatatgttgtgcctataaaaaggaaagggtattccaggcaggaaaaaaatgtatgaaaagacacagatacatgagagttttgttttgtaaaattataagtttttacagatggctggagaatggaaatgaggttggagctacacctctgagataattgttaaaactcagatgtgctccctctgaaggctaaatggagcagtaaagtggtggccctccttcctgcgtactgagcttcttgtctatagcttgaagatttaatgggacacctcagacaactggcattctcgtgactaatgtgctgcttggtttgggtgtttggtggtagtatatttcaagtgactcatgctgtactgataatggctattaatgatttgttattctttctttttcaccataaatcccaaatcctgccctttactccattattatagaaatagctggcctggcacctcaactgctcctgaagcagtgttatttgtccttagagagagcattcctaagagttcagagtaggttgttccacttcgagaaggcctaattgacagattgctttcggtatggctcatactgaattccagagccccttgttctcctacaaagttcaaactgttccctcctacattatacttaaacacagtgatagcctcactgaacaaccagtacatatattcaataaactttagatttttaacctttaggattctagttagtgtgggaaccttttttctctaaccttatttatggttttctcctattttatgcccttatttaaaaaataatcagtattctatgtgcaaaagtctaagaatgatttgatatttttctgtggggcagttaatttaggtgactctttcattcaattaattttgcagatttttttaattctttaattgagatatagcttgcatattttaaagtatacaaatattatgtgtatagctccgcagtattctggataaggaatatgtgctagaggttgctgcattagaagggtaaagtaatggagaagtagcttatgataaccagaacctcactttccagaagtgtcactctccgtgggtcgaaggcaaatgggcactgtcttaatgcatttgaactgctataataaaacaccttagactgggtaatttataaacaacagaacttatttctcactgttcttgaggtcaggaaggccaagatcaaggctccagtacattcagtgtctaaaggctacctctctgcttcaaatatggcaactttttgctgtgtcctcacatggcagaagagactaacattttcctttaggtcacttttatagggccagtaaccccattcaagaggacagagccctcctgacctaatcacttctctaatgccctatcacttaatactatcacattagtggttatattaatatttcaacattttaatttcagggggacacaaacattcagaccacagcaggcactgaagacatggatgtaacagtttctgagttggaaaatttactcattgggttagtgtgttgcatggatttccatcaaaaagcaaatgacttacatgtggtattcaatctagttcaggagacaagacatatgtaccagcaaaaatatccttaatatgcaaagcactgtataataaatgcaaagtaaatactggcttttgtatcaatggtataataaaatgttaaaaatcagcaaatcatacagtaagaataatctctgatatgtttgcttgttttgaaaatgtacttaggtatttccaataaagatgagataagggcaccaaatagccaagtcactaatttgtctctattccaaaggtatagaaagaaattatttaccctgtgacttttagtcaatagcagggattttgaacccaatgagatggcatagcataattgctggaccaaatgtttcaaatgaccatatgcagtttatggtttactgcttgcttcatttcccctccctccttcaagattctgatacatataccttctgcctgagatgtgtggagagtcagtggaaagacatgaacccagtatgctgaatctcagtcgttagacttcttgtcttccctagatacatcactccttttgtagtatcatctagtcttagggcttcaattagcatctgcaaggtgttagctaacaagacacagagaactgaagtaacttacacatagctactactacaagctgggttcatggtggacctgggttttaaatctggcagtctggctttggaatccatgctctgtttataataaataaataaaaataatatgtatttatggtgtacaacagaatgtcttgatatatttatgcattggggaatagctaaatcaagctaattttcatatgcattacctcacatctcaatttttgtgctgagaacacgtaaattctgctctcagcgatttttaaatatataaaacactgttattaactatactcaccatgttgtacaatagatctcttgaatttatttttcctgtgtaactgaaattttatattctttgaccaacatctcctcaatcctcccacttcctggccaccattctactctctttctatgagtccaacttttatacactccacatataaatgagattgtagagtatttgtctttctgagtgtggcttattttgcttaagataatgtcctccatgttgtcgcaagtggcaggatttccttttcttctaaggccaggtagtattttattgtgtatatataccacatctttttatccatttatccaccaatgaatgcttaaattgattccgtatcttggctattgtgaataatgctgaaataaacatgaaaatgcagatatttcttcaacatactgatttcatttcctttggatgcatgtacacacagtagtgggattgctgggttatatggtatttctatttttaatttttgaggaacctccatactgttttttataatggccgtatgaaagagttctcttttctccacattctcgccaacacctatcttttatctttttgatagtagccatcctaacaggtgtgaggtaatatctgattgtggttttgatttgaatttctctgattatttatgaagttgagcctcttttcatacatctaagacaaacatttattcagatcctttgcctatattaaaaattgggctatttgttttcttgctattgttgtttgagttccttatgtattttgaatattaaccctttatttgatatatagtatgcaatattttctcccgttccataggttatctcttcactgtgttaactgtttccttggatgtgcagaagctttttaggttgatgtaatgccatttggctatttctgcttttgttgcctatgcttttggggtcatttgcaaaaaatatcattgcccaggccagtgctgttgagctttctctctctgttttcttctactagttttatagtttcaactcaaaatatattgagttgacttttgagtatggtgtaaatggggtccaatttcattcttctgtatgtggatatcctgttttcccaacaccatttattgaagagactgttctttcccccatagtgtgtccttggcatcttttatgaaaaccaattgactgtaaatgtgcagatctatttctgggctctctattctgttccattggtctatgtgtttgtttttttgttagtaccatgctgttttgagtactatagaaatcaaataggaggagccaagatggccgaataggaacagctccggtctacagctcccagcgtgagcgacgcagaagacgggtgatttctgcatttccatctgaggtaccgggtttatctaactagggagtgccagacagtgggtgcaggccagtgggtgcgcgcaccgtgtgcgagcccaagcagggcgaggcattgcctcacttgggaagagcaaggggtcagggagttccctttctgagtccaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaagcagcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagagaaacaaaaagacagcagtaacctctgcagacttaagtgtccctgtctgacagctttgaagagagcagtggttctcccagcacgcagctggagatctgagaaccggcagactgcctcctcaagtgggtccctgacccctgacccctgacccctgagcagcctaactgggaggcaccccccagcaggggcacactgacacctcacactgcagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaacgcagagcgcctcttctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtacttaaaggagctgatggagctgaaaaccaaggctcgagaactacgtgaagaatgcagaagcctcaggagccgatgcgatcaactggaagaaagggtatcagtaatggaagatgaaatgaatgaaatgaagcgagaagggaagtttagagaaaaaagaataaaaagatatgagcaaagcctccaagaaatatgggactatgtgaaaagaccaaatctacgtctgattgatgtacctgaaagtgatggggagaatggaaccaagttggaaaacactctgcaggatattatccaggagaacttccccaatctagcaaggcaggccaacgttcagattcaggaaatacagagaacaccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcagcagaaaccctacaagccagaagagagtgggggccaatattcaacgttcttaaagaaaagaattttcaaaccagaatttcatatccagccaaactaagcttcataagtgaaggagaaataaaatacttcacagacaagccaatgctgagagattttgtcaccaccaggcctgccctaaaagtgctcctgaaggaagcgctaaacatggaaaggaacaaccggtaccagctgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaattctccaattaaaagacacagactggcaaattggataaagagtcaagacccatcagtgtgctgtattcagcaaacccatctcacgtgcagagacacacataggctcaaaataaaaggatggaggaagatctaccaagctaatggaaaacaaaaaaaggcaggggttgcaatcctcgtctctgataaaacagacttgaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaacgagacagaaagtcaacaaggatacccaggaattgaactcagctctgcaccaagtggacctaatagacatctacagaactctccaccccaaatcaacagaatatacatttttttcagcaccacaccacacctattccaaaattgaccacatagttggaagaaaagctctcctcagcaaatgtaaaagaacagaaatgataacaaactatctctcagaccacagtgcaatcaaactagaactcagtattaagaatctcactcaaagcctctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaacagctagcagaaggcaagaaataactaaaatcagagcagaactgaaggaaatagagacacaagaaacccttcaaaaaatcaatgaatccaggagctggttttttgaaaggatcaacaaaattgatagaccactagcaaggctaatgaagaaaaaaagagagaagaatcaaatagacacaataaaaaatgataaaggggatatcaccactgatcccacagaaatacaaactaccatcagagaatactacaaacacctctatgcaaataaactagaaaatctagaagaaatggataaattcctcgacacatacactctcccaagactaaaccaggaagaagttgaatctctgaatagaccaataacaggagctgaaattgttgcaataatcaatagtttaccaaccaaaaagagtccaggaccagatggattcacagctgaattctaccagaggtacaaggaggaactggtaccattccttctgaaactattccaatcaatagaaaaagagtgaatcctccctaactcattttatgaggccagcatcattctgataccaaagccgggcagagacacaaccaaaaaagagaattttagaccaatatccttgatgaacaatgatgcaaaaatcctcaataaaatactggcaaaacgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaagcctttgacaaaattcaacaacccttcatgataaaaactctcaataaattaggtattgatgggatgtatttcaaaataataagagctatctatgacaaacccacagccaatatcatactgaataggcaaaaactggaagcattccctttgaaaactggcacaagacagggatgccctctctcaccactcctattcaacatagtgttggaagttctggccagggcaatcaggcaggagaaggaaataaagggtattcaagtaggaaaagagggagtcaaattgtccctgtttgcagatgacatgattgtatatctagaaaaccccattgtctcagcccaaaatatccttaagctgataagcaacttcagcaaagtctcaggatacaaaatcaatgtacaaaaatcacaagcattcttatacaccaacaacagacaaacagagaaccaaatcatgagtgaactcccattcacaattgcttcaaagagaataaaatacctaggaatccaacttacaagggatgtgaaggacctcttcaaggagaaccacaaaccactgctcaaggaaataaaagaggatacaaatggaagaatattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatgacactacctgacttcaaactatactacaaggctacagtaaccaaaacagcatggtactggtaccaaaacagagatatagatcaatggaacagaacagagccctcagaaataacaccacatatctacaactatctgatctttgacaaacctgagaaaaacaagaaatggggaaaggattccctatttaataaatggtgctgggaaaactggctagccatatggagaaagctgaaactggatcccttccttacaccttagacaaaaatcaattcaagatggattagagatttaaacgttagacctaaaaccataaaaaccctagaagaaaacctaggcaataccattcaggacataggcatgggcaaggacttcatgtccaaaacaccaaaagcaatggcaacaaaagccaaaattgacaaatgggatctaattaaactaaagagcttctgcacaactaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaagacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggacaagatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcggcattattcacaatagcaaagacttggaaccaacccaaacgtccaacaatgatagactggattaagaaaatgtggcacatatacaccatggaatactatgcagccataaaaaaggatgagttcatgtcctttgtagggacatggatgaaattggaaatcatcattatcagtaaactatcgcaagaacaaaaaaccaaacaccgcatattctcactcatatgtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaattaaaaaaaaaataaagataccctaaaaaaaaaaaaaaaagaaatcaaatagtgcaatgctttgttctttttgatttgttatttttgcttaagattgctttcactatttggggacttttttggttccatacaaattttatgatttctttctatttctgtgaaaaatgtcattgaattttttataagaattgcattgaatctctagctcactttgggtagtgtcaatattttaataatatgaattctttcaatccatgaacacaagatgattttcaatttatttgtgtcttcaatttctttcatcaacgtttagtgtacagatctttcatctctgaaaatgttaaatttattctcaagcatatctttgtagctatagtgaattggattattttcttgatgtattttttaaatagtgtgtagaaatgttactgaatttttcccgttgattctgtatcctgcaactttactgagtccatttattagttctgacaattgtttgttggggtctttaggattttcaatatatgtaatcatgtgatatgcagacagagacaatttaatgtcttcctttcctatttagatgtctgttatttctttcccttgcctaattgctccggctgcaaaatcccagagactctaccaaaagactcctaaatttgataaatgaattcagtcgtttcaggatacaaaatccacatataaaaatcaatagcatttccatatactagtaatgatcaagctaagaaacaagtcaagaatgcaagctcatttacaatagctacaaaaagtatgtaggaatacgtttaaccaaggaggtgaaagatctcaacaacgaaaactacaaaacaccgatgaaagtagtaaatgacacaaagaaatgggaaaacatcccaggcttatgcattggaagagtcaaaattgttaaaatgaccacactattcaaagcaatctagagattcagtgcaattcctaccaaaataccaatgtcattttttcacagaattagaaaaaaatcttaaaattaacatagaaccacaaaagagcacaaagagctgaagcaatcctaaacaaaaagaacaaagctggaggcatcacattacctggtttcaaattattctacaaggctatactaacccaaacagcatggtattggtatagaagtagacaaattgatcaatggaaaagagtagagaattcagaaataaagcttcatacctacagccaatcgatctttgagaaaatcaacggaaacatacactggagaaaggacaccctattcaataaatggtactgggaaatttgggttgcaatacgcagaagaaggtaagtggacctctatcttttaccatatacaaaaatttactcaggatggattaaagactcaaatgtaagatctgaaactattaaaatactagaagaaaatctagaaaaactctactgatcattggccttggcaaagaatttatgactaggatctcaaaaggaagtgcaatgagaacaagaatagagaaatgggacttaattaaatgaaaaatacttttgcacagcaaaagatataatcaaaaaagtgaatagacaacctgcagaatgagagaacatatatgcaaactatgcctccaacaaataaatgatatccagaatctataaggagcttaaacaaatcagcaaggaaaacaaaaataaccccattaaaaagtgggcaaaggacaagaactgacatttgtttttcatgtacttatttatttattttatttattttttttgaggggaaaaacatttttattttttaattttttttattattatactttaagttttagggtacatgtacacaatgtgcagcttagttacacatgtatacatgtgccatgctggtgcactgcacccactaactcctcatctagcattaggtatatctcccaatgctatccctcccccctccccccaccccacaacagtccctagagtgcgatgttccccctcctgtgtccatgtgttcccattgttcaattcccacctatgagtgagaatatgcggtgtttggttttttgtgcttgcaatagtttactgagaatgatgatttccaatttcatccatgtccctacaaaggacatgaactcatccttttttatggctgcatagtattccatggtgtatatgtgccacattttcttaatccagtctatcattgttggacgtttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacaccgacttccacaatggttgaactagtttacagtcccaccaacagtgtaaaagagttctatttctccacatcctctccagtacccattgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcgcactttttgatggctaaaacaccaaaagcaatggcaacaaaagccaaaattgacaaatgggatctaattaaactaaagagcttctgcacagcaaaagaaactaccatcagagtgaacaggcatcccacaaaatgggagaaaattttcgcaacctactcatctgacagagggctaatatccagaatctacaatgaactcaaacaaatgtacaagaaaaaaaaaacaaacaaccccatcatgaaccgacatttttcaaaagaagacatacaagtggccaataaacatgataaaatgcccaacatcactagttatcagtgaaatgcaaattaaaaccataatgagataccattttccaccagtcagaatggctgttattaaaatgcaaaaacaaacaaacaaaaaaacagatgttgacaaggatgcaggtaaaagagaatgcttacacacagttgggaatttgaattagcataacctctatggaaaacaatatggagatttctcaaagacctaaaaatagtagctccatttgtttcagtagtctcgctcttgggtatctacacaaagacaaatcattatatcaaaatgatatttgtacttggatgtttattgcagcactgttcacaatagcaaatatatggaaccatcctaagtgtacattaatggatgattggataaataaaattatatatatatgtatatatatataatgctgtatatatatacacaatgttacatatatacacacacacacacacaatagaacactatttatcaataaaataatgaaattatctctttttcaccaacatggatgcaattggaggtcgttaccttacgtgaaacaactaagaaacagaaagtcaaatactgcatgttatcgtttataagtgggaactaaataatgtatacacatcgacatagagagtggaataatagacattggagagttgaaagggtaggagagtaggaaggggtgagggaagggaaattacctaaatggcacaatatacattattcgggtgatagttacactaaaaaccgtaatttcaccgctatgtaatatatctgtgtaacaaaatggcacttgtaccccctaaatctacaaataaattaataaatggctaaggtaagcatgctttctaaaaagaaaaaaaagaatccatgctcttaaacactgtgctataaggctgatattgattcatttaaaataaaaactttttgaagtataacttacatattataaaatttattttacatgtacaattcagtgatttttagtagatttatagaattgtgcaactgtaaccaaaattcaagtttagaacatactatcacttccaaaaatctctctacaaatttgtagtaacactctgttctcaccccaacaccagtcgactactaatgtactttctgtctctatagattcgtctttcttggacatgtcatgtgaatggaatcatacagtgtgcgacattttgtgtctcgctattttcacttagcataacacatttgagattcatccatgccattgtgtgtattccttttttcttgatgattaacattccattgtatagatataccacatcttgttcatccagtcacaataatggacatttgggttgtttccaccttttatctattgtgaataaagctgctataaacaggtctttctttggacatatgttttcatttatctttgttagtgaataattagagtaattaaagtaagaattagagtaaaaccacagggtcttacggtaagcttatgttaaactttttaagaaactgccaaaatattgtccaaagtgtgatttccatccaccataatttatgatcttatgtttttcccaaatccttgtcaacatttgaaattgttgatcttttttattttagccattttagtgtgcatgtagtagtatctcattgtagttttaatttgcattttttaaatgactaatgtcgaacatcttttcatgtgcttattagctaacagaatatcttatttgcatatatacatatatacacgtatatacacacgtgtatacacacacgtgtacacacacacgtgtacacacacgtatatatacacgtatatgtatacatatatacgtgtatatatacatatacgtgtatgtatacatatgtgtgtatatatacgtgtatgtatatatatacatatatatgtgtatatatacatatgtgtgtatatatacatatatgtgtgtatatatatatatacacttctcatttttgtattaggttgtttttcttctcattattgagttctaagggttatttatgtatttttaatgcaagtcctttatcagatgtatgtttcacaaatatattcactttctttgtgccttgtcttttcattttcttaaaggtatcttttgacaagcaaaagctttgaatttttatgaagtctaatttatcatatttttttcttgtatgcatcatgattttggtgtcacacctaagaaatctttgtgcaactcaagataacaaagattttctcctatgttctcctttagaaattttagctcttaaatttcgatttatgatccattgttagttgatttttgcttatggtgtgaggtaacagtctaagttcatatcttgcacttgtatattaaattctcctagaaacattgagaaagctattttttgtctccactgaattgcttggcaccttggtcaaaaatcaattgactataaatatcaaagtttatttctggattttctatttttttccattagtctatattataatatttaggccaaaactgcaccatattgattactgtagctttaaaactggaaagtgtaagtactcatgattttttttgaaagatgctttggctattctagatcctttgtgttctcatataaattttagaatcaacctgccattttcacaaaaagaaaatctgggattttgaaagcgcatgtgttgaatatatagagcaatttggagagaattgccaccttaatgctattaggacttctaaatttgtgaacacggaaagtctgaacatgtcaccttcaaataaagacagttttgatttttgctttccaatcattctcttatattcttttggttgcctaattatttagacagctttattgaaatatgattcacatgtcatacaatttatcctcttgaagtgtacaattaaatgatttttaatatattcacagttgtgcaaccatcaccaagatctaatttcagaacattttagtcacctcaaaaaagaaactccataccattagcagtcattccccatttcttttcttctttgactggctaaattcttcaataagaagttgaataaggaagaaaaaacatccttgcttgatcttaggggaagtatcttagtctttcactattaactatgatgctagatgagggttttagtaagtgccatttatcagttgaggaagttgccttctattcctagatttttgagagtttttaatcataaagcagttttagacttcatcttcctggttttgtttttgacctcctttaactttttctctataaagttgtcataattttaaaatgttagtttgatcaaattaccctctgcttaaaatcccacagtgcctctatatttcactcatagtgaaagcaaaaatatccaggagcccttatactatctagtttatgccacatagcttcctctttgaactcatcttctattactcttccccttgatctctacaagacagccacagtagcctagttgctatttcttgagcaccctgggcacacttctacctcagggcctttgcactgctaccccttctaacttgaatgctctttccccaggtttctacaaggctcattctctcatctgcttcagattgttgctcaaatgtcacctactcagtgaggtacctgctaaacaccctattaaaagttgcaaccccttccaaagcatggtaaaatgagagtcataactgaaatatgtatgtgggggagaagggtgcagatgcagggccaaaaaggtcgtcagattttcatttgtatcctcgtctcccaaagaaggggcttcctgggttgcctcttactttgtatctgatcttcgcataaagagcaaagcaggccaacccctgtattgcgactatagttctatgatctgaatgccacattttcaggggattctgaccttttttgaaaagctcactgaaaactgctagcaaaaatacaaccaaacttagtagagcttcacaaatgaatccatgaagagggagaaaggttggaaaaggagagaggacatggaatttttacagggtttattttgctgatctgaagtcagaggcaaccatgtcacttaaaggctctgattctgccccagctttctctttgaaattattttttatatttagtaaaaataataatgatgatagtgataatcctctggaatagataaagactttgatttctttttttctaatctgtgcctcctaccaccctataaatccctgatgttgttaaatgaataaatgttgaatggatggatggattatgtaagggaaggggatattgtctctattcctttttataggtgagggaactaaagttcccttggatatttacaaaatttccgatgtgtcttggacaaaagctgaattctgaagctagcctgcaatgctccaccaatctgacttttattcttaaggcataaaaggggtttcatgactcaaagaaccagacacaagagaaacgtatttcactgaaaaacatgctccttgtgttggatactgaaaagattccatgagagtttaataaagaaaatggtgttccttttctccacttatattattatttccaagacactgcctcttatgagtaatgccaaggggaaattactttatgtctagccagcagttctggggacatggagaataagatcacaacaaatagactatcaaagcaggatgcaaaggtagtgatttctgattaggggcaaaactgatttataataacttttctatctttcttcccatccacttcttgctcaacccacctaagcacagaggagacagaaaaagcaaatgtttgtaggggcaaggtacttcataaaccaaattatgttgtgctcttttcattagttcttaaacatgtcaatgctgtctgatcttcttgccctccttatctcccttcacatattgagataggattgtcaatatcccttcaagttttttctgcaacagaaagcactctgactgtattcaggctaatgtactcaactcttgccctgtgtcaatggttaactgcatatgtgagggttagctttctcttcctatagcagtggtcactatgagggcaatgattgtagcttgtgcctctggttcttccttcttttcttagtatcttcacatgactaccttatacatagaacatacttgctcaaagataaccaaagataactagagcatctctcatatgacttaaagattactgaggacctgaggagaccgttaccctcagatgaatggaaaattgctagtgtagaaagaacaccagatttgcactgcagctctccgggttgtgtgacttgagaaactcactttaacaccatgaattcttatttttgaaataaagatgataataatgtctgcaatatgtccctcacagggtcactatagggagcaaattaggtaaatagaatccttagttccaggcaaccagggtccctacatcacaaatgttagcagtaggcctgagtggaattactgatgggaatgttcttttttttttaaaaaaaaaaatgtaacccatttaattatgagtttatacaatttaactttttttaatatatatatatatttattatcattatactttaagttttagggtacatgtgcacaatgtgcaggttagtcacatatgtatacatgtgccatgctcgtgtgctgcacccattaactcgtcatctagcattagttatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgcgatagtttactgagaatgatgatttccaatttcatccatgtccctacaaaggaaatgaactcatcattttttatggctgcatagtattccatggtgtatatgtgccacattttcttaatccagtctatcattgttgggcatttgggttggttccaagtctttgctattgtgaatagtgccacaataaacatacgtgtgcatgtgtctttatagcagcatgatttatagtcctttgggtacatacccagtaatgggatggctgggtcaaatggtatttctagttctagatccctgaggaatcgccacaccgacttccacaatggttgaactagtttacagtcccaccaacagtgtaaaagagttctatttctccacatcctctccagtacctgttgtttcctgactttttaatgattgccattctaactggtgtgagatggtatctcattgtggttttgatttgcatttctctgatggccagggatgatgagcattttttcatgtgttttttggctgcataaatgtcttcttttgagaagtgtctgttcatatccttcgcccacttgttgatggggttgtttgtttttttcttgtaaatttgtttgagttcattgtagattctggatattagccttttgtcagatgagtaggttgcaaaaattttctccccttttgtaggttgcctgttcactctgatggtagtttctttagctgtgcagaagctctttagtttaattagatcccatttttcaattttggcttttgttgccattgcttttggtgttttagacatgaagtccttgcccatgcctatgtcctgaatggtaatacctaggttttcttctagggtttttatggttttaggtcttaggtttaagtctttctttagaaggtgtaacatactgtgagcatctcataggttattagcaatgatcatcataatgataacaattatacattgaaccttctatgccttcatagacacatggatgtctgtaatttgacaagaaatatctcctggtatctcactctcattaaccaaagaaaaaccgtgttaagcagcaatagcctgcggatattttcttgttaagatcttgcttcctaacactgttacagtagcactgtgatgtgaagagtgagaaatggagacaccacacatgggatcccttgcatgcacttctttatttgttgcctcaacaaaacacttccccacaggcttctttggtaattgcatagaagtgaggcatgtttttttcagtctcatatattgatattttattaggcgagatttctggtcctaaggagtacttgggccctgtaaagttctcagcaggagtgcctatctaagggaagaagccattgggggaatgggtgacgctataattgataaccagtttctcaacttattagaactccaaaaggatggcagaggttgagtccaatataaccaggaagtataaaggctagttagaagtagctcatgacggctagcttccaagctactcttaggttttgctgtgtgagccccatttctacataggaggctactatctaacccgaggaaagttaagccttgaaaaaaataaaaaaaaaaaaatcagaaggggaaaccttgaaatagactattcagagagactattgcaggggaatgagtatgtaaacatgtcatacaccattcagatttccactgagcaatccatccagcatcttttccaaatgttgcctctgttgacagagcatgagctctttagacttgacctctgaggtttccgatgtcctccatcacctttgtattttttcctggagtggtcagttttcgtgtgtgtgtgtgtgtgtgtgtgtgcgtgtgtgtgtgtgcgtgtgtgtgtgtgcgtgtgtgtggtgtatgtgtgtgtgtgttcctcaagagccatctctttcaacaaagctatagcagttcctgtgagcagcagaattatgttttttgtctgtctgttaatgatcagggtaaagatattctttctacatatctcttctcttcagtgcaatctttaaattggttaactcacagaatagcctgctgagaagaaatatttcggaaataattaaactgcaatcagaagtgaatgagtcagaacctggtgtttccaggcttcttggggggggtgtctaaggaagtacagttagggcagaaaagttatatctgtttttcaaaggtgacaggatgggattcagatatgatgatatgatccaaaaatatgagtacttaatgcctctttgagaggctatctagttcattttatccatcctttgtgttcataaagacttgaatctcagtgaacttaaacaaacaaaaatctcgttattcttaggaactgagtgggaatgcagccctgtgtttaataacatttattttagcttaatttcattttctgtttgcctttcttttaggttaacaattcatgctgagtgtcccatgcatttggaagattttcccatggatgtgcatgcctgcccactgaagtttggaagctgtatgtattttctctctctctctctgtcttttttttttgcctgatcttccaaaagaaacttaacatattatattctgtccactgcaagtttctaaagctgaggcctttaatccgggctggtatcagggtgggtcagagagtggggttgagtagtactaactaatcagggggaggagacttagcctttaacaagaattttctttctaagaagtaaactttattttgctatttcagactaatttctctgtcattagattgaaacattaatgtctgttttctaaattgcccaaaggacagagcaagacagaagtgatataaaatacagtcacagctacctaaggacaagatatgtcaaacagaatgtggttagattttttgaagtgcgtattctacctgcatcttcatatacttctatccaattcttaacagtgtgtgataggcaggaagagactctgaagatttgctcacttttgaaagtattaccttttccagtagctgtacattttacagaaaaagtagtaaatatatagtccattttcaaatgaattagaaaaatcaacattgaatagaatttgagtgagtttttgaactgaaaaatttcagagtgagtttcacatagagagtcatcagagtaatataccaaaatctgtgttgatcatgtcaaaattaatttagctgtgttttgaaacagaaagtgcatttgaaaagacccaaataattaagtgcaacatgtttcctcaatcattagtttttcagatctttacagattgtattctgtgtgccaggttctattctaggagcttggaatgcatccgtgaataaaacaaaagccttgctcttttggagctatattatagagagacgagtggcagtgaaagataaaataatggattaaagggtaaagcataaggcatgttgtaatatgagaagcaacatgggaaaacataaaagtactgcagaattaggggaatcatccatgcctaggtggaggatttgtgttaccactgaaattgaaagtagggtgattagtgtcaccctaattatttaaaaggaacattcaagcagaaatattaagaaaatagagagcttatcaatgcatatatatatatatatggaaatagagctctcagtagaaggaacaaccaggaaaaataccgtatgtctgaaaaataggtgacttgttcagccagtgtggctggccagagtgaggaaggggagagcaggagaaaaggatgagatcaaagtgggggccaggtaatctaaagtcttataggccattaaaggtctttgaattatattctaaggaaaaatgaagaacaattagaatattttagacaaaagaatggcattatctgacttatgtcttaaaataattactaggaatttttaaaatgatataagtagaagagggatcaaaccatgtggagcccaagtaggaggtgactgcaatatttctgggtaggacagagttgtttattggtgaatagtgttcccttcattaacaactataaaacctagaaccatagaaacaataaagctcagtgaagattgaagtgtctaaaattctggagaaaggggagagcctctcatagatgaagttgtgatctacagctttttcaactctgggggcatttgccagttctggccttggattgcagcttgctgggcatagggctcatactggtggatgagaagaaacagcaatgatttgatgatcacacagggctagggtgacacaagggaaatatctgaaacatctcaaattaatggctgatctccctctcaatatataattgatgaattttgaatttgcacagagcatgaggacaaaagctaatatgaaaaaagttgaaaagcagagcttccttttctgcagtcttccagtactaaaaaaaaaaaagacatgctagactactagtttaaaatcctagagagctatatcctaggaacaaggcaatagcagagacagactagattagtcaaaactataacccagcacaagtccgttatgagattaaggtgataattctcccatactttctgtatagcaaagtaaataatgaagactctacggtggaaaagatacttctctttgaaaatactacagttttatacacaatgtatggaattcaatgaaaaatcaataatcatatgaataggcaggcccatgagacctaaaaccaagttttaaaaccaatgccaaaaaccaaaatatataaacagacctacaggtgatttagacgtcagagtttgtagacaaggactttagaatgctatggctaatatattcaagaaaaaaaaaggaagtgattactaaagcagatcaaatacctataattttaacagaaaattggaacctataaagaagaataaattagaattacagggaagtacaatatcttaaattcgaattcaatggatagatttgacaagcagaaggcaggatcagatgactgaaaaattgataaatagaaaaaagcagaactgaaggatagaaagataaatacacaaacaagtaaaaagcgtgtgggtcatagtaagggaatataaatcatcctattataaagacacatgcacacgtatgttcatcgcagcactactcacaatagcaaagacatggaatcaacctaaatgcccatcaataatagactgaataaagaaaatatagtacatatacaccatggaatattctgcagccaccaaaaaagaacgagatcttgtcctttgcagggacatgcatggagctggaggccattatccttagcaagctaacacacgaacagaaaaccaaataccacaagttctcacttataagcaggcgctaaatgatgagaacacatggacacacagaggggaacaccacacactggggtttttggagggtgggaggagacagaagatcaggaaaaataactaatgggtactaatcttaatacctgggtgatgaaataatctgtacaggaaacccccatgacacaggtttacctatgtaacagacctgcacatcctgcatatgtacccctgaacttaaaataaaagttaataaaagaaattgcaatgtgtaatttgcagaggataaacaggcagataaaggagcaaaagcaataattaagtaaaggccagacactttaaaactgatgaaaattatcagcccaaatactcaagaaatcatataaacatgaagcagcataaatagaatgaaaaaatgcttattctaaagtttatatggaaatatttaaagtaacaagaatagttaaggagatcttaaagaatcataaagctgggaaatttacattaaaatctaatctgatatcagatatctagaggtattttgaagttacagtaatttagaaaaggtattattgttgcaaagtagacaaatatactcatggaacagaatagaagagagagagagaacgagagagagagagacagagagagagattcatcttgactcttacatcacatgataaacaaaaataaattccagatggtttccacatctaaatgtgaaagagtgaaagataaaacaatccagcttttattaatagaagaaagcataagagagtatctccatgatcttggaaaaggtagagactgcttacacaggacatagactaacattaaccataaaggtaaaatagaatgacttaaaatatattaaaaattaagaaattttctttattagaagatcattaagagagtgagtagaagccacagagagggagaaagtatttgcattgcatatgcctaacaaaggactcaaaagcataagacatcctgcaaatctatataaaaagtatctgaaacctcgatagaaaaaaggccaaagtctttaataggcacttgttaaaacagtttcccaagctcagaaacacacacacacacaggcacacacacgcacatgcacatgcacacaggcacagacagacacacacacacacagtgactgattgcattagtcagcagggaaatgcaaaataaaatccaaaggctaccagtacacacccattagaatgactaacataaaaaagacagaaaataccacttcttggtgaggatgttgagcaaatctggactctcatgcgctactgataagaatctacgtttgtaccaaggttttggaaaattgtttggtgctatttaatagtgctatacatgtgcatatcatacaactttgcatctctagtcctgagtatagttccaaacaggcatcattgtttatgtataccaaaaggcatataaagaatgtccatagcagagctcattgtaataaactccactgggaactaccttaatgtccatcagaatggattgaaaagctgtagcatagtcacgcaatgaaatactatacagcaatgacaattatattacactcaacaacatggatgaggtacagccacaatgctgagcaaaagccaaacacataagtgtatatagaatctgattctatttatgctatatatacaaacaggcaaaactaatatgtgctgttaaaagtctttaatattttatccatcattgccgttggttgtatttccagattcctgacagattaagcaatgggattcaggaacaagaagttggaattcctaggtattttataaattcaatgttattcttaaaacactttcaaacttcttaacgctctttatccataatcatggatatctaacttttaataaataaaaatattaatagtaactttagaagtattcagaaagagtggtaatatatggaaagattactcagacactggaaaatgatagcaaactgatagtatttgaataacaacatttgaatttcttaataaagtaaacagcactacacagaatcactcatccaaattgccagtttaaggattgattttgcttcttaaacttgttatgtattagaagaacactctcagggtttgtgtatagtatatagtgctttatgcatttagaatactgtgtgtgtagtatactatacatataaaatactatgtgtatagtatacttatgcatatagacttactaatattaaattttcaagaattaccatcagcagcatagagggccattaacacacataataagcaaaatcaactgatcaggttgtgaccactttaatcctatgtacttctgtcctgacaccagagaatttcaaaacttttaactcagtgtgacagtgtttcctgctcttggttttgacttaacatcaatagattccttcaaattagtaaagtctctatgtctattgttaagctttaattcttacaagatgattataatacttttttctggttttgctcatttctcaagtatttttctctggatttgatattcagaaaaatatctatctttctcaacacaatgtcaggaaggagtttccacatagaagcactagtcaggatagtggttacccttgatgagggttgttattggaaagggaagcaaatgatactcctgggtgctgattatctggaatgtaacttcggtgttcataaaagagatctggattggagatttaatttaggtgtcatccacatagatgatgtttaaagccatacaactagatgagatcactatggaaatgactatatacagagaagagaagagaatcaaggaaggactttttctttagacatgataacatttagaagctagaaagaagagaataatttaataaacgtgaaggcgaagacaggtgacgtatgagaaaacctaaagggaacgtgttgtcctggaggccaaataaagtacatcaagaaggagagtgatttaaattattaagttcctaaatgggcagttaaaattaatcttagaaaacctctagtgaggaagcaattctggaatgacagagttagaacttctgaaaatccactcctccataaaagcaatgagacaattttcaaacattgtcaaaataaactttctccaaactccggaaattaacaaaagtctcctaacactctgaagagcgttattcaagaaaaatgattagttctcagtacaaccagggagccctattcccatcctcttctttcctcctctgtagaagccttgaagattttgtcatgatgaaaaggtcaatccatcagaaaaaagtataacaattataaagaaatacacacttaaacacagagccccaaaatacatgaagcaacactgatagaactgaagagaaaaataagacaattcaacagtaataattagagatttcagtattccactttcaatacatggatagaacatctaggcagatcaacacagaaatacaagatttgaacaattctataaaccaattagacataaccaacatctatagagcgttccaccaaacaacataagactgaacattattctcaagtgcacatggaacattttctgaggtagaccatatattaggttatacaataagactcaataaattttaaagtattggaaccatacaaagtacattttcttacccagaattagaaatcagtaagaaaaggaagttcgcaaaatttacaaatatgttgagatcgaacaacacattcccctcctaaacagacaatgatccaaataaaaaatcacaaagggaattagaaaatattttgaaacaaatgaaaatgatgacataacacaccaaaacttatgggatgcatcagcttaaagcagtgcttagagggaaatttataactgtaaaacctatatttaaaagagaaatctaaaatcaataacctgaatttccaccttaagagactagaaaaagaagaccaaactaaatccaaagcaagcagaaggaaaaaataataaatattagagtaaaaataaataaaataaagaattttaaaaattaaagaaaataaaaaaatctaaaagttatttgaaaagatcagcaaaactgataaacctttcaccagacagacgaagcaaataaaagaatagaatcacattactaaaagcctgaaagaaggcacatcatacttgccttacagaaataagcaggattttatgggaatactatgagcaactgtacaccaacaaattaggtaacctagatgaaatgaaaaaaagtcatagaaatatacaaactgatggaactgactgaaggagaaatagaagttttcattgaccctatactaagtaaataggttacattagtaatttaataacttctcataaagaaaagcccaccattagatctaaggcttcaccattgaattgtacaaaacacttgaagaagacttgataccaatcaataccaggttttcacaaataattcttccaaaatatagaaggggaaagaacatttcttaattcattctatgaggccagtgttaccctgatatcaaaaccaaaggtaactaaaaaatacaactataggcaagtatttcttatagacaagtatttcttatgagtatagacacaaaaatcttcagtgaaactctagcaacggattcaagcaacttataaaatggattatacatcatttttaagtgagatttttcccaggaatacaaagttggctcaacaactgaaaaccattcaacctaatatgacatattaataaaatggacaaaaaccacacgatcatctcaatacatgaggaaacatatatactctgcactagaaatccaaaattttcttaatttgccagtaactagtggctataacttgtcctgtcattgtgaataataaaagttttgataattgcaattatttgattaagttataaaccaatatagtaccagtttccatttgcttttatatataccagcctcaggctgtagctttcagattcatcagaactcctaaattttttaaaaattattttcgttttaattgacaaataagtgtgtatactttttgggtacaattagatgtttcaataaatatatatattgtgtaatgatcaaatcagggtatttaacatttccattatcttaaatatttatcgtgtatttgtgatgagaacattcaaaatcctctcttctggctattttgaaatatatcatacaatattttaaaaatataatcagtcttctgcacaatagcacaccagaacttattccttctatccaactgtaccttgtacccattaatcaatctccctccattaaccaagctctctccaggccctctctcttctccttccccagcctcaggtaaccgccattctattctctacttttatgatatatctattttagattatgtatatgaatgatacaatgcaacatttgtctttctgagccttgctcacttcatttaacataatgtcctgcaattttatccacattgccacagataataggatttcattctctttttatggctgaatagcattccattgtgtgtgtgtgtgtgtgtgtgtgtgtgtgtgtgtgtgtgtgtgtgtgtgtgtttatatattatataacattttcttattcattcattcattgatggacacttggattgattccatatcttggctgttttgaacagtgctaaaatagtaattgaagtatagatatctgttgaacatattcactttatttattttgggtgtatacccagtagtggaattgctggatattatggtaattcggtttttaattttttgaggaaactcaatactttttttcatactggcagtaccaatttgcattctcaccaacagtgtataagaaagagttcccctttcttctcatcttttccagcacttgttctcttttgtctttttgataatagtcattctaaccagggtgagatgatatctaattgtggttttgatttgcatctctgtaatgattagcgatattgggcattttttatatacctggaggccatttgtatatcttcttttgagagaagtctattaaggtcttttgcccatttttaaaatcagatttttttatattatttgagttccttagatatactggatattaaccccttatcagatgtatacttcgaaaatatttttcccattctgtgtattttctgttcactctgttgattgtttcacttactctacagaagatttttagtttgataaaattccatatctctactttgcttttaatgcctgtgctttggtattgttatctaaaagatccttgcccagatgactaatggcatggagaatttcccctacattttcttctagtaattttatagcattgggttttacatttaagtcattaatccattttgattccattttttatagtgagagataagggtttagtctcattcttgtacatgtggacatgcagttttctcagcaccatgttgaaaagacaagtgggattcatcccagggatgcaaaaatggttgaaaacatacaaatgaatagatgtgatacatgacatcaacaaaatgaaggacaaaaaacacggtcatttcaatagatgaagaaaataatattcaacatctcttcctgatgaaagctcttaactaattaggtatagaaaaagaatgtacctcaacacaataaaggccatatatgacaaacctacagcaaacatcatactgaatggaaaaggctgagagctcttttctaagatctgaaactgtgaaacaaggcaaggatacccagtctcaccacttctcacaactagtggtgagaagtcctagaggtactagaagtcctagccagagcaattaggcaagagaaagaaataaaaggcatccaaattggaaaggaggaagtcaaattgtccctgtttgcagatgacataatcatataaaaaaatatatatatatatatatccatacacacatacatatatgtgtgtgtatatatatatgtgtgtgtgtgtgtatacatatatccctaaagaactaaacaaaaatttgttagaattaagaaaataagcaacgtggaaggatacaaaatccacatacaaaagtcagtaccatttctatatgccaatagtgaactatttgaaaaaagaaagtgattccatttacaatagctacaaaacaataaaattctaggaataaatttaaccaaggaggtaaaagatctccacaatgaaaactataaacattgattagaaaaatagaggaagacacaaataaatagaaagacgtcttgtgttcatggactggaagaactgatattgttaaaatgttcatgctacctaaagcaatctacacattcaatacgattgctatcaaaacaccaatgacatgcttcctgaaatagaaaaaacattctaaaattcatatgaaaccacaaaagaccccacatctccaaaaccatactgagcaaaaggattaaagctggggacatcacactacctgacttcaaaatataccacgaagctatagtaaccaaaacagcatggtagtggcataaaaactgacacacagaacaatggaacataaaaagacacctacaattgtatgtttatcacagcactattcacaatagcaaagtcatggaatcaacctaaatgtccatcagtggatgactggataaagaaaattgctatatatatatttacaaacacatacacagacaccatggaatactactcagccataaaaaggatgaaatcatggtctgctgcaccatagatggaactagaggccactatcctaagtgatatagctcataaactcgaataccgcatattctcacttataagtgggagccaaataatggatacacatggatacagagagtggaataatacacactggagattccaaaaggtgagagggtatgagggggtgaagattgaaaaaatacctgtagggtgcaatgtttcgtatttgggcaatgggtacactaaaagctcagacttgtccactacacaatatatcagtttaacaaaactgcacttgtactctccaaatctataaaaataaaaaaaaaggaatagagaatacagaaataaacctacatatttacagccaactgatttttgacaaaagcaccaaaatacacattaagggaaggacagtctcttcaacatatggtgctgagaaatctggagaatccttggatttttaccatgtccaaaccaaacttaagttcctttcactaaaactctttgtgatctctatcttggtttatatcctgtattctggttacctacctcctcaatcttatatcatatccctttccccattacattggccttctgccagttcctagaactctttaccacgtagaagactttgcatttgctggttttggggggttgcggaggtttagttgttttgttattattttggcctgaaatgttttccatcaagctcttgcatgactgactccttctcatttcttaatgttttagattagaaaccaccctcagagagatcttctcttaccactgtatctaatgacacccctcctcaccctgtaactctattttcttcatagcatgcatcactctgttactatattatttatttacttgtttattgtcagtcttttctcactagactgtaagctcaatgaggtgatgaggcctcagatgttttatgatcgctgtatcttcactatctaatatgatgccttgatatttgttgaacgggtaactgattaaatcaattaagcaagtggtttctgacaatatttcaaaagaaatgctttctcatttgtgctaacatggcaagattgtttgttacttccttttttcctggggtctgttacataccaaggctcagataacagaaggaggcattttgctaagcaactaaagacaaggagttgcttttgccattatagctcatgaaatatattgaggggcccattcagcgagtgcaaaagttctaattgtcaggtagatatcctttcttcaggaaccagtccctccaccctaccccagctcctctatggaaatagaatgattggaattgagatgagggggcagttttataggagagaagctgaggaattaaaggagcccaaatccgtggaagaaggaaagcagaaggaggtctaactgggaagaattctgctccccagtgggtgaataaattccatcattatccatgtacttggaaaagctacaatgttaggatcatgtagaatctttttaaaatgtcctttttcctttcttaagcaccatgaaaagtcaaaaattataatcatttctacttctgaaatcgctctgtcccactcagttcaacccactgtctagtatattatgcctatgggtcactgacaccaaaaggcattgtgatgaccttttaaatactgtcttggcttcagtttcactcttttccaccagccatccttacggcagctagggtgatccttcccaagcttatatctggtcatgtcatctctctcctttaggcatgtccacaactcgtgtgtacacacatgtatgtacacacgtgcgtattccaacagaggttcccactttcccattagaagtttcttctggggactatataataaaaacaagaaatccaggactgcaaaaacccttagttcttagggtaggcaatttggaatttttttttttttttttttttttttttttttttttttttttttttttgagacaaaggccttgctctattgcctgggctggagtgcagtggttcaatcacagctcactgtagccttgaactcctgggcttaattgattctcctgcctcagcctcctgagcagctggggctacaggcatgtgccaccatgcccagctaatttttaattttttttgcagagacggtttccttctatgttgcccaggttgttctcaaactcttggccccatgcaatcctcctgcattggccttccaaggtgctgggattacaacataagccactgcacccagactaacttggatattttatgctatttattaagcttccttctggcctgtgactccagtgatactattaattcctttaccgctccatgtgctcacatactttttgccttggctatgttgttcttttgctaggaatgtccttctttcacctactaaaggtggcctcatcttctgagtatcatttactttaagaatccttctgtaacaccccactctgagcaggagcaatagtgctcacctctggttttacttaacacttgtgtttattttactagtgtgcatactcctatattccaaattgcactacagccattgtgctttctctgtctccccaagtaaattgtgggcttcctgatgtgatggtggctactgtgccttcacagactttgtttaccagtacaggtcaggctccaagcagacactcaattgagtagttttcaacttgtttttgtttttatttttaaattcacatcttcgtcttccacttattcatgtctttcctgctttgccctctatcttatgagaagagggtatttttttctcctcaaatccctctgttcccatatattattgccaaagaaattaaatcgctgctttttgcatgaagtaaggtgctagtctggagaagtgaattttctgagataccgatagctacacagtttgtcgtcacatctgccttagggtctgcttggattttcagggtgaatattcagtgttgtctgtgccaggtactcaacttaagttaagagatccagcaagaaattccttttcttttttaggggtggaaacaaaatcttccattgcttactctttccctgaacgaacctgttctagtttttacactgccaaaatcttgggtagattggatagaacatggcactatctttaaacaaaaagtgttacaaccatctgaatagcaaaggtaagaagacctatacagatggttccctgcttaggagtaggggtaccccaagcatatgtactaaagataaaagactctggggaaaaatgagagcacaagggtcttgtgaaatcacatttcgcagaccgtgttatgactgcctcatataatatcagtgtaaattttaggtaagggtatgagaagggttctgagaagattttcctttcttcttggtgataatagtttaaaggtccacaaatcaagctgagagccctagatatcccataagtagaagaggatgctttgtttttaaggtggaattataaggaatcatagccatctataggagaaagtctctagaccataggttataaattgggagcttcaggtgtgacttgtttgatccatacacagtttacaacttttaaaattatttgctaagattttaaatttgtgagatgtcatataaaattccacatttgcttattatttcacaaaatcagaagactgacaacacactgggctcaaatcctacatggcttcaatcaatcgaggccaaatagtgaccatcccttgtagatgagggtatgctttccctttcctcataacctccatcactttcaccttgctccctgaaaagggagtatagtatcagttgccagtaatcatctcacttgcacttttgttttacttacaagagaattaagagctcccagtagaaatgaggaaaatgaaagcgttcttgtaccatatctatcaatttttttaaaaaattaagacatgctgagatggctatattttaaacaagatgggagaatttacattttcttatagaaataaaggatattttcacatctttaagcacacaaagtatgcttttgttgaaaacaaaacttcatatatcaaaattatgctattcattacaaaaaactatgatttatatatagaaaaaatgcacaatgaaaatattaattaaaaaacattgaaagttaggttttgcgcttcaatgcatacactaaatgttattgctagaaaatgtggttatgctttcagcaacaaacctttataggcatcaaaatatttcatagataccaaacttgtaaaaaaaagtctattaattgtatcagaaattatgtgtccaactagaaatcttgttgttgttgtgttgaagaaatgactgagactatatacaaggcaaattatgtggaaaagttaaacttcctgtgatattttcctttgcagcttatgagagcacagatataaaaaataccatagagttatgaatatttgttcatgatgtcagtgagaattttgatgtgattggagaaatttttagcatgttgctcattacaaacaaagcaggaaatgacttatttaggtgtattgaaaaagttttaaaaagtgtaatgtaagcagatcacaattggtacccatgaatagctgttaatgtcagacttgtgaaatgtatatccaatgttgcaaagttttgcagggacccagcatttatatttgtttattggcagattcaccagaaattatttgctttgtggtagaaggtttcaatagagtatattaggggtatagtagttgccaccatgagctggaggaacccctcttcccctctggcttgaacaacaggcagctcaaaacttgaaggaaaagggtatacagtatgcggtcagcttccctttatgagcctgggtgcctgagttagggcaagtactcaccctagatataaaatccacggtggaaagagttaaccatgtcagggaaggaatcaactcatttctttaatatactgactaaagttaaataaccccacctcatttctgaccatttcccttactcacgcccctgttaatctatacaaattctgtacttgacattggaattctaaatacaagccttgacattaatgctgatgcaaaagaaaaggtgtcaggtaggtgtcttgtttgcatatcaaactgataataagttatgaaagaaaatcaattattgtaattttaatttggaatttttcttttttaacttaaaatatcactagtttgaatttttgctttctctgatatgctcaccccataattaattgaatttgtactacttttctgccagcttatttttcttataattagcctcatttacttattcaaggtacctctgtgttagtctgttttgctttgctgtgaaggaatacctgaagctaggtaaattataaagaaaagagttttatttggttcatggttatggggggctgtacaagaagcatggagccagcatctgcattttgtaaggacctcaggaagcttttactcatggtgaaaggcaaagcaagccagcgtgtcacatgaaaagagggagcaaaagagagaaggcggtgcaaggctcgttgaaaacaatcagatagcctgtgaactaatacagcaagaattcactcattactggaggggggtgtcaccaagccatttgtgaggaatctgcctccatgactcaaacacctcccactgcaccccacttccaacactggggtttgcattttaacataagaattggaggggtcgaatatccaaattttgtcaacctctatggctcctgtaggcatttgagtctgtgacatctacatgagataatattttagccattcctccccctgcccctactgtctactgtccaacagaagaaaaagtttattggcagtctagaagacagtcattgaagtatgagaacactttgggttcatttctatgtacacagcatatactacagtagctgttcaatgagagtttattgtatggatggatggatggatggacggatggatggacttcagttgaagacagaccacatacccagaactctttgaagatggaagttttatttcgatctcatttgagtttagtatcaagggtaatcattctccatttccttcaacttctctttattgacccttctctgccttagatgcctatacaacagctgaagtggtttattcttggactctcggaaagaacaaatccgtggaagtggcacaggatggttctcgcttgaaccagtatgaccttttgggccatgttgttgggacagagataatccggtctagtacaggtatttaacttattttatttaacaaacatttctgtaacctataccacatgccagtcactgttctaagtgcttataacttacttaatcttcaaaacaatgttgtgacaaagatagtattatcatgagaaaactgagtatataaaagttcagtaatttgctccttgtcacagttatgcaatggcaaaacgaaaatgaacacttgtcagattggctcccaagaccatcctcttaaccacgattgcctgctgcctcttgaagagtggtgcagaaggtgaagggcattagggctagagtatgagaagagaaagcagatgaaggccatggtgggggaagagctgagctttgttcctaaagatttcattaaaataattgcttaactcagcctgtgctgaggtggcacattaactaatcccagaaaaggtcaagcacacagccaggatgcccagggagtagccatggaattattttcttaaggggatcacgtaactcagaaaaaagcttggttggcaaaacctgctaggttttatcaatggctaactcttggatattgacaaatgaaactagagttttgttctgtggccttaagtctgtccatttggaaatggcccctgagcagttcaaggggcctgagggacgatatattctggatctcaactaaccttagaatgttcgtcaaaatggagtatatgctggggcccacatatcacataatattttttttgctatgaaatgatagaagctttcaacgttaattttcaagcaacacttgtctctgtgaatccacaattatacatgtccttttatctcattatctagacatacactgttccctcttgtgatatcacagtctgtcatctcctctgccccctgttttccctccacctcagaatcaggggagggtgcctaaaaaaatcaacatttgaaatggaattgaaggacaaacaggatttagagatctagaattagtgtggggaaaggctattcttgacaaaggcaatactgagatgtcgaaagtccagaagtatgagagagcatggcctgttagggaagctgaaagctgttcagagtaagatgcagaagagataaggagtgtagggctgcaggggtgggtgggctgttctgtggggtcctggcgtcatgtatggcaggcctccggctggaccagtccaagtggcacaggcaggcaaggtgtggctggccctaatctgaagaattccctccttccagtgggtgagcattgctgctggggtcaagtgcctggctttggcagaagcagtagaggtagccggtggtgggagtgtctgggccacctgggccctgtccctgtgtcccaggagcgctcctggccatcgtgcattggctacctgggccactgcgtggccagggctcagagcactgggagtgtgggcagagccagacagggacccgtccctggctcactgtgctgaaggtgaagcaggggcattgacatacttttcctgcactggctgcacaggtactgccagcctctttagagccctgatcccgggactatgcaagcaaggagggagaggagccatttgcaggtttcacacaccctcctgtcccctcacgtctccactggaccccttacatgtgtgagcagagaagccggcctcctgcttcaagaggtgccaccaccaatgccactgcctggtttcccctcccttccccaccccaacttaagggaaaagagggggccccaggaggaggctgaggctgcagcatcacgtggcccaaagtggtgcactgcacagctgggccctagaggctgaaggcccacccttgctgctgcagggatttcctcctcagagtgagcaagcaagagaagtccctgtatctgttcactcccctcacctccccgtctgtcctgggcactgcccacctggcatcaactcttgagaccaatccttggctgcccaatcagaccccactcccacttcattttggtaaaccgcggttggtgtcatctttagcacacagaagatacacgttcataacaggaaaattagaaatacatggaggagcaaatgttggaaattaaaattctttttgtttccactttctagaaatatcttagaagatttcggtacattaactgattgttttacattcagtatttaagacggttccctttgcattttctgtataaatatgtttttatgtaaatggggccatagtattgatacttttttataagctgatttttatttaattttatattataaatgtgttttcatgtcactaaatgcacataatccaggtaaaatgtacacaagatttagtaaaatatgttagcaattagaatgaacacaccacacatttattattacttgttttggttacttaaaaaaaagtgaaaagccttcctgtcaggccagagcatagttgacaatgatgataatccctgttgtcactaggaagtgtagcatttcattgtgaaactcagtaaaatagtatctcttttttggtaatgtcctcatatagatggatcacaatctatttaaacaatcatccactattatattctgtgttttaatgctataaacaacactgtaaagacccttcttttccctatagcattttgctcctgtttaagtatccgcctaagatacagacaggatattgagattgctatttcagaaagtagacacattaaaaaaaattgatacatattgacaaactgctgttctgaaaggttaaacaattcacactcctattatcagtgatgagcaagccaatttcccctcactcttgccaacacaggtatcatgggttgaattgtgtcccctgaaaagatatgtttaagtcctaatccccagtactgcaaaatgtgaccttatttggaaacagggtcactgcagatgtaattagttaagataaggtcatactgcagtggagtgggccctaatccaatttgactggtgtccttataaaaaggggaaatttgaacatagagacacacacacacgcgtgcgtgcacatggagaacaccatgtgaatatgaaggcagagattggggcgatgcttctataagttgagaaacagcaaagattgtgagaaaacaatttgaaactaagaagaggcaaggaaggatttccctacaattttcagagggagtgtagctctgctgacacctcagtatcagacttccagcctccagaactgtgaaagaatacatttgttttgttttaacccatccagggtgtagtactttgttatggcagccctaggaaaataatgcaacaagatattgtcattcttgttttcttactgtttatcaaagtaatatatgggtttagtggtagaattactaatgatcaatttttgagcatgtaatatgtgcaaagcatttccctgagggcatgtattaactcacttaacccttgaacaacagtttgaggtgggtggtggtattatctgaggtttatagataaggaaatcgaggctcagacagattaaataattttctcagggtcacacagttggtaagtggtagagcaagatttggaaacaaggcagcaaacttgctccagagtctataaacataataactacatggatcactccctttctactttgcatctagaaggaaggaggatgtaaggaaagaaggaaggcaggaagaaaggcagggagggagggaaggaggaaagaaaagaaaatttaaaaatcaaataacaggtatatactgaaaaggagcagttcccattttaaccacttatgttttacttctgatggttccctccatagttctaaataatgtgcttatactgccatttttcacctttagagatgaaatattgattccctactctaaggtattgagtgcttatctcacttccattgcccctacctctcctttcctcctagtattgatagctggatcaaatagttagctatatttattgatctatcaacccttctgtcctcatatcctcaccttctttcttccaacttctgccaactaaaagtttgctttcattgtaaaaacggattaaaatatacactcagttcttgcggtagggagaatagcggccccccaaagatgtccacattctattccgtagaacctgtgaacatgttaggttacatggaaaggggggattaaggtgcctaatcagctgatttcaaaatagattattctggattattcaagtgggcataatgtaaccatgagagtccttataaaggagaggcaggaagaccagagtcaaaaagaaaatgagtagaagatattttacagctggcttgaaagatgacaaatggggccacaagcccagaaatgtggactacccagagaagccaaaaaggcgagaaaacctattcttccctagagtcaccagaagtgaaggcagccccacctacatcctgattttagcacagtgagacccattttagacttctgaccttcggaagtataagagtataaattcgtgctgtttgaagccaacaagtgtggggtaatttgataaagtaccaataaatagaaaactaatactgttatatacccctaattaagctttcaatactttctctatagattgatttaaaaagctcaaaaccagcaagggacatttgtattactatgactgtatgaatactatcttttgttgggattgcatttcttgtttaagggcctaccacccacttaaatttccctagttttctgtagaaagacccttcagagtattttagataaaggcactcagattatctttcttttgactgggagagtaaacacactgatacagtcattgtgcctatggaagtagggcttgtaacttttccaagttcagatctgcaggaaatgtccctattttccattcccattcttgagaccctctccctttgtccctgcagcctccaggtctgtgtcctctctgggcattgccagcagggacctcccttgtaagctgagctccctctgctgcttctcatctacactgaggcctgctttctccatcagcactttctgaattccaaaattctcttgagctctttcattcattctttcctgttgttttctttcttatgggtttattctattttactgtcttcactggtacttgatgaagtcttaagagaaagaggaggtaaatgttgctgctcagtctgctatatgaattggacatctttccaactttttacctacattttttaggagctgcattatttccatttttaaaatttacatctcgaatataatctggagttttatttttggttttgctctatgaggtaaccaaatgtaccagtatccacgagtgaataatcgagtgtttcctcattgatatgagatgcttcttttatcatatagtaaattcacatgtgtgcacatacatacacatacaaacgcataaatgtgtgtctatatttattattctttttcattgttgtctctctattctttatatgtatcacattattttaattatcgaagatacgtgttttcaaactgtgtatatatacacacacacacataatctttctaggaagatacacaagaggctgttaattgtagttacctaaaggaaggagatgtgaaatgggtaatttggggcagatgtgggagggagacattttgctgcacacacttttatacctattgatttaggaaccatataaacattattaccttacatatatatgtattgtttttattgtgaccataaattatgggcattcctttctaaattcttcatacactcttccatgtagggtctagaatatgaatggaaatctgggccagagaaaggacccacaatccgtggatgttctgattggtatggctggctttctctccaaatgctgtcagtcctcagtatgaactagcttcatgcagaggccgtctgctctttgctccagattcaaacatgtattaaataaatgaatgaaattcctcaaagtctgtggctagttgttgacaccatcccctgttttccctaatttggcgaattattacattaattttctaaaaggatagtttggatgtatgatccttatatatccatctttcctagaaatttgatcatttgttagaatgacagttttattattattgtcattgtatatattatttctttagatgtgtagcataggtaagtaaagataaggcataaaacaggacataaagaaaaatcagagagatggagataaaaagaaaacaggaggcaagataaagaacaaggagtagagatagagagagggaaaaatacccaagatagatttaagaaaatatatccacttacttttttatgatgacttaatttgccaagctaaaaaatcctctgtgtgtttcaaaaccttagaaactagctaagttgtgaatgtgttttacattctattatcaaatatttcatatttaacacagatggagtttaataggctgaagtgcaaaggcaggagaaaattcccccaaatcacttaaagggccatccttcataataagaaagacagagagacacagcaataggggcaaggagggagagaatctaacaaatccacttcaggaaaatatagtcagttacgtaaaacattatttagctaaactgttctgcgtttctgatacatagataataactaatttatgaatacatatgcattgtgtgttttatattgtacccttgaatatttcatatacaacacacacaacacaggtggtacataatgagcttaataagctgggacaaaagggtggaggtgggatggagggaattgtgaaaatcttccaatttgattaaagtttcagttctctctttggcagagaagaagatatatagagatggaaaatatcagagttgtgtttaagaaaactgattaagttaattgacataataaattaatttgctaagctttctaaaagtccacttgtaagttccacccatagaaatgatctaagttgtgaatactcgtgaatatacaaaagtgtctttccattgtccctttgacaatttcacactggacccggatagcctccaatacaaggacagaaaccagggaaatcttcgcaacctaggtgtcagttcttactaaagagaattcctttcacctcttcagaagacagacaacaagacagaatgagaaagaaagaagtatagaaaaggagaggattgaggaaaatcaatgtgttcaaccattttgagtcagttattcaaaacaaatggttaatttggtactcttttgaaaagtccatttgctttgccttttagatccacagaatgtaattaatttatgaatatttattacatcttttatatattaaatatttcacatgatcagagataggattaataggtagcgtttggaaatgtgagatggtaaagagggagaattgcataagctcatcaaagtccaactctcatgaaaaacaaatccccaatgccttctcagtggggagagagtgaaggaaagggaaaggacggaaagaagtagagatgcacacagacagaagataaaacaaagaaagaaaagaattgaaaaaaagaagcagagagaaagaaaagagatgggaactccaaagttgtaattttcaatttgctaaattaaaaataagcctacttgtattttttgtgttcacataaacaagctaagatgtgaatacatattcaataagggttgtatattgagccttggatgaccagatggtgcttcctaggtttaggtacaagggagtgggtagagtagaaaagtgggaaattgcctcacttgggaatcctgccaaaaccaaatgtgggtggaggaagagaggtgaaaaataagaagctctgataagagtgctattagagcaggcatatcgcaagggtctttggggactattttggggaatctggcttttactctttgagagatggtaaaccattggatagttttgaacagaagacagacaagatctgacttacgttttaataagatgatttctggcagctgtactatgaatgcattgaagaggagtcaaggacagagcaaggagaccagttagaaagctattatagtactctaggtgagacatgatggtggcttagaccagggtggtagcagtagaagtggtgagaagtggtcaaattatggaaatattttggagaaagaactggaagagttggctgattgattgattttgtgtgtgttatgtgtgtgtgtgtaaatgtgagacagaaaggagggagggaaggagagcaagtgagagagagagcaacagaacacggtggggttgagaagtcagtggaaagtctcttgggggagccattttgaatgggtgttggggatggggagagtgaaaaccaaaatcttgatttttcatgttaagtcaagatgcctattagatccccaagtagtgatgtctaatatataaatcttagagttgagtagagaatcttaaggctcctataataaagtaccacaaactgtgcaacttaacagaaatgtgtctcacagttaaggctagaagtctcaaatcaaagcatcaagaaggttagttctttcgagattctgaggggaaaaatctgtcccttgcctctccctagtttctggtggtggctgtaatctttggcattccttggcttgcagctgcaccactccaacctctgcttgttttttgctttttttatttttttttttttgagacagagtctcgcctgttgcccaggctggagtgcagtggcacgaccttggctcactgccagctccgcctcctgggttcacgccattctcctgcctcagcctccctagtatctgggactacaggtgcccgccaccacacccggctaatattttgtatttttagtagagatggggtttcaccatgttagccaggatggtctcgatctcctgacctcgtaatctgcccgccttggcctcccaaagtgctgggattacaggcaggcttgagccaccgcacccagccctctgcctgctttttacgtatccttctccctgtgtgtctgtgttttcacatggtgctctcttctaaggacactagtcgtgttggatgaggggcccaccctactccagtacggcatgacctcatcttaactaactacatctgcaataacactatttccaaacaaggccacagtctgtggtaacaggggctaaggcttcagcatatctttttgagggacacaattcaacccataacaagtaggaagcccaggtagaagttatacattggggagttattagagtttaaggtattaaagacacaggctggatgagaattgccagcgtctgagtgagacagaaaaaagaagtgcaagtacagagctttgacatcctccagtgtttagaaattaaaaggaacaggaaaggagacttaggaggaatggtctgtgaagtaggagagaaaccagaaaagcatcatggcctagagggtctgtgaagagagtgattacaagagggaagaaggatcaactgcataaaatgctgctgacaaatccagtaagagggagaattgactaatacatttagcaatatggggtaattattagtacctatctcacagaactgttaggaggatataaagttaacaatccacaaacactcagaaaatattttggcacacagtaaaagcgcagtaagtgctcactcttattttaggagtgggataacgtaggtcagtccacattctgctatgtgaacttttgggtctaaccaagtaagtacattagaacagcggagcataatggttaaaaagcataaactgtggacaacctacctgggcttgactttgggctttactaattactagctgtgtaaccttatgcaagttgctccatctctccttgcctcagtttcttgagctataaaatgaggataacaatagtacctacctcatagggctcctgtgaagattaaatattttataatgttaaagtgctaaatgagtgcctatcacatagcaagtgctgtagaagagatttttattttattattatttaaatgagaacattaatttacttgaatgaattgtgtcaaaattgttccgagcaagctgtattggtacactgatagcattgttttttcacacacacacaaaaaacacactattttgtgattattaaagggctctagttatatgaacttgggagatgctggaatattgaatataagattaaagagctttgtgaattgaattggggcccaacttgatttagcaatgtttatgtagctacatactgcctaattttactctctctttaggagaatatgtcgtcatgacaacccacttccatctcaagcgaaaaattggctactttgtgatccagacctacttgccatgtatcatgactgtcattctgtcacaagtgtcgttctggctcaacagagagtctgttcctgcccgtacagtctttggtgagtgataatttatggagcgtaggggaaagtcttatcatgcagagtcacagtggaggtgagaaaggtggaagaatggctcctggagagaatgggagaaattcctgtgcctagcaggagtaactgaatcatcagaccatggggttttagacgactgaattctcaaggaggaagttagaataagaagactgttggaccagtaagatactgaaatgcttcccatttcagtcctgcttgccccaaaagctggagagggaattatcctttagtaaaaaagagaggaatttagtgcatagagtggagaagttaaagggttagaaaccaagctgtctgaacagagtattggattgggggctttgttaagatctgctttttttgtatgagcgtttgactttgtggcttcttctctagcctttttgaaagtatgagttatctgatattgtgtaaaggccacacacagtttaaaggatttcttaatagtacccacgatcaaagccattttcttcatcatgagtatactgatgtctaggaagacatttgcatatcattagcactttttcctcacagacttaaaacatacaaaacatttcctgcctatttttcccactgtcggagataaatattaattttttcagctactaaactggcctccatggcaatgatacctttgaggcatatacttgagtgtacttggtatccacacagaaggtgtttctaccaatatcctgaagttttactgggaagtgaaataaaaagtaaattatgttttggaagaagtagcattgtaggtcaggtattgtaggagatagcagtggagaaagagaaatagtgacctgtaaagtaggaaaaagaaagaataatcaaaaggatgtgatatcatggaagtcatgtgaggagagtatttcaagaagcagagaatactcatgtgggttgaactgtactgagtttacatgagatgcagacagaaactgtctgttgggtattgtgatatacttggctgttagggatcttgagaagaacagttctagtgaagtggagggagcagaagctgtatgagagtgggttaaatatgctcactttgggaaatgtaacaaactagataccctgaaaaagcttcctttataaaatcctagaaaagctagataaaacatagaaaccattctttttcatttttccttccttcttccttccttccttcctttctttctttctttttttttttttctttttttttgagacggagtttcactcttgttgcccaggctggagttcaatagagcgttctcggctcactgcaaccccccgcctctcaggttcaagcgattctcctgcctcagcctcccgagtagctgggattacaggcacccaccaccacgcctggctattttttttttttttttgtatttttagtagagacagggtttcaacatgttggccaggctggtctccaactcctgactttttagatgatccgcccatctcagcctcccaaagtgctgggattacaggtgtgagccacagcacccggccgaaaccattcttttaagctaatgtcttaacgtgagcttaaaagaaattaaaggaaatacacaggggcccaaatgaaagaagaaactgaaaattgagtgtcaatcccattaactgtactgttatggcaggaagataagcagatggactcctggtcttggtaaacaagagtttgactttttaaagaaaggcatttacaactaagattgtggtaggcagaataacggtccccaaagatacccatattctagtccctggaacttgggagtgtgacctatacagcaaaaataactttgtagttgtgattaaataaaagatcttgagatggagagattattctgaattatctggaatggggcctaaatgcaatcacagtatccttataagaatcaggcagaaggagatttgactatggaggagaaagcaatgtgatgacagaaggaggaaagatttgaacatgctctgctgtcggatttgaagaaagaggaaggggatcatgagtgaaggaatccgtcatacagctctagaagctgaaaaaggtaatagattattcctttagagcctccagagggagtgcaaccctgctgacaccttgacactggaccagtgaaactaatttcagccttctagcatcaagaattgtaagaaggcatttaattgttttaggcaactaaatttttgataatttgttacataaaccaaaggaaattaatacaaggacacttcccatgaattcaatatcattgaacagttacgctttcaatgcaagggagtactagaaaaatacacttactagtgcagagagacaataaagaagcatgttttttttggcctgggctttgtgtgaaatatgagattccttgataattcatttgctaattcaaacttggcctcacattaatttagaatttatatttacattaattgcattgatgtgagaacctgcatgttaaaatgtttatataaaaaatgattgcagaattgtttatgtaagaaaaaaagcaagaatagccaatatatccttctaaaaaagaacaaagtagacagaccgggagtggcagctcatgcctgtaatcccagcactttaagaggctgaaatgggagtactgcttgagcctaggagttcaagaccagcctgggaaacatagggagacctcttcttaaattttttctttttaattagccagacgtggtggcacatccctgtggtcccagatacttgggaggctgaggtgagaggattgcttgggcctgggaggttgaggctgccatgagccatgatcatgccactgcactccagcctgggtgacagagtgagaccctgtctcaaaagatttttaaagaaaataagaaagcctaaaatacagccatatatatggaaacttgatttatgataaagatggcactgcagagaattaatttgagattgatcatggatttaagtataaaagttaaaaatatgattatcttagaagaaaatataaggcaatatctgtgcaccctttggtagacagaaattccttagttcacaaaaacataataacaataaggaaaagaactaataaattggacttcatcaaaattaaaaatttctgctcatcaaaggataacattaagataatgaaatggcaaaccatatcctgagataaagcacactatatctgtgcagacctaaaaaaatattttgaaatatttatatattctgaaaatataaaaagctcctaaaattcaataataaaaggacaaagaatccaatttttaaaatgggcaaaagatgtaaacagatatttcaccgaagaatatatacaaatgcccataatcatgtaaaaggatccttaacatcatctttttttaaattagggaaatgtaaactaaaacctcatggagacatcactttaaatactagaatggctaaaataagcactgaatgtatgaaatggtaacagtggcttattggttaaacaatacatttagaataaaatactagaacataatgtaatatatatctgttgagatgggggtatatggagataaaatgttccaaggactttcactgtcagagaaaagtgttaaagtatcaattaacgttatttattttattttattttttgaggcgggtctcaccctgttgcccaggctggagtgcagtggtgctatctcggctcattgcaacctctgcctcctggattcaagcaattctcctgcctcagcctcccgagtagctgggactacaggcgtgtgccaccatgcctagttaatttttgtatttttagttgagatggggtttcaccatgttggccaggctggtctcaaactcctgaccttgtgatccacccgcctcagcctcccaaagggctgggattccaggcgggagccaccacgcccggcctaaagttattatattatattttatttcttaagtcaaggatgcatgctgactgaaactctcataaatctactgggaatgttaaatggtaaaattactttagaaaacagtttggcaatgccatataaagttaaatatatgcttactatataatcttgtagttccattctttaggtattaaccaagagaaatgaaagcatatactcacccagacttatatgtaaatcatcccagtatctttattcacaatagttgaacactggaaacaatccagatacccattactgggtgaatgaataaacaaattaggtaatatcaatacaatggaatgctgctgtgaaattaacaggaacgagccatagatagatgcaacaacatgaatgaacctaaaaatatgctgagtggaggaagccagacacaagtgagtacatactgtaaaatatttatacgaaactctaagagaaaaatctaatccatagaaaatgaaagcacatcagtggttacctaagaccaaggaggggatggcatgggcacaaaggaatctttggggagatgggaatattctatagatgatacttatgagaaagggcagaaaggggtatcaccagatggtagatgtctcaaaagagctcaggttacaacaacactgtgatccggtaatggtctaagaagcgctagacatcaaagaaaatatggattgcacttcttgagctcttgattctgaattatcaaccacattttgagaaccaaaacagtgtattcaagaggagagtcaggtttcagttaagaccaaaagggggttatgcattcagagaagaggttgagaaaataggtggactcaccagttatacagtagcagagttgggcagtaagaagagtttgcgataaagggttcataagtatatgggtgataaggtcagataggactttgtaaaacagaattaagcctgactgaaagtgaattaacaaatatccttgcccttgtggtagtgtctgaggtaaacagatatatgaaatgtgattaattctgattatctcctaaggggagggagaatgggtgctcattttgaatgctgtggtctgaaatatctaaattttttatctttagggcttaactctgtataaggcacaaaacagttagcagtgttggagaaaagaagacaataagagctacattaataataataataatatatttaataattaccgtaagaaaagaacattattaactctgataggaacaaatgtggtacagtgggctacttggctgtgcctgagaattaaagtcctttccactcatcacagatgtggtttggtataagagacacatgtcatcacgtaagtgcactagaagtgctcaaaggagacgagggaggacagtcagttctacctaagccttttcagaaatgttttctagtcttgaaagagaagcactggtgacaggctgaatatcttttaaaatgccaagaatctctttgtccatccatgaagcgtaccaaaggcttgattgagggccctaccagctctgactagctaagagctttcaaaaagttgacagttttaattaagccctagagactagagctccaaaaatctctactgagatatggcacagaaacacttatgttgcaatacagttctctccatctaagcactagcagcacactgctatgaatgtgtcagagtggacaactgcatttgctaataaccattaataaagtagcttgtttctcccattaagtaactacttggttggtatgatctgaaggttttcaaggcctggatccattgtcagagattaccaggttacagattcagagagtttgttaataagtattagctatgtggcagattcctcacatggcgtaaaatgtgtttcggctaatcagccttgatgactccctgcctagttggtgcaaaggtactcctttagggtatttctgttgaaattgtacggagtcttttgcagtctggattttcatttatatagcaaatatataagtaaggtactacggcagaccaagatagaaaaggaagccccagaggcttcagcacacatggctgaccctctgggtaaagttaatggacacagtgccttctctgcttgatttcgcatatagcctctttcacctcattagaaattcattccatgccccacttgacccaggctaaggaggctcactttctccatcctcttcagcatgccaacgctaagaaagacattctgaccatttccccttcctcaagtttgaatgactttgtacatctactgctttatcaaaatcctgggggacagagacagtagggaatattcatagatgggcaaaatggaggcacagagagaataaagaaattgcctaagatataaatcaagtaagtgggagcactcagaacatctaacttctagtgtagtactcattgagactagaaaaacatcactagcaattgtaaaattattatgataatattgttgttaacattgattatacttatactattataattatatagtatgacaacactattgttctaacaacagtaaagacaatagtcatgttaattatagaagctactatttatggaatgattactctgtgtcaggtattatactatagactttatgtatatgtgtatatatatacataatcttcaatccctaacaaatctctgtattatctggtgttattaccccccttttacacatgataaactgaggctctctggggtaaaacaccttattcaaggtcatattactagtaggtgaggttgctcagttttcagcctagttcattctgactctaaagcttataccgttaatcacaattttatattatatatatatatatattcacatgcatatctaaaatatgaaaagattagaaaaaatgtaaaatataatttaaatgtaaataaagccttgaatttagaataacactccccccaaaaaagaatcaattggtctaaagacaagcttggatttggcaaaaactcacaagaaacagatttcggaatagttttcatcgttcacaaagcccaatagggacctagtgtgtgacgcagctacagaaccactttccacgatagtttgctgcattatcagaagactgtccaaaattaaggaagtaagcatcttactgaattccgaccatgtcctgagtcttgggctcagttctgggctattcagaaaagaaaaaaaaagaaaaaagaaaaaaaaataggttagggaaggaagtaaacaagaaaaggagttcatgaggtgaacttgaatctccatgttcattctgaagatgagcagtttcgcaaggagccatcaccctttttaggtctctgaaggtctgttctggagagtaaggagcagattttttttcccttgcatggctacagaagacactccaagatcggtctgtggaccagtagctagaagaagccagatttcagttcgtgagctagtttttttttttctaattaaaatgctctcttacaatgaaatggactacctgctctttaatggaaatgtttaagcagaagctagaggacaacaattaaatgtaatccattgcagatgcctatatagtcttctgccaattgggatgggctggttactaggtggacccatcagatttgatagtccagtgtttttttaaaattttattttattttaaaagggccattttgagtggggtaaagcttctcctttcaaataggaaattagtgatttcatcgaataagctctcaatgtcttccagttgcaactggttctcatctttcctctcctcaggtgtcaccactgtgcttaccatgaccaccttgagtatcagtgccagaaattccttacctaaagtggcatatgcgacggccatggactggttcatagccgtctgttatgcctttgtattttctgcactgattgaatttgccactgtcaactatttcaccaagcggagttgggcttgggaaggcaagaaggtgccagaggccctggagatgaaggtgagatatagcaaaagagaaactgagaagcacccccgagagacctgtattgggaccaggagtgggcagcctatagcctgcaagaactgggcagggctatgtgctatgcactggggtcatcaatccagttctcaactggagtgcttcttggcaacctggcatgttgtctgagggcaaagaaaagagggcaggtatcatggagggttgatgtcttgtggtgaaggatcaaacctaaatgtgatgctgctagactcaaggggcacccattggtacttacaaagtcactcaaaggcttggactctatcttcaacccagagtacaatctctaaggccatctctgcccctcttcccagtatattcaaattacagtcaaaacaaaatgatcatctttctttctgtgtctgcttattttgctttctgtacctggaatgctctttgttttttcccatgcctgttaaagacctactcattcttcaagtcccaactgaaatgctactttctccatagagcctttctggaatcattcacagatttatctttgattgaggcatgggtgctcctgatattaaaataatttattcatattagtttttgtcttcctctcactagactgtgaacattttgagggcaagagcttgtctgcctcttatttctagctagccaacatccttgcctagcatctgactcacagtaaaagctgaataaatgttgattggattggtgcattgatgggaaggaagaagagagattaaaatcattaaaccaactaaattgataggaataaaacatgaatacagtgaaattaagattgttgtccctggctgctttaaataagttcaggtcgctagaactagatgaagattatcaaaatatgctaagaggaactggcaaatgtgatctcaggaccatcctggtactcctcaaataatcatggagaagagaaacgataatgatttttcaaattaggagaaaatatgtattgcatagagtatagattggtgagttggcaaaatttttgaacaatttttaactatttagataaaatttattaactccttgctataaattatgaagagataagtgtagttctacttccttaatctactctaccataggattttttgcttggttttattgtgcttaatctagttgttacttttgtacccttaaaatatatttattcctctataacttggtttatcagctaggaacagggtctgttagccccccacccaggaagaatataaggaaatcagtacatgcccactcctacctctccttctctctaccagttcctatcatctcctaatttctgtttgctatactactattgctcccttattacattttataacacttacatcctcccatgcaactgtaaatcctataattgtttagtcatagttctacatttaaatgggttcttttcttaaaatcgtccttttatctatcatttctattcattgtatatttacatcaattcctttttttaagttcaggggtacaagtgcaggtttgttatataggtaaacttgtgtcatgggggttggctgtatgctgtacagattattttatcacccagatattaaacctagtattcatgagttatttttaatgatcctctccctccttcttccccccaccttcccaaaggccccagtgtgtgtagctatcttctataagtttctttaagatggtctcatgggaaccatatttccttctgttttgaatgtataaaatcattgtctattgtgtttatacttaaataatagttgagctattgtacaatccatgggtcacattctctttttctgatgactccattaagacatttattacaatactcaataggtcattttcttccttttgtaacaaagtttgtgttaatcgcatgatagtttgtcttcaattcttacttgaagttgcattagagaaatttttactactcttgttatgtatggaaatatcattgggggagtaactgagagagttagcaggatagtaatgagtagctgagaatgagtagtagagtagtttgagcatcacttgttgtctatataatctcttatgagtagtcttccttgtagttgtgattctacttctgactagtaagaactttcccttgttcacaggaaatccctctatgttgatacaggtgtctgtgtgcatgtctctgtgtgtgtttgtgtatgtgcttgtgcatgtgtatgcgtgtatagtattatattctttaattttgcagtctctgtctcctctgccactatgtggtagtcagagttccaggatgttctcattaccagtttgaaaactgattttatttcaaaacagggattgtttctttcctttgtcaggtcatgccacacacttttgggacactatccttgacctgaaatctagagcagcaggtatcctcagtgtcatcttcaccctgatctgattttcactgcgcttcactttcacttcacttccgagcccttacttcttgggattaaggttataaaagctgttaagtttcaccaaagatagagttctggtttttatttctcatcttactgtttttggttggttgcagagaggaaaagtgaacaaaggtatccttactctgacatattaaactggaagttccctaaaatacattattaaacagatagatattttaggagcagttagcagcaatcagtgatatacagcttgagttcactaatgagaaattatctaacctcatgagcatttgtcaacagtttattggactagtggaccagaaaatgtcatagattttaataaaatatttgactaacttttaaaaaattatacctccttgaagaaaaggaagcaggctggatgtggtggctcacgaagcgggcagactgctttagctcaggaatttgagaccagcctgggcaacatggtaaaatcccgtctctacaaaaaaaattaataattatctgggcatgggtgcatatgcctgtagtcccaactagtcaggagggtgaggtgggaggttcatctgagcttgggaagttcggactgcagtgagccaaggtcgcaccactgcactccagcctgggtgacagagtaagacgctgtcaaataaaaaaaagaagagagagagaagagagagagagagagataaaggaaggaaggaagggagggaggcaaaaaaaaaatagtacaattaggctgatgtagttggttgaccaattcaaatcaaatagaattaactgatggcgctgaaggcgatggctcacacctgtaatcccgacagtttgggaggccaaagcaggcagatcacttgaggtctggagttcaagaccagcctggccaacatggcggaaccccatctctacaaaaatacaaaaaattagctgggcacggtagcatgctacttgggaggctgagacgggagaatcacttgaacctgggaggtggaggttgcagtgagtcgagattgcaccactgcactccagcctgggcaacagacagagactcggtctctaaataaataaataaataaataaataaacaattaaataaattgactgatggactgacagacaccaaactgaatggaggtccctggggttacactacaggactttgtctttgaccctgctttttcaaatgttgttattaatgactcagatgaagacatatagggtagaagactcaaatttataagctggtattaatgaatattggttggggaatgagtattttctgaattaggaatcaaagaggatttctaaatttgaaaggacaagcttaaattaaaatattaacatttgctaaatcaaatacagattcttacacataggtacaaaaaaatagacctgggattaaaaaagcttaacaattaaacattgaaaataaaatgctaggatatgaagaaaatgcaaatctaatgtacgcctactttgtgctacaactctggaaaagctcaatttgatttgggtctgagttaagaatcacctagaactagtgagagcataagccctatttgatttgggtctaagttaagaatcacctagaactagtgagaggataagccctttttattatgtactggttggcccgtgtttagagtacactgttccagtttggttactacagtagaggagggacaaatgcctcagggggatgattattgctatttttagatagctgcaaggcttccatgatgttttataaaaaatgagacagatttttttttatggccagtaagaggagtggaagtggtttgaagacagagagaggacttaaatagattgttagaaactctagagctagacatcagaaatgatgaccatttctccatttaaaaagtgctaaaattttaaatagagagaacaaaaagaatattataaaactattttgcaaagatagtgatctcagtcttcctctttagtctctatggtcagtccatttaagttatctcaagaagcatattatgagaattgaaaaaaagatggaatgcagaaaaatggatctctaatgtacaggtgctctgctttgtctgcaccgctacaatacggagcaactaatagtgagatcaacagaaaaaaatttgaagtgcattggaagggaaaatattagaatttaataataacttagtttcttttttcttccattagggagacatattaaacctttttgcttcctaaagctggaatgggtgagcataaaacagttttaaaataatataactgattttaagatttatttttgatctgtattatgatcaggcattagataaaatgtgagaggaaacattagaaaggaaaaaaagaagatacagaaataaaacctcatttttaaatgaagataactgactaccctgtaattgcactctagacaatagatgaactgtgggtttttgatgatcaaccacatgtttttatcactgcttcctttgaagattccgctaaaatgagagtaaaggaataaaacaggtataaaaccacaagtaacaggtgagaaggacaagggatgtcagtcagacaagagatattaacatagctatagaagaatgaacattgatggaggttataataactgatttatcgaactgcagtaaaacataacccgggagaaattcagtgttaggaagcgctagatacaatagagaataaaacaaaagtctgtgtacagagtactccagactccagagcctgctcaatatgtgaaatgtctctagccagatgtatactctccaggaaaaaacagcagggttgctcttctaaagaagctgagcatccctagaggaaagtttttgcatactgacattttgaagtatcccctcaaaatgacctactttacctaatcatcctaaatcacagcccaccaatcaacaagctcaggttagctacatgagcaaacagacatcttctctgttaccaaataatactgggatatcaaggatcaccagttaaaagtttgcaatgtgaaagagaagagcaaagattaaaacaaaaacaggcaaataaactaaaaaggaacacctcaccttgaggggacagacataatttagggaattaaagagaacgtaagaaaaacaagacttttactttagatttgtaaatatattaataaaataagaacaggatgctatataaaaataaatcagagaataaggaagaggtattgaaaataaaaagaattgccaaaataaaaatttcaatagagaagtaggaaaataaattaaaggaaatcagtctataagtagagcagaaaaaaaagaatgtgaaaggaaaggtaagagatctagggataaaaccaggaagttcatccaaacttaaaaagaaaaattatatcgagtatctttcccaaccacaatagtatgaaactagaaagcaataaagagaatgattttggaaaattcacaaatacatgaaaattaaacaacattctcctgaacaaccaataagtcaaaggagaaattaaaagggaaatttaaaatatcttgagacaaaaatagacctacagtgtaccaaaacttatgagttgcagccaaagcagttctaagaagaaggaaggttatagcaataaacacctacatcaaaaaagaataaagatctcaaataagcaatctaactttatgccttgaggaacttagaaaaagaagaactaagcccaaagttactagaaagaagcaaagactaaagatcagagcagaaatacatgaaatagggaacttaaaaatcaatagaaaagatcattaaaactaagatgtgtttttttttcaaaagataaacaaaatagacaaacctttagactaagaaaaaggagagaagactcaaatacaaaaaataaaaaatgaaacaggagatgttaacaactgttatcacagaaaaacaaagaatcataacagattactataaacaattgtatgccaacaaactgataatctagaaataatagataaattcctagacatacatcacctgctaagactgaatcatgaggaaatggaatatctgaacagaccaataatgaataaggagctgaatcagtaacaaaaagtctcccatcaaagaaaagcccaggacctgatgtcttcactgttgaattctaccgagcacttaaagaagaactaataccaatcattctcaaattcttccaaaaaattgaaaagggaatacttccaaactcattttatatggccagcattaccttcataccaaagacaggcaaatacactacaagaaaagaaaattgcaggccaatatccctgatgaacaaaatagatgtaaaaatcctcaacaaaattctagcaaaccaaagttaacagtacattaaaagaatcattccccagaacttcttaaagtatatatgtatacactatatatatatacactatatatagtactatagtatatatactatagtatttatatactatatatatgtatatatatggtgtaaatatatacatatatagtatatatatactgtatatatatactatatatacactatatagtgtatatatagtgtatatatacactatacctatatatgtatatatacactatatatacatatatagtgtatatatagtgtatatatacactatatatgtatatatagtgtatatatagtgtatatatactatatatgcatatatagtatatatagtgtgtatatacactatatatgcatatatagtatatatatagtgtatatatacactatatatgcatatatagtgtgtatactatatagagtatatatactatatatagtatgtatactatatatagtgtacatatatacactatatatagtgtgtatacatactatatatagtgcatatatagtgtgtctatatatactagtgtatatatacactatatatagtgtatatatacatagtgtgtatatatatacatacactgtgtgtgtgtgtgtgtgtgtgtgtatatatatatataacacgtcaggcaatggctgtaagggttaaatcataaacttaaaaaaaatactcatcttgaccaagtgggatttatcccagggatgaaaggatggttcaacatgtgtaaatatataaatatgctacaccacattaacagaatgaagtccaaaaccaagttgtcatctcagtagatgcagaaaaagcatttgacaaaattcaacattctttcatgataaaaaacctctcaactaattacaatcacaataaaggccatatatgacaaacccacagctaacatcatactcagtggtaaaaagttaaaagctttttctccaaggttagcagcaagacaggtatgtccactctcactacagtattggaagacctatccagagcaattcaacaagagaaagaaataaagggcatccaaattggaaaggaagaagttaaattttccctgcatatggatggcctgatcttttttctttttttttattattatactttaaattttagggtacatgtgcacaatgtgcaggttagttacatatgtatacatgtgccatgctggtgtgctgcacccattaactcgtcatttagcattaggtatatctcctaatgctatccctcccccagcctcccaccccacaacaggccccagagtgtgatgttccccttcctgtgtccatgtgttgtcattgttcaattcccacctatgagtgagaatatgcagcgtttggttttttgttcttgtgatagtttactgagaatgatgatttccaatttcatccatgtccctacaaaggacatgaactcatcattttttatggcctgatcttatatatagaaaaccctaaagaccctacaaaaaagaaaagaaaagaaaagaaaaaagctgttagaactagcaaataaatttagtaaagttgcaggagacaaagtcaacatgcaaaaatcagttgcatttctttatcaacaatgaactatctggaaaagaaatcaagaaagcaatcccattcacaataagtacaaaaaataataaaatacttaggaataaatttaaccaagaggataacagactagtacactaaacctataaaataccaaataaagaaattgaagacacaaataaatggaaagatacccactgttcatggctagaagaattaatattgttaaaatgttcatgccacccaaactgatgtacagattaaatgcaactctatcaaattccaatgtcatttttaatagaaatagaaaagatacagtcctaagacttacatggaaccacaaaatactctgaatgtcaaagcaatcttgagcaaaaagaagaaagctgaaggcatcgtattacctgacttcaaaatatgctctagaactatattaaccaaaacagcttggtactggcataaaacagacacacagagcaatttaacacaatagagagcacaaaaataaattcatgcatttatggttaattgattttccacaaaggtatctagaacacacaatgaagaaaggacagcctatttaacaaatgatgttgggaaaactggatagccacacacagagaaatgaagttagacccttatctcacaccatatgcaaaggtcaactcaaaatggattaaaggtttaaatgtaatgcctgaaattctaaaactactaaaatgaaacattggggaaaaaaatctctgtgaaacaaaggtaatttgaatatgatcccaaaagcataggcaacaagagtacaaatagacaaatgggattacaccaaactaaaaagctttttgatagccaaggaaacaatcaacagagcaaagagacaacctatagaataaaagaacatatttgcaaaccaaccatctaataagaggctaatataaaaactatacaaggaacccaaacaactcaatagcaagaaaacaacccaatttaaaaattcacaaaggacttgaataggcatttctcaaaagaagacatacagctagataatagttatatttttaaaatgctcaagattactaatcatcagaaaaatgtaaattaaaaccacaatgagatatcacctcacacttttaaaaatgtctgttatcaaaaagaccgaagataactgttggtgaggatttggagaaaagggaatccttccacactattggtgggaatgtaaatttgcaaagctagtatggaggttcctgaaaaaattaaaaatagaaataccaaatggttgatcgaccccactactgggtatatatccaaagaacttgaaatcagtatgtcaaagaagtatgtgtacttgtataataattacagcattattcacaaaagccaatatgtgtaatcaacctaagtgtctataaactgatgaatagataaagaaaatgtggtataggcaatggaatactattcagcctttaaaaaagaaggaaaccctgtcatttacataagcacggatgaacctgaagaacattactataaatgaaataagctaggcacagaaaagaaaaataccacatgatgtcacttacatgtgtgatctaaaaaagttgaactctaatcccagcactttgggagactgaagcgggcagatcacgaggtcaggagatcgagaccatcctggctaacatggtgaagccccatctctactaaaaatacaaaaaattagccaggtgtggtggcgggcgcctgtagtcccagctacttgggaggctgaggcaggagaatggcgtgaacccgggaggcagagcttgcagtgagccgagatcgcgccactgcactccagcctgagcgacagagcgagactccatctcaaaaaaaaaaaaaaaaattgaactcacagaagcagagggtagaatggtggttactggggactgggagttgggggtagttgttggtcaaagaatacaaaattttacttagagaagaataagttcaagagaccctatcgtacaacaagtgactgtagttaatagcaatgttctgtattcttgaaaactgctaagagtagattttaaatgttcttaccacagaaaatgataactgtgaggcaatgcatatgttaattagcccaatatagccattccataatgtacacctatttcaaaacatcattttgtacatgataaatacatgcaatttcatttgtcaattaaaaatgaataaatagaaataaaaattataaaaagtgaagtactaaagtgacaactgtgcagcaagcaaatttgcaaaggaaccagtccagtttgcagatggctactacagggatttatacagtcatttataatgctatcaccactggttattgatagaactaaaaagtttgctataattgtactagaggattcaggaagggttacatatgtgaaataaatcatttatcatgaaaagacaattggtagtaagcaaaactggtagcagtataaatatattgtataaaagtatagaaataactattagaagtattactatcacctaagagaattaaaaataaatacctacaaggggctggacaatgggtttgggtgcattggggtaagggtttcttgattttcataagttttcaacttcaattttttaaactatgtccattactactttaagttattcaacattaaaaataataaaagcaaatttaaatgaaaaaacaaatctcaacatttaaaaagaagaaaattattcttagaaccatttataaaatttgtataacttcttgtataaattttgcaaaaaatagtaatgcttggactttctttttttattttcaaatgctctagaataaaattttatcttttttacattggagaaaacattcacattctcttcaaatcttggaaaagcttagtttcttgtccttaatggcttttaagtctatgggtcattcctgcaattgtagccacaaatcaaatcaccccttggtatttctttgttgggtaagtaacattcaatatgggttaagttttactcataaactggtggtcttcctaccttgctctgcagtaggtataagtggcctagcagtaatcatagtctcgattgaaacacacacacacacacacgcacacacacacacacatagacgcacacacggcaattatttctggaatacctgtggtttgcaaaactaaactacatggtcccagtactcaggacctgatggtctaagaaaagtaaggcatatatccatatatatatacacacatatacagacagagcactgatataggacaaagtgctgagtgtcacaggagagataaatccaaaatacttcctctctattttgttgtttaccttactgagtacttgactgtttcctaaaaaatctactgcccttgcaagtggaagccactcctccattccctcctgctgcttccaggccactgtttactcctttacttcatgcaaaaagttttgtcctttgatgttcacttcatctggctttatcactctatttttcttcatcttgctcaacttagcaacattattgtattctctccgtgttcatttcatatgtaggatttctacaaccagttcactttatttgcaactgccccaagttctctctttgtttttcaattggatgactcatctgacatcataaactggaattgagcctattaaatgaggtctggattgtcccatttaccaggcattgctactgtttccagcactacgtgaaggtttcagaaatgaaccaatctaactgcctgtatatttgttctagtgttttgtttttgttttttgtattttttttttttttcagaaaaacagtgacagtaagtcagctaattgtgttagtgtttttggaactgttacttgacatcagaagagttttgtaatgaaatttgtggacacatgaggccatatgttccatagggctcgcctctgtgtcatccttggtcaatacccaaattgtagttttctctatggttatttatcctcccctcacttcttatccttatcctcttctgtggttttttcttgacgtatcctcctactcctcataaactgtccctcacttccctcaggaactcctgttcatgggaagataaaacattctgccccagcagcttcttcattgaatgacccgtccacctcctgttttaactgatatgtgattctcagttgagacttccttccaactgccttcctgcttggcagaagctgttaatcagattcccattttccagaagtgtagtttacatcgtcttaatccccagtactgctttcagaccattactctctcactctttgatattaaagatgtcttctttgaaaaaggtgtcaactcctcacttggattctcatacatcaggatttcctgtttttcttgttcgtccttggtattttctttgcactatccttgtcttctttccagcactaaacgttagagcatttcagggcagctcagtcagatctgcaggccagtcagcagtctgatctcttttttattttctgaatctgtactcacttctcaagcgacctcattcaatcccaagacattgaatcaatggccatctagaggcgaacaacttccaaatatgtatctctatcccaaacctttcccctaagctgcagactgatatatgtaactgtgtacatctctattgggattatattcctattgggatgtctgataaaaatgtaattctcatatccaaacacaactcctcatcttccccctaaacctgctcttcttcaagtcttcccagcacagccaataatgtcactattcttccagatgctcaggccaaaaacctggaatccattcttaattcttttatttttcttacctgcccccaactctgctctcagacaacccaaacctaactcatcagcaagtcctaactcctctacgtgcacaatataacttgaatctgtctacttttctccatatctaacattcaacacaccacacctcttcactagcctcattaggactaacatcctaattttagtcctttactttcagtgcctacacatctattctctgcccaacagtagggaagatcaattaaaatagtaaattataaaaattctgctccaaatagtttaatggcttcccactacatttagatcaaattccattattcttacgatggtgctcaaaaccttacaggatcttgtccttagatctgtgatggtacctcttaccatcttttttgaattttcattcactccactcactcatcccatagtggcctccttgatgattctatttatttatttatttatttatttatttatttatttatttatttttgagatggaaactcactctgtcacccaggctggagtagagtggtgcaatctcggctcactgcaacctccatttcctgggttcaagcgattcttctgcctcagcttcctgagcagctgggactacaggcgtgtaccaccatgcttggctaattttttgtatttttagtagagactgggtttcaccgtgttagccaggatgatctcgatctcctgacctcatgatctgcccgccttggcctcccaaagtgctgggattacaggcgtgaggcaccgtgcccagcctccttgatgattcttaatgaatcactttcattccaagcccaggtactttgtcattaccattctttctctatggaatgtttattgttgagatcttttcacagcttgctttcttattttgttcaggtctctacttaccttctcaggcagaccttctatcactagcattcatcatctttttctgcactgccctgctttatgtgcttccatgataattctcacctcctgacattacattgctttatgcatttttttgcttctatgtttattacatgtccccccaactgggatgtgaactcctttagggcaggagctgtgttttaccatttattcctgcaccccaagcacctagcacagaacctgtcacattgtagacgcagaaaatattaaataaatggatgatttcctatgttttccttgcttctctatccagcataggtcccacactgtatcactgcagtcactcaccagcactcttgacctccctagtcacttcagtccaagtcctctatttctctccgaaaaaaaaaaaaaatccattgctattgatggattggtgacatttatgagtgtatttttgaattctgctgttccttcaacctatgcctgcagttactctctgtccctaattagttctgtcttctttattctacaaaatctagtttaaattagccaggcatgtctacagctatctgatctttgacaaacctgacaaaaacaagcaatggggaaaggattccctatttaataaatggtgctgggaaaactggctagccatatggagaaagctgaaactggatcccttccttacaccttagacaaaaattaattcaagatggattaaagacttaaatgttagacctaaaaccataaaaaccccagaagaaaacctaggcaataccattcaggacataggcatgggcaaggacttcatgtctaaaacaccaaaagcaatggcaacaaaagccaaaattgaaaaatgggatctaattaaactaaagagcttctgcacagcaaaagaaaccaccatcagagtgaacaggcaatctacagaatgggagaaaatttttgcaacctactcatctgacaaagggctaatatccaggatctacaatgaactcaaacaaatttacaagaaaaaaacaaacaactccatcaaaaagtgggtgaaggatataaacagacacttctcaaaagaagacatttatgcagccaaaagacacatgaaaaaatgctcatcatcactggccatcagagaaatgcaaaccaaaaccacaatgagataccatctcacaccagttagaatggcgatcgttaaaaagtcaggaaacaacaggtgctggagaggatgtggagaaataggaacacttttacactgttggtgggactataaactagttcaaccattgcggaagtcagtgtggcgattcctcagggatctagaactagaaataccatttgacccagccatcccattactgggtatatacgcaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaaggatgagttcatgtcctttgcagggacatggatgaagctggaaaccatcattctcagcaaactatggcaaggacaaaaaaccaaacaccgcatgttctcactcataggtgggaattgaacaatgagaacacatgggcacaggaaggggaacatcacacaccagggcctgttgtggggtgaggggagaggggagggataacattaggagatatacctaatgctaaatgacgagttaatgggtgcagcacaccaacatggcacatgtatacatatgtaacaaacctgcacgttgtgcacatgtaccctaaaacttaaagtataataataatataaataaataaataaataaataaattagccaggcgcggtggctcatgcctgtaatcccagcactttgggaggctgagaattgagtacagattcagaaaaaacacctgaggtcaggagttcgagaccagcctgaccaaatggagaaactcccttctctactaaaaatacaaaactatcctggggaggggggcagcggtggcacatgcctgtaatcccagctactcaggaggctgaggcaagagaattgcttgaacccgggaggcagagattgcagtgagccgagatcatgccattgcactccagcctgggcaacaagagcaaagttccatctcaaaaaatatatatatacatatatattctagtttaaatctttgctatttatttaaccttcctcatggggaatgtagaagccattgtatgagatttcccttaacctactgtgctcctttctctccaccaaaatatagtatctaatctcatccattctttccttctcagctgtgatctggacctgagaaattccacacttatgctctagataacccccacccccccaccgcctttacaggaaagtggtgcaagtgattatttttcttccatctgcattttctctcctttccattgacttacctgacagttccaaattcttccttctcttgaactcccttgatttcattattcatgcccctctgaatgtttctaatttgtgctttctcctgtatattttaattctctcttattttaattaaccttcctcactaaactagatttcctgagggcagggtctctgatttaatcatatatgtgtatatatgtgtgtgtgtgtgtgtgtgtgtgtgtgtgtacacatactcgtaaatatatataaccttaatcaatttgaattgtgtaattcagtcctgttaaatacattcacattgctgtgcagtctcctgaacccttttcatcttgcaaaactggacctctgtattcattaaacaacaactccccattcctttctgccctagccccagcacccaccattctactttctgtctctatgaatttgctactctagatatgtcatagaagtaaaatcacataacagttatccttttgtgactggcttatttcatttagcatcctcaagattcatgtctgttgtagtatatatcagaatttccttcctttgtgaggttgaagaattgtgaatggaatgaattcattgtgtgtatataccacattttgtttattgttctctcgatggacacttgggttgcttccaccatttggctattgggaataatgaaggtgtgaacatgggtatgcaaatatctctttgagaccctgcttataatttggggatatatactcagaagtggaactgctgaatcatatagtgattctatttgtaagtttttgaggaaccctcacaacattttccatagtggttgcaccattttacattcccaatagtgcacaagggtttcaatttctccacatccttgccaatacttgatattttctggggttttttggtagtacccatcataatgtgaggtggggtctcatggctttgatttgcatttctgattagtgatgcttaccatcttttcatgtgattgttggccatttgtaaatcttttttggagatatgtctactcaagtcctttgcccatttttaaattgagttgtttgggtttttgttgttggttttattcatctttgagtcccacatagcatatattccattgttttgccccacttctggaaatgggctcagaaaagctgagcacctgcaagggggttgacacagaggcactggaccatgtaagtatatactctgaggttctagttgagcttcacctttagagacaattgacaggagtatcatcggaggaagactcttgagtgggacatgcatttctctataaaagttttcattgcctcatcacaaaacccacatgaaatagatttttagaaggaaaggcgttcctgttctggattcaaactccttgggaaatttggagaagtcaatttccactttttggttaggaaattgccctaggctgaactttggagacatgctatttatgcagcaaaggtcaagactcaggggaaacaaacaataaatcacattgataatcttcaatggtgggtattttttcattcagtaaacatccatcatttgcctaagagccagatacttggctagggggtaggaatattatgacaattcggtcaaagttaagtcatctcagtctgtatctatcaaggagaattactggaaaactaggtgtagaaatgggtaaatattaccattaatctatggctcattttcctattttcttgacactcaaattttgctttgatttccttctttaatgatttaggtaaaaaattgtagtggctgattaaaatgtgtcatgttgaaaatggtggaagaaattaaaaggtaattttcccttactacttaaaaaatctgtgattaacgtgattgctgcttctccccatctatagaacataaagtgcctatggagctaaaaaaaagtattcattgttcagaatcactgtttcagagacttagtcatagccagtttataagatggctaagtgaagtaacatatataaaagcttctagaaaagtcagggcaatattttctttcctttcttttttcttttctttctttcctataatttttggtctacccatgaaaaaagagtttactaagcaaattaataagcaagtttgcaaacaagcaaagcacccttttatttaatagcaaagacatttagcagcagggctctattcacacaatgaatttgctaattataagtgagtcccatgtagtatttaaataatttacaaggtttttagaaaccttagagttctgtcccccttccacttgtaacaatgtgattgcaatccccagggagaaagaatattgctttcaaaatatcctattagtcagactgttcaatttacgtaaaccaacatcctctcatctgtcgcacttcccgtccatgactgaaaacactgaggccaaaataagcagacaaagcaagagagcatagcatataaggcctttcaaggtcttgctgctgcctgttttacacagcctcagtttctgcaactctttgccatgcacgctgtggcccagctacagtaaacttcttgtcaactcaaaaaacagtgcccttggccaggtgtagtggcttgcacctgtaatcccagtgattttggaagccaaggtgggaggatcacctgaagccaggagtacaagaccagcctgggcaacatagtgagacatcatctctaaattaaaaaacaaaaaaatagctgggcatggtggcacatgcctgtagtcccagctactcaggagcctgaggcgggagaatcacttgagcccaggagttcaagactgtagtgggctatgtttacacaaggcccaccagcccaggtgacagagcaagacccatgtctctaaaataaataaataaagtgtccttggcctgtgtactggcctttgccgcatgctcatcttttgtgacccagagcataaacttcattgccttctctgagccaccttttccaatgcctgcaggtactttgtccctcctttgactgatttcccatagtacttggcccagatctttgagaagtctgatcacgttcaatggcaatcgtgtgcttaaaaggctttctcccacacccgagtgtgagctcctggaagacagggactcatgttttaccctttccatttatctctaagtacctagcatagttcttggcccagtacgcattcagtaaatattgggcaaaagttattaggatcactatagtaaatggcagtgacgtctaaaggagaaaaaataagaatgatggggactctgaagttaagaagaaaggatatatgaagagatgaggagataggggtcagcaagagaggatggaaatagagaaacacacaaagaaaacaagtaggaagtgaaggaataaagaagtgaagcctgggttctgggaagcaaagtaacatcaagaatgcactcatgaggtatgtgaaattagggcatttctgaagctcatctatacccacttttccctagagccaaactgggatggaagaaaaggccagagtgaggaatgaggcaacaaaccatctatagactatgagctaggccactgcatttggcctggggctggggttggcctccttccctggcctctcctgttcttcagcttctcagtttgtatccaggcctaagcattgtctcctcttctctcttctgcatcaggggaggcccagtgaggctctctgtatacacaagttcatatatatgagagcaaattggcctgtgtgtgtgcttgcttcccactgggtgtttgagtttctttcactcttaaaaataagcccaaagggcagtgacatagcaactccgcatctatctctgcctttgctatgtcagagagtcttttacatagctctgtggaaagccttggcccgctcctgagcttgctgaacagttacactgcatgaagggtgggaagctgttgtaatgatgcatgtcaacatgccatggtatgtattgtctttatgacaaaatgacttttcagactcaccaagctctcttcctcacaggagatgtgccacttgatggtcacggccttctggagttatttcttgggtaaccaaaaagtgtccggggcctatagaaagcagcacagtgtagccctagataaaaatctcttacccagattgcaagttaggctctgccacttagtctgaggctgagttttctcatctgtcaaatgggagtaatctcatccacctacctcataggggttgctctgaggatcgaatcacatgatgtataagattccacatgtgaccaacattccacagtttattggcgatttctagctccattctcttatctgatcctctcaacaatcctgaaaattattttgatcctcattttacagatgaagaaactgaggcatgaagaggaaaagtgacttagccaaagcgacatagctcgtgagccaggatgatgcacgttttctcttttcatactcatcttcagttattccttgacacaaacctggttactagtgctattggctacatggcccctgtgccttaacttccctcatggctcctcctccctgcagcctctgaaggttctctgtgtaatgaattaattagctttgcttttttctccctttccccccctctttttcctggcctctagaagaaaacaccagcagccccagcaaagaaaaccagcactaccttcaacatcgtggggaccacctatcccatcaacctggccaaggacactgaattttccaccatctccaagggcgctgctcccagtgcctcctcaaccccaacaatcattgcttcacccaaggccacctacgtgcaggacagcccgactgagaccaagacctacaacagtgtcagcaaggttgacaaaatttcccgcatcatctttcctgtgctctttgccatattcaatctggtctattgggccacatatgtcaaccgggagtcagctatcaagggcatgatccgcaaacagtagatagtggtggcagtgcagcaaccagagcactgtataccccgtgaagcatccaggcacccaaaccccggggctccccttcgcgtatttcaggattctcctttttacccctctaccaagctgtgaccctcaattcatatttatgaatctctacgcaaaaaataactacagaaaaattacttgtccctccaatattgcccagtataaccccatcaaagccaaacactgccatttgtccagttgctcatcttagtctgccaatctcccctagctgagggcactgcatgtattttattgcactctgcccgctgcaaaaagaacaagagattctactctccatagtggaagccttggctgtttgagaggcccagaacaaggagaattgttgactcccatctagatcagatgactctaacttactaggcagccaggttaggctaggccatgtgatcctgcgtgccacctcccctgccttcagcaaggcctactaggcataagtactgatagcaaaggtgggagccagttctacacccccaacccatttattggtttggaaattagtggggacaattggtactaaccaccgtctaccatgtatggccaaaataaatagaactagctctgccagcctggcaccaagatggctggtgccctgccatgtccagcccctcgggaaaatagtcccctccttggtacatctctcctccagaaaatcttcttcccccactgcctttggcacccttgtagccaactgagcactacttaatttggactcattaccacctgtaaacttttcaggaaaaaatgatcaagcattttttatttatatcgaaaagttgcaaatagaaacaaagtgatctagatttaaaaaaaacatttttttaaaatatgggagagatacaaaagtcacctccctgccaaggcaactagcctatactggattgggtaagaggtttggagtggatggtagttgaggattgaagtctggctcaaaagagaaggctactggcagatgaaagtcaaattcttccttccatacactccacattccacaccctggcccaggcacttttctcccaccatatcgggaacctccggtcctctgttgatgccgattctatgaggggtgaattggaaattcatacaaataaatatctctagtcaatattgagtcaactagatcattaactttattgccaattttataatatattatttagaggccatttgttcttaatcttaatgtgagtaaaagacacaggcataaatacgcaatttttataaggtagataaactgaatcccagaagtttgaatgatttgcctaggctccttacaagtgtctttaataaagagctatcgtgcgcccctttccaaaggccaaaataaaggactgagaagccaggtccaccgtgacctcagaatcagcacaatctcagcgggccttctgggtcactagtggaacttggttgggcaccaaaaaggtttttagaaagtcacaatgtgtcacccaagaagatcacttttaatagtctcagcccaagagaatgagactgtttatgatggcagccccagccactttggctctgaatacctgcactagtccagagtatcctagaagcccagggtaaagccacagagggcaccacaagcagattctccctgcccaccggctgaacaaagctcctaaggggtgtatcattagctgctggttgccttttcatccatcctttccccgtcccctgcttccttgccattgctgggataatgcatgcccgtcccattattcctaagactgtgtctgtaggtaaattcatgactagaagagtgtagtcttgtggatatgtggggatatggggggtgggagggcggggctgttaatggttgtcttaaggaacttagaatggaagcctgatctttgcctctctgtagaaattgtgtttccaaatgctttggtgcaatgtttagctgctgtttattaaaccctttctgaattgta

SEQ ID NO: 130 - DNA, 58509 bp, Homo sapiens
gcaggaagacggcgctgcccggaggagcggggcgggcgggcgcgcgggggagcgggcggcgggcgggagccaggcccgggcgggggcgggggcggcggggccagaagaggcggcgggccgcgctccggccggtctgcggcgttggccttggcggcggcggtggagaagatgctgcagtccctggccggcagctcgtgcgtgcgcctggtggagcggcaccgctcggcctggtgcttcggcttcctggtgctgggctacttgctctacctggtcttcggcgcagtggtcttctcctcggtggagctgccctatgaggacctgctgcgccaggagctgcgcaagctgaagcgacgcttcttggaggagcacgagtgcctgtctgagcagcagctggagcagttcctgggccgggtgctggaggccagcaactacggcgtgtcggtgctcagcaacgcctcgggcaactggaactgggacttcacctccgcgctcttcttcgccagcaccgtgctctccaccacaggtagggtatcctgcgcgccccctggccgccccggccacctcgcccacaacccacacaccccggccccggcgccccgggcccctctaaccctcccaccccaccccccacctttcgccatcccggctcctccagcccgcctcccctcactgtcctcccgaccctccgaccttccccttactggcgtccccggcctctgcctgggtgactcgggagggcaagccctgcggagccggaagccagagaggtgactccagacgtgacttggttgttgccgtccgtaactctggggaagtggtccctaacttcggcctgggtggctgcaggtgcttcctccccttgagttcttttttcgcaacccactaagccaaactgtcgggtttgaatgtgtagcagcacctggccgccgtgcggcaaggcagcgggatgatggaaactcaccaccttcctcccgcacccatcccagaggccgaggctgcagtctggtaataataccttctaaagggtcaccttccggagtgtgccgtccctttggaccatgcacagatattccagctcttttgtaccttggaggcagttttgggggtagccgagtgacatcactctgctcttcccaggtgacctctgggcggacaggccgatccggtttcttttcagagtaggaggaagggtgagggagagtaaaggaaccataggattgcctaagatctgacttaattggggcaccctgattcagcagttccttcaacttgaggtgtgcgaggctccccataaacttcgaagcgccacgtccccgtacgactcacccgcggggcgcccggccatggaggagcctcctcaggtgaaagatgaggccgggcgcatgccccagggctcggtcactgtgccagatcagatgaatgaaggccgaatttccccagccggacctagtaaggcacatacccagagtggagatatcaattggtatttggacagtgggaggaatctgaaagagcgttcagcacagtcccttcttttgatctatgagatccaatctttgaaataatccatctcgtcatgcacaaggtcacacacttcctagttaccagtgtcgtcctggaacctgggccttgtgatttctctgccaggaccactttgtaaccccccaccctcaacctttacaggtgaatcacatccctttgtgtgactcccaactcttccttcctccccacccccctccaccacccaaattattgtgtataattccctttgggctatatcttgttgactatcttggtaattacttggtaatgagtaataatacactattcatgtagatcacatgaaacaattattcagaggtctggggtgaattactaaactgatgtaaatctaccctgaaataaacagaagtggaattctagcttgtattgtgagatctaaaaaactgttaaatgtagcgctagacaagacagacctgttatctcactttccaaagaatgcctgttcccttgccaatacaatttaatttttctttccataactctgcctccattgtctttacctagtcctctgttcctcagatcatttaggagtcaccatgcctttcctttggagtatatttgtgctatattgagagtcattcattcttcccagaagtaagtgtttccatggggctacagaaagtttacaactgggtcacaatgttgggtaaacatttcgaaggatgcttatagcgtgtggtgttttcttactaatgatattgtgaggatagaacaagaataagaacagttttgaggaaaaaggtttgcttttatctgggtgggatttttcgtgactcatgtatagtcttaacatcatattgtctaattaaatgttaaaaattagtttataatcttgaatagatgaaatattcttcccagaggagaattagaaaaagggatagtttctgtttaagaaaggggtggggtgggaatagacgtcttattattggtattcagattgctttgtagttcctaagaaagtctgtattcatgcaaaacaagtgttcatttaagaaatcagtgcaaggggcacttaaggataaactaaatgaaaaaggtgcctcttggtttgtaaagttagcacatcaatgaattcttgttatatgaatacaactattctaaatgaaaagtactcttctgttggctttgtactgccccattatttgacacatttgatatttcttaaggtttcaaaattataattacccattatttgattcatttgatgttttttaaagtcttcaaattatcataggtgccctggccatgaatcttataatgggtgagaaatcttttcttccctacaaggggaaataaagagatgttaaattgtgtgctggaaacaaacaatattttaaatcacttgctggaagcagacaattttttagagtaaagctgatgtgcttcattactaggaaaatattttctggaaaagcgccaaccaaataaaatgagttgcaatcgcttttcgttttttgggtggatattagacatgttgtgctttttttttttcttttcttaacacttctagtccttttgaaggcaaatcactgagataattgttacctaattaatcagtacagtcaatccttgacttattcagaatgctaacaatgagcattacaaagatgctgttattggtagtcattgttgtaacacaggcccatgagtgcttttatgtcagaatcttctcaccccagaatgtacaaacttccgtttctggaaggaactgagtaaagtcttcatggtctacttggaagaaggcttaggttggtaattcagcaatagtcttctcattctgtgctttgccaaagactctgaattatttccagcaaacaatttaacatctctttatttccctttgtaggaaagaaaagatttctcacccatcataaggttcatggccggggaacttataataaaatgcaaattaacaagataaaagcacacacatttagttaatataagttttagatgacatagacgcctttagaaatgaagaccccaagaaacagggaagtttatgtatttttaggacagttgtgtagacgaatgattggagaacaaaaggatatgatctgactgagcacggtggctcacacaggtactcccagcattttgggaggccagggtggaaggattgctggagctcaggagttcaagactgcagtgagctatgattgcaccattgcactctagcctaggcaacagagtgagacctcatctctactaaaagttaacaaaattagcccggagtgatggcgtgtgcctgtagtcccagctacctagaaggctgaggcattgagtctaggagtttgaggctgcagtgagctgtgattgagccactgtgttccagcctggacaacagagcaagactctgtcttggagggggaaaaaaaaagaacaaagaggatatgatctaaaaagctaaataactggaggaatttagcaaggcctatttgttcagatttttcttggaatctctgtgtcttcaaagatagagcattccttttctcaggatataggatgggctcccttgtaatgagggtcttcttcaaaggaagggcagagcttcagggaagaaggttaagaggaaggcgagaatgatcttcctgcttctgctgttttctcaaatgctaaggtgccctgtttgggggtcgcatgccctgaactccatcacccttcattctaaaagatacggcaacatctgcataggaatcttatgagaatgagtgaaacactgcaatacagttttgagcttttcagaaagaagagttgtatacaaaaaaaaaggaggtattatagactgcagaatttcccacagaacttctatactgtgttttttttttttccccaaggattgaggaaataatgtccaggtgatatttggggagtaagaaataattattaaactttggtagccatctaaaactttggacagtgtcgttcattcttaagaacaatttgtgatgttgatttactaaagtttacttctttattcattccccaaagcaaggccatgttatgatgacaactgttgggtaaaaatacagtttttgcccaggcgcggtggctcacgcctgtaatcccagcactttgggaggccgaggcaggcagatcacgaggtcaagagatcaagaccatcctggccaacatggtgaaaccccatctctattaaaaatgcaaaaaatagcttggtgtgttcgcatgcacctgtagttccagctactcaggaggctgaggtgggagaatggcttgaacccgggaggcggaggttgcagtgagccaagattgcaccactgtactccagcctggcgacagagcaagactccatctcaaaaaaacaaagaaacataaaaacaaaacaaaacaaaaaataatttttgtattcatgcagtatacaaacttttagtaccttttgctgctttgtaaatgtgggatccatgtgacagctcagttcctgttcctttttgtttatttttattttttggagatagggtctcgctctctcactcagtctggagtgcagtgacactatcgtgggtcacttcagcctctaactcctgggcttagttgatcctcccacttcagcctcctgaggagctgggactacaggcgcacaccaccgcacctggccaatttttttttcatttttctttggagagcgtggtcttgctttgttgcctgggttggtctcaaacttgttgccttaagctgtctcccacctcagcctctcaaagtgctgggattacaggcatgagccaccatgcctggcccctgttcctgccattggtaaccctggtgcctttagccaggatgctgctttatccctatttatgaagagatgcattgaaactctagttaaagtgttcagtaagtgaacttaattgggcttggtgtacagtggcttttgattaaggcaggtagggagctgctacaacataggtagttttcaaataaagaagatgggaagaggcagtgggggatgctggactgatccttagttgtcaaattattttcagtagtacaaatgtgttgttaccatcaacaaatacttgttgcgcttttagaatagagtgaagtgggccagacacggtggcttatgcctgtaatcccagcactttgggaagccgaggcaggtggatcacgcagtcaggagttcaagaccagcctggccaacacggtgaaaccccatctgtactaaaaataccaaaattagccaggcgtggtggtgcacacctgtaatcccagctactcgggaggctaaggcaggagaattgcttgaacctgggaggtggagattgcagtgagccaagatcacgccactgcacaccaacctgggcagcagagcgagactcctccgtctaagcgaggggggcgggggggcgggggggcaggggggtgaagagtagaacgaagtgggcgaactagggcccctggacctaatctagcccaccacctgtttttgtactgcctgagctaagaatggctttatattttcaaatggttgggacaaaaaaaaagaaaaagaaaaagaatgttttctgacacagtcaagttttatgaaaatcaaatttcattgtccataaacacagttttattggtgtgcagccacacctgtttgcttctgtatcatttatgactgcttagcggctaaggtggcagagttgaatagttgaacagaaaccatgtggccacaaaacctaaaatatttactgtctcacaaaaaaagtttgctgacatctgcttcagaatgatacttgaaaggtacgctaagagtattctgaatatttcactttcttctgggaaactttgtgtaagaaagttcagcttctcagacttctttgtgctgttgttctaagtggtatgcaacattgaataaattatgtatcaccaccaaccactttcaaaacaaatgtttatttcagatgccacttacttgtgatccaatttgtgtcactgctttttttttcctttaatgatgacagtctacacttcacattgtgattatcttatctaaaatgtgcaataaatactaaattatatctactatagaatttacataaaattaaacaagcaaactctgtattagccagaagagagatccaaaatcccatattctgatgtttgtgctctgtattcacaggtcttgattttgagcctttacatttaattctagaagttttaattatctggttttcaagcctataatataagaaattacagagggaaaggcacagctatggggaaatagacatggcaggttataaaaagataaatagttaaaaaattccaaactaaaattttattttaaaataacatctttattgaaccctttatatgtgccaggcaatgtttacacatattcatttccatgcattgcaataaactgatgagatataggtatcattgtcttcactttacagaggatgaaacggaaattaataggttgaacaacttctctacttaggtcccaaagccggaagtgacatggtcttaatttgaatgcagttatgtctaagaacctgagctttaatagcatctgggcatcagaccttgttatgggccaaatcgtctccctcaagttcttatgtcgaagttctaccctcagtatttcaaaatgtgactgtatttatagataacatctttaaggaggtgattaagataaaatgaggccacagtgagaaggtggccatctgcaagccaagagaggcctcagaagaaatgaagcttgcagacacattgatcttgaacttgaagcctccagaactttgagaaaataaatttctgttgtttaagccacccactggtgatattttgttaaggcagccctagcaaactaatatagaggtacatgatagtttttatttagttgcacaaaacccatacaaatagtggaggacaagagacagaatcttttaagtctttagtcttgcaacgaacaattttatatacctgaatgggatgtcattgttttagagcgcaatatagtaatccacgtccttgaatcatcaagaaaaatatctcaacatgtttctacttaagaaggcagggaagtgtataataaattctagaaacatttccacccaataatggtcaaagagaagagattcttagtgtttaaatctgtgaactcatacctgtctataaaacataccagtttttagtattttgaaggtttggggtttttttttaactataaatttgttattatctatgcctattttatagcccctggaagatactgctactattatcaataacgtggaagaaatgatgtctttccttttatgacataactgtgagtcctatcaaggacagaatctttgattgaaccagtatcctaagggaactctggtgctctcagaacaagctattttatgacattgctcattggagtgttactgtgtgtgactgtcattttatagcccccggaagatactgctactattatcaataacttggaagaaatgatgtctcttcttttatgacataactgtaagtcctatcaagaacagaatctttgattgaagcagtaacctattgggaactccggtgctttgagaacaagttgttttatgacattgctcattggactgttgctgtgtgtgagtgtctattgtctttggagcatgtgaattgccgacactcaattgttttgacccataaaaatggcaattccagaaggttcagtttactacaaggttggtttcagggacagaaatctcatctgcctcatatactctgacatactcagagttgcacctgctggcttttattctccaaagacatcttccaattgtattattgacaaatccgtgaaatactaaggtgctgaagttctccattgactgtgtcatgcccaggtggcttattcaaggcaggagataaaggttgtcactttattggaaagcaagcaacttttgaggtgttttattgactcctgtgatacttctatctcctagactcagtctgtactctgactttctttgtttcttttgcatggatcccttattttttgttcaatccccaaagttggtggcccactctctgtcagcagcatattgcaaggtgatgcccccgatctgaggctgaatggaggaagaaagagaatagggagttggagatgtagagtttgtgcacctgaaaggactgtgggattgtctccttgaacttgagtcagatcagaagggcttatctgtgactttctactggttttcatgtttgccttctttaatttggaaaacagctgattgttatattgatgagattaatttgcttaggttagacatgggagtgtttttaatttgctaccgtctgcttgatcccagatcagagtctaactttttgcattagctcctctgactgggattgaccaactttgtgaaataaaagcctgcccgctgctgcctctgagactcagttattagtacccatggaagggctttaggcagaaagctctcagggaactcagagagagtcggtgaaatcatggctgatgcattcagaggacagaaagccaggcacagagtgttaaatacaacattttctcacccatatgtggaagctaaaaaaagttaatctcaaacagtttttctaatgcactaacttctgggattatcttttcaaaaagaaacaatggaagataatgaaaacaaatggaaatggttagcaagaaaaaaaaaaggttggctttatagaagtgaaaagtaaatggagcatactagcatctgggaagggtacggggaggggggatggggagagatttgttacaggatacaaaattacagctagataggaggaataagttctggttgtctataccactgtagaatgactatagttaacagtaatatatagtttcaagtcactaaaagaaaggtattaaatgttcccaacacaaagaaatgataaacatttgagatgatggatatggtaattaccctgatgtgatcactgtacattatgtgtattgaggtatcactgtgtacctcataaatacgtaaaattattacgtgtcagttttaaaaagaagaaagaaaccttttgttttttgttattgagacggagtctcgctctgtcacccaggctggagtgcagtggcgtgatctcagatcgctgcaacctccacctcccaggttcgagtgattctcctgcctcagcctcctgagtaactgggaccacaggcgcatgccaccatgcccggctaacttttgtatttttagtagggacagggttttgccatgttggttgccatgctggtcttgaactcctggcctcaggtgatccacctcagcctcccaaagtgctgggattacaggtagcgtgagccaccgcaccttgccaaaaaagctttctttaaaaaaaagaaagtaaacctgaaactattcaagtcaaaaaacaaaacaaaagcaggtagaatgtttctaagggatttagagagagtaaaacatgttaggtttcatttctctgagtatgatcaatagagttggagttggaggctccagttgtttacggtcatctcttgttatgtggggggctctgtgacctgagttaagctatttactcaagtcgatgccccagttccctattcactctgcttcactgaagcctcttggggcttatttagacaatggtttcatcatttcgtctgaatagagtctgaagagtctttggtggaagtatgcactgaggagggaggcggcagaagtgccctatcccaggaaagtgtgctccccaggatgcgctgagccaggcacacacaggacttggggctactgagaagcaggttcttttcaagttctgttgtcccagacacctcctccatttcttcccgctctttctccacagcacttagctttctacctgctggttcccgtaacatctgtcttcacctggcctcacctatcttcacctggcctcacctgtcttcacctggcctcacctggcacctggttcccatagcacctctcttggcctcacttggcatccctagcactcaacaggtgctcaaaaggagcaacttaaggcacatttcttcatatgtctgaatctgtgccttttctgaaaaatgaagaaggttctaaagatgttacttctattcaagagaccttagatataactttattctcttgatgaggaaacagaggcctgcattgccaaaatgggttttgaagctattcatataaaaacaatgatatctggggggcctcatgtgtactcggtgcaccacaaaaggccctaagtgatataaagagaagagaggcattcattcctctctgagtatttgtggagcactttggttactaggtgctactccaggcacttagggatatgtcagggaacaaaaccacaaaaatcacttttgccctcctggatgtgtcagtctgggttgggatcggagatacaattgtaggggccaagagaaaacttctccttcaccctctgaagtttcactgaaaatcacctgataaaaggcagattaataggagaaaaggcatatacagttgcttgaccatagtttatgtgacatgggagccttcagaatgaagacccaaaaacacaggggaaaccattcacttttatgcttaggttcaacaaagtataaacaggtgtgtaaaaaataggattggaccaaaagggaatgatctaaatcttataagaccaagcggggaagcccagcaaggcctgtctggaatcttctcggcctctctgagcatgtattccttccttctgggtgtggggcagcaccctctctggaatggggattcttatgacctacagtcaaacaagatgggtcatataatttcattggccagttttacatagaaaggtggaggaaaagttttatggttttatggctggctttggggaaatggggttctggtctctaggatccaccttggggaagaggtattccagattttatggctagcctgggggaggatgaggggtgagagataggagggcaggagaaggtcggagaaaaacttttgcttctgggaccttgattttgggttatcattttctgagctccagcatgaacaaagagataactaagggaaatgcacaggatgttaggtggtgataggtgctcaggaacaacaatgcagagcaaaggagatggggagtgtgtgattagtgtatggtgaagggggcagagtccaggatcgtagtcttccataaagttgcccgtgaaagccttactgagaagatggcacttacgtaaagagtgagaggaggtggggagtgccttatgcagttttctggggagctgtgttccagaacaaaggcacctattggaggtgcagctagaaagtgactgtggctggagctgagtaagaggggagtgatgaggtcaggaagaaggggagggagcagatgctgtaggatgtcctaggccactgcaaaacatctggcttttatctgagctaggggaaaagcaccaggagattttgagcaaagggttgacacaatctgactgactgttccaacgcgttcactctggctggtgtaggagggcaaggctgaggctgagactaaaaggaggctcttctgatgacccagggggtcatcggaccaccgatgcctctcggtgactcagaaaagtggtgatgagaagtggtcagattctggattcatattgttggccaaaccatctggctttgctgatggattggatgtgaggggtaaaagaaagaagagtgaagaatgacccccgggtttctgacctgagcccctggcaatgtggttcttctttacagaccaaaggaaggccatggaaggagaaggtgttggataaagaatctcaagcaggttccagaacctgctgaacttgagatcccttttgggtgtccaggaggatctatctacacaaggcacacagtaaaccctaatggggcgtgatgagggccacactcggagtgtaggtgacagtgccttctgttggtacagcatgccgtgatgtcatgttgtatcacacacatcgattaactcactgcagaggctgaagaaggcttttgggggtgatatctgattttgaccttgaaggaaaactagaatgtcagtaagtagaaaagaaagaagaggtcattcagactgagaatgtgagttccctgggctgatctgccatttaatgaatacatttaacaacagcgttaaatacttccaggctaagaaagagtacctaaactgtaatattgttttctaatttaatattacaaaaggttgtttgggaaactgtagagaaagcccccaaatgaagtatttgcttcatattttcttaaaattaacagtaggatatttagtatttgatataatcgtttaataaaaattatattttatataattcaaagaataaataaatatctccagtactcttttaaggagtagctaatattaaataaagccaccaaggaatgaatctaggtggtttctgtttttaggaagtaagtaagtaaaacatgattttttttttcacaaacaatctaaacattttaggagtgtgtcaggttcaaataaacacattgacgatttttacagtttgtactgatgggaggattttcatgtgactctcagaaaaacacctgagtgattttcatttttactgcattgttgctttactgtttgaaatgatcccatgagtataacagggctggctccttgctcattattgatcatctaaacatcttctttatttccctcaaatactgtattttttatgaagccacagcttgtaaataacaggaagggaaataaagtgttttaaactagaattaaaaggttaaaatatggttgtaactcacattcttcaaatgtttgaacacgggttaccaaggcacttaattatttaaaaaccatggttagatggattaagttaattaaagaacctggagaggctgttccgcagctgcctaggtgtcagactgactcagaaattctgactcagaaattctgagtagcaaagcgcccacatcgctacctacctgccacccagtgctctgacacgagccatctcagaaaaacagtctgtcgcccacgggccagctccagcagatgcacctcgcagtgggagggtgggcgggtgcggatgagctgagccgtttcgcacccccagacagcagggaagagcactgttgtgtggatccacaatctgtcatccactgctactcccatctcaccctcccctccactgcagagcagctgatgtttgaaaatccaaccaaccaagatggaataaggaaaaaaaactaaaattttaagaaagttggggagcacaaaaaagcaaatttctgttagtagttgatgggatgtgacctaaagcaatatttgctctttcagcaactctggtggaacaccagagttatttgtaatctgaatgaggctaaaaggatatgtttggcacctgaacttgcctgtctagattctctgtttcgcttcactcagaactatgttttgtgcgttgacttgtgttagtcatctctacccagatgtctgggctgtgtctcattgacccagtggcagtggagtatgtgtgccctcagaatttcttctgcctgtcttcagtgtcccagtctctacacaagctcagctaagggtggtgccatctcacgggagcattccctcataaccatcactggcttggggaatggagctggcaaatcaaattgtcatcggtgatatcaggctgaatgaatactattgaaaagtccaacctcgaagatggaaacagtaggtattggagaatccagaagagggaaggatggaaggagggccagggtccagaaactacccattggatactatgttcactatttgagtgatgagttcatgagaagcccaagcctcaccattatgcaacatacccaagtaacacacctgcacacgtacccccgaacctaaagtacaaaagaattgtaacaatttaaaaagtcggccggatgtggtggctcacgcctggaatcccagtactttgggaggccgaggtgggcagatcacctgagctcaggagttcgagaccagtctggccaacatggtgaaaccctcatctctactaaaattcaaaaattagccaggcgtggtggtgggtgcctgtaatcccagctacttgggaggctgaggtggagaattgcttgaacttgggaggcagagtttgcagtgaactgagattgtaccactgcactccaagcctgggcaacagagcaagactctgtctcaaataataataataataataataaattttaaaagcccaacctaatgtagtgaaaagtgagaatcatgaattatttttagggaaaatgtttatgttcagagatactgaatgaccttacatagactgaagtgaatgtgcggattggaagtgtgaaagcgttgaactggggattggtggcctgggttctcttcagacaagaattcattgtggatttctctagatttcggttgcttcagctatacaatgaaaaggctaagtaagacccccttctaactctaacattttataatcctaggtctttggaatatttactgagtacatcccaacatgtggggatgcattaaaaaatactgtaaagggataatcactgaaatataaaagcccacagccagctggggagactcgactgaaacatcaaagtcccagaaagctgcatagggtgtagagacctaactgttgaattgtatgggaccccatggtaattgggtaattgggtaagtgggtaacatctgtaggactttgatagggagatggctgaagtggtcagggaagctttatggagtaggcgcactgagataaacaggcagtatggtaaggttaggtagagtgggccggggaagagggttgttaaggaaagggacatatactcagcacacccatccagaagtggaaggcagccttgccttagagagaccgtgagggtgccagcctctcagagccaaagctccctgctggcacacagcagcaggcgacaggcactgaaggtggaggtgagacgtgggaagcagatctggcacttgagtcagtagaaaatggggagcctctgtgggctcctggtcctgcaccgtgataaatagcctgtcctgcaacctggcttaaaacagggaaagccggagttaggcaacagagtgcctagctttctcagtcattcaaacacaagcacggaagaagagattgcactgaccagaggaccgccagggtgtgatgctccgtagtcgcagggatgaaggaaaaccatgggcggagcttgtcatggacagctcctaggtggacataaatggaaactcattggttctggggcacggcgggaagagggagacggccctggacggccgcaccaagaatttcacaacccaaacccgactagaaagcctgggtgagtagcgaagttgttgctgtacgtaggaatataagttttttctggatgtgtatgtggcaggggatatagaagggaacaaccccagttctgtgtctcttcacctcctgatacctgtgtgggccggcctgaccccagacatcaggtgttcttctgagaggtgggcaatgggagctggttccaccatctgaattctcatggattcagccgtaaaatgatgagtaacctctcaagggtgtacctgtaggatgctgcttgtaattactgtgtcagttagttacaaatgggtacttctaagtagttttggaagcgtttgagtagttgctgcaatcgtgtttatactgttaattggctttaaataaattattttttgtcagagcaaaaccccaacttcagttcagttcctacgtcactgagttgtaacttaactaagctttagtttactctcatctttaaaagaaacaggcattctttgcattttgtacaatgctttgcattttgtaattgttcaagataacttcttggtacattggcctcagattaaggatatctggcttctctttaatctcttaatattttcatttttgctctagggctcccaatattacaagtctgttcttgacaaggaagttgggatgacagaactactgtatgaaaactcagaaatgctcagaagtgcagacctttggttctgttttcttcctcatcagataggaattttttttaactacgcacagaatcacacttgcgaagtcttcttttccttcttgttactttatttagaagctgtgaactcaagaagtaggtcccatgttgaatctacatgtgcgcaggtgattcttttagccaagtcatttccacactcatgcccaagtctggagatacacaggtatgtggaaatgtttgaaaagcaaaaccaggttgatgagactttcaatctcttgataacctgtcatctaacctctgagggtccactctggtaaatgtcaacgtcagacatgctacctctccaggtcaccttggtcaagtgcactttcagagcagtgagagcaccatagaaacttgatacatagcttgtttgcagcaaaagagagaggtagatattagcatttccaaaagagctacttaaaacaattatagtaggttgaatatgagccctataataatgtcacccttacttctgttcttacatgttctgacaaggaaaagaccgtgcctcatctctggctctcagaattgtccatcatccacagtctattttatttatacctacgtggtaactgctaactcaaataggcgtgatggtgaccgattatcattgtgtttccctttgccaccaggtgcgggtttctgacaacatcaagatatgaaaggttgtcactcactgaacccctaatgtgtgtttaactgttggggaagaatgggaatcactgccctgagacacagaatttaattaggcctgcttctttgtgtttctctttaatgataggattttaagctcaacggttatcagctcaaaagcagaaaatgttcattcccgtttgtgccctggtatcttgaagaatgtgcaataggtgagcttgccattaatctaactgaatttctccctgcttgtagacattatggttttgaaaacagccttctaagagtgcactaaagttaccctaccctcactcatcatctctactctgcaagtctaaaaatgtggcgtgtgtcagggtacacagtaagacaattcatttatttttaagtgtttccattctccactcatttcctcatctgtgcagtgaggctgagctagaatttagctgtgtgttcctaaagaaatgtgctcactgttttcacacattagccttgttcctatgctgggtctgattacatgctgatagattctggttttttttaagcaagtaattctccttttcccattaaatgcagaggtagagggaggagtttcatccggaaatgtccctgattgagactgtcttctaggttggtcctctttggctcgaacagagggaaccactgcattaggcttgacagaggtctcatagttcagcctggctgtagccctggaagtcagttggacagcagttgcccaagatgccatgacaaaatttacccatcctgttccctcttccacgtgcgtgctgctgtgcttactggaacaggaaaacattgcgttgtcttctgctaagtgggaataggacatttggctgaaaagcttcttatcatgggctaatatgtgctctgtccactcagctcagggaactctctcattttattcccacaggctgctgcttaagttaatgatttctttgatgacaggttctgcatgaattcactttaacatcgttgctctgttttctactcttttttttctccctaaaaatgtgagctctaatttgaagctaataagttttgacatgcaagcaaccaaattactggatagagcaaggagaatattttattagtaattttgaccagataggatggtaaggtcagttaatgaactaatgaacctcagggttcatttttttataaccttaccgggactggatttctttctttctttttttcttaagctgccaacagttcttgtcaggattcaatgtagatgctgctgctggctgtcctggtggtggtttgatctctgttgtgtgggcttcacaaggggctctggttcagtgattccagtaatggctaccactcggtgaccacatagtgtgtgctgcacactggatgtgacttttttgtccttccctgcattggtgcttctgctgtccactcactggtcttagaggtcctggcttttcttcctgaggatcgtgggtttgggcctcttttcagaaggagcccagtgtgcaccttcctgactggcaactctgctttctttgtcctcctgctgttctccctcatcaggttcattagcagttcagctctcaggacttagttttttggggcatcccatctcttaggcagtcttttcatgtaaagacattcggaaggagagcatcctctctattctcagaaatgttttgaaacctgttttctcagtgtcttgtgtctgcctgcagctcccaaccagatcttcctccttggcctttacaaagacgaggttcatttttgttgacttgggtttgcttctgtctgccatttcaatgataactgtgttgatttttagtgagtgaatcatatgaaaatagcaatgagagcctggagaaacatggggtggagaagaggaggttacaagcaatactggtttcttttgtgaccctgagaaatctatcccatactagatggatttgccatttgccttcttctgacaggtatgaaattgtcaaagtatgtaaacaaacaaacaaacaaaaaaaaccacaccacatttttagaagaaagctccattggagtatgtattataggattcttctgcagagcattttcatgtaggttatcatgttaaaataagctagattaacataatgtccttgggaaatgatgatagcccaatgaacttaatgtttgtttttctgaaggattcaagggatattcttgaatctgagaatatgtgatttcattacactcctaaaccaccaattctgtaaggtgaaatttgaagtcctattatcaaataggcctatctctctagaaaaataaagtcatggtgctaatttgtctaaaatcttgattaatgccctgtaaaatactaaatttatttagtgtttaggaaaactctgaaaaggacacaagctttagtattgcagtttccagtgtctaaaattccatgtttttttcattttaggagggatagtttttggttgttgtttgggcttggaagagaggattttaaaggaagagatacaaacagcccatgatttaagaagaaaacattaagcctcgttaatggtaggtgttaggggaaaaccctaacattagcctctagcatgagggagtgaaattaacatagtcacacatccgcaacacagcagtagtgtattcatttattaatagctgggtacaaaaaaattgtgaagacatgtgcttggcaatgactacgatgagaaggggactatgagaaatagacacacacaataagaatatttacattttgggccgggcgcagtggcttacacttgtaatcccagcactttgggaggccgaggcgggcgaatcacaaggtcaggagtttgagaccagcctggccaacacagtgaaaccctgtctctactaaaaatacaaaaattagctgggtgtggtggagggtgcctgtaatcccagctacttgggaggctgaggcaggagaattgcttgaacccaggaggcggaggttgaagtgaactgagatctcgccactgcactccagcctgggtaacagagctactctgtctcaacaacaacaacaacaaaaaaaaaaaaaaagaaaaagaaaatacattttggtatagcttttcaggttcttaaactgctttcacaaacttcacttctcttggtagttaaaatgtttatgtgcggacaacagggcagacactaatgactcctgtttctcagatgtgaaatctgaggccagaaaatgtatcaataaatggctgcttaatgtgcagcagttggaagtggcagtacaggtactcaaacccaggtgctcagacagtcccggatggaggctgttggagagagtcaacgaggctgaaggcagagtttttagcaaagcagggctcatgggattgttatgcccaccagatgctctgcaacagtgactttagctttattaagtgccctggttattctttagtaataagggtcactagggaaacttctgttgctaatgctcatgcatttacacttccttagaatcacttaatgaaaagctgaaggaaaagcaagatcatctgttgggagcagacagaagcctgattaagtttttcaatttgccagtatgtcctgctgaggcatatgagtatgaagtggtcattatgtccagacagaacacttcatcaaagaaataagtgtttcttttccaagttaaattgatatatattataaccctcactcgtactcaggcttctactccttggcccagctccaaaagaaagaagagtgtttacttataaataattctctagtccaacctatggaccgcttaggccaattctttaaaacagaattctcctaatagccaaaacaggtaaatatccaagtgttttttttcttttagaaactactttaagattgtgttaacagcagttatcaatttgtgaaaggaaaaattatcatcttttttatataaatgttttatgtatgtacttggttggatggggaatatccctgagggtatagtcaacacagaaaagcacaataaataatgatatttcgctagaaaataaaagccatatttagtgtttattcaggtcacacatatattttgagttccactgtgagcctgtctctgctaggcttgaaatatggtaataaacaacagatagtctttgtctaaaggcaacctggaatctgcctccaagatcataacatttttgttgcttttcatgcttttgaattgttgagtaaaaatggaagctttaagccagtagggcatcacgactatatatattttttatttcaaattataatacttctttatatatgatttgattaataacatgttaataagccataagccaataatttttttttgttaaaaactaagctatgaatttgcttttgccgaatgaaatttattcaatcatttgctgatccatttattcatacttgggcaaaatattttgggggcacctactgtgtgccaggcatgtttttagatgctgaggaacatcagggaacaacagactaaaattcctgctatgtaatatctatttcagaaggcaagaatgacaataatataaataaataaagcataaaatattttacataaaataagtgttaagaaaaaatacaataaagcattgaaaggtgatataaggtttgcattgaagagaacgttgatattttatatacagtgacttgggtaggcttctctgagtaggcgacctgaagttggtgagtaagccagctctgcataataggggaaagaccattcaggccatgcgggcagccacgtgcaaaggccctgagccaggagtatacctagtatcgagctaagaggccagtgtggctggagctgaataaacagtggggagtcgtagcagatgagattagggaagtagtggagtcagatcatgtaggaccttatgggccctgataaggatgttaggttttgttgtaagcaagtgaagttgaggagtaacatgatatcctagttgagtgaagttgaggagtaacatgatatccttgttttcttagggttgctgtggctcctgtttatgggaggctggggccgatcagggagaccagctgggaagctattactgtaatcctcagagagatctccgtggcttgggctacagcaggagagtgagagttggtggattctgaatgtcattcaatggtagagctagtaagatttgctggtggattggaaatgagtgaaagagagaacaagagataagtgaggctgcaggattttggcttgagcaacagtgagaagaaggtgccactgactgagaagagctaaaccccagtagagccaagttgggaggtggtgaaaaaaatccaggtgctcagctgtggatctgttaagtttagatgcctgtgtgatggccaagtggagatgcagaggaagaagttgggtgtgtgggtctggtctccctcacattagatatctgaacagggaggaatcggatcacaagactggggggtggttagtgatgtcataggaaaaacaggtgatccctctaggacaagggatcacgagagaggtggagaggcattgaaggcagcagggggatcatggtttctacatgttgtcctgcaaaggggcacaggagaatgggcagtaggtggcagggaagtggaggatcaagagatggtgtttaagatggtgagatggggccaggtgtggtggctcacgcctgtaatcccagcactttgggaggccatggcgggaggatcatgaggtcaggagatcaagaccatcctggctaacatggtgaaaccccatctctcctaaaaattcaaaaaattagcagggagtggtggcgggcacctgtagtcccagctacttgggaggctgaggcaggagaatggcgtgaacccaggaggcggaggttgtagtgagccaagatcgtgccactgcactccagcctgggcgacagagtgagactctgtttcaaaaaaaaaaaaaaaaaaaaaagatggtgacatggaagagcagtaatggttatggaaacaaggcaggttcactgggctgtgtttttgagcaggtgaatggggctaagaccccatacccaggaagcgagctggcatcagaagcagaagactgaggtcatttttatggatgggagatgtgctggtgggtttttagaagagctcatgtcagttggcatccatttcttcagtaaggtgagaaggtaaggaaaattagaaacaaaggacttttaaaaactcaccaatatacataccaatttttctgcctatctctcaattttcaccatcctttctttcaagctagactctcagctccttcaaattaaaattttccatttggcaatgcaagtttatcttttcttaaagacggaatgaccagccttttgatggaagattttatgactctggtgtcttccaatgacgtgaccagtgatgaggtttgcatctgtgtaaaacctacagattggaattctgctttctggtgcaatgtagtgttggaatgtaatgtcgttttgggaacctcaggattgagagcaaacccaattcaatcattggaggagcaagaaactcattttacgttttaaatggttctattcactgggctgaatagactcaatatttaaaacccttaagaccagtgattctcaatgggttgtggagggagagggataggcaatttgaagactcagtagtatatttaatatttactatttatcatgcaatttatagaaatgaatgcttgacaatgtcgtgggctgtggaaaaatgaaaaaaaaaaacacagggttgtcctctcctgcttctgttatatttatttttgttatgttgtttatccaaagggggcattgattataacagttagtaaaatactggtgtggctattcacctttgttagcttatatgtcttaagtggtacaaacaaagccaagtaagtgtctgatgtgagatccttaaaaccgggaggcctgggtgctccttcttcccctgactccagtattcctgccctggacagtgagcccacctgaagctctttcctgaggtcccacaaagaagggtctgatggttttatcaggaaaaaaataattaattttttaaaattttaaatggaaaaaattaaattagttaaaaattaaaaatggctcttttccttgtttctcttgttttttgatgaccaatacctaaaaaagagagaaaaaaaaaaaagaatgaaattgtcaactcaagaaatgagggttttgcagaagggagaatgtttttcttccccaggcctgattggactggagcactgcagggtaaactgtgctctgcagcagctttgtgaagcaaatcgttgaccgattgtggaggctgcagagcagtgatggccacggtgacgccagcctcagggcctccccttgaggaggctccctgggccatccttttggggctgagtggccatattgcacaggtgcagggctgtggggagccaaccgaggacacacagcatgtgatgagcactccagctctgcatccatgggctcgatgactaagtgaggccatccatgtgcagggaaacgttttatgccagagagtaatatttttggaaagggaggaactcatatgattctgctgagcagcttgttcttcctacatttggctctgtggggtagtgtgtatgtctggaagtggcagttacatgtttcccactacctcggggtaaatgtccacaaaaaaataacactcactgtttgggaaaattaaaaaataagcctagggatgattaggttcctctgatccaagtctttggaagtcttctctccacatttgtgcacccatgtgtgggtttgtcctggctgatgggctccagtcctaacacacccaaaaaacagatgaatatatagggcttgagtttttcactcatatgatcctgaattaggacaaagtccaaagaaggggctaactgacctcacacagtacttgttctcctttttctttcttatatagcatatttttaaccactcatttggcccctaatatcctgttttgcatttttaaatgttctttgctttttgactctacaagtatatttttcataagacaagaacatggatctagtcctgtgtttctttgaagaatctgcaacatttcaaatagttggataaatagtagatatgtcatagggatgtgaatatcagaaccaaagtgtattcctgtgtattttgattagatatgagaagggttgattttctgacttttatgttgcctaattgaatccatttttcccataagcagcaccttctttttcacttctaagcgtccttctcatttatctggcaagagtatttaaactagaagaatcctaacgtctgacaaagcattgaacattctttctatatttgtgtcaaatacttgattctctttcttgttaatatcataagggagagagttgatgcttcttaagctgttcaattacaaaaaaaacaacaaagaaaaccacacaactgtgaggcaattggtcatctcgtgaacgtggcattgtggtttgcatgtttgctcatttttgcttttgtactcctggcatttatccggagagctccttcctgcagagtgcctgaatgctggttccttcttacacatgagccacgtcagaacacacctggtgggactcctctgtggggctcttcccatgcctgtttcctgctctgggcagttggtggtctggggcattgggacatatagaaaagaagctgaggaggaaaggcgttgttgctattacttcaatattctcatttttcaagtgaggatttacaaaggggactgtaagctttccatccgaagagaggtctgaggtaagaattcttttctccaaatgagaaagactggaatcccaccaggtgtgtgggaagctgcagtgagaaaaccaaataatcctggtttgaagagttaaatattcttggtaacatttgaataaattggaaacatattcctctgagaattttttttttgcaccatagatagtttctaaaaggcgtggaaacatttataagaaataccaattatgcagtgttggtgtcagtgtggacttaactgccgagactgacttattgccaggtgggcaggtgaagtaataaagaaataattggaattcttattgctgaactctaaaggactctcaggaaacctaaccttgcttttgacctactgattagcttgaattcagcggactcattatattctaatttcatctccattgaaagataaaacagacttagaagtaattaattatagttagatattaatgatcaagtgaattgacttcaaaagtcattttcatgtgaactgatttccctgtgatggaactttggtaacattttacatttgtatttttaatctcttaagtaagtactcctgtaaattgttccaaaagaagtggttttctgggataacgtagagaatgaaggtcaggtctggctcttgtgctatggttctgcttttctctctctctttcttttttagacagggtctcgttgtgtcgccagactggagtgcagtagctcaatctcagctcactacagcctccacctcccaggttcaagtgattctcaggcctcggcctcccatgtagctaagattaaagccttgtgccaccacacccaactaattgttgtgtttttagtagaaacggggttttgccatgttggccaggctggtcttgaactcctgagctcaggtgatccacccgccttggcctcccagagtgctgggattataggtgtgagccacactgtccctggccaacaggctctacttttctcataggcgatgcccgagggtgtcggtctaaattggcatctctcttaaaatctagtgagtttatcctgagatggtaagtttcttcagcaaataaatggaagcacaaacaagccggaagactttctatgtaggacactctgtaggtccttagagtatggctctcaccaggtgttttcactctactttctgcctgtcggagggctgagtcacaatgaagaatcttcagccagagcacaccaccttctaattaaagtgctgctttcctctatattttgagtcctctcaaatttcataggcttctacaagcttgctccatgcagagccctatgccagggtttcagggttagagatacagatagactcagtaatcaagcagctcgtatcttagagaaacatctaaactgattattgtaatacaagtgatgtacaattaagattgcttgcagctgcagtaaacaaaaatcccaatttataatggcttaaatttataggagggacacgtaaatgttctcacactgtaaggtctggcagtaagcggatggggtgttatatccccacttaacacggcagggtcctgttggcacttcctggcttgccattccttcttcctgtgctggggtcagggaggaaatggaatttctcctcaaccctcataagttcataagttgatgagacagatccctgtaacaaaagatagattaacaagagaaaaacaagcaagtttattaacacaagcagtgcatgtcccatgagagaaacctcatgaatggtaactcaaagcagtggcttagatagcatcttcaacaaagaacaacaaattcaaggcaagtgacaggacaaaggaaaaggattttgagtgtctgcagggagccgcttgggcagcagatgaacaaatggcagggcagataaaaattagtgaataaaatttgttgatatcagttcctctggtgtcatctcaagtttgatgagggtcaaagctgtcttcagtggttagcttttggtggagaggtgggcaggataccttatgtgtttgtcaatcatctgtctcctgtttttaggcaaacagagggagggcagagagctcccctgcgtcttcttcattgtcttcagctcagcaatttttcctgcttttggggagtcatgttctggtctctcactctaggtttgacctcatgctagtcactctacctcatgagatgcctgctcagctgcagatgtgttgtttgtgttaaaggcaagaagaaacaaagattcccccaaaccaacttccctccaggtttccacttctatctcatcagccagagctctgtcatgtggtcactgcaaccttcccgggaggtgagaaaaggaactgtgtagctttcctctgctccatggtagggacagacaggggacaagggcaggtgagcagatactggccctgaggggcttgaagacaggtcagaaagatgaaagggagcagcatgtacaaaatcatgcaagtgtgaaagggcagggggtgttctgagaccacgtcctggttctctgatgcaggcgcaggcaagcattgaggctggacaggtgggcagggcttgtttgtgagggacactgagaggacctgcaggatctgccctttagcctgtggccatgggaagtgatgctgtgggggatggacgggtagaacaacccaaactaaaacacagcagcggtgatagagtaaaagcaatgaattcgggaaatcattccaaagtcactggctcttggtgccattttttttttcttttgagacagagtctcactctgtcacccaggctggagtgcagtggcgtgatctaggctcactgcaaccactgcctcctgggcttgaacgattcttctgcctcagcctcatgagtagctgggactacaggcatgcgccaccgcacccggctaattttttttttttttttttgcatttttagtagagatggggtttcaccgtggtggccaggctggtctcgaacttttgacctcaggtgatccacctgccttggcctcccaaattgctggtatacaggcgtgagctgctgtgcccagcctcttggtgccattttaatgtcagtgatgaggaaggaggagtcagggaagtagagctgatctctgagccacagcaggtttgaggggagcttgctagttcagtcatgcatatgtggggttataggtggctatggcacatccacagtggttaggagtagaggactggatttggtgagagaagtggggacttaaagagtataagtaagggactttgagcagagagtggggaggctgtgggtactagttgaaataaaatggccaatgggcatgttcggggtgagcagctggtccactcactacactctaactggaatccatgtctatgtatgagctcacggttttgcattttctttcacagtaaaacattttctgtgatgagcttctattgtgagtgcagcactttccctatggtcagttctctttaaacactgtacctcctcccaggcagtgcttctctttatcttatcctcaggctgtgtttcctgttgtttcctatttacagaagttagaagaagagagatggagacttggacctcataaatgggtgtgggctgcccaccaggtcttagaccaggttggcaggaggagccaaaactgcttcacttcttcttacttagtgcatgaatgtggtagggctggattcacttataccaccgctggcagcatctccagacagggcagcatttaaattcacctaattcctgtccacccctctacccgaccccaaacccagcctcctggtcatagtcaacaaataatatttagaatatgaaaacagaaacaaaaacaaaaatggcataacaagacaaaaattacccggggtcccacaattctcagacaactgttgcagttcacatttctttgcaataaaactgccacccatttcaggagggttcatggtgcttcttaaacagaccagttactgtcctggtccatttgaggttgctgtaagagaataccactgggtgatttataaaaaacagaaatttatttctcaaagttctggaggctgggaagtccaagatcgaggtaccaacttctgatgaaggccttcttcctgcattctcacatggcagaagagcagaagagcgctagaataaacccactcccacaagccctttttatagcagctttaacctattaatgaggaaagagccctcatggcttacacaccacccagaaggccccaactcccaacactgttggactggggattcagtttccaggacatgaattgtgggggacacggtcagaccatagtacctactaattcatatattcaacaaatattcgttaagcacatacttctgactaagcagctcttagcacttaggcatacaatgataaacaagacaaacaagttccctgtccccattttagttgggaaggcaatcagtacataattcaattagatagtagtgggggctacaacaaattgaaacaggatactgagcttgagcatgactggggagggagtgaggctattataggaagggtgaccagaaagccttctcttgggacagtgatattagtctgaggtctgagtgaagagaaggtgccagtcatgtaagactgagtgcagaaggcatcaaaccaggggaacagtgagtgcaaaggccctgagctaggatctcaagctttttgaagagtagacagaaggcccttctgtccagagggatgtggtaagaggaacagtggtaagatatttggtcaaagaggttgtcgggggccagatcttgtagagttctgtaacccatttcaagaaatttaagattacattctatttccagtatttgcaatgggaaatcattgggggattttaatttcaaaagtagactgggtgaggtggctcacatctgtaatcctagcactttgggaggccaaggcgggtggatcacgaggtcaggagattaagaccatcctggccaacatggtgaaaccccatctctactaaaaatacaaaaaattagctgggtgtggtggcgggcgcctgtagtcccagctacttggaaggctgaggcaggagaattgcttgaactcaggaggcagaggttgcagtgagcggagatcatgccactgcactccagcctgggtgacagagtgagactttgtctcaaaaaaaaaaaaaaagagatatgacatcatttttattgttaaaagataagcctatagtgttgtaatgggtttaatggtgactctaaaaagatgggtgcataccctaacctctggaaactgtgaatgtggccttctttggaaaaaacgtccttgtggaaataattaagttaaggatctccagatagggtcaccctggattatccagatgggccctaaatccaatgggaagtattcttataaaagacagaaaaggggaagagacagagggggaaggcatgtggagacagaggcagagattggagttatgcagtcacaagctaaggaagcctggagccactagaaactggaagaggcaagaaagccttttcccctacagccttcggagggactgcttcgaggcactgctaataccttgatttcagatttttgccctgcagaaattttgagacaatacatttctgttgctttaagccactaagtttatggtaatttgtacagcagccacaggaaacgaataccagtgtctcataggcttggcgtacattagggggtggaggattggaatcatgggggaaataacagaagctgataaattaatccaagagaaaaatcacgtggcttgcatcaacagcagtgggaatagcgagaagtgctctatttagaacattctgaaagtagaaccaacaggatgtgctgatagattagatgttggagacaagggaaagaaaaaaaagcttcttggtatttggtctgaagaactaaacagattgcctaatactgttacctgaaatgaggaagactaggggagggacaatttgggctgaggttttcagggtgagaggtgagaggtgatggtggggatggaggttgcctagggtgtaacatggtgaagacttctttcatggacgtattgattttgagatgcctacgtcacattcaaggtggaagtttgaataggatgtcaggtatgaatttggagctcagaaaagagatgaaggtcagtaagttaggagtcatttgtgtgtcgatccatgagtctcaaccttagctctataatggagtctcttgaagagctttccaaaaaagatacccatacttgtgctccatcctgggctgattaagatgaaatctctaaagtatttaagaactctccaggtgaggctaggggcagccagggtggaaaaaccacaaatgtaagcaccgtatttaaaggcatggatctagacggaatcacgcagggagagctgcctagaggataagatgctgctaatatgtcacaggtagaccagactgatcctcctcagctctcaaggtggccgcagttttggtgttggcaccattattattattattattattattattttggtaggccatgaggtgaaagagataggaaaagccgagtgcagggagtgagagcagatggaaggtctgaaggccgagtcctggagggttctaatgtggtggggtcaccaagaagaaagaaccaacacgggaaacagacagaaattcttgaactgggaggtagcagtgagaatgtggcatgtgtgaagccagaggaagaaagtgtttcaggcagaacaggggactcagtttagtcaagtggtccttagaagttgagaaagatgaggatagaattaattcagggatttgtgaagatagaagccactggtggccttgagacgacagacctgtttgagaagagcggcttggatggaagctcacattgaaccagctgaggggaagcgagtgcattttgagcctatagatcttcccaccaaactcgaagcagtgagtgacgcctcttattggcacattgcttctgctatttccccttaaaatctggcatttctgagagttagaaaattttattcaaagtgactttattgaagcagatgtttaatcttctggaatgtagtacatggatccacttattaatgtgtcagttttataaacggcatgtcatctgtgcttctgtttctttcctctaaatcgttttcttttgactttgttccagatgaaatcctcttggtattttcctgggtatgtgtgatggtttagcgttgctagccattcatcttgagggaggctgttctggtttaatgaatcacagctgcttcagacgtgaatgtcagtggtgctgtcaaacctcattgcctagtatgtagttggggctcaggaaacatgagttgaagaaacttagggtgaaagtaaccctgtggtggacactgcagctgccttggggagggtgaggtgaatgttttgaggtctcttcagaggagggcacaggagccatggctgtggattggagagtttctgccctttaccaactcctgtccttgttacctgctcatcgtctgttcagtcctcggtgctctccttagggcctcacgatgctcaacagggagggagggctgccttgtcatttaagttttggctatgaattctctgctccactctggctgtctgctctggaaggatcctggtgcatccatggtagttaacaggatgttggaagtcggattcagcatgtgtgggtgagctcctgtagctttagtgaaattgcgttttctggagcactgcacaccaggaacaggttggtaagaccaggaggtgctccctggtctgcacccctccagcctggcagatgagcctgggctcttccaagaattctgttccatgttgcacaagagctgacagctgatttactttaaatctctgcaaactgtactgaggaaaaaaccccaagtatattctcctccatccatttggcccctgtgcttttgaattgcttatagcctgggagtttgtgctctcaaagaacattccaaaaatttaattcttccatctgaagatattatggaatcatcacagatttggagggtttcaaattaagaaatcacatttgactatactttaatgttttgtaagtgccatacctctgtattctaattcatttcctgtttatgtggtaagatatacttgtagtactgtctctataaaagcagaattttaaggcataaagaaaatctagaacttcctactgaggttgtccaaatgaaaaactgtgttcctatgtccatatttccaagccgcaactttttaactttttattatggttattttcgaacatatacaaaataagagagaattagataacaaatacacagtgcatacacaagccagctgtcaactgtctgaatcctgccatccttgtttcatccatcccacatacctcacccactttctttttatttttttctggcatgtcagtacattttttttttaaccatgagatgctgtagtaacatggtcccaaactctccgtgggttataataacaaaggtctctttctttcttgcttgcttgctttttttttttcttcccttgagacagagtctcactctgtcacccaggctggagtgcagtggtgtgatcttggttcactgggcaacctccacctcctaggttcaagccattctcctgcctcagcctcttgagtagctgggattacagacgcgcaccaccacacccggctgatttttgtatttttagtagagatggggtttcaccatgttggccaggctggtctcaaactcctaacctcaggtgatccacctgccttggccccccaaagtgctgggattataggcgtgaaccaccatgcctggccaacaaaggtctatttcttgctcaagtcacatgtcctttgtgggtacaggggcccttgctccataccttctttattctgggaccaagctggagagatgagtctctatctgtggaagaccttggaagaccccactcagggttgttctgaaagggatctcacatggattgagccataacctagagccaagagaagccagatttgctaggagaaagtcctgtcagcatagtcaaacacttaggaggagtaaaaaggtgtatttttctgcatagatggtgtgatcacatttttatcaattaatctgcaccctagggacaaagagttaacatttgaatttttctcagtaagaatctactcctcagggaaagttagcgtttgaaaaactctaactagaaatccactttccagaggctgtctcagcaagtgcttaagtatctagactagaaattcccttcataagcatgaggagtgctggaagtgatttttcattggtgaaatgggtggttttcaagttatgtagatggactggagatatttttcctctactcttgcatgaagaaatatgtcttaatgtagatagactggagatatttttcctctactcttgcatgaagaaatatgtcttaatccctttggattgctataacaaattaccttagactgagtaatttataaagaatacatttgtttcttctggttctggaggctgggaagtccaagatcaaggtactagaagctttggtgtctgataagggcttgctctctgctggtgccttgttgcatcctcatgtggtggaaggggcaaataggctccctctgccctctgatataagggcactaatctcattcatgagggcagaatccttatgacctaatcacctcccaaaggccctaccttttaatactattgcattggggattaggctttaacatatgaatctggaagttgggggaacacaaacattcagactgtagcagggaatgaaatctttgggcacccagcaaatggatatctttaagaacaggattctaggtctagaacaccatcctcttctgtgttctgccactaaatgatgggtcctgagggttttatctcctgatttggttagaagattgttgaatctggctgtgagagcctttcaagtgcctaaaggagagagcttgaacttccctgagagtacaccaggtgatgtgacactttcttgtccttgtaatatgccacctagaagagaacttttaggagaggagacctacagttctcaccaacctttaatcattagaatttaccagcatctactgataagaatgtgatcttggtgagcagctatcatagtgggtcagtttgcaatgaggggagtaagaatttgagagagcgcatttggatttttctgttggggagtcattgtagtcattctaaactacagagtggccacacagttcctctatatcagattcgttcccaagcactgttgttaagtctttaattactgtcagggaccactttaataacatctgttagtgtgggagaaggtctcttaaaggacttggggaatattaaaacgtgtgcagagaacagaggggagcatatagttcatttgtaactagtatagctaggaagagtgtggccaatatgaaagggtgtgcctattgtggagataattcaattagttttttctttccacagcaatagaagagtttaacttcatggtacttcctatgtgcagcgtctgtactaaatgttttacatggattgtttcatttaaccctcataacacctgcatgagataggaaatagtcttcacatttgacagatgaggaaactaaggcatcaaatttttcagggagacatagctaataagaagcagaaccaggattcaaatttagcaaatgtgattcctcagcccgttcccctaaataaagtctttcgaacaatagaaaaaaaaaaaaaaactgttgacttcatttcaagagtgtcttcctccaaaagatacagagattcccaccagggcaaaatggacgccacgtttccctcccgggggcaccagaagccttagcaggtggctgctctgagttcctgtggatggaggctcagaggttgggtttgattctacagagcatccagggttcccgcatccctttacataatacgagaatttaggactactttgctttctagtctcagttaagctttgggaccaagcaagagctatattcattacttgcaggtttggagtgtggaaattcagcatcaagtaaacggtgcgtcttcttgtcatccagcgtttgcccccattacctctgcaatctgtcttccattgggtaaagtgtgcccaactgttcttgaaggaaaagaaatctaaatcctgagttgcctgcacagcatctatgccccagggaaaaatgcctacagcacgaatttaaaaacctcattctaaaagtgcattactgaaaaggctttacagtataataacttttaaacctaagggtagtgatggctgcaggataattatgtcaaacctgaaagcaaacccagaggaggtggcatgtggaagaaataccactttggttaatagatttgcaacctcgtttaaaatattgaggctttaggaaaaactagatttatcctctctgttagcttctttatcttatcttcactctgttgtcctgttgttaaaatttctaagaaatggtaaagaaagtgagaggggaaaatatcaaaaagaaagaaaaaggggcatactagaacatagtatatgattctccctttgctattctgttttatgcaataatcagggtcaggtttctaactctctcttcgaatgtcccagatagaaaggtgggtctgtgtttgatagacaggcagatgggagcaggacgtgtgcagtgtgctgactcctacacagaagtggaggtaggtgctgtcaaatgcatggcagcaggagctggtgtgagaacgccaggacacgttgatggcattgcctcatctctggcaggctgctgtctcctacaagacgtttatgtggattacattcacatgaggttgtataaaccctcttattcctattctcatggaattgggaacaggaagacaagggatgacctggacatttcatttagattagaccaaaggtgaacaaaggtgatgaggcaacaaaggtagcctttacctgagagtaaccccaaggcagaggccaccatgagttaaaagcaaacagggccaagcaacaatcaggctcagatccaggaaggactggacaagtgttctgaagctgtagcctaattcttactgaaggccatgggatcatgggggctgagacctgtttttcctgggagctcctgcttgggtgggttagatctttggttgttgtcttaggtccattctatctcagagtaaattctggaaacatccagggatttctttctccagcttttgttttctacattggccatcacccctctttgatttttccttgttcttccttaccgctacccctgaggccagacataatagattgataaacccatggttcaaatcctgcccccatcatgcatctgctttcagatctttggaaaactatttaaccccctagtctctttatctgtaaaatagggatatgcatacttatctgaaagagctgctgtgaagattaaaggaggttatgcctttaaagcataacataccgaatgctttcctttcattttttcattggaatgctcttcacaggtctggagtgagggggaacaagagttaacaagtaacaaacatgggggtgatttaaaggtttcaggagctcatgctgttcatgccataactatccatagaccacattccctgactttttcctaaatgctttcaagcacgtctcccctgtaactatccagtacactggatgcttcctggtttggttactagaacaagctcctcagggttgggttgggactgtttctaggccatgctggtggacatgcctttgcagagcttggctctggtcacacactccttctgtattatctttttattctgatgctttgacatcttgggttttgctgacactgaaggaactgcccttcccagggctggccaattcctaaggacagtaaaggactcacctgtgagcatgcctttcctatgcaaactgaacactctggagccccatcccccagccaccttctttatcaggctttcaccttctgagccactaattctctgcctcagtcaccccagagcctggtaccagacaactgggacaactcctatattccaaagcttgctgaaatgattcaaactagctaaccctaaacctgcttatgctgcttcacccatttattcctgcagaaaccacagtaaagttccccccttgattcctttgtgtcctgaccaactgatgtttccctaggtgcccccacagcatggcatggcatgccccacttttgaaacctgaacaagctgtcttttcaattacagatatcccctggtctgttggcctcactatacctgaataataataaaacttacattttgaaacctcttccctgactgatggttaattgttgtgtcaatttgactgggctagaggatgcccaggtagctggtaaaacattacatctgggtgcatctgtgagggtgtttctggaagagattagcatttgaatcagtagactgagtagagaagatccatcctcaccaaggtgggtaggcgttatctaattcatgaagggcctgaatagaacaaaaagggagagaaagggctatttgtcttttgttgagttgagacttctctcttctcctgaccttggactgggagttatgtcattggcctccatggttctcaggccttcaaacttgggcagaatggtaccaccggctttcctggttcttctgcttgcagacggcatgccaagggacttgctggcttccgtaattggataagccaattcccataataaatctcttcttatatatctatatatatcctattgcttctgtttcttcagagagtcctgacaaatataaagattgataccaagaagtgggagtgcttctaacgaatgtggaagtggctttggaaatgggtaatgggtagaaactggaaagagttcggaggtgcacactagaaaaagcctacattgctgtgaattgacctttaaaggtgattctggtgaaggctcagaaagaaaagaggagagctataaagaaagccttaatcctcctagaaaatacctaagtgatcatgaacagaacgttggcagaaatatgggtaataaaggccagtctgataaggtctcagagggaaatgaggaccatgttattggacaatggagaaaaagccatcggggtgggggggaaagggaagggagagcatcaggacaaatacctaatgcatgcagggcttaaaacttagatgacaggttgatagatgcagtaaaccacatgtatacctgtgtaacaaacctgcacgttcagcacatatatcccagaacttaaagtaaaagaaaacaaatttttttaaaaagcgtcagagaacttggctgaattgtgcctgtattctagtgttttgcagaaggtagagcggtgaacactgaaattacatatttggataaggaaatttctaggcaaagtgtgaaagttgtggcttggcttctcttgacagcctacattaaaatgtgaaaagagagaaaagatttaaagacagaattgttaatcaaagagaagcagcacttaaagatttggaaaattctcaccctagccatattatgaagaatgagataacgggtacagtggttcatgcctgtagtcctaactgttagagaagtggaggcaggaggatcccttaaacccaggagtttgagacttgtctgagtaacatagtgagagtccatctcttaaaaaagaataaataaataaatgagaaggcacattgggaaagaacaccaagggtgcggccaaatgaccatctgataaggagattagtcaaccaagtggaacctgttgctcaaggtgattcagaagtaattggggctgccacctccatcacagctccaatgtgcaaaagcttgagcaggcaagcatgggacctccacagagagcccttactagagcaacatccaggatagccgagtggtaggaccaccccagcagccccagacctgtagagtcatagacacgattctagctcttggagccacaagggcacagagcaacctttggggagggccaccacgcccgtgggttgggaaagcaggaccacagccctagtgggcctgggggacagagcattgagccaaagaagattattctccagacaaaattttggactttgctagggacctatcctttcttcttttctttctttctattcttttctttcttttgaaatggaaatgtctattctatgcctgtcccaccattgtattttggaagccccttgacttgtttaatttcacaggctcacagctggaggggaaattgcttcagaatgaatcataccttgcgtctcacccatatatgatgtaggtgctgtttaaatgagactttggactacagaccttcaagtagatactggaatgagttaagatttttggaaccattggaatggactgaatgcattttgcgtgtgagaaggacatgaaattttgggatgccaggggtagaatgttatggtctgagtgtttgtgtctctcccaaatttatatgttgaaatcctaacccccaccctctcaaggtgatggtatcaggaggtagagcctttgggaggtgattaggttatgagggtggaggcctcgtgaatgagactcgtgcctttataaaagagacataagagggactccttcctccttctgccttgtgagattagagtgagaagtctatgaggaagcagccctcaccagacactgaatctgctggtgccttgatcagagacttcccagccactaaaactgtgagaaatacatttctgttgtttataagcctgtggtattcttttgtagcagcttgaacagactaagatacccttggatgaggagcaactgaggtaaagtgggaaaaaaaaaaaacggctccaatgccaagggcatactggacagctctttaacttatgcttggtggttgcttctcatcattttcagttaatcgtaaagcattctacttttgtggatttcaagtccctaggaaaggatgctgaaggaaacgacagttttgtgagaccatcagtaattgtaatgttgacacctctgcattcaaatgggttacaggattaaacaagtgtcatccaaaggaccatcaggatggctagataacagaaaagagagtttcactggcaatactggtttacaaacctggaagagagagtctccggtgtgaactgaaaatgctctctctgaagaacaaagagaaggttagaggttttataaaaaggagaaatgttgcatattgctctttgagaagtttcattggcaccagtaaggttttgaggagctggcaggcttcaactgataagtgagggtggtgcgtaaacccagtctgagagttgcagcaggtcgtctcagtagtcgttagacaaaactggtttcaggttactgcaggcagtgtcagctgccaggcctgcagaaaattatgttttttggagcaatgttcttcaccctgagtgctttttccccttggcttattgattctttgttgggtatgacaagaatgactcatttcatgtgatcagctttcacacaagggtgacaaagcttcaattatttatttctttattatttatttatttaatttgggacagagtctctcgtcgtctaggctggagtgcagtggtgcatgatcatggctcactgcagcctcaacctcccagcctcaattgatcctcccacctcagcctcccgaatagctgggactactggcacatgccaccatgcccagctaatttatttagtttttgtatagacagagctcactatgttgactagggtgatcttgagctcctggcctcaagcaatcctctcacctcagtctcccaaagtgctgggattacaggtgtgagtcaccatgcccagcccaaagcttcgttttaagtctcttttatttactttttttggtcctagtcataacacattgtaaatatactctgtcagagaattagatagcttgttgttttttaagtcttttctaattaatctgttcatgtaatttagtaagaaaatattaaagggaaatcttgcccgagagatggccagtactgagtaagaagcccatttggtttgtgtctgggaggatgggcagtgaggatgagtgaggatgagtttaatttagcttggtgagagggggacaaatccaccttttcacgagagctgctttctcatcgctttttgtcccccttcatccacaacccccgcagccaaggcagtgtcagtaaattttgggatggaaaagccttaggtaggattcttatgttttcgaaatgtgactgattggaattgggggaaagctgtattaaaattggatatgtggtaaaagctggatatgtggttattacccatatccagtagtgggtcatgttcctgtgctaccatgatctgcccgcagtaacctagcaagacatcaaatcacagtgtgcagtagatggtaccgttgaacaagccaagccatattgtctgcagggatctgagatgataaagagattattacagaatttgttttcataaggaactgtgtaattatgatgattagccaaagaaataagaaagaaagaaagagagaaaaagaaagaaaagaaaagaaagaaaaaagaaaaaggaaagacgaaagaaaagaaagaaagagaaagaaaagaaagaaagagaaataaagaaagaaagagagagagagagaaagacagcctggtctgttacctatgctgtcctactatagcatttaatatcttactgcaaattttactaagttataacttaaaagtgttaatttttttttttatcactttgacaaacttagcctcctacagcagaaggtgactgatcaaaagctggactgtcaaccaggtactcaccagcttagagagaatggagaaaaggagtataaagaatttgaataattgtatgtaacatacgtgtttcttttgaaatttcagttttaggaagcaaggcctgatgagatgatcttcatttgtgagagtatgcagagggtggtgtgaaaagacatggcagggattcgtatttttaaaatggatggaaaaacagttctaaaaatatgaaaaaataaggacaaataatcataatttaaattctcaagctaagaaaggttcaacacatttcaaagttaaattgtaaacagtgttagggaaaagaaaccatacagaaatgggacaacagggatccattagagttggatatcattcatttactagtttgaggggcaaaataaataattatatgtgtttttaaatcatagagaatgaaccctgaaaatgtttaatgcttagaaaagaaagcatgtataatagaaattttaatttggccaaattgcttactttaaaattagaaaattcgatttttttgattgcataattttggacacataattaataagcaggtagattaaaaggaaaaacctacatattaagcaagaatcatctaacaaaaacagttccttatataagagactgtatgctaactcctagatgccaagagagaaaatgagactacatgagactacagtcaagcgtcacctaacgacagggatacgttctgagaaatgcatccttaggtgtttttgtcattgtgtgaacaacgtagagtgtacaaagctgaatgctatagcatattgctctaggttacaaacttgtatatcatgttaccgtactgaagactgtaggcaagtgtaacacatggtatttggagatctaaatatatccaaacctagaaatgatacagtaaaaatacagtataaaagattttttaaaatgggacacctgtatgagacacttagcatgaatggggcttgcaggaattgaagttgctctgggtgagtgagtaagtggtgagtgaatgtgatggcctcggagattactgttcactactgtagactttctagacactggacacttaggctaagttcagttatttaaaattgttttctttcttcaatttattttctttctttaatttattatattaatcttagcttttgtcacttgtttactttataaactttttaatgtttttaattttgattcttttgtgataacgtttaacttaaaacacgaacatgttatactgctgaaaaagtatttcctttatattcttatttggtaagctttatttttaaatttttcagtttttttttactttttagattttttttgttaaaaactaagacacgaacacacacactagcctaggcctacacagggtcaggatcttccacccgcacatctgtcccactggaaggtcttcaggggcagtaacacgcatggagctgtcatttcctatgataacaatgctttcttctgaattcctcctgaaggactttcctgaagctggtttacatttgacattttttttattttaaatattttttattaaaaaaaatgtcaaatgtaaaccagcttcaggcaagtcctgtagaaggaatacaatctaaaataatgataaaaattagtaaaaaattgtaactatataaaccagtaacagtcatttattatcattgtcaatatatatacatacactataatcgtatgtgctatacttttatgcaaatagcagcgcaggaggtttgtttacaccagcatcaccacagacacttgggtaatgcatcgccttatgatgttaccatggctacgacattgctaggggatgggagtttttcaggtctggtatagtctgatgggaccactgtcatatatgtggcccattattgactgaaacgtcgttatgtggtacattgactacactgccggcaagctcctatttaagtaaacaaacacaataaacacaaacaaacatgagaagtccagaagaaaggccaaggatgataagagaaccttcttaggaaaaggaagctacatcagggcaaggggctggttctcacctggaagacacagtactgcacactgcagccagatgagtgccattttcatgtttcagaatggagccatctccaggatatactgttaaaagaaaactcctaacagtaacctctggagagaactagaattgaagaggacatgagtagtcaaggggacatttgctgcatcagtgttgtttgaatattttacaatgaaaatatacttatatattgagtaatttataatcataatgtacaattttgatttctacttttacctgatatttacgttaatgtctttagaatataactcattctttgggctgttggacatcctatcttacttagctggtatctctgcaattagatatttatttataaacagggattccttgagagttatcgtttacattaaatagttaaataggaagataagtattttattggaatttagtttatgcttatatcactgatattaattattgccacagaaactctacttttgaagatcaccactaatttgttatgtttcatgtttgtttgtcacaatttagggacagtcttcattgatgaccttactatttaccacagaagttcatctatgtggctccaaactctatttcaagaatatgaaaggcatgtaggttatgcctacgttctcggacccttgatagatgttttgctgacccaccttctgatatctgtagagttaccctaggctccaccttccaccaaccagttctgtgtgtgagttgcacggtcctttgttcattactaaacgttgtttttgcgctctcctgtcctctcatttcagtctcactatcttagaatcagcttcacggaaccacaggaaagacatcattgttcttcttttgcaggtagcgagtaacaccaccctctcactgagagcacctaagaaataatgttaggacttgagttgacttttgatgcatccgtgtcctttgtatcatataatatatctggattggtagagtgcaaagattatgggctcaacttgttatttgtatgactttgagcaaattgtctaaactctcaaatactcagtctttttatttatagagtagaaataacaactctaggatttggaaattgttatgaaggttcacaattattctgcatacactacagcttatacacatatggcaagcagctaggtgtggctgtttttattgagtgttttgagcccgtttccctcctttccagaacctacctcctcagactgatggatgcatgatgagttccccttgcctaagttattatttctaatcgttctttcactgcgctgccatttttagtggaaacttcattgcaaaaagtgcaaggttctcatctgtggaacttgagttgtttgctggctcccctagcttttaagtgtggtgtattaatttagtccctctctcagatgtccactataaggtaaagaattgatgccatgtcccaactaggaatgccattgcctctctgtctttgcttgttagcaagaaacgattcatgaatgagtagaaacaacaataagtgtttagaaaagtattaaatgaatgaggcagtaaaaagtgatcccaagaaaatcctagaccacttgcacctgccatgacttgttacctctgtgacctcttaccatctgtgcctccttggtcgcgtgtattgactgtagcccactttcattctgtcagcatttctcttcagtctatttagagctcccttgagccttctctctctggcaaacttctttttataacataagcaaaataacggaagatgtacattccttgttgtgtgcatggcatggatgggaaggatgaacggagtttatccatgaaaagtatggctgtcaaaaaagggaattatgaagacatgttgtatgcaagatatcttgaagttaactttttaaaaatatgaaacaacttatttccagcaaagtgcaaaatgaaaatcacagaaaaagtcaacctgacctgaagcttattcatcaccgtgcaatgagtttcaccatacagtgagtttctgacccatgtgacattgaagtcactaacagcaccggtgttacggttcactgtagattggacagcactgtgtttggggatcctggagaaatttaaagtaggagaggatgtggtctacctccagggccacacagtccagcgggaaagagataattaataagctgaagtcgaggactgcaaagtaaattctgttttacagaaggggaaacattgcgactgatttcagtatctctgctgaggtggagaggctgaggttcttctttcgtagctgctgctgctgcttcttcttcttctccttcttcttcttcttcttcttcttcttcttcttctcctcctcctcctcctcttcctcttcttcttctttttgcatgtatcaagctaacttaatggagaatgtatacattgttccatatcatactaaataatgcaaataagtgatactgttacagactcagggtcacaacgtggggccattgtaagctacacctttctcaaaagcatctggtgtatgtgaagaagttgcatatcagtgacttgctctgatgtactctataggagcccagaaaggttctctgtcttggccctcattaaggagcatttaaataccagaaaaatctagcgaagcatagcccctgattggatattagccagcatagtgtcagggctgttgtaattagagtagccagatgggaaggcaaatttagtaggggactgtcatcattacaaccacccattatacgtatactcatacatgcctcacagatgcaagctcataacaggaaacccagcagttgtggagtaggaggctagaatacaagaacattagtgagtgagagctttgcctcaggattataactaattttgaggtcagttttttcagcagtctttgttatgttcaatcttttggttccaaaaattatgtgatgactggccttaaaaaaatgtaacccaagtaagcctggtctattaacattttgctaaattcttcgtggtttgtaatggagttaaatatgattataagatttaaaaatatgaattttgcttcatgatctatctgaaggttcaattgactggacttgagtaaattattcacgacttcattaaaattcaataggactgaaagtttccgtcagatgcattaagccgtctactgcaaacgaagcgctgtgttgtagttggtgcagagggtggtttactcaatgtggcctgtgctaagtgtatggaatgcaaatgagatgtaaattttatattttactttccattaccaaaaaattatttatgtacacatcaggagaggaaaattactttcagtaaggatctgcgtggtggtgatttttaatctcttagtgggaatatataatatttttacagtactagcataaaaatgccattactgcagagagaggtcttagagtcttataatgattatcttcattgcttggagataacattttagtaaatgagatttagttaacattctaatgaaaagagctatcataatttgagagaaaattcctaagctaaaatatttttaaactagaagtttgtttacttttttttctctactagaacctaaattatgtaatttattgcaacagatggtatggaaaatttggattgtgtgttacagttttagtaaagctgatttataaaaatttataaaaaggctaccaaaaaaagtaataaaatcatagacttaaaggccttcgtggagtccaactgactcagctgatcttatgttttctcgacaaaatcagtgccaaagctaaattcatctcttgcagtttctgtttgaccttctggtcatgtgagcactgttgttaatatctcctaacactttcagtcacaagctggtaactacatttgcgaatcgcttttcagttggctttttttttgcgggggggtggggacagagtctcgctgtgtcacccaggctggagtgcaatggcgcgatctcagctcactgcaagctccgcctcacgggttcaaacaattctcctgtctcagcctcccaagtagctgggattacaggtgcccgctaccatgcccggctaatttttgtatttttagtagagatggggtttcaccatgttggccaggctagtctcaaactcctgacctcgtgatccgcccgcctcgccctcccaaagtcctgggattataggggtgagccaccgtgcccggccttcagttggcttttttatggttaaataaagttccatttttcagattctatttccagatctctgcaatcatcggatcatccctccttggtgcctcgctgaagttgtagctcccattagttcaggtggttctgtaatatcagctgccttcctcagaacgagtctcattcttccttcacatatttttttttctcaaaatgaaacattcaaaggctcctgcttccatatgtagcatgaacattatttggcaccatccttcatgttattctcaaggcactctccaacttgcccatttccctctttcaatatgatgcccaaaattagtcaccgcattccaggagcagttgggtgtgcagggaccagatggattcaggagccaacactcagaacaagagtagttcttaaccatttgaggacgcgtaccccttgagagaatcaaagccctggaatctctccatgggaaagtggatgtacaatctcagaggattcctgggccttgccgtagttcattcataaactgtgtaccttctgggacagtgggtcaagaaccctgcctctgccgtggtgaggccgtacatgggaataatcaaggaagctttttaataaccacacacacttgtataagccttaagtataaggcagagaatttgggggatttgcaactaaggagtttgtttatttttaagctgagtgtattttagagatcagattttgaaactacttttcaattataatcacctgtgtggatttttctcagaatccaatttcatttaaaaaaaatgtatttagctggctttttcctgaattgacttgttcagacatgttagttcttttaagatgaagtgctcatgagattttaaaaatagccaccaggccccatgcccagctgggttctctgttggcgttggttggatgaagagtcccctgattagctagatttgggaaaaacttcaaccaggtagaaagtaaaacagacatgtgtttcaaccactggtcctaatgtaattttttcaatgtttgtggaatttatgacatctttgaaaatacagaaatgaccggggggtgggggaaatgtgtcagtttatgaatgtgccatttaaccagataactgggcaaaatattttacaagaagtattctcatgagcggtacagagtaagagataaccacgtccatgcacatttgtgcctttccatagtgtcacacttttactgatgctatttcagtcacaaaagccaggagctgcatggaattccaaggagggaattctccctagtaccttctgttcactcggtagtcagagctgcaggcacacaagccacttcacaagtcaattgtattgcaagccatacataatagtatacttaatcaatagataagtgttacagatcaaacatttcacaacaaacaaagtaacatataacatcaagagaaaagggacaagaagaagggttaacaaaccagtcaagggagactgggagagcaacaaagacccaaagaatcccctggtcggggccaggcaagtggtccacaggttttgcaacaaagagtcttcagtgggggcagagccttcccggcaaatgccaagtgctaatcacagttgacagcaaggcagtgtcagttgagatggccgttttgagctaccaatgtcctgctctttttatggccacagagtcctctggcgaggactgatagtgacagaatgtgcttgtttttgcccttatctggttggatgcagactttatttattaagcataacatcttgtccacgttggcaaagtgccctatgaaatgtaagatggagtctttttctaagatggagttactcatgtcaagggtgctgtatacaagtgcttgatcctgtgacatggcatgctttaatcttcatttttcttccgctttttgatatctctatcttcattgattctactccaccctcttactggactcatattatcttggttctattcacacacctttatttgtcagtcattcctgttagaacattctgagtagtttgggaggtgagtgtagactgaggtttacacactaatgaggatgcttggggaaagtgaactgaaggggtggaggggatagactggccctggtgaagtgggtagcctcggatgagtttttcctgatggtctaagatgggtgtgggccttagcttcttagtacacagaacttgtgtttgagcctgatagtgaattcaagaccagagaccctgatgtgttggaattgctggttggattttacaaagaatggtggactttcaaacttatggtgaccactgttgaattttactgggacatgacaattatactagagcccctaaagtggcagacctgaagtctcgctgttctctttggtttgaggggaataagggcagatgataggcatatattgtttaaaaacgtgtttgccactttgtctcttcctcttcgcctcagtgaccttgttctccttgcaggttatggccacaccgtgcccttgtcagatggaggtaaggccttctgcatcatctactccgtcattggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgtgtgagtattacagctccctggctgctccttctgtctcctttattttatttatttatttatttatttattttgagcccagctctcactctgttgcccaggctggagtgcagtggtgcgatcttggctcactgcaacctccgccttccgggttcaagggattctctgcatcagccttccaagtagctgggcttacaggcttctgtctctattttgccattgcaagctccacttcacctctcaatgaggggtcattcataaaagcactgattgctttcttctcattgagaagttttccgaatttaccaccttctcaaccatttcattttatggtttccttcaaaactgtttatgcaaaaatcttattactgagatatttttcacaacaccttaaaattacagacgaatttcttactaataatgtaggcgttataaatgacagtgtaaaaatacatcatacaggccgggcgcggtggctcacgcctgtaatcccagcactttgggaggccgaggcgggcggatcacgaggtcaggagatcgagaccatcctggctaacacggtgaaaccccgtctgtactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaatacatcatacagaatgtacttgataaccaactgttaattaaaaaaaaagattgctctactttattaaatattttaaggccaagaaaactaggcctcggatagagcgtgttatcaatcatgctctttaatttaccagaaaagtcttaaaagagctgcttacctcatttgtccatctggttctttttagaagaagttcgcctctattaactgtttccagaattttgtgtgtggaaaataaaatgggcattcaaattcagatggtcagggatttataattttttaacagttttcattttaaattcaatgtaatatcatagaaaacttaaccatccattttcaagaaactgttcatttctgtgtgagccctcctgtccttttcagcatgcacacagttgcagttataatgtacctactgttttcatttctgtcttgccttcttaagaatttttcaatttacgacttggctcaggtcacgttttctagcgaatcatagtagatactcaagcagccagatgctctgtcttggccctgtcttgtaattcttaaccctacaaaatgcttagttgaattgtgtgtattttgacatttcctttaaaccatgggctcagccaaaacagacgttactcataaatccctaatgctttgaacagtgcctggctaccatacaagttcgacagacttttttttgccaaatggttacttaggataattttatatttcctgtagctaccataggtattatttttagagcccatatggtattcaccaggtggcaaaaccataatccaatcatgcctctattgctcattatttagctttcttctaattcaggggtattataaatgacattgtagagaattttttttttttgagatggagtttcattcttattgcctaggctggagtgcaatggcacgatctcagctcactgcaacctccacctcccgggttcaagcgattctcctgcctcagcctcccaaatagctgggattataggcacctgccaccacatccggctaattttttgtatttttagtagagacagggtttcaccatgttggccaggctagtcacgaactcctgacttcgtgatctgcccgcctcagcctaccaaagtgctgggattacaggcgtgagccaccccacctggccaagaatatttttgtatatatacacatttcctcctctgatattcttccaagaaatgagattgctggtgcaaagtgaatacgcctttttgtgactcatagaacataatgacctggtgctttccaaatgttgttatgagttgacacgtcaccagcattatctgagtgtgacagtttcagcactcctggggtggtgatggccagtagcattagagatgttttttgtgtatgtgagtttgatagccaaataaacattatcttaactttcttttcatattataggtgattgttttgttttattttattttattctgtgacttggaaagtagaatgtttctgtaattatgtttgctagctacaataattttctcttatataaattgtcttctcataaattttgcccaaccacttaacttcttcagtgtttcatataatactaaatccttgcataacattttatcacttcttacaatgtggatcattttttaaaaagcaatctacatagaattagtttatgttttgagcatcaagaacctgagtatctaacaaatgaatattccaaagatatattagatgtgggcaggataaaatacccctgtttttgtctgaaaccccatggatatttttgtgagcattcaagagtttgacaaaataattataaaggaggctgggcacggtggctcatgcctgtaatcatagtactttgggagacgaaggcaggcagatcactaaggccaggagttcgagaccaacctggccaatatggtgaaacaccatctctactaaaaatacaaaaattagctgaaaatcacttgaacctgggaggcggaggttgcagtaagccaacatcatgccactgtacttcagcttaggtgacagaatgaggctctgtctcaaaaaatagtaataagaataataaaggaaaagacacagagatccatcaattagtctaacaatgtcattactatttttaaagtacaggagagcacactgaatgcacgatattgttttcaaaacctatagtcagattctgaagatactaaaactttgtattctgtggttaattagtttccttattcctgttatgctgccaattttagcttccctacttcatacattttcgaaaatccttctcaaatgttttaccactgggacataaaatcagaatttttgttattcttggagttttcatcttcacatttctgttcctttttatgatttttttttctgaaaactcatttttaaaatgatggaaggaattttaaatcaccatttcccatcacagattccaagcaatacattttacttgagtcaacagttatccttcattttcccagtaacaaactggtaatgttggccagtgaatagtccacatgtccaaaaacaactgagagataatgaagagcttggctttgttgctggatttaggtgcaagtgtagatagccatgcacaaggacctatttaatatcaacatacattcttaaatttttgatttagtttagtgtattagtctgttttcacactgctgataaagacatacccgagactggacaatttacaaaagaaagaggtttaattggacttacagttccatgtggctagggaagcctcacaatcatggtggaaggcaaggaggaggaagtcacatcttacatggatggcagcaggcaaagagagagagaatgtgtgcaggggaagtcctctttttaaaaccatcagatctcgtgagacttattcactatcatgagaacagcaggggaaagacttacccccatgattcaactacctcccaccaggtccctccaacaacacatgggaattcaagatgagatttgggtggggacacagccaaaccatagcatttaagactgcaatttctattataaactcttattctataatagaaattgtaagagtattgagtgcttaaaatcttccgagcaccccatgataaaacaaaaacttttctaaaacatcactggctttttgtgagccactgattataaagcagaggtggcaaaccctccttgcataaaatatcacacttgggtaagtgcagtatgttatgtgtctttaataatgccacatcagccccaagtattttttttttctcaaaaattgcagcctgtgattctaactaatccaagttcataggaggttaaatcattcttcattgtctttcactctttaataatgggtagttcctctttgaaccatgaacttaaaaacacttctaaaaattaagaaactggcaatgagtttattccttaacaaacactgtgttggcatgaggtggggaggtaaatcactcgctacttgatttatccatgttgagatcacactaagacagtgtcctgtttctcacacaggttacctgctacttggccttattgccatgttggtagttctggaaaccttctgtgaactccatgagctgaaaaaattcagaaaaatgttctatgtgaagaaggacaaggacgaggatcaggtgcacatcatagagcatgaccaactgtccttctcctcgatcacagaccaggcagctggcatgaaagaggaccagaagcaaaatgagccttttgtggccacccagtcatctgcctgcgtggatggccctgcaaaccattgagcgtaggatttgttgcattatgctagagcaccagggtcagggtgcaaggaagaggcttaagtatgttcatttttatcagaatgcaaaagcgaaaattatgtcactttaagaaatagctactgtttgcaatgtcttattaaaaaacaacaaaaaaagacaaatggaacaaagaagctgtgaccccagcaggatgtctaatatgtgaggaaatgagatgtccacctaaaattcatatgtgacaaaattatctcgaccttacataggaggagaatacttgaagcagtatgctgctgtggttagaagcagattttatacttttaactggaaactttggggtttgcatttagatcatttagctgatggctaaatagcaaaatttatatttagaagcaaaaaaaaaaagcatagagatgtgttttataaataggtttatgtgtactggtttgcatgtacccacccaaaatgattatttttgtagaatctaagttaaacttactatttataatgcataggtaaccattaactatgtacatataaagtataaatatgtttatattctgtacatatggtttaggtcaccagatcctagtgtagttctgaaactaagactatagatattttgtttcttttgatttctctttatactaaagaatccagagttgctacaataaaataaggggaataataaacttgagagtgaataaccatagtattctgctgcaataaatgtttctaccctcttgcgatagaatggtgtcagatgtctaacatgtttataaacatttttttgaattgaacaggttatgaaaaggatttattaaaaggttaagatactttgttttgaaagtacattgtgatttgcagccacctagcactaaagcatagaacttaaacacgaatccctaaatgaacagattatgttacattaatctgagaattttaaatttagaagctaaaataaataaaaatcacagctggttgt

SEQ ID NO: 131 - DNA, 19815 bp, Homo sapiens
agcagcgggcgcgctcataaagggcacagccgagggtacgtggatcgcggtgcggagactgaggttagaaggcacaggtggcgagatgagccgggtaccagcgttcctgagcgcggccgaggtggaggaacacctccgcagctccagcctcctcatcccgcctctagagacggccctggccaacttctccagcggtcccgaaggaggggtcatgcagcccgtgcgcaccgtggtgccggtgaccaagcacagggggtgagtgaggagggtcggggtcaggggcaggagaaactggaaagcggggaaaggaggagcaggaagaggaggggtgggagaagggaagagacggcttgcctaaccgttgctaacagctgccacttttaataggcgctacccggtgtgctaagtgggcgttttacaggtgttaccttgtttatttcagcacactctccacctagggaggtattgataccaccatttgattggtggaaaactgagactcagagaggttaagtgacttacctaagcttacacagctactaagtggcagagctggaaaggttttctgatccagagccagacttctgaacatactgtgcatagtgtctaagggaagggcagagggatgcgggggctggaagagggccagtggggtggtgaggaaggaaagaaaaaggaaagtatatggatactttctaagagaccccagcattgatgggaaggggctgaagctgctccctctctccttgtagctacctgggggtcatgcccgcctacagtgctgcagaggatgcactgaccaccaagttggtcaccttctacgaggaccgcggcatcacctcggtcgtcccttcccaccaggctactgtgctactctttgagcccagcaatggcaccctgctggcggtgagcaacttcctgtcccggggtggaatggggcccctgggcccagattgaagctcaaaagtaagttctccgcagcagggggagtcttgattgtgactacgcgtgcccctctgcaagtgactggataccagcaacagtgaaggttatctgtgtccatgtatctatttctaggactgcctgaggatgcataacacggcaccagcgcccactgctgcctcaagcatgtgacagtgtggaaataataatcttgttgtcattcttgcatatgtccttgtcctatactcagttgccccaaatacgcagcttgaatgaacccattagccaagggaagacttacttactgaatccttgtcgacatggaaaagaaggggtgttctataatccctgggagtcttcagaggggtatacggtgtgacctgttttaatatctaatcatagtttcaaaaggtagcagtagcttgtgtttatggagtactttttataatgcatcaggcacttttctaaacatttcacatttattaatcctcttaatacttaaaactattctatgatatgggtaatatgattactcccactttatagatgaggaaaccgagtcagagcaactatgttcaacttaccgaggtttatgtaaccaacaattagcatggttggacttcagagctgctcagtctaagtccacggtccataggtccagactcttctaagaccaccgccattttaactgctacatattgggcacttatgtgccaagaaggagacgctgatcacattcaattctgcaaaattcctctatgggtgtttttattaactccccttccccccaatttctgttgaggtccttgaggctcaggttagtagagtcactttgcttgaggtcacacatctggttagtgaaagactcaagaatcactcccaggtgtgacagttaactcttaaggtctgtgcgctccaagctgggtcttacaatgtccctccttttcccctgaatttctggatcgccaaataatctggccgtttaacactcctttgagaatatctagctttccccaacttacactcatccaaccgagatggcattcatactacctgccaacagcggttccctaggggggtagaacccaaggctttgaaactagatgacagctgaatctgctcagtgacttcgtgattcacttcctcatctgtaaaatgaggttgatgatgcctattttttgatgatcagctgagatgaataacagggagaggagtgcagaggatggtttttactagcgaggcataattttcaaccttcgctgtgtatcggaatcacctgggctgtctgggtctcactcctggaagagatacagactgggttaatctaagggtggtatctgagcatcttcacgaagctttccacatgtgcagcaggaacggagagccactaagagtttcatggccgttgtccagatgtcaattggcaaccttctctctctagttccttcttaatttggtgttttgagaatcctagggcaagaaaagaaaatgggcagttcttgagggctcaccatgtgctagatgtttccagatatgccagtgcatttaatcctcacaataaccctctgaatggctggcattatcttttttacaggtgaggaaaccagtgcttaaagattaaagtgtttgttcaaagttgcatatctcgtaagtggaggaatcggatccaggtctgacgccaaacccatgctgtttgtaggatgctataaaacttcctaagctaatattttagaactgtttcttctaatttatgcagtggacaggggttccccttgctcactgtctctcttttcctccaaggtcatggatggaaatgtcataactgcaaagagaacagctgcagtttctgccattgccaccaaggtaagatgaatggctggctgtaccattaaggtgagctgtcaagtggggtctggtgtctcaatcttgagagactaaaggagaagtggggaacttattttggtttcctgttggacatagctggaactccagatgtcagatatatcagtaattcacgaaattattagctaccaattagtgtgcatgaccagatttcaagtaccttatgtgcataattctcaatcttcccatcagtcttgaagaatcgaaatgagaaattctctccaccttccaggtcaaggaatatggctcagagagcttctgtgaattgcccaggatcacacagctaataagtgctagagtaagaatttaatacttgacctctctggcttccaggactggcttcttgtccctgtaccacattgcccctggtaagacagtataattgtcccatagaccaaagctagtactacacaagaggctgagtgaactgaacatatccaagccagatccctgtattcattcgacaagtattgactgggcttctatcatgtgtcaggcactgttctaaatgttagggaaatggcagtgagaaaaacagaggggcacacacaggggaggtagacaataccaataaaaaggaaaacacaggctgggtacagtggctcacgcctgtaatcccaacattttgggaggctgaggcaggcgtatcacttgagctcaggagttggagaccagcctggtcaacatggtgaaacctcgtctcttgtaaaaacacaaaaattagctggtcgtggtggtgggcgcctataatctcagctacccgggagagtgaggcaggagaaacgtttgaactcaggaggcagaggttgcaatgagcccagatcgagccactgcactctagcctgggcaaaagagtgagtgtcttaaaaaacaaaacaaaaaggaaacaaaacaaaacaaacaaaaacatctgttgagtttaataatgtgttaaatagtaataaataatatgtaattaaataattagtacatattaataaatgattaatagcgtgcttagaatttgctaaaaaataaaaccaacaataatccaaaaagccacataacatgttaggtgaagataaagcagaagtgagagtattggagaagctgtcacattttacattatccaagaaaggcctccctgagaaggtgacatttgagtcaaagctgaaagcagtgagttagcgaaccatgcaaaaacacggaggggcactccaggcagagggaacagtaagcaatgggggtgatgatgttcccaagcaatgtcaaggcatcctataagaaaaacagcatttttaaaagttagagttaagaggatgaggcttaggaaacagggtgtctgtgggaacgattggagtctggagtctttcacattaaatgtggaagtacaaggtcttgggacactggttttcctaagttattataaaggaaacgtggtaacccagggaaagttgcagcagcaaagaccaggtgttcaggttgcatgtcgaggttttctagatacctgctggggagggaagaatgggaggattaatctggtaattgtatgcgaagggagtagaccaacagcacccacctcaatgaactggtttttagttatatccagacctgactcaactgaagtaatcaaggactccttgctatgtttgctggtaatttgggaacagaatgaatcttgtattactgtcatttgcaaagagctttagtctttttcaaactcatttccagccccttgtctggactacgagtttctgtgaggaaggcagagaaagtattaatggcctcattttacgcataaaagaatagaaacttgggtttcctgaagtcatacaaccaggttcctgcgggtccttttgaggccacatggtcttgtcccagataagaagtttccaacagaagcaagctatgcagcagcattagctagggaagtttttaaaaactcaaattcccatgcctactgaatcaaaatcacagagtgaggatcaaccaggtctggaaaccacacttttgtagacccagcctgcaataacactgctttgttgcattaataaaaatctgtgctcccagaagaatcaagaagccttgggttgacacttcaaagtttagacacttcaaagtttaggctgaaacttcacagctttatttccaggggctcagatgaactgtttcaataaggaacaaagggtctattttacttgttgccttgagagtagaatattttcttgtccatcatttctcttctatttagggctcttgttggggagaataagtatacggagctctagggtctgatgaacataatacattttttgtgcttgggtctcacataagcttcattgaagcctctgatatgttttctcaaggtgatagtatatattagggtttagcactaacatacatttattcaacaaatatttgagtgtccaccaaatgcaaggttctgcgctcagcatggggtaagcaaaaccagatacagtacttgccctcatgtagtacagggtccagtgggggaggcaagatatagtccaaagatcacatcaataggctgggcgcagtggctcacgcctgcaatcccagcactttgggaggctgaggcaggcagattacctgaggtcaggagttcaagaccagcctgaccaacatggaaaaaccccatctgtactaaaaaaaaaaaaaaaaaaaaaaaaaaaaaaattagctgggcatggtggcaggtgcctgtaatcccagctacttgggaggctgaggcaagggaattgcttgaatcctggaggcggaggttacagtgagccaagatcacaccactgcactccagcctggacaacgagtgagactcagtctccaaaaaaaaaaaaaaaattcacaccaataaatatgaaactacaacgctgacaagtgctgtaagagtgtaaagcagtatgtcttgatctagcctgtggctgtgtctctgtaggggatatttgagctgagattgaaggataatcagttacttgtgagggggagaggggacaaagcagcctagcatcgtatggcaaggaattaattcatgcaaaggccctgtggttgaaggaagtacatgagcttgggaagctgcaaggaagccagtatggctggaagacaggaagtgcaggggaacatggcatggtggtatgagagacagctttagagataggagggccagaccatgcaaggccttggcaaatgcaaatgaaacagactttcagactctttaaatgagaaacccagcagattcatatacgtgtacttaataacctgcatgcttaggagaaaagattgaagtgccactaatgctgtttaataaatcttataaacatatgattaaaaatcggctgggtgcagtggcttacacctgtaatcccagcacttttggaggccgaggcaggtggatcacttgaggtcaggagttcgagaccagcctggccaacatggcgaaaccccatctttaccaaaaaaaaaaaaaaaaattagccaagtatggtggcacatacctgtaatcccagctactcgggaggctgaggcatgagaatcgcttgaacccaggaagcagaggttgcagtgagctgagatcacaccgctgcattccagcctgggcgacaaagcgagactgtctcggaaaaaaaaaaaaattttaaaaatatcaattatcacactattaccagggcaacaaattatcaagtaagacaaccaattagaattacacatttagtttaggaagttgaaggttatttttatgggatactgtaacaatttctgaagctcacctgtactttcaagaatagattcatattaactgagaacagaagaaaatggtaacaattaaggaaaaaaatctaattatccttatcagacagcaacataagatttctagtcttgtggatattatcattttgaaaccttttcaaatcagagacgttaaactatattttatggcacagaatggtatctctccttcggtagctgcaggagataaaattaattcctaatatttcagagatgctgttttgctagtaattagtagttaagaagacttttcactttttaaatattatactccaaaattccagtgagtagcattttataaaagaacagaccacagggaactcaaagtttactaaatggaatagagaaaaggcagaagagggttttatttaatacatatggtgtcgagggccaagtgatgtctttcctctatgccagtggttctccactgagcatgagtttgccacctgctccagagacatttaggagtgtgcagacgtttttagttcccacaacttgaaggggtggaaaatgctactaacatctaatggatagaaaccagagatactgttgcacatcctataatacacaggttggtgcccctccccaataaagaattgtccagcccaaatgttagtagtaccgaggttgagaagcccagtgctacctcttgtaggtcatagtaggtatgtaccagttctgtgcaaataagactacctctgtcctcatggggcttaaagacctgtagaagaaaatctacaaacaaataagtgctatggcctggtgcattctatcaaggaggtcagaaaggcttcattggagaggtggcactggacgtgagttgatcacagaatcctgctctcaaacacagacaccctcaggagatgccacaaatgctaattctacattcgtctttagaggaagacagaggcagtgaaaagatcaacagagttggcccagtgaatatagctagaaccctgggaaggaagggctcacagaatccaggcagctcttagaagcagctcagagctctgagaagtgggtatggctgagcatgtacctgagatatgaagaaaggacatgggctttggagtatggaagacgtgactttagagccacactgtgcccttcaatagttgtaagacctggctaggtgcggtggctcacgtctgtaatcccagtactttgggaggccgaggtgcacagatcacctgaggtcaggagtttgagaccagcctggccaacatggtgaaaccccatctctatcgaaaatacaaaaattagctgggtgttgtggcgcacacctataatcccagctccacggggggctgaggtaggataatcactggaacccaggaggcagaggttgcaatgagccaagatcgtgccactgcactccagcctaggcgacagagcgagactccatctcaaaaaaaaagaaaagaaagaaagaaagaaaaagaaataaataaataattttaaaaagtagttgtaagacccagagcaagttcacctttctgttaccagggcaacctcagtctcttcatctgtaagaagaagatagtaggagtccccaactcgtagggtcaatgtctagactaaatgagatcatgggggcaaagcattggcatacattagctgttcagtgaagccttcttccttcttttcccacttgatacgggggaaactagacacaaaaggaaattctcttgattgcctgcaagctcttgagggaggcagaagagagggcagaagtcacctgatactcaaaccatcttagttttttacccgtctgctagggtctcccttgacctttgccacttcatttctctcatatagtttctgaaacctcccagcagtgaagtgctgtgcatccttggggctggggtccaggcctacagccattatgagatcttcacagagcagttctcctttaaggaggtaagtccaggggtgggggtgggagagaagagggaagggggtggtccttgacctgtctatactgcttcactgcaccacaggttattctgaaataattaagttgtgagccccatctagaccattcttgtatcttcatgacttcccagaagccctgatggaggggatggaggataagagtcaggggaagatctgattacctgtttccagtcctcagttcagagggcatttgtctgaggatacagcaagcttactcggttaaaagattctattatatctcttgtatacattcagttgtccttttagctcctgtctattatgtttttcttaggagaatccagagtttttaagtattcaaggttatggatcaagaaactgggtgggatgagacctggagaccaggaggccacagcctctctcttttgcagtctccatactggtccaccttccccccactgcgtctcatgcttccccctgggaatttttgatgctattgttattttatgtgtgtgtatgaaagggatggagcagttttaaagtatgatttaatgatgaaaataaaaccactgccttgagaaatatagactattaggtgagtgcaaaagtaattgcagttttggccatgacttttttttttttttttttttttgaaatggagtctcgcgctgtcgcccaggctggagtgcagtggcataatctcggctcactgcaacctccatctcctgggttcaagtgattcttgggcctcagcctcccaagtagcttggattataggcgcccactaccacacctggctaatttttgtatttttagtagagatggggtttcaccatgttggccaggctagtctggaacttctgacctcaggtgatccacctgccttgtcctcccaaagttctgggattacaggcgtgaaccactgcgcccagttgccattacttttaatacaaggaagaaaacaaaagaaaaatgccctttcatctgttttcaaagacagttaatgttttctgatcttccctcttcagctttttataacatagctttagtcacgttagatatgcaccattttatatcctctcttactgaatgttctaacatcacttttcaggttatctaatttttgcataaaatttgcatagtcttctatcaagaagggtgaagaggttaaccatgcacttccggccgggcaaaatgtcctgtttttcaccttgcttggtgaacttgcttagacataaagtttgtttccgtatgtattatatttccttatgagaaattctgtaggccttattttcagttgacgggtgacaagcccttgacccaaacattgaaacctgtcaagcaagtcggcaagtccccagctcctggtgaggccgctgccccaccctccaaccccagcacctttcaggattccagccgtagctaccattcttggccttttcattggctatgccatttaccttcaaactcgtctgatcttgaatttcctaagtattcttcaccgatcaagttattccatgaaaaacattatcataaataatccttcatatgaatctcccacccattacaactcctttacggggtctcagacataaagtgtgagttccacacagactttgccagttatatttccattttacagatgtggaaactaaggctgaatgacatgaagcaatttcaggaaatagcagagtggagattggttccaagcctacctggctccagaacttgctctgctaatcattatgctattaatatataatagctatgaagttactgaggctgtgcctcttggcctagaagtgaaatacttccactcattttaaaaggggaaagtggtagagaacgctgattttcaaatacctggctaggtgtctaagttaatgctgtacccctgatcaaatgtccattctccatggggaatgatttaggagtgatttagataaccactgacccctatgccagagtagttcaactttccctccgcatccctgggctcagtgtaacataagcagccaaaaaatggcgccaatatccttcttgttactcccaatgaaggtgaggatatggaaccgcaccaaagaaaatgcagagaagtttgcagacacagtgcaaggagaggtacgggtctgttcttcggtccaggaggctgtggcaggtgcagatgtgatcatcacagtcaccctggcaacagagcccattttgtttggtgaatgggtgaagccaggggctcacatcaatggtaagtagagtggctccataaggcatgatgggtggtggccaggctcctctctagacgggaccagtcgactacatttgcagagccagtttattcatgcagaatgcccaagctatttaagggccttgaaaacatgtgagattgaaaaaaacaatatttggctgggtgcagtggctcatgcctgtaatcccagcactttgggagactgaggcaggtggattgcttgaggccaggagtttaagactaacctggtcaacatggcaaaaccccgtctctactaaaaatacaaaagttagccaggcatggtggcttgcacctgtagtcccagctactcatgaggctgaggcatgagaatggcttgaacccaggaggcagaggttgcagtgagccaagattgtgccactgcactttagcctgggcaacagagagagactctgtcttaaaaaacaaacaaacaatatttgctccaagaaatgtaaaagggaaattacaaacctgaaactaaagaatatttaatgttctataaaatgtaagttttttttctttttttgggacagggtctcactctgtcgctcaggctggagtgcagtggcgagatctcagctcactgcaacctctgcctcctgggttcaagcgattctcccacttcagcctcccgagtagctgggactacaggcatgtgccaccatgcccagctaattttttgtaatttttggtagagacaaggtttcaccatgttggccaggctggtctcgaactcctggcctcaagcactctacccacttcagcctcccaaagtgctgcgactgattacaagtatgagccactacgcctgaccataacatgtaaaattatggcaaatggtaattcacagctcaattctaaaatgtgatgaaatttaaatcagaaaggccaaatgagtcactttttcttaacactaagaattataaacctttaaatttcttttgtactgtaattttttatgtgacatgtatatgctttttaatatgtgtgataggatgaggggcaggagagggggctctagacatgagggtgcctggggcctctgtagaccttcagatggccctgggtgttatagcaagagctggtctacatctaatactactgcaggtgctgtcatgaattctttgtataattctttgtatattaaatgacattattctatgtataatgtcatttaatacttataaccaacttatgaggcaggaactattatcataaacattttatagggggatgaaccaaggcatggagaaattatataacttttccaaagtcacaagtttttgtttgtttgtttgtttgtttgtttgagatggagtctcactctgtcacccaggctggagtgcagtggcatgatctcagctcactgcaacctccacctcccatgttaagtgactctcctgcctcagcctgccgagtagctgagattacagacacacgccaccatgccagctaatttttttgtatttttagtagagatggggtttcaccacattgtccaggctggtctcgaactcctgacctcaaatgatccacccgcctcagcctcccaaagtgctgggattacaggcgtgagccactgtgccaagcccaaaatcagaggttcttgatggcagagctgggatttgaacggaggcactctatcctcagagtccaagctttaaatgatactcatgattgccttccaacaggaagactggattctggtgagcagagcaggcaaattttagaggatttaaagatggtcttggtgccctgtgttttagtgacaagcacatggtgtgaactcagaagctaagagctttgcacacgtgggcagatgagccggcgagagccaagtcaaatgatgacgcattcaatcatacatgctgactgaatctctaccgtgtgccaggcactattctagatgccagggatgccacaataaccaggcagtcaaggtcactggtttcatggtggttaatttcagtgaggagagatagacaacaaacaaacacatagaggaactagatcgttctggctaaagatgagaccggaaagaacaaggccctgggtgatagaggctggtggtggaggtggaaggtagaagcagagagaggtgttttcaatagggttatctgagaagctctctaagatgtgttttttgagctgtgacctgaatgaggaggaagagcagccatgccaagagctgaaggaaaggcattcagggtagagggcacagcagatgcaaaggccttgagtgtggaagcgaacatggcgtgtttgaggaatggatcaaagtaatttgaaagtctcaggctgcatgggactggtggtcagactgggtccagggaatgggtaagaggtaagtcagggctgagtttatggacaataagaccatttctggaaggacctgggaaatcaaaaggaaccagttcatggtgaaatgggtttccaaggctgcatcttcagaaagatggacttgatttttttttcagcttaaaacaacacattattatcatctcacagttcccgtggttcaggagactgggtgtgggtagctggatcctctgtgcaaagtctcacaaaaaagaaattgggcaacatccgggctgcaatctcatctcatgctcgggggtcctcttccaggctcccatggtgtggcaggattcagttccttacactggaggatggggggagcccctttccttggggccattctcagctcccagagatgacccaaatttcccaccatatggactctccatcctcacatccagccacagacaatctcccttatgttggatccctctctcacttggaatcattctccaggaagggctgacttgattttgagtcaaggcatctcttctgttttcctggcccagggacaaaattggtttatgtgttcacagaggcaacacatacatttaagaaaaatgtgtcacaagcgcagacaacagggaaataccaacaacagattttacttagtttacagctcagcggagggacaggcccagttccaccctgccccatgcctccctcctcctgcccccacaccctgtcaagcctgtctgcgaccctcactcatttagccccatcacaaccaagccagagccttgtttgagtcaggcttctctctctttactgcctggcccacctccatccgcctgagtgacctcacacaaccctttgagaactcgcccggctcataagcagtggttgtgcaggggaaatagtccagtgagaaggagtggcctgagaaacgggggttttgttcccaccagcttatgatttatttacaagcttccttaagctagtgcttttgttctatagaactctccgcacaaacaaccttcaagatggacatttttacacaactctctttggaaattagaatgagggagaacagaacgggagggaacaaagggagaaaacggggcggcagtggaagaaggcatataaatgctgtcttatatttgtataaggctttatagcagttttcaaagactagccagccaggggctggatccagccagcagatgtgtttggtttggaccatagagtaatctaaaactcaaggagtgacatatgcaaatagatttcctgtttctcttctaagaaaacaactggggcatatctggtaacagtggatctacattcacacgtggtaatgattagctggagctgaacaatgactgtccccttcggaagggcctgctggcttccccgcccctcagtctccaccacatctaatccagtccctctgaccagctttgttcattttcattacctccctggccttgcaggcatttggtggcagcctctgcattctcctgtgtcctggtgccagggggcgtgacaccttggattcatcattctggtcctggactccatagaggatgtgacagttcagggccaggacggagccagttttctttctgacgagacttctccatgaccctgacactgagtttttgttgttgttgttttttttcttttgtcatgagttaagagagaaccgggggtgaggagagggaaaggggcatagtggcaggcgtctgtggtcccaacagtttgggaggctgaggcgggaggatcacttgagctcaggagtttgaggctgtggtgagtttttgtttgtttgttttttgagatggagtctcactctgtcgcctggtttggagcacagtggcgcagtcttggctcgctgcaacctccaactcccaggttcaagagattctcctgcctcagcctcccaggtagctgggattacaggcgtgtgctaccatgcccagataatttttgtatttcagtagagacagggtttcaccatgttggccaggctggtcttgaactcctgacctcaagtgaaccacccacctcagccttccagagtgttaggattacaggcatgagccactgcacccagcctgtggtgagttctgattgcaccactacactccagcctgggcaacagagtgagaccctctctccaaaaagaaaaaaatagatattaaaagaactggttgagggtgaggaatgggaatgatggagatcaagaggagagtgaggtgtgaataagcaccaagtgatgtctctgtttcgggatttttgtgaggaaggtgttcctgttaagcagaagaggtgtgagcgcctaggtgctctctcagacctggattcacccatcagatccttaaccttggcaaacaccttcacttctttgagcctccattcgtgcatctgttaagtgagaaccagactttgaaatgtacttgcgagaaccataaatagtacgtgcaaaacatcccacagagagtagacaccctgtaaatgaatgctatgtcgtctcaaaatcttttagcaatgaggtgggatatagaatagaaaggcaaaatggtaggtagttttttttgtttgtttgtttgtttttttgagatggagcctcactctgttgcccaggctggagtgcagtggcatgatcttggctcactgcaacctccgcctcccaggtttaagcaattctcatgcctcagcctccagagtagcaaagactacaggtgtgagccaccacgcctggataattttttgtatttttagtagacacagggtttcaccatgttggccaggctagtctcaaactcctggcttcaagtgatctgcctgcctcagcctcccaaagtgctgggattacaggtgtgagccaccacacctggcctatttcttaataagtatttcgtcctactgattgggagagcatggcctggggaatgagggggtattttgaatctgagtgtgttcacgagtcctttgttcacctctctcctgtgctttgggcttcttagcagcctttggcactaatcctgggcttaaggtctgttttgctgtctcttagctgttggagccagcagacctgactggagagaactggatgatgagctcatgaaagaagctgtgctgtacgtggattcccaggaggctgccctgaaggagtctggagatgtcctgctgtcaggggtgaggcccttctgaccccagtcagggctgccacctggctggcctcacctggatcccagggtttcattaacttcccttccagtttggtctgctccagacctcagccaccccacctccttgtaggggaaggagctcctaaacattttgcaaccctctttaattccattccagaaaaatatgggcattatgggtggtgacatgtgtgttcctggaaggagaagctcagtggattttatttttttgctgggctgtcctctaaagaagtgggattggaagcttcttgcagcctggaaaccttcccaatgtggccaacatgataagactgtgttgcccaccttctggcctcattttacggttataatcagcataaaacaagaagggagctgctggcatgcatgttcagataacagcatgtctatttcctcactgacacaatgatcttggcaggacagctccctgagcaccaactcgaatctctgtgtttatggtatcacaaaagcaaatgccaccccaaaaggatttcggggccagcctcctccctaatatcattcagtgtacaaaggatctctctctttttttttttttttttaatcaaatttatctcttatccaattcaggaattccctgggctggcttcaaaagccaaccctgcacagactttagcttcatgcctgggtcagcgtatgtttgtttcctaggccgagatctttgctgagctgggagaagtgattaagggagtgaaaccagcccactgtgagaagaccaccgtgttcaagtctttgggtaagatccattgctccctgggcacaaatccaactagcgcacaaggcaggttcacccattggtggaaagagcaatgagtcaccagactctgcagctgaatcattgtgctccatcattcaggtcaattatttacatggtttagcctagtgctaagcccatgaactctggaactgagcagtcctgggtcagagtcccttccccgccactcaaaggcaggtgtccttaggcaagtgatctgacctctgtaggcctcagtttcctcaccacctgttaccattgaggattaggtgggatttgcatataaaatgaatcagttcggtgcagatcttgatgaaattcagaaggtacccttcagaggtggagggggcaggggacaaagatgttaaaagacaggaaccttaagggaaatggcagagacccaacctgaaagagtcagatggaaagtatagcctaagccctgttcattccctccttccctactctcccacttgctgctttgaggagggcttccatggggagccccctaccacctgagttgtatggggtaccttatagaagcccaacaaagggtgggctcccagtggccagtctgtcccttgccccaggtcctcttccaccctatgagattgaaggaaacagaagtacatgggaacaggctgagctcggtggctcacgcctgtaatcccaacactttgggaggccaaggtgggcagatcacttgagctaaggagtttgagaccagcctggccaacatggtgaaactccatctctactaaaaatacaaaaattagccaggcgtggtggtgcacatctgcaatcccagctacttgggaggttgaggcaggagaatcacttgaacccggaaggtggaggttgtagtgagctgacatcgtgcactccagcctgggcaacagagcaagactccatctcaaaaaataaataaataaagtacatgggaacagagctgatacacctaaaacactgaaatactcccaaactggttggtaaacagttgctatcctgagcccctcgagagtgccctctgtccccctctcatgaccttccatacttcgtgatcaagcagcaaaagagtaaatgcctggcagagcatcaggagcgctctggccacccagagcccatgccattggttaagtatccatgccttgcaggttggtaaatgtctttaaaatctctcatgcactggaagacaaaggcaatacaattttatctggagcctggttcaaagacatcacatggatccagttttgtctgaaaacttcaaaggtcatggcagatcagaggtcagccagcccttacttaaggagccaaaatgctgcagaaacttgttctgtcctttttggcaatttttgctttcttacttttggggatcagtttattggtgcattgtttcatctaacagatgcgtatcaagcacctaattatctgtgctgggtgcagaggttaaggtatctaccaaaattacaagacaaaggggagatatcaaaggatgcagcattcaaactggaccaagcgtcagaaaactacagtcctggggccagacctgctctgctgcctgcttttgtgtggcctatgagctagaaatggtttttagattttcaaatgaatggggggagaaaatatttcatgatgtctgaaaatgatacaaaattcaagcttcagtcccatcaataatttcactggaacacagcccacagccaggctcttttgtttacctgttggctgtgttttctactctaaaggcagagttgaataattgtaatagagaccctgtggcccacaaagcctaaaggatttactgtctgaccctttttgaaaagtttgttcaggccaggcgtggtggctcatgcctgtaagcccagcactttgggaggccgaggtgggcggatcgcctgaggtcaggagtttgaaactagcctggtcaacatggtgaaaccctgtctctactaaaaatacaaaaaaaaaaaaaattagccaggcatggtggcatgcacctgtaatcccagctactcaggaggctgaggcaggagaatcacttgatcctgggaggcagagtttgcagtgagccaaaatcgcgccactgcacttcagcctgggcaacagagcgagactccatctcgaaaaaaaaaaaaattaaaaaaaaaaatttgctcagccctgagctagatttagaaagatgcacaatttgttggtgggtgtttcttactatcatattctctgcccctttgcagacaattgaagcctgagctcatctctgggtatcagtccctgttattccaataggcattggcaacatggacatgtatcaggaaacttccagccatggggcctgggttgtttcaagaaaagttgttttgaccaaaggcgaaccaaatttctgtctattctaggaatggcagtggaagacacagttgcagccaaactcatctatgattcctggtcatctggtaaataaaacaaaggaacttgatgttgagatggatgcttgaggaatattgctgctggttctcataatttctagagtaaatgagggagtccagtccccagtgaactctccttttgtgcttatcatgttttaccttaaatgctgagatcctcatttatgtttgtagttggaaagcaaagctaggtagccatttcttctgttctaccaagttataatagcattcatttccctttatatttccctgaaataaagcacattccaattgtgc
